US008097712B2

(12) United States Patent
Paldi et al.

(10) Patent No.: US 8,097,712 B2
(45) Date of Patent: Jan. 17, 2012

(54) COMPOSITIONS FOR CONFERRING TOLERANCE TO VIRAL DISEASE IN SOCIAL INSECTS, AND THE USE THEREOF

(75) Inventors: Nitzan Paldi, Moshav Bar Giora Doar-Na HaEla (IL); Gal Yarden, Doar-Na Negev (IL)

(73) Assignee: Beelogics Inc., Miami, FL (US)

( * ) Notice: Subject to any disclaimer, the term of this patent is extended or adjusted under 35 U.S.C. 154(b) by 118 days.

(21) Appl. No.: 12/222,949

(22) Filed: Aug. 20, 2008

(65) Prior Publication Data
US 2009/0118214 A1  May 7, 2009

Related U.S. Application Data

(60) Provisional application No. 60/996,244, filed on Nov. 7, 2007.

(51) Int. Cl.
*C12N 15/11* (2006.01)
*C12N 15/113* (2006.01)
*C07H 21/02* (2006.01)

(52) U.S. Cl. .................... 536/23.1; 536/24.1; 514/44

(58) Field of Classification Search ............... 536/23.1, 536/24.1; 514/44
See application file for complete search history.

(56) References Cited

U.S. PATENT DOCUMENTS

| | | | |
|---|---|---|---|
| 4,732,250 A | 3/1988 | Maucher et al. | |
| 5,898,031 A | 4/1999 | Crooke | |
| 6,107,094 A | 8/2000 | Crooke | |
| 6,506,559 B1 | 1/2003 | Driver et al. | |
| 7,056,704 B2 | 6/2006 | Tuschl et al. | |
| 7,078,196 B2 | 7/2006 | Tuschl et al. | |
| 2002/0086356 A1 | 7/2002 | Tuschl et al. | |
| 2003/0092651 A1 | 5/2003 | Norris et al. | |
| 2003/0180945 A1 | 9/2003 | Wang et al. | |
| 2004/0259247 A1 | 12/2004 | Tuschl et al. | |
| 2005/0080032 A1 | 4/2005 | Gross et al. | |
| 2005/0095199 A1* | 5/2005 | Whyard et al. | ............... 424/9.2 |
| 2007/0011448 A1 | 1/2007 | Chhabra et al. | |
| 2007/0219151 A1 | 9/2007 | Satishchandran et al. | |
| 2008/0194512 A1 | 8/2008 | John et al. | |
| 2008/0261303 A1 | 10/2008 | Kreutzer et al. | |

FOREIGN PATENT DOCUMENTS

| | | |
|---|---|---|
| CN | 101139607 | 3/2008 |
| EP | 1416049 | 5/2004 |
| WO | WO 00/04176 | 1/2000 |
| WO | WO 2009/060429 | 5/2009 |

OTHER PUBLICATIONS

Amdam et al, J. Theor. Biol. 223:451-464, 2003.*
U.S. National Bee Colony Loss Survey (Bee Alert Technology, Inc.; Mar. 26, 2007; web.archive.org/web/20070429223747/http://beealert.blackfoot.net/~beealert/index.php.*
Cox-Foster et al. "A Metagenomic Survey of Microbes in Honey Bee Colony Collapse Disorder", Science, XP002533680, 318(5848): 283-287, Oct. 2007. Database EMBL [Online], Retrieved From EBI, Database Accession No. EU 122366, Nov. 15, 2007.
Maori et al. "Isolation and Characterization of Israeli Acute Paralysis Virus, A Dicistrovirus Affecting Honeybees in Israel: Evidence for Diversity Due to Intra- and Inter-Species Recombination", Journal of General Virology, XP002533679, 88(Part 12): 3428-3438, Dec. 2007. Database EMBL [Online], Retrieved From EBI, Database Accession No. EF219380, Nov. 21, 2007.
Palacios et al. "Genetic analysis of Israel Acute Paralysis Virus: Distinct Clusters Are Circulating in the United States", Journal of Virology, XP002533681, 82(13): 6209-6217, Jul. 2008. Database EMBL [Online], Retrieved From EBI, Database Accession No. EU436456, Jun. 19, 2008.
Ananthaswamy "Can the ISPs Bear the Peer-to-Peer Explosion?", NewScientist, 2 P., Oct. 13, 2007.
Radware "Content Inspection Director. High Speed Content Inspection", Radware Inc., P.1-8, Sep. 18, 2002.
Radware "Radware Content Inspection Director (CID)—Symantec AntiVirus™ Gateway Solution", Radware Inc., www.radware.com, P.1-4, Dec. 6, 2002.
Wang et al. "Tracking Anonymous Peer-to-Peer VoIP Calls on the Internet", ACM, CCS'05, Alexandria, VA, USA, Nov. 7-11, 2005, 11 P., 2005.
Akiyoshi et al. "Genomic Survey of the Non-Cultivatable Opportunistic Human Pathogen, *Enterocytozoon bieneusi*", PLoS Pathogens, 5(1): e1000261: 1-10, Jan. 2009.
Burri et al. "Microsporidian Mitosomes Retain Elements of the General Mitochondrial Targeting System", Proc. Natl. Acad. Sci. USA, 103(43): 15916-15920, Oct. 24, 2006.
Chen et al. "High Throughput Genome-Wide Survey of Small RNAs From the Parasitic Protists *Giardia intestinalis* and *Trichomonas vaginalis*", Genome, Biology and Evolution, P.165-175, Jul. 6, 2009.
Cornman et al. "Genomic Analyses of the Microsporidian *Nosema ceranae*, An Emergent Pathogen of Honey Bees", PLoS Pathogens, 5(6): e1000466: Jun. 1-14, 2009.
Gill et al. "Stripped-Down DNA Repair in a High Reduced Parasite", BMC Molecular Biology, 8(24): 1-14, Mar. 20, 2007.
Katinka et al. "Genome Sequence and Gene Compaction of the Eukaryote Parasite *Encephalitozoon cuniculi*", Nature, 414(6862): 450-453, Nov. 22, 2001. Abstract.
Malhotra et al. "Double-Stranded RNA-Mediated Gene Silencing of Cysteine Proteases (Falcipain-1 and -2) of *Plasmodium falciparum*", Molecular Mcirobiology, 45(5): 1245-1254, 2002.
Mayack et al. "Energetic Stress in the Honeybee *Apis mellifera* From *Nosema ceranae* Infection", Journal of Invertebrate Pathology, 100(3): 185-188, Mar. 2009.
Nakayashiki et al "Evolution and Diversification of RNA Silencing Proteins in Fungi", Journal of Molecular Evolution, 63(1): 127-135, Jul. 2006.
Peyretaillade et al. "Microsporidian *Encephalitozoon cuniculi*, a Unicellular Eukaryote With an Unusual Chromosomal Dispersion of Ribosomal Genes and a LSU rRNA Reduced to the Universal Core", Nucleic Acids Research, 26(15): 3513-3520, 1998.
Price et al. "RNAi-Mediated Crop Protection Against Insects", Trends in Biotechnology, 26(7): 393-400, Jul. 2008.

(Continued)

*Primary Examiner* — Kevin K. Hill

(57) ABSTRACT

Compositions and methods for reducing susceptibility to infectious disease in bees using RNA interference technology, and more particularly, prevention and treatment of viral infections in honeybees such as Israel acute paralysis virus (IAPV) by feeding of pathogen-specific dsRNA. Further, multiple-pathogen specific dsRNA is disclosed.

23 Claims, 14 Drawing Sheets

OTHER PUBLICATIONS

Siomi et al. "On the Road to Reading the RNA-Interference Code", Nature, 457(7228): 396-404, Jan. 22, 2009. Abstract.
Slamovits et al. "Genome Compaction and Stability in Microsporidian Intracellular Parasites", Current Biology, 14(10): 891-896, May 25, 2004.
Taylor et al. "Validation of Spermidine Synthase as a Drug Target in African Trypanosomes", Biochemical Journal, 409(2): 563-569, Jan. 15, 2008.
Tsaousis et al. "A Novel Route for ATP Acquisition by the Remnant Mitochondria of *Encephalitozoon cuniculi*", Nature, 453(7194): May 22, 2008. Abstract.
Ullu et al. "RNA Interference in Protozoan Parasites", Cellular Microbiology, 6(6): 509-519, 2004.
VanEngelsdorp "Colony Collapse Disorder: A Descriptive Study", PLoS ONE, 4(8): e6481: 1-17, 2009.
Williams et al. "Genome Sequence Surveys of *Brachiola algerae* and *Edhazardia aedis* Reveal Micriosporidia With Low Gene Densities", BMC Genomics, 9(200): 1-9, Apr. 29, 2008.
Chen et al. "*Nosema ceranae* Is a Long-Present and Wide-Spread Microsporidian Infection of the European Honey Bee (*Apis mellifera*) in the United States", Journal of Invertebrate Pathology, XP022438643, 97(2): 186-188, Jan. 29, 2008.
Nunes et al. "A Non-Invasive Method for Silencing Gene Transcription in Honeybees Maintained Under Natural Conditions", Insect Biochemistry and Molecular Biology, XP002523702, 39(2): 157-160, Feb. 1, 2009.
Williams "Unique Physiology of Host-Parasite Interactions in Microsporidia Infections", Cellular Microbiology, XP002589428, 11(11): 1551-1560, Nov. 2009.
Carthew "Gene Silencing by Double-Stranded RNA", Current Opinion in Cell Biology, XP002263320, 13: 244-248, 2001.
Cox-Foster et al. "Saving the Honeybee. The Mysterious Ailment Called Colony Collapse Disorder Has Wiped Out Large Numbers of the Bees That Pollinate a Third of Our Crops", Scientific American, P.40-47, Apr. 2009.
Franco Nunes et al. "A Non-Invasive Method for Silencing Gene Transcription in Honeybees Maintained Under Natural Conditions", Insect Biochemistry and Molecular Biology, XP002523702, 39(2): 157-160, Feb. 2009.
Maori et al. "IAPV, A Bee-Affecting Virus Associated With Colony Collapse Disorder Can Be Silenced by DsRNA Ingestion", Insect Molecular Biology, XP002523701, 18(1): 55-60, Feb. 2009.
Maori et al. "Reciprocal Sequence Exchange Between Non-Retro Viruses and Hosts Leading to the Appearance of New Host Phenotypes", Virology, XP022065066, 362(2): 342-349, 2007.
Robalino et al. "Double-Stranded RNA and Antiviral Immunity in Marine Shrimp: Inducible Host Mechanisms and Evidence for the Evolution of Viral Counter-Responses", Developmental & Comparative Immunology, 31: 539-547, 2007.
International Search Report and the Written Opinion Dated Nov. 30, 2010 From the International Searching Authority Re. Application No. PCT/IB2010/053776.
Aronstein et al. "SID-I Is Implicated in Systemic Gene Silencing in the Honey Bee", Journal of Agricultural Research and Bee World, XP009115329, 45(1): 20-24, Jan. 2006.
Malone et al. "Effects of Transgene Products on Honey Bees (*Apis mellifera*) and Bumblebees (*Bombus* Sp.)", Apidologie, XP009141014, 32(4): 287-304, Jul. 2001. P.288, 1-h col., § 3-P.289, 1-h col., § 2.
Response Dated Jun. 15, 2011 to Communication Pursuant to Article 94(3) EPC of Feb. 17, 2011 From the European Patent Office Re. Application No. 08847971.2.
Computer Associates International "eTrust™ Content Inspection™. Malicious Code Protection", Computer Associates International Inc., 2 P., 2000.
Price et al. "RNAi-Mediated Crop Protection Against Insects", Trends in Biotechnology, XP022757296, 26(7): 393-400, Jul. 2008.
International Search Report and the Written Opinion Dated Feb. 24, 2011 From the International Searching Authority Re. Application No. PCT/IL2010/000844.
Campbell et al. "Gene-Knockdown in the Honey Bee Mite Varroa Destructor by a Non-Invasive Approach: Studies on a Glutathione S-Transferase", Parasites & Vectors, XP002621493, 3(73): 1-10, Aug. 16, 2010. Abstract.
Liu et al. "Effect of a Fluvalinate-Resistance-Associated Sodium Channel Mutation From Varroa Mites on Cockroach Sodium Channel Sensitivity to Fluvalinate, a Pyrethroid Insecticide", Insect Biochemistry and Molecular Biology, XP025014535, 36(11): 885-889, Nov. 1, 2006. Abstract.
Wang et al. "Molecular Characterization of an Arachnid Sodium Channel Gene From the Varroa Mite (*Varroa Destructor*)", Insect Biochemistry and Molecular Biology, XP002621492, 33(7): 733-739, Jul. 2003. Abstract.
Communication Pursuant to Article 94(3) EPC Dated Feb. 17, 2011 From the European Patent Office Re. Application No. 08847971.2.
International Preliminary Report on Patentability Dated Nov. 17, 2011 From the International Bureau of WIPO Re. Application No. PCT/IB2010/051980.

* cited by examiner

COMPOSITIONS FOR CONFERRING TOLERANCE TO VIRAL DISEASE IN SOCIAL INSECTS, AND THE USE THEREOF

RELATED APPLICATION

This application claims the benefit of priority from U.S. Provisional Patent Application No. 60/996,244, filed on Nov. 7, 2007, the contents of which are incorporated by reference as if fully set forth herein.

FIELD AND BACKGROUND OF THE INVENTION

The invention relates to compositions and methods for reducing susceptibility to infectious disease in bees using RNA interference technology, and more particularly, to the use of dsRNA for prevention and treatment of viral infections in honeybees.

Colony Collapse Disorder

The importance of honeybees and other pollinating insects to the global world economy far surpasses their contribution in terms of honey production. The United States Department of Agriculture (USDA) estimates that every third bite we consume in our diet is dependent on a honeybee to pollinate that food. The total contribution of pollination in terms of added value to fruit crops exceeds $15 billion per annum, with indirect potential consequence of $75 billion dollars.

Viral Diseases in Honeybees

The health and vigor of honeybee colonies are threatened by numerous parasites and pathogens, including viruses, bacteria, protozoa, and mites, each with characteristic modes of transmission.

In general, transmission of viruses can occur via two pathways: horizontal and vertical transmission. In horizontal transmission, viruses are transmitted among individuals of the same generation, while vertical transmission occurs from adults to their offspring. Transmission can occur through multiple routes in social organisms (for a detailed review see Chen Y P, et al (2006) Appl Environ Microbiol. 72(1):606-11). Recently, horizontal transmission of honeybee viruses has been documented in bee colonies, for example, transmission of deformed wing virus (DWV) and Kashmir Bee Virus (KBV) by the parasitic mite *Varroa destructor*, as well as some evidence of virus in honeybee eggs and young larvae, life stages not parasitized by *Varroa* mites. Vertical transmission of multiple viruses from mother queens to their offspring in honeybees has also been recently demonstrated, as well as viruses in feces of queens, suggesting a role for feeding in virus transmission. Moreover, honeybee viruses have been detected in tissues of the gut, suggesting that viruses could be ingested by queens from contaminated foods and passed into the digestive tract, which then acts as a major reservoir for viral replication. Indeed, viruses might penetrate the gut wall and move into the insect hemocoel, spreading infections to other tissues.

In honeybees viruses often persist as latent infections. Thus, group living activities such as trophylaxis and nurse bee brood feeding, can potentially drive high levels of horizontal transmission or amplification of existing infections.

Colony Collapse Disorder

Colony Collapse Disorder (CCD) of honeybees is threatening to annihilate U.S. and world agriculture. Indeed, in the recent outbreak of CCD in the U.S. in the winter of 2006-2007, an estimated 25% or more of the 2.4 million honeybee hives were lost because of CCD. An estimated 23% of beekeeping operations in the United States suffered from CCD over the winter of 2006-2007, affecting an average of 45% of the beekeepers operations. In the winter of 2007-2008, the CCD action group of the USDA-ARS estimated that a total of 36% of all hives from commercial operations were destroyed by CCD.

CCD is characterized by the rapid loss from a colony of its adult bee population, with dead adult bees usually found at a distance from the colony. At the final stages of collapse, a queen is attended only by a few newly emerged adult bees. Collapsed colonies often have considerable capped brood and food reserves. The phenomenon of CCD was first reported in 2006; however, beekeepers noted unique colony declines consistent with CCD as early as 2004. Various factors such as mites and infectious agents, weather patterns, electromagnetic (cellular antennas) radiation, pesticides, poor nutrition and stress have been postulated as causes. To date, control of CCD has focused on varroa mite control, sanitation and removal of affected hives, treating for opportunistic infections (such as *Nosema*) and improved nutrition. No effective preventative measures have been developed to date.

That CCD is due to the introduction of a previously unrecognized infectious agent is supported by preliminary evidence that CCD is transmissible through the reuse of equipment from CCD colonies and that such transmission can be broken by irradiation of the equipment before use.

Recently, Israeli acute paralysis virus of bees (IAPV, SEQ ID NO: 6), was strongly correlated with CCD. Indeed, Table 1 below shows that although other etiological agents of diseases in honeybees were found in CCD colonies, many were also found in apparently healthy, asymptomatic operations. In contrast, IAPV was not only found in 83% of CCD colonies, but was almost completely absent from apparently healthy colonies.

TABLE I

Analysis of bees tested for pathological candidates in CCD and non-CCD operations

| Agent | CCD (n = 30) | Non-CCD (n = 21) | Total (n = 51) | Positve predictive value (%) |
|---|---|---|---|---|
| IAPV | 25 (83.3%) | 1 (4.8%) | 26 (51.0%) | 96.1 |
| KBV | 30 (100%) | 16 (76.2%) | 46 (90.2%) | 65.2 |
| N. apis | 27 (90%) | 10 (47.6%) | 37 (72.5%) | 73.0 |
| N. ceranae | 30 (100%) | 17 (80.9%) | 47 (92.1%) | 63.8 |
| All four agents | 23 (76.7%) | 0 (0%) | 23 (45.0%) | 100 |

IAPV—Israel Acute Paralysis Virus;
KBV—Kashmir Bee Virus;
N. apis—Nosema apis;
N. ceranae—Nosema ceranae.
From: Diana L. Cox-Foster et al. (2007) A Metagenomic Survey of Microbes in Honey Bee Colony Collapse Disorder; Science 318: 283-286.

Moreover, it was recently shown that when injected or fed to the bees, IAPV causes paralysis and death in 98% of bees within days, further confirming IAPV as the infective agent in CCD.

Israeli acute paralysis virus (IAPV) has been characterized as a bee-affecting dicistrovirus. Recently, DNA versions of genomic segments of non-retro RNA viruses have been found in their respective host genomes, and the reciprocal exchange of genome sequences between host and virus has been demonstrated (Maori et al. Virology 2007; 362:342). These authors showed that the bees who harbored integrated viral sequences were found to be resistant to subsequent viral infection, and a RNAi mechanism of resistance was postulated. Most recently, as shown in Table 1 above, a metagenomic survey has indicated a close association between CCD and IAPV (Cox-Foster et al., Science, 2007; 318:283).

It thus follows that prevention of IAPV infection may prevent development of CCD, significantly improving the state of the beekeeping industry and world agriculture. The United States Department of Agriculture has developed an urgent action plan intended to cover all aspects of bee management to combat CCD and avoid future threats to honeybee management. They seek to maintain bees with resistance to parasites and pathogens and develop new methods of managing parasites and pathogens (see "CCD_actionplan" at the USDA website). However, no specific measures have been recommended, other than improving general sanitation, nutrition and combating opportunistic infections.

Methods for Silencing Using siRNAs/dsRNA

RNA interference (dsRNA and siRNA) has been shown effective in silencing gene expression in a broad variety of species, including plants, with wide ranging implications for cancer, inherited disease, infectious disease in plants and animals. It was also shown in a variety of organisms that dsRNA or their siRNA derivatives can be used to arrest, retard or even prevent a variety of pathogens, most notably viral diseases (see, for example, WO/2003/004649 to Tenllado et al).

It has been shown in some species that RNAi mediated interference spreads from the initial site of dsRNA delivery, producing interference phenotypes throughout the injected animal. Recently the same spreading effect of dsRNA has been demonstrated in bee larva, as well as detection of SID transmembrane channels considered responsible for endocytic uptake and spreading effect of dsRNA in humans, mouse and C. elegans (Aronstein et al, J. Apic Res and Bee World, 2006; 45:20-24).

Application of interference RNA technology for insects that are plant pests and other plant pests has been suggested. Moderate RNAi-type silencing of insect genes by feeding has been demonstrated (Turner et al., Insect Mol Biol 2006; 15:383; and Araujo et al., Insect Mol. Biol 2006; 36:683). dsRNA absorbance via honey has also been demonstrated (Aronstein et al., J Apiculture Res Bee World 2006; 45:20-24).

U.S. Pat. No. 6,326,193 refers to the use of recombinant insect viruses such as baculoviruses expressing dsRNA to silence selected insect genes for pest control. PCT application WO 99/32619 describes generally that dsRNA may be used to reduce crop destruction by other plant pathogens or pests such as arachnids, insects, nematodes, protozoans, bacteria, or fungi. PCT patent application WO 2004/005485 describes the use of vectors comprising sequences designed to control plant-parasitic nematodes by RNA interference, and transgenic plants transformed with such vectors. US patent application 20030180945 generally describes chimeric genes capable of producing antisense or sense RNA equipped with a prokaryotic promoter suitable for expression of the antisense or sense RNA in a particular prokaryotic host.

US Patent Application 20030154508 describes a method for pest control comprising exposing said pest to a compound (dsRNA) which disrupts, within said pest, a cation-amino acid transporter/channel protein.

PCT patent application WO 02/14472 describes methods for inhibiting target gene expression in a sucking insect, by expressing in a cell a nucleic acid construct comprising an inverted repeat and a sense or antisense region having substantial sequence identity to a target gene, wherein the inverted repeat is unrelated to the target gene. US patent application 20030150017 describes the use of RNA molecules homologous or complementary to a nucleotide sequence of a plant pest such as nematodes and insects.

Raemakers et al (PCT Applications WO 2007/080127 and WO 2007/080126) have disclosed transgenic plants expressing RNAi for controlling pest infestation by insects, nematodes, fungus and other plant pests. Among the sequences taught are sequences targeting essential genes of insects, including the honeybee. Waterhouse et al (US Patent Application 2006 0272049) also disclosed transgenic plants expressing dsRNA, and dsRNA directed to essential genes of plant insect pests, for use as insecticides, particularly against sap-sucking insects such as aphids. Boukharov et al. (US Patent Application 2007 0250947) disclosed constructs for expressing dsRNA in transgenic plants for targeting plant parasitic nematodes, specifically the soybean cyst nematode. While expression and processing of dsRNA were demonstrated, no actual inhibition of infestation with the dsRNA was shown.

SUMMARY OF THE INVENTION

According to some aspects of some embodiments, the present invention provides methods and compositions for preventing the spread of insect epidemics, such as Colony Collapse Disorder through the application of RNA interference technology directed to bee infectious organisms and agents, such as IAPV, Acute Bee Paralysis Virus and Kashmir Bee Paralysis Virus.

According to an aspect of some embodiments of the present invention there is provided an isolated nucleic acid agent comprising a nucleic acid sequence downregulating expression of a gene product of a bee pathogen.

According to another aspect of some embodiments of the present invention there is provided a nucleic acid agent comprising a nucleic acid sequence complementary to at least 21 nucleotides of a bee pathogen specific RNA and capable of inducing degradation of the bee pathogen specific RNA.

According to another aspect of some embodiments of the invention, there is provided a nucleic acid construct comprising a nucleic acid sequence encoding the isolated nucleic acid downregulating expression of a gene product of a bee pathogen.

According to some embodiments of the invention, the gene product is a mRNA encoding a polypeptide of the bee pathogen.

According to some embodiments of the invention, the agent is selected from the group consisting of a dsRNA, an hnRNA, an antisense RNA and a ribozyme.

According to some embodiments of the invention, the nucleic acid sequence is greater than 15 base pairs in length.

According to some embodiments of the invention, the nucleic acid sequence is greater than 30 base pairs in length.

According to some embodiments of the invention, the nucleic acid sequence is 19 to 25 base pairs in length.

According to some embodiments of the invention, the bee pathogen is selected from the group consisting of a virus, a bacteria, a parasitic protozoan, a fungus and a nematode.

According to some embodiments of the invention, the bee pathogen is a virus.

According to some embodiments of the invention, the virus is Israel Acute Paralysis Virus.

According to some embodiments of the invention, the virus is Kashmir Paralysis Virus.

According to some embodiments of the invention, the virus is Israel Acute Paralysis Virus and said polypeptide of said virus is selected from the group consisting of IAPV polymerase polyprotein (SEQ ID NO: 51) and IAPV structural polyprotein (SEQ ID NO: 52).

According to some embodiments of the invention, the viral pathogen is Israel Acute Paralysis Virus and said nucleic acid sequence is as set forth in SEQ ID NO: 6.

According to some embodiments of the invention, the viral pathogen is Israel Acute Paralysis Virus and said nucleic acid sequence is as set forth in SEQ ID NO: 33 and 34.

According to some embodiments of the invention, the virus is Israel Acute Paralysis Virus, and the nucleic acid sequence is a viral nucleic acid sequence detected in honeybee nucleic acid following Israel Acute Paralysis Virus infection.

According to another aspect of some embodiments of the present invention there is provided a bee-ingestible composition comprising the nucleic acid agent comprising a nucleic acid sequence downregulating expression of a gene product of a bee pathogen or a nucleic acid construct comprising the nucleic acid agent.

According to some embodiments of the invention the bee-ingestible composition is in solid form.

According to some embodiments of the invention, the composition is in liquid form.

According to some embodiments of the invention, the composition comprises protein.

According to some embodiments of the invention, the protein is in the form of pollen and/or soy patties.

According to some embodiments of the invention, the liquid is a sucrose solution.

According to some embodiments of the invention, the liquid is a corn syrup solution.

According to some embodiments of the invention the liquid further comprises a carbohydrate or sugar supplement.

According to an aspect of some embodiments of the present invention there is provided a method for increasing the tolerance of a bee to a disease caused by a pathogen comprising feeding the bee an effective amount of the nucleic acid agent comprising a nucleic acid sequence downregulating expression of a gene product of a bee pathogen or a nucleic acid construct comprising the nucleic acid agent, thereby increasing the tolerance of the bee to the pathogen.

According to a further aspect of some embodiments of the present invention there is provided a method for increasing the tolerance of a bee colony to a disease caused by a pathogen comprising feeding bees of the colony an effective amount of the nucleic acid agent comprising a nucleic acid sequence downregulating expression of a gene product of a bee pathogen or a nucleic acid construct comprising the nucleic acid agent, thereby increasing the tolerance of the colony to the pathogen.

According to some embodiments of the invention the bee is a honeybee.

According to some embodiments of the invention the honeybee is a forager.

According to some embodiments of the invention the honeybee is a hive bee.

According to some embodiments of the invention the disease is Colony Collapse Disorder.

According to some embodiments of the invention the bee pathogen is Israel Acute Paralysis Virus.

According to some embodiments of the invention the feeding comprises providing a liquid bee-ingestible composition.

According to some embodiments of the invention the feeding comprises providing a solid bee-ingestible composition.

According to an aspect of some embodiments of the present invention there is provided a method of increasing the tolerance of bees to Colony Collapse Disorder (CCD), the method comprising feeding to the honeybee hive an effective amount of double stranded ribonucleic nucleic acid (RNA), said double stranded RNA being homologous to a contiguous sequence of at least 21 nucleotides of Israel Acute Paralysis Virus.

Unless otherwise defined, all technical and/or scientific terms used herein have the same meaning as commonly understood by one of ordinary skill in the art to which the invention pertains. Although methods and materials similar or equivalent to those described herein can be used in the practice or testing of embodiments of the invention, exemplary methods and/or materials are described below. In case of conflict, the patent specification, including definitions, will control. In addition, the materials, methods, and examples are illustrative only and are not intended to be necessarily limiting.

BRIEF DESCRIPTION OF THE DRAWINGS

Some embodiments of the invention are herein described, by way of example only, with reference to the accompanying drawings. With specific reference now to the drawings in detail, it is stressed that the particulars shown are by way of example and for purposes of illustrative discussion of embodiments of the invention. In this regard, the description taken with the drawings makes apparent to those skilled in the art how embodiments of the invention may be practiced.

In the drawings:

Figure 1:
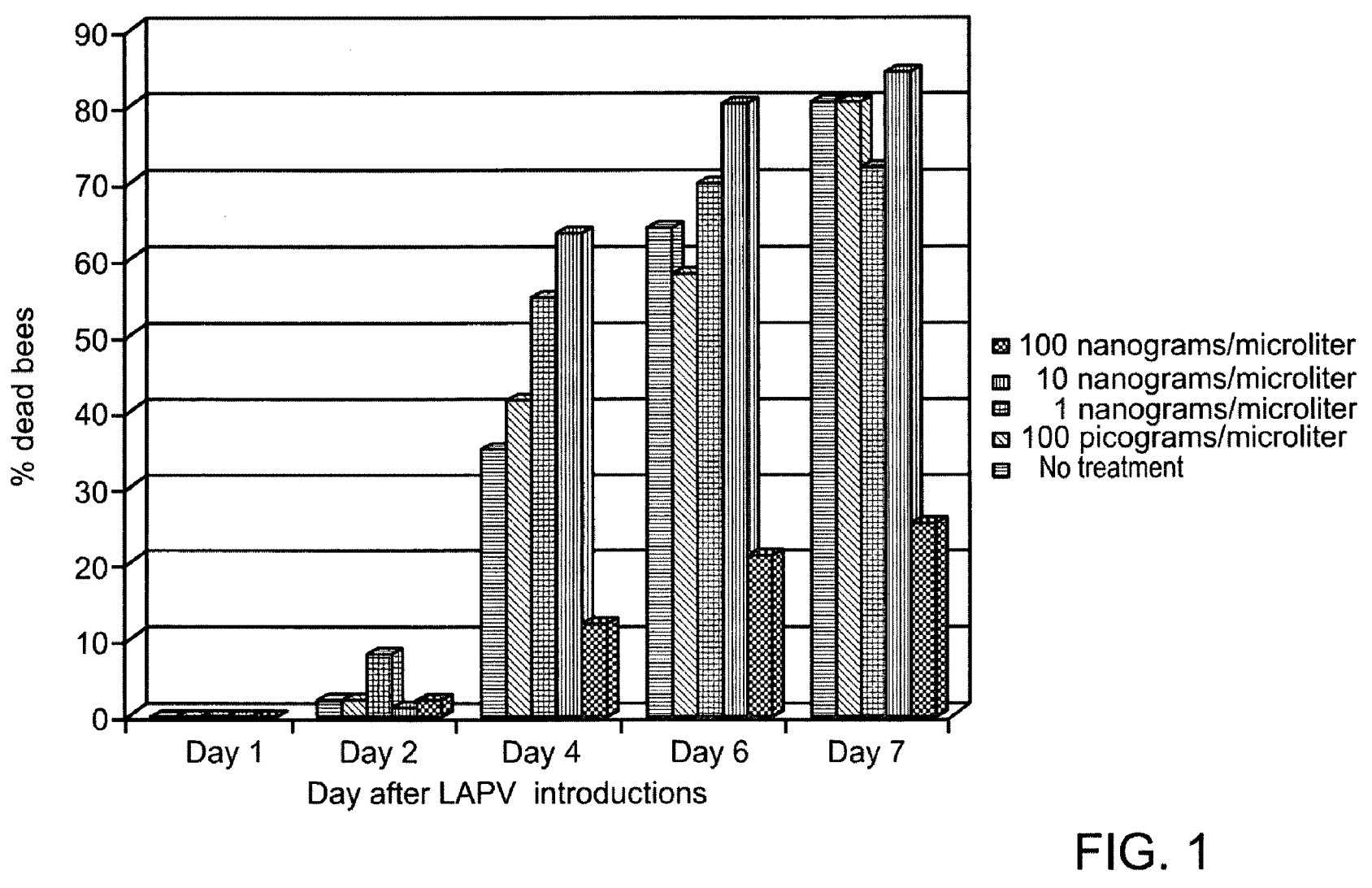

FIG. 1 is a histogram showing the effect of IAPV titer on bee mortality. 30 or 50 bees were exposed to increasing concentrations of IAPV in a 50% sucrose solution, in increasing doses (900 µl of 0.0001 to 0.1 microgram/microliter virus particles). Vertical striped bars—100 ng/µl; Cross-hatched bars—10 ng/µl; Stippled bars—1.0 ng/µl; Horizontal striped bars—0.1 ng/µl. Controls (checkered bars) received sucrose without added virus. Dead bees in the containers were counted daily, and the total number of dead bees was calculated as a percentage of the initial number of bees introduced into the container at indicated days;

FIGS. 2A and 2B show bees of hives exposed to dsRNA following feeding with IAPV-specific dsRNA (1 µg/bee/feeding), 3 days prior to (FIG. 2A) and 8 days following (FIG. 2B) IAPV exposure (0.01 µgram/µl in sucrose solution). FIGS. 2C and 2D show bees of hives exposed to dsRNA following feeding with non-specific dsRNA (1 µg/bee/feeding), 3 days prior to (FIG. 2C) and 8 days following (FIG. 2D) IAPV exposure (0.01 µgram/µl in sucrose solution). FIGS. 2E and 2F show bees of hives exposed only to IAPV infection, without feeding with IAPV-specific dsRNA (FIG. 2E) three days before and 8 days following (FIG. 2F) IAPV exposure (0.01 µgram/µl in sucrose solution). FIGS. 2B, 2D and 2F show the effects of exposure to IAPV, eight days following exposure to IAPV. "Q" indicates queens, and "CB" indicates capped brood. Note the superior survival of the bees exposed to the IAPV-specific dsRNA, as compared with the decline of the unprotected colonies:

FIG. 4A represent PCR products with IAPV-specific primers (SEQ ID NOs. 35 and 36). Arrow indicates migration of 180 bp IAPV product. FIG. 4B represents PCR products with actin-specific primers, as an internal positive control (SEQ ID Nos. 37 and 38). Arrow indicates migration of 500 bp actin product. FIG. 4C represents PCR performed without reverse transcriptase. Absence of products indicates the absence of DNA in the template. Total RNA was extracted (8 days following inoculation with IAPV) from bee samples as follows: Lanes 1 and 2—IAPV–dsRNA treatment followed by IAPV inoculation; Lane 3—GFP–dsRNA treatment followed by IAPV inoculation; Lane 4—no dsRNA followed by IAPV inoculation; Lane 5—no dsRNA, no virus inoculated; Lane 6—negative control without template RNA. Lane M is molecular weight markers;

FIG. 11A illustrates the presence of IAPV-specific siRNA at 7 days and the end of the experiment. Lanes 1-6, Day 7: Lane 1—positive control IAPV-specific siRNA; lane 2—blank negative control; lane 3—untreated control bees; lane 4—bees fed with IAPV-specific dsRNA but no virus challenge; lane 5—bees challenged with IAPV, no dsRNA; lane 6—IAPV-specific dsRNA plus IAPV infection. Lanes 7-10, end of Experiment (Day 42): Lane 7—untreated control bees; lane 8—bees fed with IAPV-specific dsRNA but no virus challenge; lane 9—bees challenged with IAPV, no dsRNA; lane 10—IAPV-specific dsRNA plus IAPV infection.

FIG. 11B illustrates the presence of IAPV-specific siRNA at the start (0 days) and the end of the experiment. Lanes 1-4, Day 0: Lane 1—untreated control bees; lane 2—bees fed with IAPV-specific dsRNA but no virus challenge; lane 3—bees challenged with IAPV, no dsRNA; lane 4—IAPV-specific dsRNA plus IAPV infection. Lane 5—blank control. Lanes 6-9, end of Experiment (Day 42): Lane 6—untreated control bees; lane 7—bees fed with IAPV-specific dsRNA but no virus challenge; lane 8—bees challenged with IAPV, no dsRNA; lane 9—IAPV-specific dsRNA plus IAPV infection. Arrow indicates 21 bp RNAi fragment. Note the amplification of IAPV-specific RNAi in treated bees exposed to IAPV infection for a period of time (FIG. 11A, lanes 6 and 10; FIG. 11B, lane 9);

DESCRIPTION OF EMBODIMENTS OF THE INVENTION

Figure 2A:
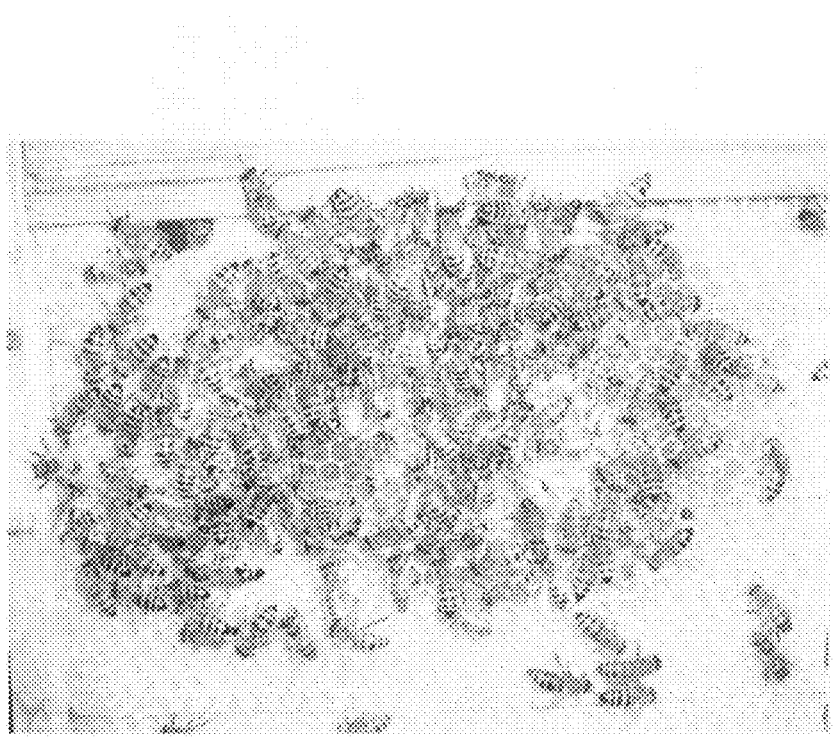
FIGS. 2A-2F are photographs showing the effect feeding IAPV-specific dsRNA on colonies exposed to IAPV infection.
Figure 2B:
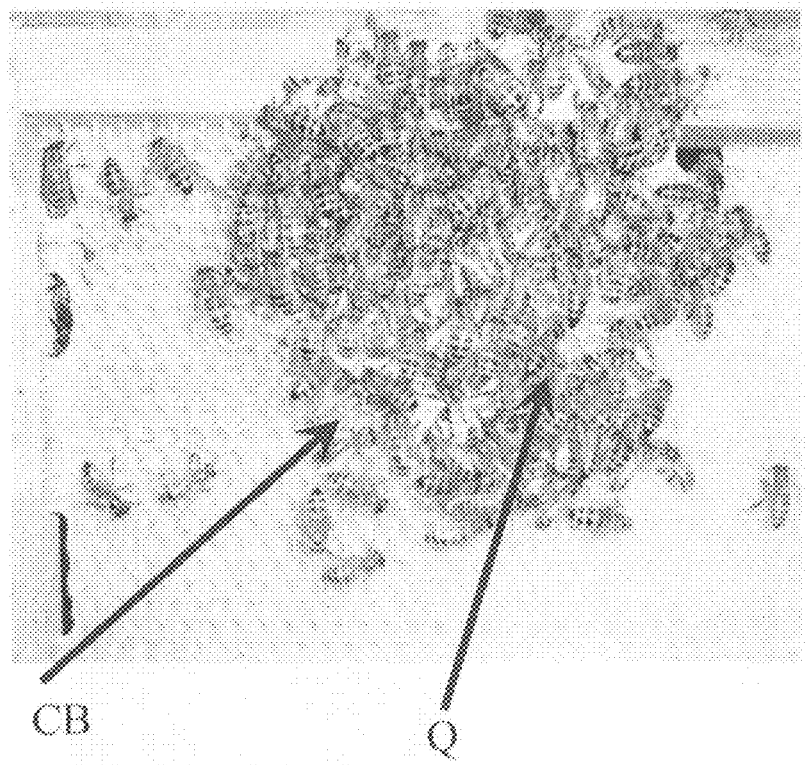
Figure 2C:
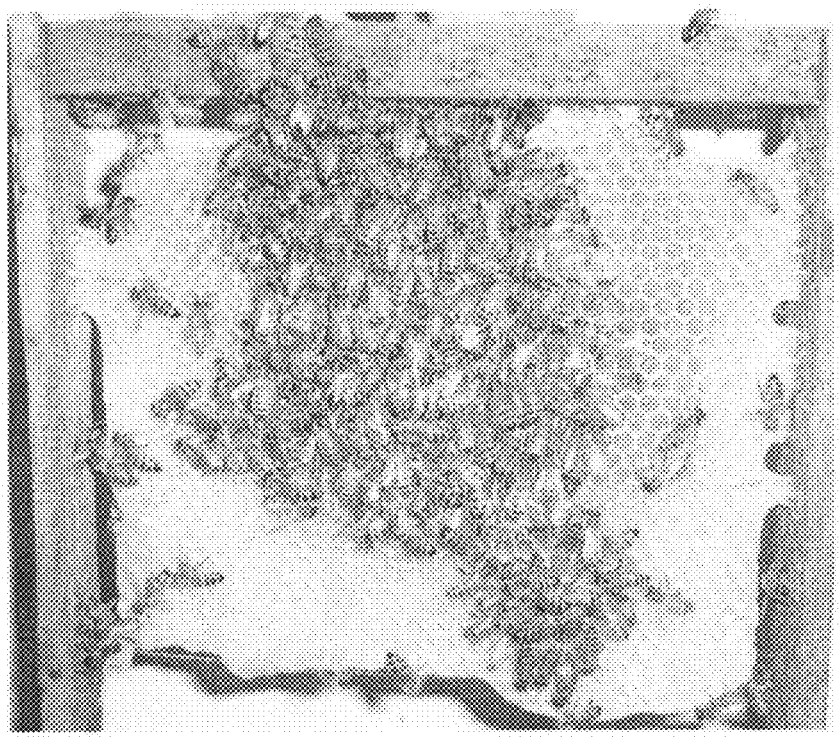
Figure 2D:
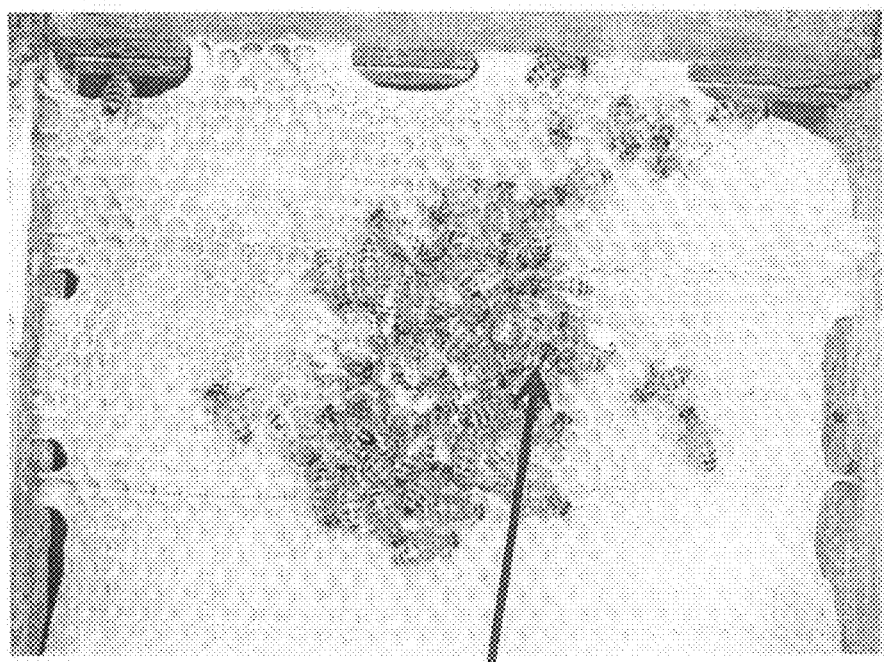
Figure 2E:
Figure 2F:
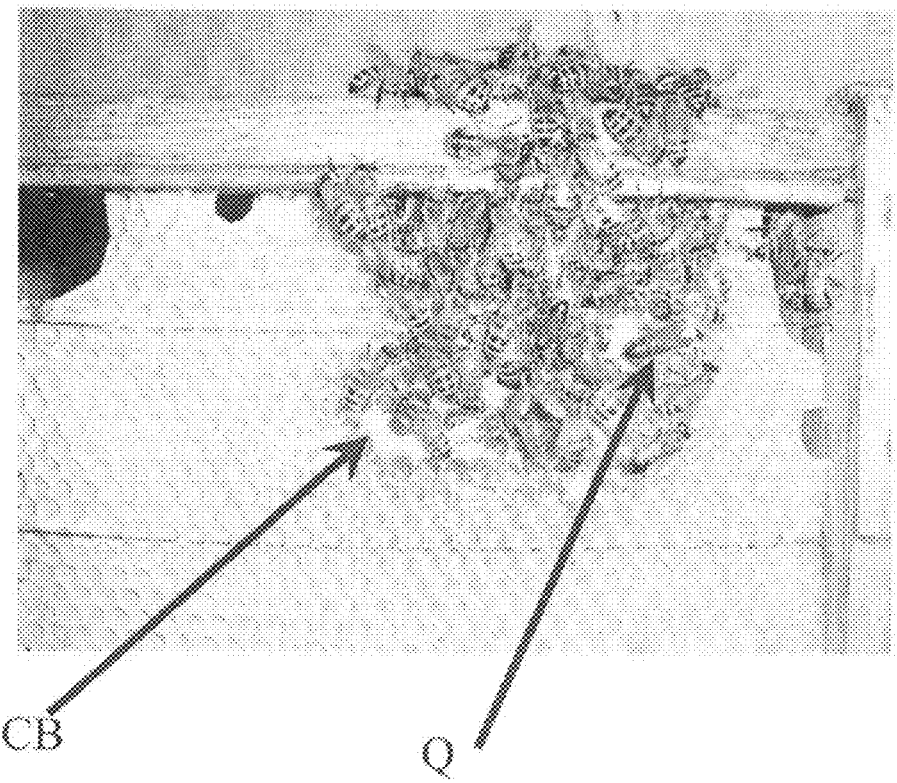

The present invention, in some embodiments thereof, relates to methods and compositions for reducing the susceptibility of bees to pathogenic organisms and, more particularly, but not exclusively, to methods for increasing the tolerance to viral diseases, such as Colony Collapse Disorder, by feeding viral-specific dsRNA.

Before explaining at least one embodiment of the invention in detail, it is to be understood that the invention is not necessarily limited in its application to the details set forth in the following description or exemplified by the Examples. The invention is capable of other embodiments or of being practiced or carried out in various ways.

While reducing the present invention to practice, the inventors have shown that ingestion by a bee of compositions containing one or more dsRNA molecules, wherein at least one segment of the dsRNA molecule corresponds to a substantially identical segment of RNA produced by a bee pathogen, will result in reduced incidence and severity of infection, and greatly enhanced survival of the bees and the colony overall. These results indicate that a polynucleotide molecule, either DNA or RNA, derived from a bee pathogen sequence can be used to design a nucleic acid agent or nucleic acid construct according to the methods of the present invention to produce one or more RNA sequences that can form into a dsRNA molecule available for ingestion by bees when provided by feeding. While reducing to practice, it was shown that bee colonies exposed to IAPV-specific dsRNA in their feed endured IAPV infection with greater survival (see FIG. 3) and lower incidence of infected bees than untreated colonies (see FIGS. 2E, 2F and 3, 4A-4C and 5). In colonies treated with a non-specific dsRNA mortality and incidence of infection was similar to that in untreated colonies (see FIGS. 2C, 2D, 3-5).

Thus, according to one embodiment of the present invention there is provided a method for increasing the tolerance of a bee to a disease caused by a pathogen comprising feeding the bee an effective amount of an isolated nucleic acid agent comprising a nucleic acid sequence downregulating expression of a polypeptide of a bee pathogen, or a nucleic acid construct comprising the nucleic acid sequence, thereby increasing the tolerance of the bee to the pathogen.

As used herein, the term "bee" is defined as any of several winged, hairy-bodied, usually stinging insects of the superfamily Apoidea in the order Hymenoptera, including both solitary and social species and characterized by sucking and chewing mouthparts for gathering nectar and pollen. Exemplary bee species include, but are not limited to *Apis, Bombus, Trigona, Osmia* and the like. In one embodiment, bees include, but are not limited to bumblebees (*Bombus terrestris*) and honeybees (*Apis mellifera*).

As used herein, the term "colony" is defined as a population of dozens to typically several tens of thousand honeybees that cooperate in nest building, food collection, and brood rearing. A colony normally has a single queen, the remainder of the bees being either "workers" (females) or "drones" (males). The social structure of the colony is maintained by the queen and workers and depends on an effective system of communication. Division of labor within the worker caste primarily depends on the age of the bee but varies with the needs of the colony. Reproduction and colony strength depend on the queen, the quantity of food stores, and the size of the worker force. Honeybees can also be subdivided into the categories of "hive bees", usually for the first part of a workers lifetime, during which the "hive bee" performs tasks within the hive, and "forager bee", during the latter part of the bee's lifetime, during which the "forager" locates and collects pollen and nectar from outside the hive, and brings the nectar or pollen into the hive for consumption and storage.

As used herein, the term "tolerance" is defined as the ability of a bee or bee colony to resist infestation by and/or proliferation of a pathogen, including, but not limited to, degree of infection, severity of symptoms, infectivity to other individuals (contagion), and the like. Tolerance can be assessed, for example, by monitoring infectivity, presence of symptoms or time course of a disease in a population following a challenge with the pathogen.

As used herein, the term "pathogen" is defined as a nucleic acid-containing agent capable of proliferation within the bee and/or bee colony, the pathogen causing disease in bees or bee colonies, especially, but not exclusively, a virus, a bacteria and a fungus. A bee or bee colony pathogenic agent can be an intracellular or extra-cellular parasite. According to one embodiment of the invention, the pathogen is a "bee pathogen", causing or facilitating a bee or bee colony disease, such as Colony Collapse Disorder, Sacbrood virus disease, Deformed Wing Disease, Cloudy Wing Disease, Chronic Paralysis, Nosemosis, American Foul Brood and the like.

As used herein, the terms "bee disease" or "bee colony disease" are defined as undesirable changes in the behavior, physiology, morphology, reproductive fitness, economic value, honey production, pollination capability, resistance to infection and/or infestation of a bee, a population of bees and/or a bee colony, directly or indirectly resulting from contact with a bee or bee colony pathogenic agent.

A non-limiting list of exemplary disease-causing pathogens, and diseases of bees and bee colonies associated with the pathogenic agents, suitable for treatment according to some embodiments of the methods and compositions of the present invention is found in Table II below. The complete genomes of several known isolates of IAPV and information on possible phylogenic relationships between strains that can be similarly targeted with the methods and compositions of the present invention are provided in Palacios et al. 2008 (published online ahead of print on 23 Apr. 2008, Journal of Virology)

TABLE II

Bee and Bee Colony Pathogens

| Parasitic Organism | Genes |
| --- | --- |
| Acute bee paralysis virus | Acute bee paralysis virus, complete genome. Accession NC_002548 (seq id no: 8) |
| Israel acute paralysis virus | Accession: NC_009025, israel acute paralysis virus of bees, complete genome (seq id no: 16) |
| Deformed wing virus | Deformed wing virus, complete genome. Accession NC_004830 (seq id no: 10) |
| Kashmir bee virus | Accession: AY275710, kashmir bee virus, complete genome (seq id no: 9) |
| Black queen cell virus | Black queen cell virus strain poland-6 non-structural polyprotein and structural polyprotein genes, complete cds. Accession: EF517521 (seq id no: 20) |
| Chronic paralysis virus | Chronic bee paralysis virus rna 2, complete sequence. Accession: NC_010712 (seq id no: 23) |
| Cloudy wing virus | Cloudy wing virus rna polymerase (pol) gene, partial cds. Accession AF034543 (seq id no: 7) |
| *Paenibacillus larvae* (American Foul Brood) | Accession: NZ_AARF01000646, whole genome (shotgun) sequenced. (seq id no: 11) |
| *Melissococcus pluton* (European Foul Brood) | Accession: EF666055 *Melissococcus plutonius* superoxide dismutase (soda) gene (seq id no: 21) |
| *Ascophaera apis* (Chalkbrood) | No genomic data |
| *Nosema apis*, | 1)Accession DQ996230 (seq id no: 15), *Nosema apis* RNA polymerase II largest subunit 2)Accesions EU545140 (seq id no: 22), EF584425 (seq id no: 19), EF584423 (seq id no: 18), EF584418 (seq id no: 17) all are 16S ribosomal RNA gene |
| *Nosema cerana* | EF091883 (seq id no: 12), EF091884 (seq id no: 13), and EF091885 (seq id no: 14) are accessions of 5S ribosomal RNA gene, intergenic spacer, and small subunit ribosomal RNA gene. |

While reducing the present invention to practice, the inventors have shown that providing a IAPV-specific dsRNA in the feed of bees exposed to IAPV dramatically reduced the incidence and levels of IAPV sequences detected in the bees, after 4 and 8 days (FIGS. 4A-4C and 5). Thus, in some embodiments of the present invention, the methods and compositions are useful for downregulating expression of a polypeptide of a bee or bee colony pathogenic organism.

As used herein, the term "downregulating expression" is defined as causing, directly or indirectly, reduction in the transcription of a desired gene, reduction in the amount, stability or translatability of transcription products (e.g. RNA) of said gene, reduction in translation of the polypeptide(s) encoded by the desired gene and/or reduction in the amount, stability, or alteration of biochemical function of the polypeptides encoded by the desired gene, so as to reduce the amount or function of the gene products. As used herein, "downregulating expression" also relates to reduction in amount, stability or translatability of bee pathogen RNA molecules in cells of a bee, where the bee pathogen genome is a single stranded RNA molecule, as in case of a single-stranded RNA virus. Downregulating expression of a gene or other bee pathogen RNA can be monitored, for example, by direct detection of gene transcripts (for example, by PCR), by detection of polypeptide(s) encoded by the gene or bee pathogen RNA (for example, by Western blot or immunoprecipitation), by detection of biological activity of polypeptides encode by the gene (for example, catalytic activity, ligand binding, and the like), or by monitoring changes in a cell or organism resulting from reduction in expression of a desired gene or bee pathogen RNA (for example, reduced proliferation of a pathogen, reduced virulence of a pathogen, reduced motility of a cell, reduced response of a cell or organism to stimulus, etc). As used herein, the downregulation can be transient, for example, for the duration of the presence of a downregulating agent, or permanent, resulting in reduction of gene expression or bee pathogen RNA for the lifetime of the organism and/or its future generations.

Downregulation of bee pathogen polypeptides can be effected on the genomic and/or the transcript level using a variety of molecules which interfere with transcription and/or translation (e.g., RNA silencing agents, Ribozyme, DNAzyme and antisense). Treatment and prevention of viral infections with dsRNA has been disclosed by WO/2003/004649 to Tenllado et al. Use of dsRNA in insects is disclosed in US Patent Application 2007 0250947, US Patent Application 2006 0272049, PCT Applications WO 2007/080127 and WO 2007/080126, US patent application 20030150017, PCT patent application WO 02/14472, US Patent Application 20030154508, PCT patent application WO 2004/005485, PCT application WO 99/32619 and U.S. Pat. No. 6,326,193.

Following is a list of agents capable of downregulating expression level and/or activity of bee pathogen polypeptides.

Downregulation of bee pathogen polypeptides can be achieved by RNA silencing. As used herein, the phrase "RNA silencing" refers to a group of regulatory mechanisms [e.g. RNA interference (RNAi), transcriptional gene silencing (TGS), post-transcriptional gene silencing (PTGS), quelling, co-suppression, and translational repression] mediated by RNA molecules which result in the inhibition or "silencing" of the expression of a corresponding protein-coding gene or bee pathogen RNA sequence. RNA silencing has been observed in many types of organisms, including plants, animals, and fungi.

As used herein, the term "RNA silencing agent" refers to an RNA which is capable of inhibiting or "silencing" the expression of a target gene. In certain embodiments, the RNA silencing agent is capable of preventing complete processing (e.g, the full translation and/or expression) of an mRNA molecule through a post-transcriptional silencing mechanism. RNA silencing agents include noncoding RNA molecules, for example RNA duplexes comprising paired strands, as well as precursor RNAs from which such small non-coding RNAs can be generated. Exemplary RNA silencing agents include dsRNAs such as siRNAs, miRNAs and shRNAs. In one embodiment, the RNA silencing agent is capable of inducing RNA interference. In another embodiment, the RNA silencing agent is capable of mediating translational repression.

RNA interference refers to the process of sequence-specific post-transcriptional gene silencing in animals mediated by short interfering RNAs (siRNAs). The corresponding process in plants is commonly referred to as post-transcriptional gene silencing or RNA silencing and is also referred to as quelling in fungi. The process of post-transcriptional gene silencing is thought to be an evolutionarily-conserved cellular defense mechanism used to prevent the expression of foreign genes and is commonly shared by diverse flora and phyla. Such protection from foreign gene expression may have evolved in response to the production of double-stranded RNAs (dsRNAs) derived from viral infection or from the random integration of transposon elements into a host genome via a cellular response that specifically destroys homologous single-stranded RNA or viral genomic RNA.

The presence of long dsRNAs in cells stimulates the activity of a ribonuclease III enzyme referred to as dicer. Dicer is involved in the processing of the dsRNA into short pieces of dsRNA known as short interfering RNAs (siRNAs). Short interfering RNAs derived from dicer activity are typically about 21 to about 23 nucleotides in length and comprise about 19 base pair duplexes. The RNAi response also features an endonuclease complex, commonly referred to as an RNA-induced silencing complex (RISC), which mediates cleavage of single-stranded RNA having sequence complementary to the antisense strand of the siRNA duplex. Cleavage of the target RNA takes place in the middle of the region complementary to the antisense strand of the siRNA duplex.

Accordingly, the present invention contemplates use of dsRNA to downregulate protein expression from mRNA.

According to one embodiment, the dsRNA is greater than 30 bp. The use of long dsRNAs can provide numerous advantages in that the cell can select the optimal silencing sequence alleviating the need to test numerous siRNAs; long dsRNAs will allow for silencing libraries to have less complexity than would be necessary for siRNAs; and, perhaps most importantly, long dsRNA could prevent viral escape mutations when used as therapeutics.

Various studies demonstrate that long dsRNAs can be used to silence gene expression without inducing the stress response or causing significant off-target effects—see for example [Strat et al., Nucleic Acids Research, 2006, Vol. 34, No. 13 3803-3810; Bhargava A et al. Brain Res. Protoc. 2004; 13:115-125; Diallo M., et al., Oligonucleotides. 2003; 13:381-392; Paddison P. J., et al., Proc. Natl Acad. Sci. USA. 2002; 99:1443-1448; Tran N., et al., FEBS Lett. 2004; 573: 127-134].

In one embodiment of the present invention, the dsRNA is greater than 30 base-pairs, and is as set forth in SEQ ID NOs: 24, 33 and 34.

Another method of downregulating bee pathogen proteins is by introduction of small inhibitory RNAs (siRNAs).

The term "siRNA" refers to small inhibitory RNA duplexes (generally between 18-30 basepairs, between 19 and 25 basepairs) that induce the RNA interference (RNAi) pathway. Typically, siRNAs are chemically synthesized as 21mers with a central 19 bp duplex region and symmetric 2-base 3'-overhangs on the termini, although it has been recently described that chemically synthesized RNA duplexes of 25-30 base length can have as much as a 100-fold increase in potency compared with 21mers at the same location. The observed increased potency obtained using longer RNAs in triggering RNAi is theorized to result from providing Dicer with a substrate (27mer) instead of a product (21mer) and that this improves the rate or efficiency of entry of the siRNA duplex into RISC.

It has been found that position of the 3'-overhang influences potency of an siRNA and asymmetric duplexes having a 3'-overhang on the antisense strand are generally more potent than those with the 3'-overhang on the sense strand (Rose et al., 2005). This can be attributed to asymmetrical strand loading into RISC, as the opposite efficacy patterns are observed when targeting the antisense transcript.

The strands of a double-stranded interfering RNA (e.g., an siRNA) may be connected to form a hairpin or stem-loop structure (e.g., an shRNA). Thus, as mentioned the RNA silencing agent of the present invention may also be a short hairpin RNA (shRNA).

The term "shRNA", as used herein, refers to an RNA agent having a stem-loop structure, comprising a first and second region of complementary sequence, the degree of complementarity and orientation of the regions being sufficient such that base pairing occurs between the regions, the first and second regions being joined by a loop region, the loop resulting from a lack of base pairing between nucleotides (or nucleotide analogs) within the loop region. The number of nucleotides in the loop is a number between and including 3 to 23, or 5 to 15, or 7 to 13, or 4 to 9, or 9 to 11. Some of the nucleotides in the loop can be involved in base-pair interactions with other nucleotides in the loop. Examples of oligonucleotide sequences that can be used to form the loop include 5'-UUCAAGAGA-3' (Brummelkamp, T. R. et al. (2002) Science 296: 550) and 5'-UUUGUGUAG-3' (Castanotto, D. et al. (2002) RNA 8:1454). It will be recognized by one of skill in the art that the resulting single chain oligonucleotide forms a stem-loop or hairpin structure comprising a double-stranded region capable of interacting with the RNAi machinery.

According to another embodiment the RNA silencing agent may be a miRNA. miRNAs are small RNAs made from genes encoding primary transcripts of various sizes. They have been identified in both animals and plants. The primary transcript (termed the "pri-miRNA") is processed through various nucleolytic steps to a shorter precursor miRNA, or "pre-miRNA." The pre-miRNA is present in a folded form so that the final (mature) miRNA is present in a duplex, the two strands being referred to as the miRNA (the strand that will eventually basepair with the target) The pre-miRNA is a substrate for a form of dicer that removes the miRNA duplex from the precursor, after which, similarly to siRNAs, the duplex can be taken into the RISC complex. It has been demonstrated that miRNAs can be transgenically expressed and be effective through expression of a precursor form, rather than the entire primary form (Parizotto et al. (2004) Genes & Development 18:2237-2242 and Guo et al. (2005) Plant Cell 17:1376-1386).

Unlike, siRNAs, miRNAs bind to transcript sequences with only partial complementarity (Zeng et al., 2002, Molec. Cell 9:1327-1333) and repress translation without affecting steady-state RNA levels (Lee et al., 1993, Cell 75:843-854; Wightman et al., 1993, Cell 75:855-862). Both miRNAs and siRNAs are processed by Dicer and associate with components of the RNA-induced silencing complex (Hutvagner et al., 2001, Science 293:834-838; Grishok et al., 2001, Cell 106: 23-34; Ketting et al., 2001, Genes Dev. 15:2654-2659; Williams et al., 2002, Proc. Natl. Acad. Sci. USA 99:6889-6894; Hammond et al., 2001, Science 293:1146-1150; Mourlatos et al., 2002, Genes Dev. 16:720-728). A recent report (Hutvagner et al., 2002, Sciencexpress 297:2056-2060) hypothesizes that gene regulation through the miRNA pathway versus the siRNA pathway is determined solely by the degree of complementarity to the target transcript. It is speculated that siRNAs with only partial identity to the mRNA target will function in translational repression, similar to an miRNA, rather than triggering RNA degradation.

According to one embodiment of the present invention, the nucleic acid agent is capable of causing cleavage and/or degradation of a bee pathogen target polynucleotide sequence. As used herein, the phrases "target" or "target polynucleotide sequence" refer to any sequence present in a bee cell or in a bee, whether naturally occurring sequence or a heterologous sequence present due to an intracellular or extracellular pathogenic infection or a disease, which bee pathogen polynucleotide sequence has a function that is desired to be reduced or inhibited. The bee pathogen target sequence may be a coding sequence, that is, it is translated to express a protein or a functional fragment thereof. Alternatively, the target sequence may be non-coding, but may have a regulatory function. One target polynucleotide sequence is a bee pathogenic virus polynucleotide sequence necessary for replication and/or pathogenesis of the virus in an infected bee cell. Another embodiment of a bee pathogen target polynucleotide sequence is a non-expressed regulatory sequence of a virus-induced disease, which sequence is required for the maintenance of the virus in the bee cell, for example, a polynucleotide sequence of an intracellular or extracellular pathogen necessary for replication and/or pathogenesis of that pathogen in an infected bee. Yet another embodiment of a bee pathogenic target sequence is any sequence to which the nucleic acid agent, or sequences derived therefrom, is capable of binding, which binding results in cleavage and/or degradation ("silencing") of a bee pathogen polynucleotide. The term "gene" is intended to include any target sequence intended to be "silenced", whether or not transcribed and/or translated, including regulatory sequences, such as promoters, enhancers and other non-coding sequences.

In one embodiment of the present invention, synthesis of RNA silencing agents suitable for use with the present invention can be effected as follows. First, the bee pathogen polypeptide mRNA or other target sequence is scanned downstream of the AUG start codon for AA dinucleotide sequences. Occurrence of each AA and the 3' adjacent 19 nucleotides is recorded as potential siRNA target sites. Preferably, siRNA target sites are selected from the open reading frame, as untranslated regions (UTRs) are richer in regulatory protein binding sites. UTR-binding proteins and/or translation initiation complexes may interfere with binding of the siRNA endonuclease complex [Tuschl ChemBiochem. 2:239-245]. It will be appreciated though, that siRNAs directed at untranslated regions may also be effective, as demonstrated for GAPDH wherein siRNA directed at the 5' UTR mediated about 90% decrease in cellular GAPDH mRNA and completely abolished protein level (www.ambion.com/techlib/tn/91/912.html).

Second, potential target sites are compared to an appropriate genomic database (e.g., human, mouse, rat etc.) using any sequence alignment software, such as the BLAST software available from the NCBI server (www.ncbi.nlm.nih.gov/BLAST/). Putative target sites which exhibit significant homology to other coding sequences are filtered out.

Qualifying target sequences are selected as template for siRNA synthesis. Preferred sequences are those including low G/C content as these have proven to be more effective in mediating gene silencing as compared to those with G/C content higher than 55%. Several target sites are preferably selected along the length of the target gene or sequence for evaluation. For better evaluation of the selected siRNAs, a negative control is preferably used in conjunction. Negative control siRNA preferably include the same nucleotide composition as the siRNAs but lack significant homology to the genome. Thus, a scrambled nucleotide sequence of the siRNA is preferably used, provided it does not display any significant homology to any other gene or bee pathogen target sequence.

For example, a suitable bee pathogen siRNA can be an IAPV-specific siRNA corresponding to IAPV sequences SEQ ID NOs: 33 and 34. Additional suitable bee pathogen siRNAs can be designed according to sequences from any bee pathogens, for example, the sequences detailed in Table II, including, but not limited to Acute Bee Paralysis Virus (for example, SEQ ID NOs: 32430-41886), Deformed Wing Virus (for example, SEQ ID NOs: 9533-19652), Kashmir Bee Virus (for example, SEQ ID NOs: 42281-51771), Black Queen Cell Virus (for example, SEQ ID NOs: 19653-27934), Chronic Paralysis Virus (for example, SEQ ID NOs: 27935-30219), Cloudy Wing Virus (for example, SEQ ID NOs: 30220-30613), *Paenibacillus* larvae (for example, SEQ ID NOs: 30614-32007), *Melissococcus pluton* (for example, SEQ ID NOs: 32008-32429), *Nosema apis* (for example, SEQ ID NOs: 53774-56822) and *Nosema cerana* (for example, SEQ ID NOs: 51772-53773). Multiple bee-pathogen sequences can be designed to include sequences suitable for producing siRNAs effective against more than one bee pathogen, such as the multiple bee-virus dsRNA described in detail in Example IV herein (SEQ ID NO: 24). Such multiple bee-pathogen dsRNA can be of the long or short variety, and may include sequences corresponding to homologous sequences within a class of bee pathogens (multiple bee-virus sequences, for example), or sequences corresponding to diverse classes of pathogens (e.g. viral+bacterial+fungal sequences, etc). Further, multiple sequences can be designed to include two or more dsRNA sequences of the same bee-pathogen.

According to yet another embodiment of the present invention, synthesis of RNA silencing agents suitable for use with the present invention can be effected according to bee pathogen target sequences known to integrate into the host genome, target sequences suspected associated with resistance to a bee pathogen infection, target sequences representing intergenic regions of the bee pathogen genome and pathogen-specific sequences shown to be critical for pathogen growth and/or replication. It will be appreciated that, in a further embodiment of the present invention, nucleic acid agents targeted to sequences having a conserved homology between different strains of the bee pathogen, or even between diverse bee pathogens, once such sequences are identified, can be effective against more than one strain of the bee pathogen, or even against different bee pathogens.

It will be appreciated that the RNA silencing agent of the present invention need not be limited to those molecules containing only RNA, but further encompasses chemically-modified nucleotides and non-nucleotides.

In some embodiments, the RNA silencing agent provided herein can be functionally associated with a cell-penetrating peptide. As used herein, a "cell-penetrating peptide" is a peptide that comprises a short (about 12-30 residues) amino acid sequence or functional motif that confers the energy-independent (i.e., non-endocytotic) translocation properties associated with transport of the membrane-permeable complex across the plasma and/or nuclear membranes of a cell. The cell-penetrating peptide used in the membrane-permeable complex of the present invention preferably comprises at least one non-functional cysteine residue, which is either free or derivatized to form a disulfide link with a double-stranded ribonucleic acid that has been modified for such linkage. Representative amino acid motifs conferring such properties are listed in U.S. Pat. No. 6,348,185, the contents of which are expressly incorporated herein by reference. The cell-penetrating peptides of the present invention preferably include, but are not limited to, penetratin, transportan, pIsl, TAT(48-60), pVEC, MTS, and MAP.

Another agent capable of downregulating a bee pathogen polypeptide is a DNAzyme molecule capable of specifically cleaving an mRNA transcript or DNA sequence of the bee pathogen polypeptide. DNAzymes are single-stranded polynucleotides which are capable of cleaving both single and double stranded target sequences (Breaker, R. R. and Joyce, G. Chemistry and Biology 1995; 2:655; Santoro, S. W. & Joyce, G. F. Proc. Natl, Acad. Sci. USA 1997; 943:4262) A general model (the "10-23" model) for the DNAzyme has been proposed. "10-23" DNAzymes have a catalytic domain of 15 deoxyribonucleotides, flanked by two substrate-recognition domains of seven to nine deoxyribonucleotides each. This type of DNAzyme can effectively cleave its substrate RNA at purine:pyrimidine junctions (Santoro, S. W. & Joyce, G. F. Proc. Natl, Acad. Sci. USA 199; for rev of DNAzymes see Khachigian, L M [Curr Opin Mol Ther 4:119-21 (2002)].

Examples of construction and amplification of synthetic, engineered DNAzymes recognizing single and double-stranded target cleavage sites have been disclosed in U.S. Pat. No. 6,326,174 to Joyce et al. DNAzymes of similar design directed against the human Urokinase receptor were recently observed to inhibit Urokinase receptor expression, and successfully inhibit colon cancer cell metastasis in vivo (Itoh et al, 20002, Abstract 409, Ann Meeting Am Soc Gen Ther www.asgt.org). In another application, DNAzymes complementary to bcr-ab1 oncogenes were successful in inhibiting the oncogenes expression in leukemia cells, and lessening relapse rates in autologous bone marrow transplant in cases of CML and ALL.

Downregulation of bee pathogen polypeptides or cleavage of bee pathogen RNA can also be effected by using an antisense polynucleotide capable of specifically hybridizing with an mRNA transcript encoding the bee pathogen polypeptide or a bee pathogen RNA target sequence.

Design of antisense molecules which can be used to efficiently downregulate a bee pathogen polypeptide must be effected while considering two aspects important to the antisense approach. The first aspect is delivery of the oligonucleotide into the cytoplasm of the appropriate cells, while the second aspect is design of an oligonucleotide which specifically binds the designated mRNA or RNA target sequence within cells in a way which inhibits translation thereof.

The prior art teaches of a number of delivery strategies which can be used to efficiently deliver oligonucleotides into a wide variety of cell types [see, for example, Luft J Mol Med 76: 75-6 (1998); Kronenwett et al. Blood 91: 852-62 (1998); Rajur et al. Bioconjug Chem 8: 935-40 (1997); Lavigne et al. Biochem Biophys Res Commun 237: 566-71 (1997) and Aoki et al. (1997) Biochem Biophys Res Commun 231: 540-5 (1997)].

In addition, algorithms for identifying those sequences with the highest predicted binding affinity for their target mRNA based on a thermodynamic cycle that accounts for the energetics of structural alterations in both the target mRNA and the oligonucleotide are also available [see, for example, Walton et al. Biotechnol Bioeng 65: 1-9 (1999)].

Such algorithms have been successfully used to implement an antisense approach in cells. For example, the algorithm developed by Walton et al. enabled scientists to successfully design antisense oligonucleotides for rabbit beta-globin (RBG) and mouse tumor necrosis factor-alpha (TNF alpha) transcripts. The same research group has more recently reported that the antisense activity of rationally selected oligonucleotides against three model target mRNAs (human lactate dehydrogenase A and B and rat gp130) in cell culture as evaluated by a kinetic PCR technique proved effective in almost all cases, including tests against three different targets in two cell types with phosphodiester and phosphorothioate oligonucleotide chemistries.

In addition, several approaches for designing and predicting efficiency of specific oligonucleotides using an in vitro system were also published (Matveeva et al., Nature Biotechnology 16: 1374-1375 (1998)].

For example, a suitable antisense oligonucleotide targeted against the IAPV mRNA would be of the sequences as set forth in SEQ ID NOs: 51 and 52 (IAPV polyproteins).

Several clinical trials have demonstrated safety, feasibility and activity of antisense oligonucleotides. For example, antisense oligonucleotides suitable for the treatment of cancer have been successfully used [Holmund et al., Curr Opin Mol Ther 1:372-85 (1999)], while treatment of hematological malignancies via antisense oligonucleotides targeting c-myb gene, p53 and Bcl-2 had entered clinical trials and had been shown to be tolerated by patients [Gerwitz Curr Opin Mol Ther 1:297-306 (1999)]. Antisense oligonucleotides targeted to nervous system proteins have been used effectively in honeybees (Fiala et al, J. Neuroscience 1999; 19:10125-34).

Thus, the current consensus is that recent developments in the field of antisense technology which, as described above, have led to the generation of highly accurate antisense design algorithms and a wide variety of oligonucleotide delivery systems, enable an ordinarily skilled artisan to design and implement antisense approaches suitable for downregulating expression of known sequences without having to resort to undue trial and error experimentation.

Another agent capable of downregulating a bee pathogen polypeptide is a ribozyme molecule capable of specifically cleaving an mRNA transcript encoding a bee pathogen polypeptide. Ribozymes are being increasingly used for the sequence-specific inhibition of gene expression by the cleavage of mRNAs encoding proteins of interest [Welch et al., Curr Opin Biotechnol. 9:486-96 (1998)]. The possibility of designing ribozymes to cleave any specific target RNA, including viral RNA, has rendered them valuable tools in both basic research and therapeutic applications. In the area of therapeutics, ribozymes have been exploited to target viral RNAs in infectious diseases, dominant oncogenes in cancers and specific somatic mutations in genetic disorders [Welch et al., Clin Diagn Virol. 10:163-71 (1998)]. Most notably, several ribozyme gene therapy protocols for HIV patients are already in Phase 1 trials. More recently, ribozymes have been used for transgenic animal research, gene target validation and pathway elucidation. Several ribozymes are in various stages of clinical trials. ANGIOZYME was the first chemically synthesized ribozyme to be studied in human clinical trials. ANGIOZYME specifically inhibits formation of the VEGF-r (Vascular Endothelial Growth Factor receptor), a key component in the angiogenesis pathway. Ribozyme Pharmaceuticals, Inc., as well as other firms have demonstrated the importance of anti-angiogenesis therapeutics in animal models. HEPTAZYME, a ribozyme designed to selectively destroy Hepatitis C Virus (HCV) RNA, was found effective in decreasing Hepatitis C viral RNA in cell culture assays (Ribozyme Pharmaceuticals, Incorporated—WEB home page).

An additional method of regulating the expression of a bee pathogen polypeptide gene in cells is via triplex forming oligonuclotides (TFOs). Recent studies have shown that TFOs can be designed which can recognize and bind to polypurine/polypirimidine regions in double-stranded helical DNA in a sequence-specific manner. These recognition rules are outlined by Maher III, L. J., et al., Science, 1989; 245: 725-730; Moser, H. E., et al., Science, 1987; 238:645-630; Beal, P. A., et al, Science, 1992; 251:1360-1363; Cooney, M., et al., Science, 1988; 241:456-459; and Hogan, M. E., et al., EP Publication 375408. Modification of the oligonuclotides, such as the introduction of intercalators and backbone substitutions, and optimization of binding conditions (pH and cation concentration) have aided in overcoming inherent obstacles to TFO activity such as charge repulsion and instability, and it was recently shown that synthetic oligonucleotides can be targeted to specific sequences (for a recent review see Seidman and Glazer, J Clin Invest 2003; 112:487-94).

In general, the triplex-forming oligonucleotide has the sequence correspondence:

| | | | | |
|---|---|---|---|---|
| oligo | 3'--A | G | G | T |
| duplex | 5'--A | G | C | T |
| duplex | 3'--T | C | G | A |

However, it has been shown that the A-AT and G-GC triplets have the greatest triple helical stability (Reither and Jeltsch, BMC Biochem, 2002, Sep. 12, Epub). The same authors have demonstrated that TFOs designed according to the A-AT and G-GC rule do not form non-specific triplexes, indicating that the triplex formation is indeed sequence specific.

Thus for any given sequence in the bee pathogen polypeptide regulatory region a triplex forming sequence may be devised. Triplex-forming oligonucleotides preferably are at least 15, more preferably 25, still more preferably 30 or more nucleotides in length, up to 50 or 100 bp.

Transfection of cells (for example, via cationic liposomes) with TFOs, and formation of the triple helical structure with the target DNA induces steric and functional changes, blocking transcription initiation and elongation, allowing the introduction of desired sequence changes in the endogenous DNA and resulting in the specific downregulation of gene expression. Examples of such suppression of gene expression in cells treated with TFOs include knockout of episomal supFG1 and endogenous HPRT genes in mammalian cells (Vasquez et al., Nucl Acids Res. 1999; 27:1176-81, and Puri, et al, J Biol Chem, 2001; 276:28991-98), and the sequence- and target specific downregulation of expression of the Ets2 transcription factor, important in prostate cancer etiology (Carbone, et al, Nucl Acid Res. 2003; 31:833-43), and the pro-inflammatory ICAM-1 gene (Besch et al, J Biol Chem, 2002; 277:32473-79). In addition, Vuyisich and Beal have recently shown that sequence specific TFOs can bind to dsRNA, inhibiting activity of dsRNA-dependent enzymes such as RNA-dependent kinases (Vuyisich and Beal, Nuc. Acids Res 2000; 28:2369-74).

Additionally, TFOs designed according to the abovementioned principles can induce directed mutagenesis capable of effecting DNA repair, thus providing both downregulation and upregulation of expression of endogenous genes (Seidman and Glazer, J Clin Invest 2003; 112:487-94). Detailed description of the design, synthesis and administration of effective TFOs can be found in U.S. Patent Application Nos. 2003 017068 and 2003 0096980 to Froehler et al, and 2002 0128218 and 2002 0123476 to Emanuele et al, and U.S. Pat. No. 5,721,138 to Lawn.

The RNA, dsRNA, siRNA, or miRNA of the present invention may be produced chemically or enzymatically through manual or automated reactions or in vivo in an organism other than the plant for which pest control is intended. RNA may also be produced by partial or total organic synthesis. Any modified ribonucleotide can be introduced by in vitro enzymatic or organic synthesis. The RNA may be synthesized by a cellular RNA polymerase or a bacteriophage RNA polymerase (e.g., T3, T7, SP6). If synthesized chemically or by in vitro enzymatic synthesis, the RNA may be purified prior to feeding or formulated in an acceptable carrier and provided as a liquid, solid or semi-solid to the bees. For example, RNA can be purified from a mixture by extraction with a solvent or resin, precipitation, electrophoresis, chromatography, or a combination thereof. Alternatively, the RNA may be used with no, or a minimum of, purification to avoid losses due to sample processing. The RNA may be dried for storage or dissolved in an aqueous solution. The solution may contain buffers or salts to promote annealing, and/or stabilization of the duplex strands.

For transcription from a transgene in vivo or from an expression cassette, a regulatory region (e.g., promoter, enhancer, silencer, leader, intron and polyadenylation) may be used to modulate the transcription of the RNA strand (or strands). Therefore, in one embodiment, there is provided a nucleic acid construct comprising the nucleic acid agent. The nucleic acid construct can have polynucleotide sequences constructed to facilitate transcription of the RNA molecules of the present invention are operably linked to one or more promoter sequences functional in a host cell. The polynucleotide sequences may be placed under the control of an endogenous promoter normally present in the host genome. The polynucleotide sequences of the present invention, under the control of an operably linked promoter sequence, may further be flanked by additional sequences that advantageously affect its transcription and/or the stability of a resulting transcript. Such sequences are generally located upstream of the promoter and/or downstream of the 3' end of the expression construct. The term "operably linked", as used in reference to a regulatory sequence and a structural nucleotide sequence, means that the regulatory sequence causes regulated expression of the linked structural nucleotide sequence. "Regulatory sequences" or "control elements" refer to nucleotide sequences located upstream, within, or downstream of a structural nucleotide sequence, and which influence the timing and level or amount of transcription, RNA processing or stability, or translation of the associated structural nucleotide sequence. Regulatory sequences may include promoters, translation leader sequences, introns, enhancers, stem-loop structures, repressor binding sequences, termination sequences, pausing sequences, polyadenylation recognition sequences, and the like.

The nucleic acid agent can be delivered to the bees in a great variety of ways. As detailed herein, bee feeding is common practice amongst bee-keepers, for providing both nutritional and other, for example, supplemental needs. Bees typically feed on honey and pollen, but have been known to ingest non-natural feeds as well. Bees can be fed various foodstuffs including, but not limited to Wheast (a dairy yeast grown on cottage cheese), soybean flour, yeast (e.g. brewer's yeast, torula yeast) and yeast products products-fed singly or in combination and soybean flour fed as a dry mix or moist cake inside the hive or as a dry mix in open feeders outside the hive. Also useful is sugar, or a sugar syrup. The addition of 10 to 12 percent pollen to a supplement fed to bees improves palatability. The addition of 25 to 30 percent pollen improves the quality and quantity of essential nutrients that are required by bees for vital activity.

Cane or beet sugar, isomerized corn syrup, and type-50 sugar syrup are satisfactory substitutes for honey in the natural diet of honey bees. The last two can be supplied only as a liquid to bees.

Liquid feed can be supplied to bees inside the hive by, for example, any of the following methods: friction-top pail, combs within the brood chamber, division board feeder, boardman feeder, etc. Dry sugar may be fed by placing a pound or two on the inverted inner cover. A supply of water must be available to bees at all times. In one embodiment, pan or trays in which floating supports-such as wood chips, cork, or plastic sponge—are present are envisaged. Detailed descriptions of supplemental feeds for bees can be found in, for example, USDA publication by Standifer, et al 1977, entitled "Supplemental Feeding of Honey Bee Colonies" (USDA, Agriculture Information Bulletin No. 413).

All the bees in a hive are potentially susceptible to the pathogenic diseases detailed herein. Thus, according to some embodiments, the bees can be honeybees, forager bees, hive bees and the like.

Also provided is a method for reducing the susceptibility of a bee to a disease caused by pathogens, the method effected by feeding the bee on an effective amount of a nucleic acid or nucleic acid construct comprising a nucleic acid agent down-regulating expression of a polypeptide of the bee pathogen and/or causing cleavage and/or degradation of a bee pathogen RNA. Methods for reducing the susceptibility of a bee colony or bee-hive to bee pathogens by feeding oligonucleotides and/or polynucleotides are envisaged. Thus, in some embodiments, the present invention can be used to benefit any numbers of bees, from a few in the hive, to the entire bee population within a hive and its surrounding area. It will be appreciated, that in addition to feeding of oligonucleotides and/or polynucleotides for reduction of the bee pathogen infection and infestation, enforcement of proper sanitation (for example, refraining from reuse of infested hives) can augment the effectiveness of treatment and prevention of infections.

It is expected that during the life of a patent maturing from this application many relevant methods for downregulating bee pathogen proteins will be developed and the scope of the term "downregulating bee pathogen protein" or "downregulating bee pathogen polypeptide" is intended to include all such new technologies a priori.

As used herein the term "about" refers to ±10%.

The terms "comprises", "comprising", "includes", "including", "having" and their conjugates mean "including but not limited to". This term encompasses the terms "consisting of" and "consisting essentially of".

The phrase "consisting essentially of" means that the composition or method may include additional ingredients and/or steps, but only if the additional ingredients and/or steps do not materially alter the basic and novel characteristics of the claimed composition or method.

As used herein, the singular form "a", "an" and "the" include plural references unless the context clearly dictates otherwise. For example, the term "a compound" or "at least one compound" may include a plurality of compounds, including mixtures thereof.

Throughout this application, various embodiments of this invention may be presented in a range format. It should be understood that the description in range format is merely for convenience and brevity and should not be construed as an inflexible limitation on the scope of the invention. Accordingly, the description of a range should be considered to have specifically disclosed all the possible subranges as well as individual numerical values within that range. For example, description of a range such as from 1 to 6 should be considered to have specifically disclosed subranges such as from 1 to 3, from 1 to 4, from 1 to 5, from 2 to 4, from 2 to 6, from 3 to 6 etc., as well as individual numbers within that range, for example, 1, 2, 3, 4, 5, and 6. This applies regardless of the breadth of the range.

Whenever a numerical range is indicated herein, it is meant to include any cited numeral (fractional or integral) within the indicated range. The phrases "ranging/ranges between" a first indicate number and a second indicate number and "ranging/ranges from" a first indicate number "to" a second indicate number are used herein interchangeably and are meant to include the first and second indicated numbers and all the fractional and integral numerals therebetween.

As used herein the term "method" refers to manners, means, techniques and procedures for accomplishing a given task including, but not limited to, those manners, means, techniques and procedures either known to, or readily developed from known manners, means, techniques and procedures by practitioners of the chemical, pharmacological, biological, biochemical and medical arts.

As used herein, the term "treating" includes abrogating, substantially inhibiting, slowing or reversing the progression of a condition, substantially ameliorating clinical or aesthetical symptoms of a condition or substantially preventing the appearance of clinical or aesthetical symptoms of a condition.

It is appreciated that certain features of the invention, which are, for clarity, described in the context of separate embodiments, may also be provided in combination in a single embodiment. Conversely, various features of the invention, which are, for brevity, described in the context of a single embodiment, may also be provided separately or in any suitable subcombination or as suitable in any other described embodiment of the invention. Certain features described in the context of various embodiments are not to be considered essential features of those embodiments, unless the embodiment is inoperative without those elements.

Various embodiments and aspects of the present invention as delineated hereinabove and as claimed in the claims section below find experimental support in the following examples.

EXAMPLES

Reference is now made to the following examples, which together with the above descriptions illustrate some embodiments of the invention in a non limiting fashion.

Generally, the nomenclature used herein and the laboratory procedures utilized in the present invention include molecular, biochemical, microbiological and recombinant DNA techniques. Such techniques are thoroughly explained in the literature. See, for example, "Molecular Cloning: A laboratory Manual" Sambrook et al., (1989); "Current Protocols in Molecular Biology" Volumes I-III Ausubel, R. M., ed. (1994); Ausubel et al., "Current Protocols in Molecular Biology", John Wiley and Sons, Baltimore, Md. (1989); Perbal, "A Practical Guide to Molecular Cloning", John Wiley & Sons, New York (1988); Watson et al., "Recombinant DNA", Scientific American Books, New York; Birren et al. (eds) "Genome Analysis: A Laboratory Manual Series", Vols. 1-4, Cold Spring Harbor Laboratory Press, New York (1998); methodologies as set forth in U.S. Pat. Nos. 4,666,828; 4,683,202; 4,801,531; 5,192,659 and 5,272,057; "Cell Biology: A Laboratory Handbook", Volumes I-III Cellis, J. E., ed. (1994); "Culture of Animal Cells—A Manual of Basic Technique" by Freshney, Wiley-Liss, N.Y. (1994), Third Edition; "Current Protocols in Immunology" Volumes I-III Coligan J. E., ed. (1994); Stites et al. (eds), "Basic and Clinical Immunology" (8th Edition), Appleton & Lange, Norwalk, Conn. (1994); Mishell and Shiigi (eds), "Selected Methods in Cellular Immunology", W. H. Freeman and Co., New York (1980); available immunoassays are extensively described in the patent and scientific literature, see, for example, U.S. Pat. Nos. 3,791,932; 3,839,153; 3,850,752; 3,850,578; 3,853,987; 3,867,517; 3,879,262; 3,901,654; 3,935,074; 3,984,533; 3,996,345; 4,034,074; 4,098,876; 4,879,219; 5,011,771 and 5,281,521; "Oligonucleotide Synthesis" Gait, M. J., ed. (1984); "Nucleic Acid Hybridization" Hames, B. D., and Higgins S. J., eds. (1985); "Transcription and Translation" Hames, B. D., and Higgins S. J., eds. (1984); "Animal Cell Culture" Freshney, R. I., ed. (1986); "Immobilized Cells and Enzymes" IRL Press, (1986); "A Practical Guide to Molecular Cloning" Perbal, B., (1984) and "Methods in Enzymology" Vol. 1-317, Academic Press; "PCR Protocols: A Guide To Methods And Applications", Academic Press, San Diego, Calif. (1990); Marshak et al., "Strategies for Protein Purification and Characterization—A Laboratory Course Manual" CSHL Press (1996); all of which are incorporated by reference as if fully set forth herein. Other general references are provided throughout this document. The procedures therein are believed to be well known in the art and are provided for the convenience of the reader. All the information contained therein is incorporated herein by reference.

Example I

Effect of IAPV Virus Titer on Survival of Honeybees

In order to determine whether bees are differentially sensitive to IAPV, the effect of virus titer on bee survival was tested. Bees were introduced into plastic containers and exposed to increasing concentrations of IAPV (in feed solution). Survival of the bees in the hive was monitored over a period of 7 days.

Materials and Methods 50 bees were introduced into 0.5 liter plastic containers, or 30 bees into 0.25 liter plastic containers.

All containers were prepared in advance to accommodate air flow and enable feeding with sucrose solution and water. The bees were kept in the dark at a constant temperature of 30° C., and were fed once daily with 2 ml 50% sucrose solution and 1 ml water introduced into reservoirs in the containers.

IAPV was introduced into the sucrose solution, in increasing doses (0.0001 to 0.1 microgram/microliter) in 900 microliters sucrose solution added to the sucrose: Vertical striped bars—100 ng/μl; Cross-hatched bars—10 ng/μl; Stippled bars—1.0 ng/μl; Horizontal striped bars—0.1 ng/μl. Controls (checkered bars) were without added virus. Dead bees in the containers were counted daily, and the total number of dead bees was calculated as a percentage of the initial number of bees introduced into the container.

Results

As can be seen in FIG. 1, bee mortality during the days 1 and 2 was negligible for all viral concentrations. Significant mortality, of 35-60% (depending on viral titer) was observed from day 3, steadily increasing to 70-85% by day 6-7. It was noted that lower viral doses resulted in an initially higher mortality, which plateaued by day 6, whereas mortality among bees exposed to higher concentrations continued to increase from day 3.

Example II

Feeding Viral-Specific dsRNA Prevents Acute Disease of Honeybees Caused by IAPV In order to determine the effectiveness of ingested IAPV dsRNA on viral infection, honeybees were provided with IAPV-specific and control dsRNA in the feed for 4 days before, and 3 days following infection with IAPV virus. Numbers of dead bees per experimental hive were counted, and sample live and dead bees were collected for molecular analysis.

Materials and Methods

Establishment of mini-hive colonies: Young, approximately 2-month-old queens, together with approximately 200 worker bees were collected from hives in a local apiary. The bees were transferred into mini-hives fitted with one mini comb that was previously built by a regular hive. All of the mini-hives were closed and placed in a temperature-controlled room (30° C.).

dsRNA preparation: IAPV sequences corresponding to the intergenic region (bases 6168-6594; gi|124494152; 426 b SEQ ID NO: 33) and to a viral sequence known to integrate into the bee genome (bases 8977-9410; gi|124494152; 433 b, SEQ ID NO: 34) were cloned into a plasmid between two opposing T7 promoters. Following propagation of plasmid DNA, the viral fragments, including the T7 promoters, were excised, gel-purified, and served as templates for T7-directed in-vitro transcription (MEGAscript™, Ambion, Austin Tex.). The reaction product was submitted to DNase digestion followed by phenol extraction and ethanol precipitation. The final preparation was dissolved in nuclease-free water.

dsRNA feeding in minihives: 5 gr. pollen supplement patties were placed on top of each comb and 10 ml of 50% sucrose solution was introduced into the hive in a sterile Petri dish nightly. The feeding was continued for 7 days and subsequently only hives in which queens had begun to lay eggs were included in the trial.

Following establishment of active hives (queens laying eggs), some of the mini-hives were supplemented with viral-specific or non-specific control (IAPVds or GFPds) dsRNA, which was added to the 10 ml 50% sugar solution given to the hives, adjusted to approximately 1 microgram dsRNA per feed per bee, assuming all bees consume approximately the same amount of sucrose solution. dsRNA feeding was continued for six days.

IAPV infection in minihives: Three days after feeding in active hives, some of the colonies were fed with 0.01 microgram per microliter of IAPV in the 50% w/v sucrose solution (IAPV). Thereafter dsRNA treatments continued for a further 3 days. Samples of live and dead bees (larvae and adults) were collected daily from each mini-hive post introduction of IAPV for 7 consecutive days. Every bee collected was frozen in liquid nitrogen and preserved at −70° C. pending molecular analysis. Vitality of the colonies was monitored by opening the hives (without smoke), withdrawing the mini-comb and photographing the mini-comb from both sides. The hivecombs were photographed daily, and the number of remaining live bees was monitored. The photographs were downloaded onto a computer and the total number of bees was counted for every mini-hive.

To test dsRNA toxicity, another group of hives was provided with IAPV-specific dsRNA, but was not IAPV inoculated. Two sets of hives served as additional controls: hives that were not treated with dsRNA and were not inoculated with IAPV, and hives that were not treated with dsRNA, but were inoculated with IAPV.

RT-PCR Analysis:

Extraction of Nucleic Acids: Total RNA was extracted from the preserved bees using the TRIREAGENT method (Sigma, St. Louis Mo., USA). Briefly, RNA was extracted by precipitation and separation by centrifugation, then resuspended in RNAsecure solution.

Real-Time RT-PCR: Measured amounts of RNA (100 ng for viral expression analyses and 100 pg for 18S rRNA internal controls) were subjected to one-step RT-PCR using the SYBR Green PCR master mix with Taqman reverse transcriptase (Applied Biosystems, Foster City, Calif.). Real-time RT-PCR was conducted in GeneAmp PCR System 5700 (Applied Biosystems). Reactions performed without reverse transcriptase or without template did not result in any product. PCR cycles were as follows: 1 cycle of 30 min at 48° C. and 10 min at 95° C., followed by 40 cycles each of 15 s at 95° C., 30 s at 60° C., and 45 s at 72° C.

Table III shows the primers for all IAPV-related RT-PCR assays, including real-time RT-PCR:

TABLE III

| Primers used for PCR | | | |
|---|---|---|---|
| Primers & Purpose (5'-3') | SEQ ID | Amplified sequence (GenBank #) | Product size (bp) |
| IAPV: RT-PCR detection | | | |
| F: AGACACCAATCACGGACCTCAC | 35 | 8860-8997 | 137 |
| R: GAGATTGTTTGAGAGGGGTGG | 36 | (NC_009025) | |
| Honeybee β-Actin: RT-PCR detection | | | |
| F: ATGAAGATCCTTACAGAAAG | 37 | 686-1200 | 514 |
| R: TCTTGTTTAGAGATCCACAT | 38 | (XM_393368) | |
| IAPV: dsRNA synthesis | | | |
| F: TAATACGACTCACTATAGGGCGACCA CCCCTCTCAAACAATCTCAAACA R: TAATACGACTCACTATAGGGCGATA TATCCAGTTCAAGTGTCGGTTTTC | 39 40 | 8977-9385 (NC_009025) | 408 (excluding the T7 promoter (in bold)) |
| IAPV: dsRNA synthesis | | | |
| F: TAATACGACTCACTATAGGGCGAGAC ACAATTCTTGAAATGCCAAACT R: TAATACGACTCACTATAGGGCGACAT GTGTTACCATACGACTGCTGTAA | 41 42 | 6168-6594 (NC_009025) | 427 (excluding the T7 promoter (in bold)) |

TABLE III-continued

Primers used for PCR

| Primers & Purpose (5'-3') | SEQ ID | Amplified sequence (GenBank #) | Product size (bp) |
|---|---|---|---|
| GFP: dsRNA synthesis | | | |
| F: TAATACGACTCACTATAGGGCGAGC CAACACTTGTCACTACTTTCTCTT | 43 | 254-685 (U87625) | 432 (excluding the T7 promoter (in bold)) |
| R: TAATACGACTCACTATAGGGCGAAG GTAATGGTTGTCTGGTAAAAGGAC | 44 | | |
| Honeybee (β-Actin): Real-time PCR | | | |
| F: TGCCAACACTGTCCTTTCTG | 45 | 1000-1060 | 61 |
| R: TTGCATTCTATCTGCGATTCC | 46 | (XM_393368) | |

Northern-Blot Analysis: Total RNA was extracted from treated and control bees. Formaldehyde was added to the RNA to 1.8% and warmed to 65° C. The RNA, 15 µg per lane (in light of the real-time PCR results, only 1.5 µg of RNA was loaded in the case of upper leaves of inoculated plants), was electrophoresed on a 1.2% agarose gel at 70 V, 4° C. with stirring. The previously described amplified IAPV-RNA product was digoxigenin labeled and served as a probe for hybridization. Detection was performed with the DIG luminescent detection kit (Roche Diagnostics GmbH, Mannheim, Germany). RNA sizes were estimated by comparison to electrophoresed RNA Molecular Weight Markers I (Roche). Hybridization was carried out at high stringency (0.1×SSC; 65° C.).

Results

Figure 3:
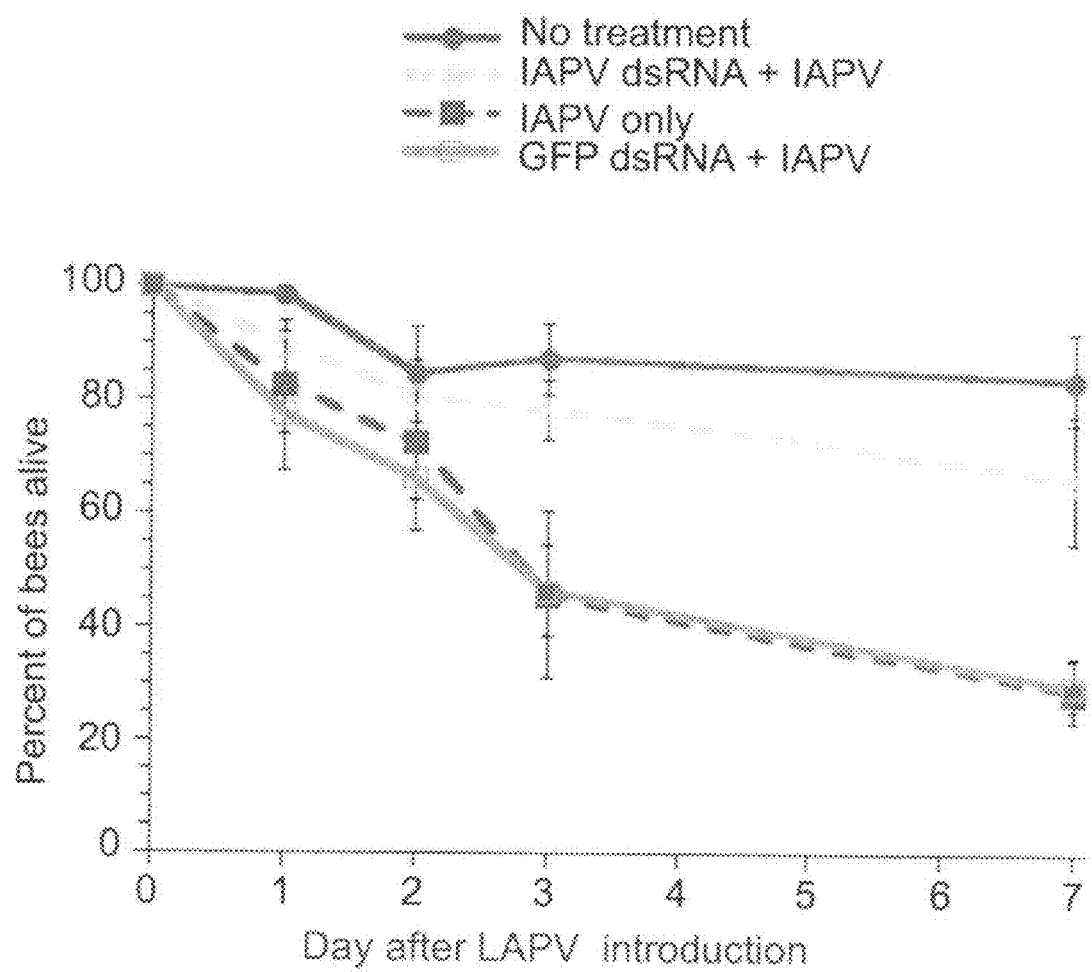
FIG. 3 is a graphic representation of bee survival following IAPV infection in the hives as treated in FIG. 2A to FIG. 2F. Filled squares (■) indicate virus exposure only (IAPV only). Empty circles (o) indicate virus exposure and IAVP-specific dsRNA feeding (IAPV dsRNA+IAPV). Empty squares (□) indicate virus exposure and non-specific dsRNA feeding (GFP dsRNA+IAPV). Filled circles (•) indicates no virus exposure and no dsRNA exposure (no treatment). Data are mean (+SE) estimated percent of bees alive. Statistical analyses were performed on arcsin square-root transformed proportions using JMP version 7.

As can be seen in FIG. 3, among bees inoculated with IAPV (on day 0) mortality was significantly reduced (25% mortality) in bees treated with IAPV–dsRNA (empty circles) relative to untreated controls (filled squares) (75% mortality) and sham-treated controls (GFP–dsRNA, empty squares) (75% mortality)(LSmeans contrast, F1,82=9.74, P=0.002). Mortality of bees treated with IAPV–dsRNA and inoculated with IAPV tended to increase relative to the noninfected bees (filled circles), though the difference did not reach statistical significance (LSmeans contrast, F1,82=3.25, NS).

FIG. 3 clearly demonstrates the efficacy of feeding IAPV–dsRNA in protecting bees from subsequent IAPV infection, whereas unrelated dsRNA (sham treated controls—GFP) fails to protect bees from infection. Ingestion of sham dsRNA had no effect on the survival of the bees, relative to untreated controls. Ingestion of dsRNAs (of IAPV and GFP) without subsequent IAPV inoculation did not harm bees in any way, indicating absence of toxicity of the dsRNA.

Figure 4A:
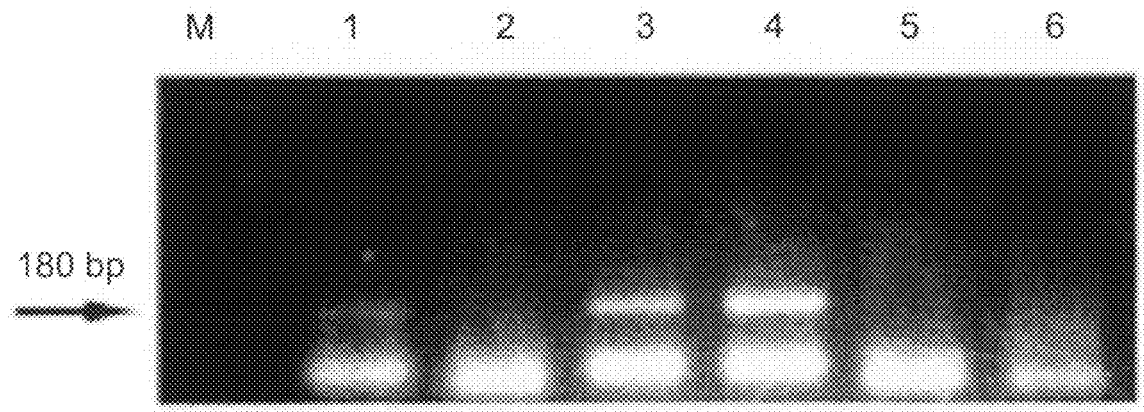
FIGS. 4A-4C are photographs of PAGE analysis of RT-PCR of bees from hives, treated as detailed in FIGS. 2A-2F and 3.
Figure 4B:
Figure 4C:
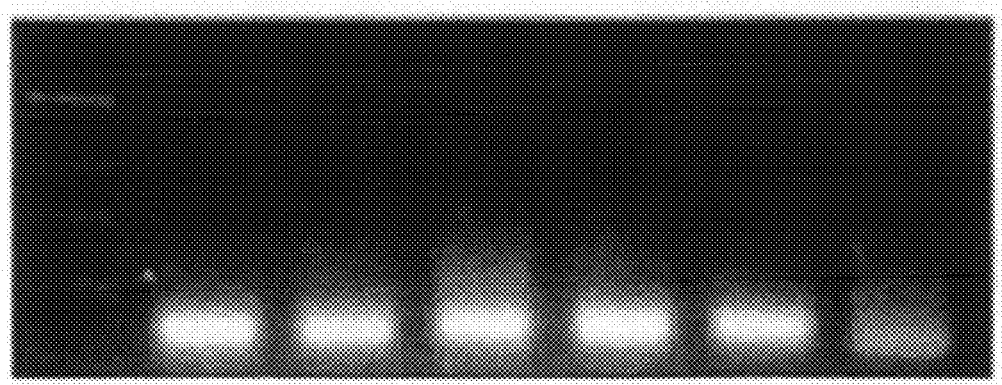

When detecting RNA using RT-PCR, the effect of feeding dsRNA–IAVP on IAPV infection in the bees is clear. FIG. 4A shows that IAPV–dsRNA-treated bees carry only residual virus transcripts (lanes 1 and 2), whereas considerable amounts of virus transcripts are detected in the untreated (lane 4), and GFP-dsRNA-treated bees (lane 3). As indicated by the identity of the band size and intensity in lanes 1-5 (actin internal controls) of FIG. 4B, all samples contained comparable amounts of template RNA.

Figure 5:
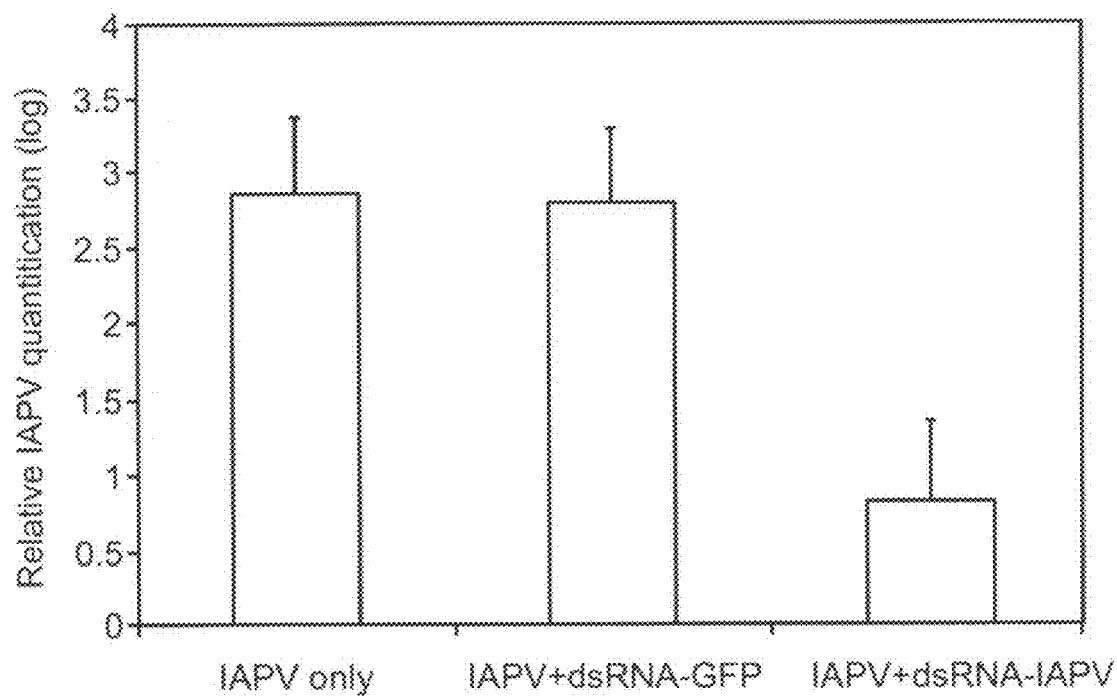
FIG. 5 is a histogram showing reduction in virus titer following IAVP–dsRNA treatment. Relative titers of virus (as determined by real-time PCT) were determined four days following IAPV inoculation in untreated bees (IAPV-only), sham (GFP) dsRNA treated bees (IAPV+dsRNA–GFP) and bees treated with IAVP–dsRNA (IAVP+dsRNA–IAVP). Relative titers were calibrated against virus titers in non-inoculated bees.

Using real-time PCR, FIG. 5 shows the strong decline in IAPV level detected in bee populations treated with IAPV–dsRNA. At the fourth day after inoculation of IAPV, real-time PCR detected approximately two orders of magnitude (2 log units) fewer IAPV in IAPV-dsRNA-treated bees as compared to that detected in bees that had not been treated with IAPV–dsRNA, or treated with unrelated (GFP) dsRNA (FIG. 5). With very few exceptions, the queens and a few nursing bees survived IAPV infection, a situation reminiscent of CCD-affected hives. Thus, the reduction in mortality among bees ingesting dsRNA-IAPV is clearly due to extensive reduction in the levels of viral infection and proliferation in the treated bees.

Figure 6:
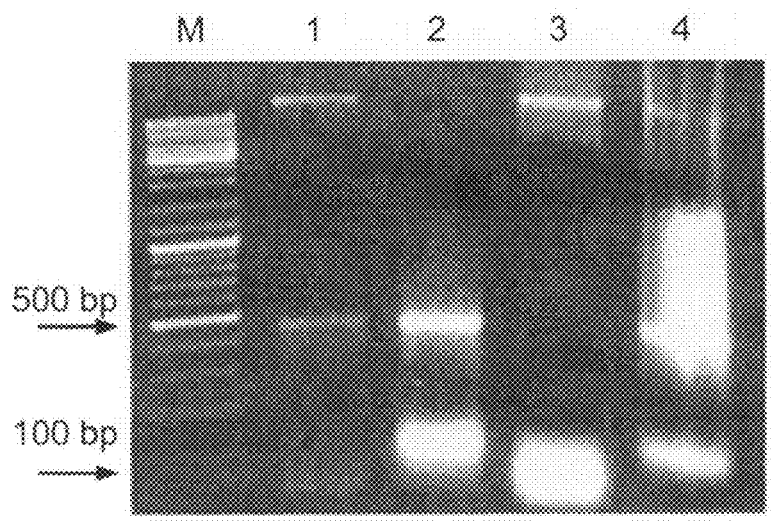
FIG. 6 is a photograph of a PAGE analysis showing the accumulation of dsRNA in bees fed with IAPV-specific dsRNA. Total bee RNA was extracted from dsRNA-fed bees as described herein, treated as indicated with RNase A, RNase III or DNA, separated on PAGE and stained for detection of prominent species. Lane 1: total RNA after digestion with RNase A. Lane 2: total RNA after digestion with DNase I. Lane 3: total RNA after digestion with RNase A+RNase III. Lane 4: untreated extract of total RNA. M is molecular weight markers. Note the presence of dsRNA (RNase A and DNase resistant, RNase III sensitive) band in lanes 1, 2, and 4.

The fate of ingested IAPV-specific dsRNA in honeybees: In order to better understand the mechanism(s) of action by which dsRNA–IAPV protects the bees against IAPV infection and its consequences, total RNA was extracted from dsRNA-IAPV treated, and non-treated control bees, submitted to digestion by a panel of nucleases, and separated on PAGE. As can be seen from FIG. 6 (see lanes 1, 2 and 3, representing digestion with RNase A, digestion with DNase I and digestion with RNase A and RNase II, respectively) the presence of a 500 base pair band representing dsRNA in the treated bees (RNase A and DNase I resistant, and RNase III sensitive) indicates actual, successful ingestion of the dsRNA–IAPV and its persistence in the bee.

Figure 7:
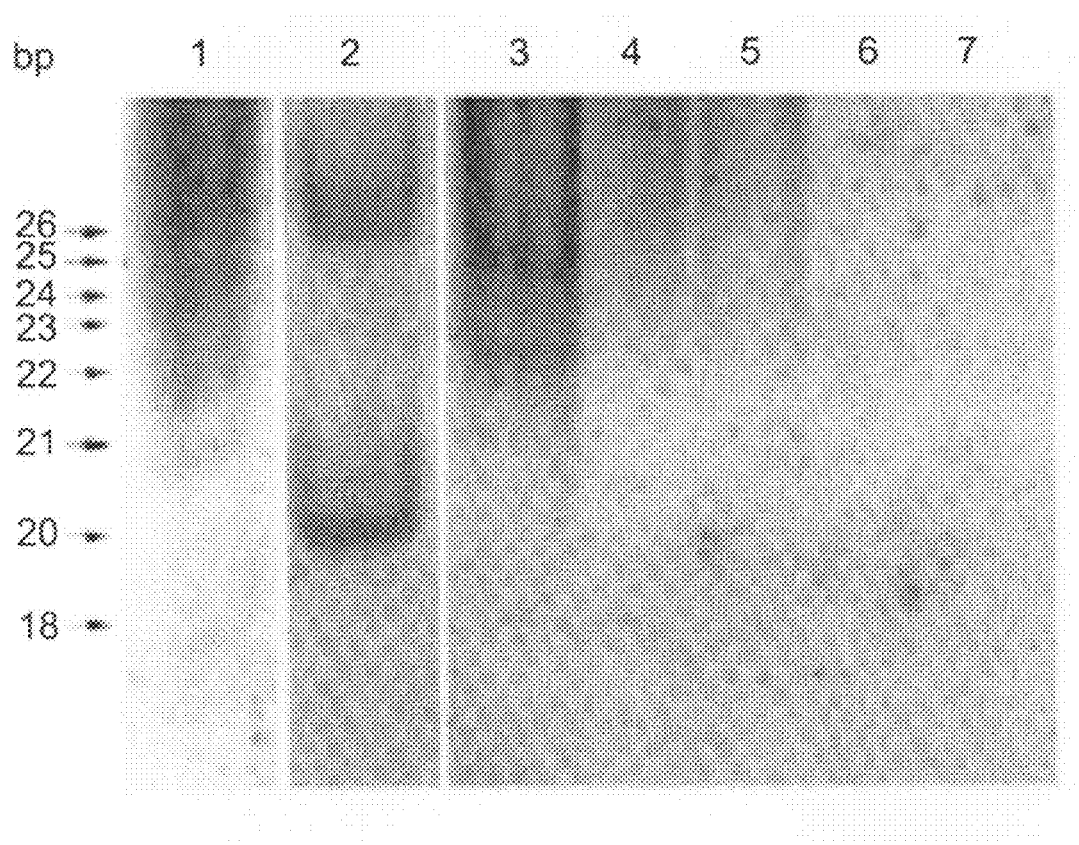
FIG. 7 is a photograph of a PAGE analysis showing the accumulation of IAPV-specific siRNA in bees fed with IAPV-specific dsRNA. Total bee RNA was extracted from dsRNA-fed bees as described herein, separated on PAGE and blotted onto a matrix for detection with a probe representing a segment of a IAPV structural protein. Lane 1: IAPV–dsRNA digested with RNaseIII, resulting in 18- to 26-bp fragments. Lane 2: synthetic primers for IAPV as size markers for 20- and 26-bp fragments. Lane 3: electrophoretic pattern of total RNA extracted from bees fed on IAPVdsRNA. Lane 4: blot of total RNA extracted from bees fed on GFP–dsRNA. Lanes 5 & 6: synthetic IAPV–dsRNA and GFP–dsRNA (respectively). The ca. 400-bp dsRNA was excluded from the siRNA gel. Lane 7: total RNA from untreated bees. Note the presence of IAPV-specific siRNA (21, 22, and 25 bp long) in bees fed on IAPV–dsRNA. Arrows indicate size in bp.

When RNA extracted from dsRNA-IAPV treated, and control bees was separated, blotted and probed for IAPV-specific sequences (see FIG. 7) the presence of small IAPV-specific sequences exclusively in the RNA from dsRNA–IAPV bees (see FIG. 7, lane 3 vs FIG. 7, lanes 4-7) was detected. Thus, ingestion of dsRNA–IAPV initiates an RNAi related pathway, leading to the production of small IAPV specific peptides and the silencing of IAVP reproduction in the treated cells.

Taken together, these results show that IAPV can be silenced in bees by feeding with a segment or segments of IAPV–dsRNA and further indicate the activity of an RNAi-related pathway of silencing. The dsRNA-engendered silencing was sufficient to greatly reduce bee mortality resulting from IAPV infection.

Example III

Large-Scale Field Trials of Viral-Specific dsRNA for Prevention of IAPV-Associated Disease of Honeybees In order to determine the effectiveness of ingested IAPV dsRNA on viral infection under actual field conditions, and to assess effects on important parameters of colony health, bees in sample full size hives were provided with IAPV-specific dsRNA in the feed for 4 days before, and 3 days following infection with IAPV virus.

Materials and Methods

Insect Material:

Pools of five bees from the following treatments; Remote control, IAPV–dsRNA only, IAPV only and IAPV-specific dsRNA+IAPV at each time point day 0—(day of virus application), day 7 and end point (day 42). The test was repeated several times.

RNA Extraction:

RNA extracted using Tri-Reagent (Sigma, USA) according to protocol provided by the manufacturer. All samples treated with DNaseI and resuspended with loading buffer (90% Formamide, 0.05 Bromophenol Blue, 0.05% Xylene cyanol) prior to loading on gel.

Gel Electrophoresis and Blot:

10 ug of freshly prepared RNA was measured using the nanodrop spectrophotometer and loaded on 12% Acrylamide gel (1:19 acrylamide:Bis acrylamide ratio) in danturation environment (gel contains 7M Urea). After electrophoresis samples were transferred to positively charged nylon membrane (Roch, USA) using electrobloting method.

Hybridization and Signal Detection:

Membrane hybridized with freshly prepared DNA probe of IAPV segment, taken from a region that does not correspond to the dsRNA of the IAPV-specific dsRNA itself. This is made using DIG PCR probe preparation Kit (Roch, USA) o/n 42° C. in DIG easyhyb solution (Roch, USA) according to manufacturer protocol. The membrane was washed twice with 2×SSC/0.1% SDS than washed for stringency with 0.1×SSC/ 0.1% SDS in 65° C. Membranes were further washed using DIG Wash and Block Kit (Roch, USA) according to manufacturer protocol. Detection was preformed using CSPD-star substrate (Roch, USA). Positive control was 21nt DNA primers corresponding to the hybridized sequence.

Signal was detected using membrane exposure for 2-12 hours in chemiluminator manufactured by Kodak Results Feeding IAPV–dsRNA to a Hive Does Not Affect Overall Health of the Colony:

Basic parameters of bee colony health (numbers of capped brood, numbers of bees in the hive, returning foragers and honey production) were assessed in hives fed IAPV–dsRNA and control hives, in the absence of infection with IAPV. Table IV presents the results of this comparison.

TABLE IV

Comparison between IAPV-dsRNA-treated and control hives

| | Mean (average) parameters in field trials | | | |
| --- | --- | --- | --- | --- |
| | Capped brood overall (cm$^2$) | Estimated bees in the hive overall | Returning foragers overall | Honey production (kg) |
| Control | 2934 | 5834 | 28.9 | 3.8 |
| IAPV-specific dsRNA (w/o virus) | 3391 | 6781 | 29.5 | 3.5 |
| T-test | p > 0.19 | p > 0.12 | p > 0.68 | p > 0.84 |
| Conclusion | N.S. | N.S. | N.S. | N.S. |

Table IV clearly shows no significant differences between the treated and control hives in any of the measured parameters, indicating that feeding IAPV–dsRNA is benign to the bees and the colony as a whole, in the absence of IAPV infection.

Figure 11A:
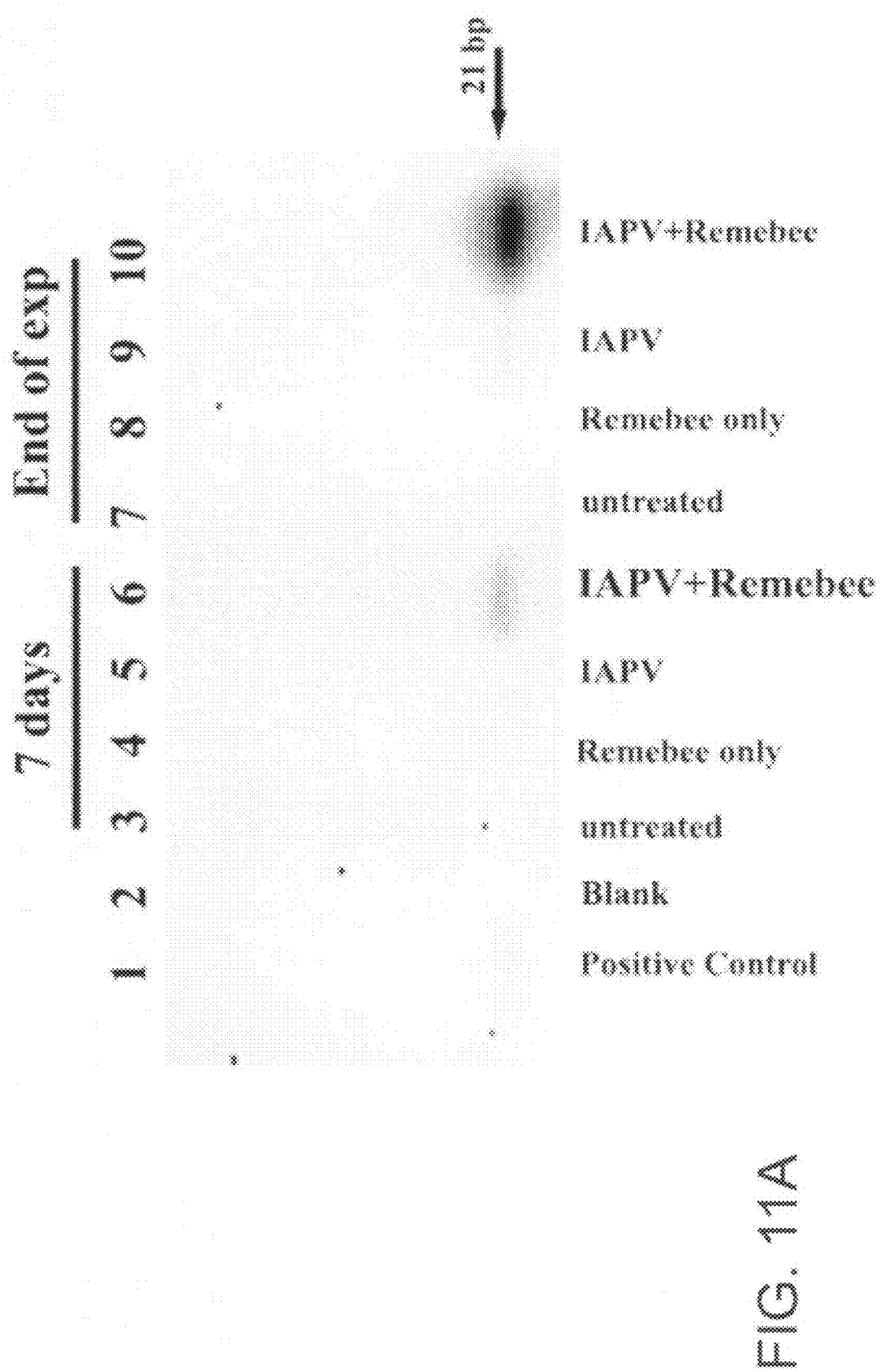
FIGS. 11A-11B are photographs of a PAGE analysis and Southern blot showing the accumulation of IAPV-specific siRNA in bees fed with IAPV-specific dsRNA in a large scale field trial.
Figure 11B:
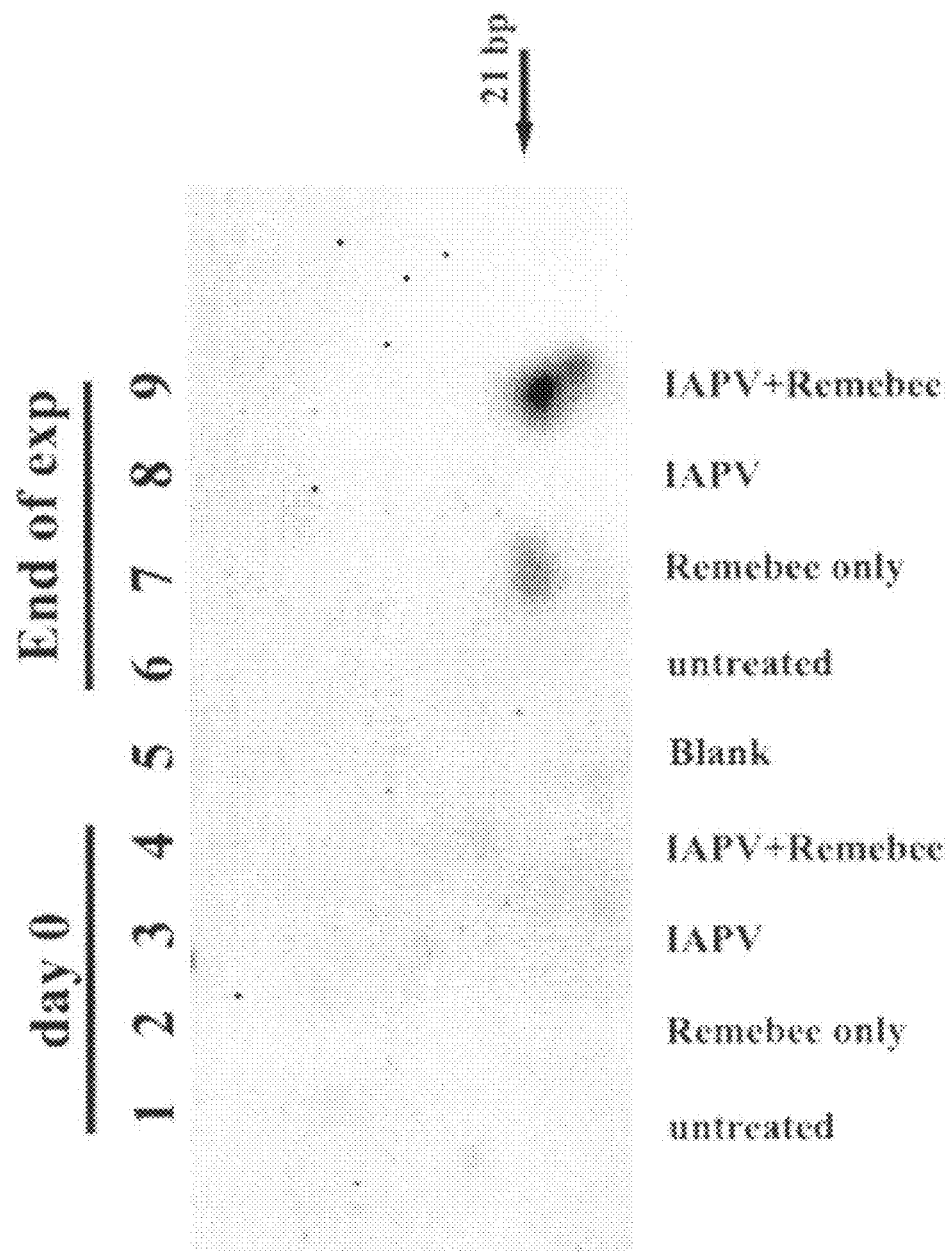
Figure 12:
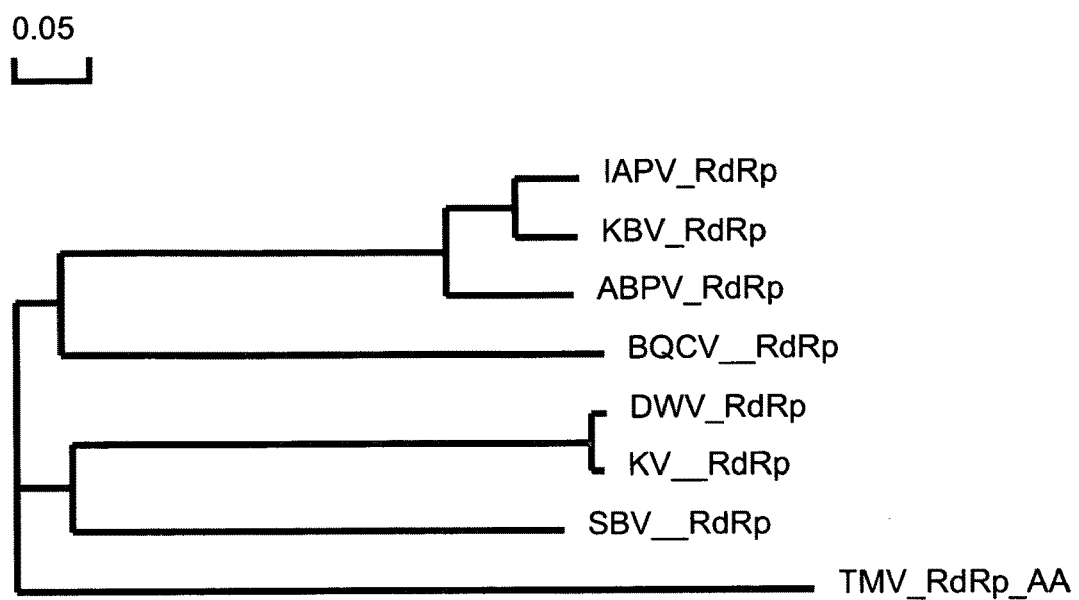
FIG. 12 is a schematic diagram showing the phylogenetic relationship between bee-viruses of the Picornavirus Superfamily.
Figure 13:
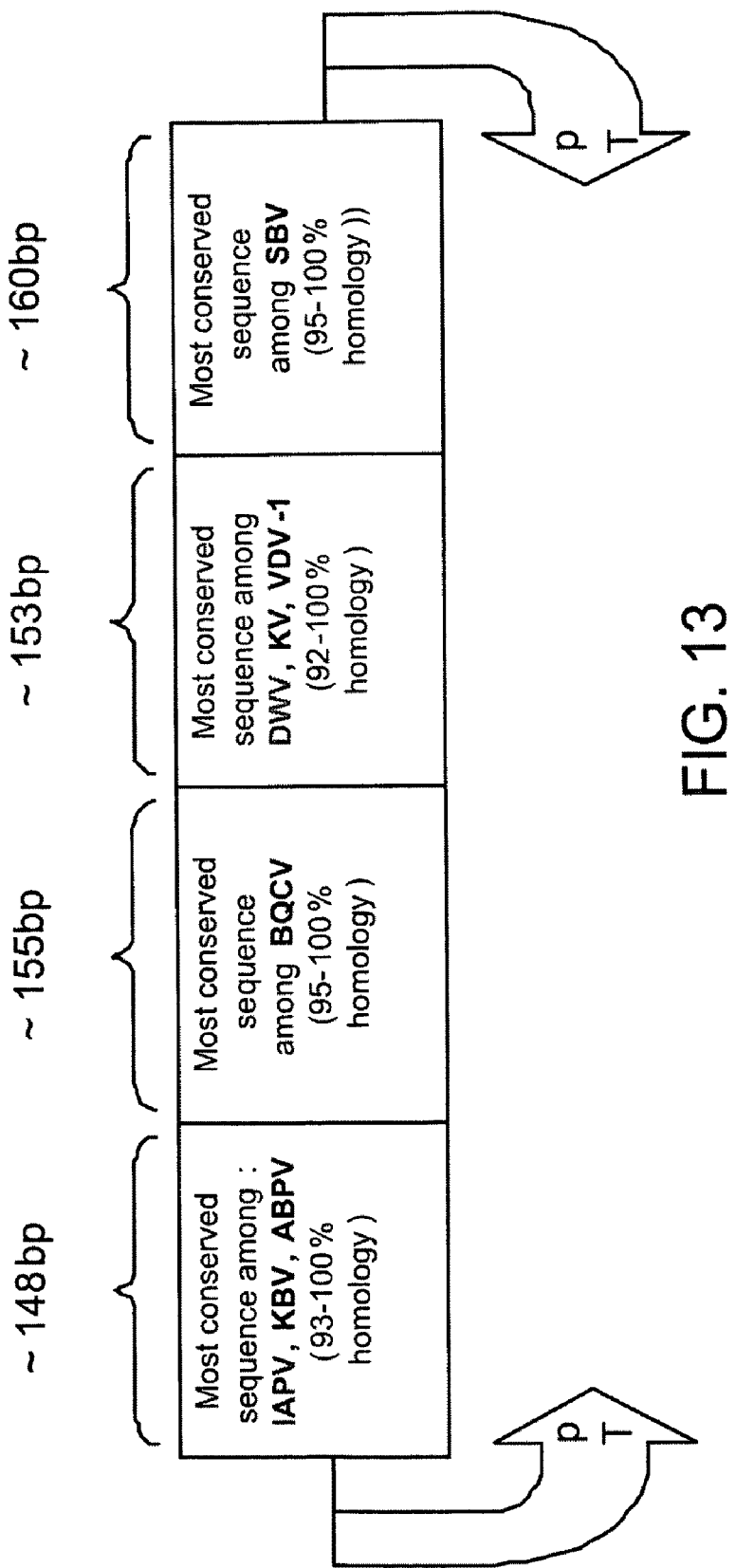
FIG. 13 is a diagrammatic illustration of the sequences comprising the multiple bee-virus resistance nucleic acid construct SEQ ID NO: 24.

Detection of IAPV-Specific siRNAs in Treated Honeybees Under Field Conditions:

FIGS. 11A and 11B show siRNAs specific to IAPV sequence detected by gel electrophoresis and hybridization of honeybee RNA to a IAPV-specific probe. At day 0 no IAPV-specific siRNAs were detected in treated or untreated bees (FIG. 11B). By day 7, IAPV-specific siRNAs were detected exclusively in bees fed IAPV-specific dsRNA and infected with IAPV (FIG. 11A, lane 6). At the end if the experiment, day 42, IAPV-specific siRNA was detected weakly in one sample of RNA from IAPV-infected bees (FIG. 11A, lane 9) and also weakly detected in one sample from bees fed IAPV-specific dsRNA but not infected with IAPV (FIG. 11B, lane 7). In contrast both samples from bees fed IAPV-specific dsRNA and exposed to IAPV (FIG. 11A, lane 10 and FIG. 11B, lane 9) showed a strong signal at 21 bp, indicating greatly increased amounts of IAPV-specific siRNAs. Untreated (remote) control bees (FIG. 11A, lanes 1 and 7, FIG. 11B, lanes 1 and 6) showed no signal throughout the experimental period, indicating an absence of IAPV-specific sequences.

These results indicate that IAPV-specific siRNA is present in bees fed IAPV-specific dsRNA and exposed to IAPV infection only. While not wishing to be limited to a single hypothesis, it is postulated that where IAPV infection is severe, the initial IAPV-specific dsRNA silencing signal is amplified (IAPV-specific dsRNA plus IAPV infection, FIG. 11A lane 10 and FIG. 11B lane 9), the strong presence of siRNAs probably restricts the severity of the disease in the bees leading to a longer life-span.

IAPV–dsRNA Prevents Symptoms of IAPV in IAPV Infected Colonies

After establishing that IAPV-specific dsRNA alone did not make any difference relative to the untreated control, colonies receiving virus only and IAPV-specific dsRNA+ virus were compared to test the efficacy of the treatment in directly preventing the IAPV symptoms.

Figure 8:
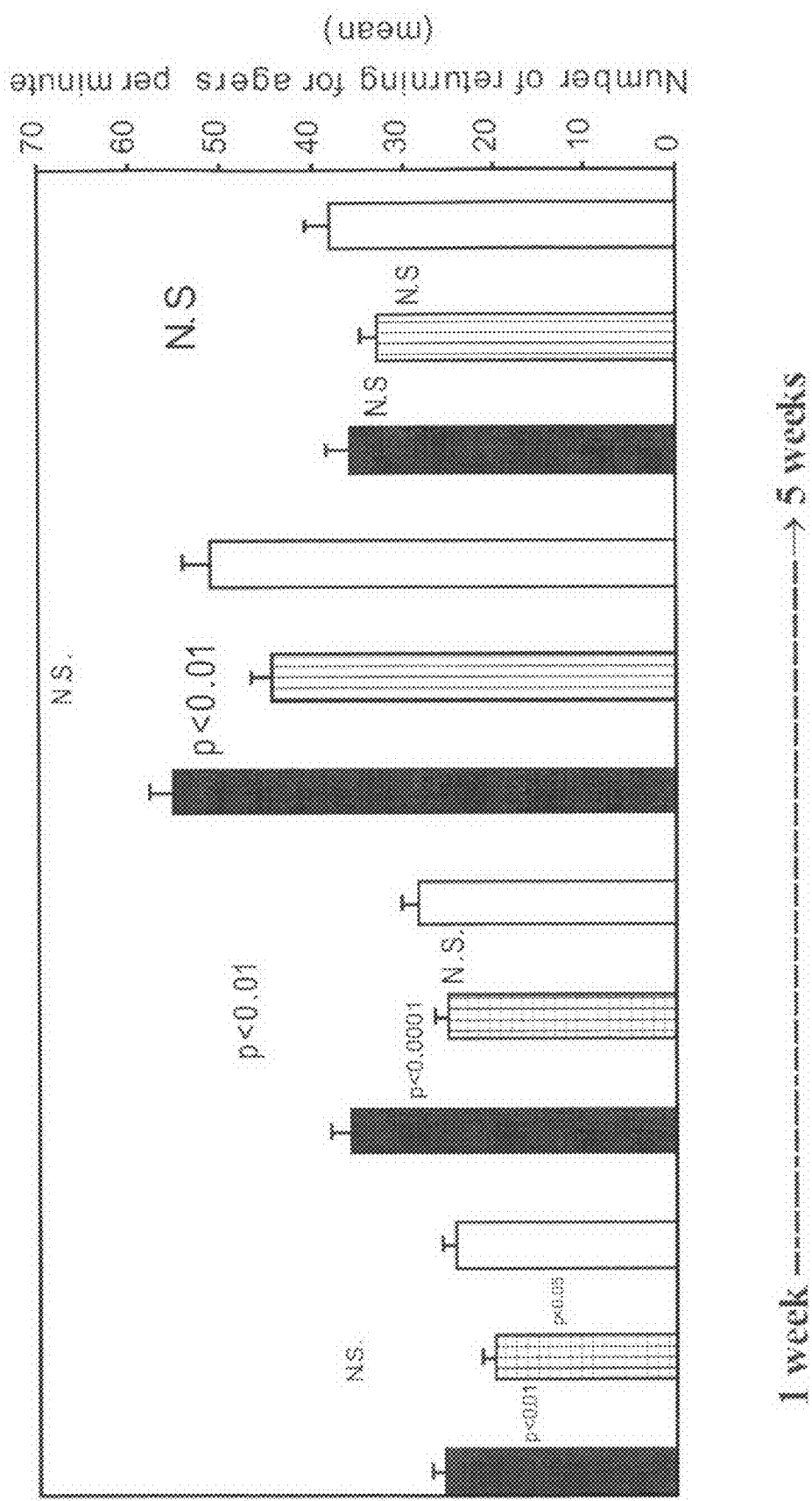
FIG. 8 is a histogram showing increased numbers of returning foragers in IAPV–dsRNA treated hives in large scale field trials. Separate hives received either IAPV alone (white bars), IAPV dsRNA+IAPV (lined bars) or no treatment (controls, black bars). Returning foragers were monitored on several occasions at several times of the day over a period of six weeks. Data is presented from one week following exposure to virus to 5 weeks after exposure. Note the progressively significant increase in numbers of returning foragers among the IAPV dsRNA-treated hives as compared with the IAPV-only hives.

Colony Collapse Disorder (CCD) is characterized by thinning of the affected colony due to reduced numbers of returning foragers, with dead bees typically found outside the hive. FIG. 8 shows the effect of feeding IAPV–dsRNA on the numbers of returning foragers in virus-infected colonies. At the beginning of the experiment, a small (insignificant) difference in the numbers of returning foragers can be discerned between the treatments. However, with greater time following IAPV infection the IAPV-specific dsRNA+IAPV treated colonies showed progressively greater numbers of returning foragers, as compared to the other colonies. Without wishing to be limited to a single hypothesis, the initial differences in the numbers of returning foragers observed in the first week can be attributed to the death of foragers in the weeks following infection with IAPV.

Figure 9:
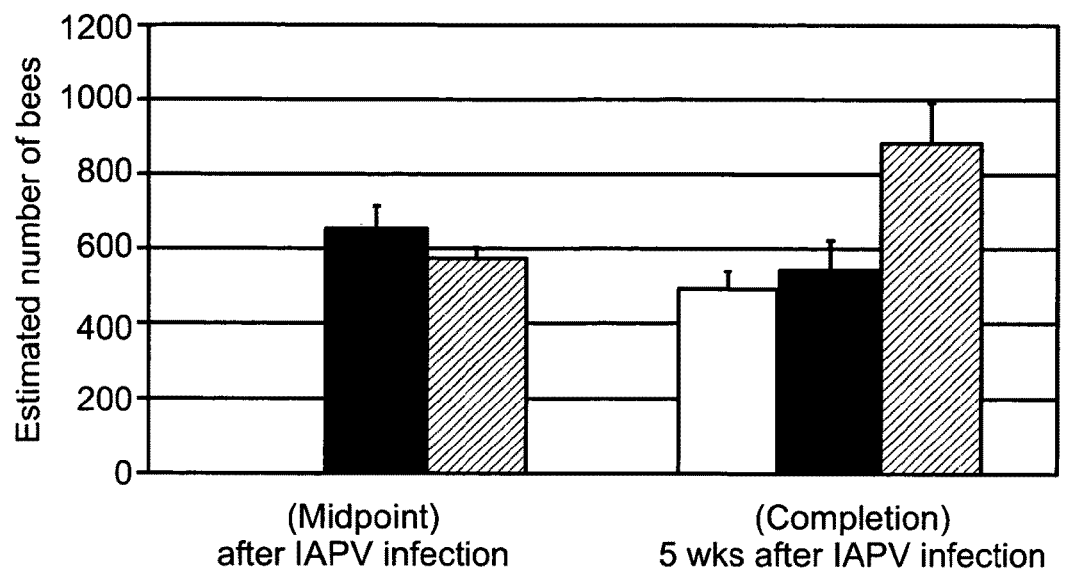
FIG. 9 is a histogram showing the effect of IAPV dsRNA on numbers of bees in the hive following IAPV infection in large scale field trails. Separate hives received either IAPV alone (white bars), IAPV dsRNA+IAPV (diagonal shaded bars) or no treatment (controls, black bars). Numbers of bees per hive was estimated at the mid-point (May 13) and at the end of the experiment (June 10). Note the significantly greater numbers of bees in the IAPV dsRNA-treated hives at the conclusion of the trial.

Another important parameter characteristic of CCD is a reduction in the total number of bees in the hive. FIG. 9 shows that although mid-point analysis of the field trial hives shows no difference in the estimated number of bees in the hives between treated and non-treated colonies, the advantages of IAPV specific-dsRNA were clearly evident by the end point of the trial. FIG. 9 shows that, at 5 weeks following IAPV infection, the estimated number of bees in the uninfected control and IAPV remained insignificantly different, whereas colonies receiving IAPV-specific dsRNA were significantly more populated (p<0.01).

Honey production of a hive reflects not only by the numbers of bees in the colony, but their overall health and robustness. Flight activity data was correlated with honey production in the treated and control colonies.

Figure 10:
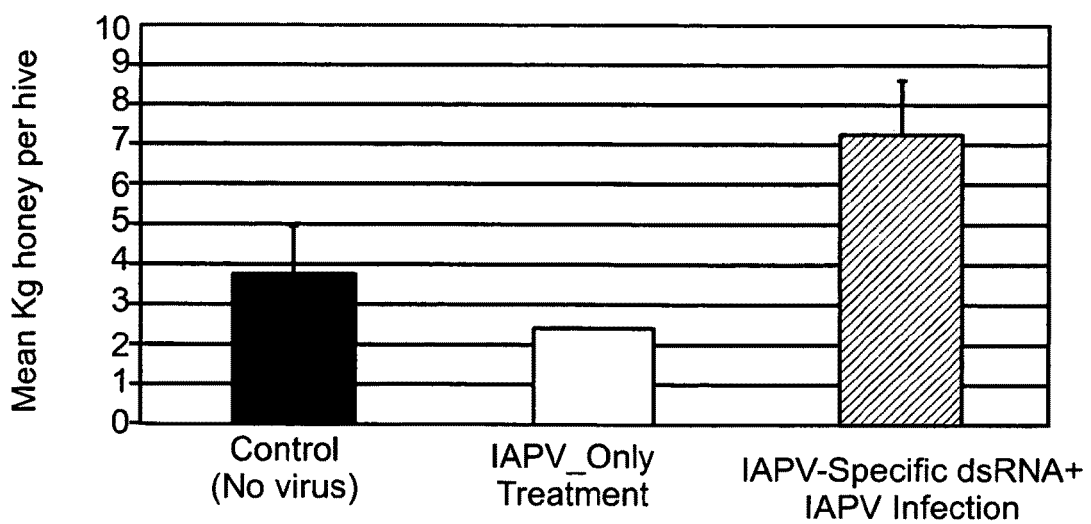
FIG. 10 is a histogram showing the effect of IAPV dsRNA on honey production in hives following IAPV infection in large scale field trails. Separate hives received either IAPV alone (white bar), IAPV dsRNA+IAPV (diagonal shaded bars) or no treatment (controls, black bar). Amount of honey (in Kg) per hive was weighed with a portable scale at the end of the experiment 6 weeks following IAPV infection. Note the significantly greater honey production in hives treated with IAPV–dsRNA+IAPV, as compared to untreated IAPV-infected and uninfected control hives.

When compared between IAPV-specific dsRNA and control colonies, flight activity data correlated strongly with honey production. FIG. 10 shows that IAPV-specific dsRNA+IAPV treated hives produced approximately three times more honey than IAPV-infected only hives and nearly twice the amount of honey of the uninfected control hives.

Further, the number of hives producing significant honey was much greater in the IAPV-specific dsRNA than those in the untreated virus-infected colonies. Moreover, none (0%) of the IAPV-specific dsRNA treated colonies died during the experiment, compared to four dead out of 20 (20%) of the untreated, virus infected colonies and one dead out of 20 (5%) control colonies.

Taken together, these results show that silencing of IAPV in bees by feeding with a segment or segments of IAPV-dsRNA is effective in preventing symptoms of IAVP in infected colonies, resulting in greater viability of the bee colonies and surprisingly improved honey yields.

Example IV

Multiple Bee-Virus Resistance Sequence

In order to enhance the efficacy of the use of a nucleic acid agent in reducing susceptibility of the bees and bee colonies to viral pathogens, bee-viral sequences were compared for sequence homology, and a composite nucleic acid agent, comprising multiple bee-virus sequences was designed.

FIG. 12 shows the phylogenetic relationship between several bee viruses whose genomes have been fully sequenced: Acute bee paralysis virus (ABPV)—GenBank AF150629 (SEQ ID NO: 3), Kashmir bee virus (KBV)—GenBank AY275710 (SEQ ID NO: 9), Sacbrood virus (SBV)—GenBank NC_002066 (SEQ ID NO: 2), Black queen cell virus (BQCV)—GenBank AF183905 (SEQ ID NO: 1), Kakugo virus (KV)—GenBank AB070959 (SEQ ID NO: 4), Deformed wing virus (DWV)—GenBank AJ489744 (SEQ ID NO: 53) and Israel acute paralysis virus (IAPV)—GenBank EF219380 (SEQ ID NO: 6). Sequences from IAPV having high homology to ABPV GenBank AF150629 (SEQ ID NO: 3) and KBV AY275710 (SEQ ID NO: 9) were identified by alignment of the viral genomes. Sequences from DWV having high homology to KV GenBank AB070959 (SEQ ID NO: 4) and VDV-1 GenBank AY251269 (SEQ ID NO: 5) were also identified by alignment of the viral genomes. To these, sequences from the BQCV genome (SEQ ID NO: 1) and SBV genome (SEQ ID NO: 2) were added, and a composite nucleic acid construct having high sequence homology to all of the abovementioned bee viruses (with added pT7 viral sequences) was produced (SEQ ID NO: 24, FIG. 13).

Table V shows the primers useful for creating multiple bee-virus resistance dsRNA:

TABLE V

Primers used for multiple bee-virus resistance dsRNA

| Primers & Purpose (5'-3') | SEQ ID | Amplified sequence | Product size (bp) |
|---|---|---|---|
| IAPV/ABPV/KBV homology | | | |
| F: AAGAAATCAACCTTTCATGATG (59° C.) | 25 | SEQ ID NO: 47 | 148 |
| R: ATCTCAATGTTGTCAATGAGA (59° C.) | 26 | | |
| BQCV | | | |
| F: CAATACCTATAAAGGGAGTCGCA (60.7° C.) | 27 | SEQ ID NO: 49 | 155 |
| R: TAATAGCGATTGACGGTGGG (60.8° C.) | 28 | | |
| DWV/KV/VDV-1 homology | | | |
| F: ACGTTAATGCGACGATATCAAT (58° C.) | 29 | SEQ ID NO: 50 | 153 |
| R: ATTAAAGATTTCATGTGGAGAGC (57° C.) | 30 | | |
| SBV | | | |
| F: GTTGGAGGCGCGTAATTGC (63.9° C.) | 31 | SEQ ID NO: 51 | 160 |
| R: CATCACTGGACATTTCGTGTAGT (62.9° C.) | 32 | | |

It will be appreciated that feeding bees with a dsRNA comprising this multiple bee-viral homologous sequence will be effective in treating and preventing infection and symptoms of a broad variety of bee-viral infections in affected colonies. Yet further, without being limited to a single hypotheses, it is suggested that the numerous consensus sequences reflecting the high cross-species homology of the multiple bee-virus construct (SEQ ID NO: 24) can be processed (in the cell, by dsRNA processing enzymes) to RNAi effective against many bee viruses, including bee-viruses not yet identified and/or sequenced.

It will be appreciated that multiple bee-pathogen sequences for dsRNA effective in protecting against more than one species or variant can be determined in a similar manner for non-viral bee pathogens, for example, using the sequences of the pathogenic organisms detailed in Table II above. Multiple bee-pathogen sequences can include sequences within a certain class of pathogens (e.g. viruses, bacteria), or even include sequences effective for different and diverse classes of pathogens (e.g, viruses+bacteria+fungi, etc).

Although the invention has been described in conjunction with specific embodiments thereof, it is evident that many alternatives, modifications and variations will be apparent to those skilled in the art. Accordingly, it is intended to embrace all such alternatives, modifications and variations that fall within the spirit and broad scope of the appended claims.

All publications, patents and patent applications mentioned in this specification are herein incorporated in their entirety by reference into the specification, to the same extent as if each individual publication, patent or patent application was specifically and individually indicated to be incorporated herein by reference. In addition, citation or identification of any reference in this application shall not be construed as an admission that such reference is available as prior art to the present invention. To the extent that section headings are used, they should not be construed as necessarily limiting.

CD-ROM Content

The following lists the file content of the CD-ROMs which are enclosed herewith and filed with the application. File information is provided as: File name/byte size/date of creation/operating system/machine format.

CD-ROM1 (1 file):

1. 43740_ST25/11.1 MB/Sunday, 3 Aug., 2008/Notepad/PC.

CD-ROM2 (1 file):

1. 43740_ST25/11.1 MB/Sunday, 3 Aug., 2008/Notepad/PC.

CD-ROM3 (1 file):

1. 43740_ST25/11.1 MB/Sunday, 3 Aug., 2008/Notepad/PC.

SEQUENCE LISTING (56822 sequences)

SEQ ID NO: 1 - DNA, 8550 bp, Black queen cell virus
cgcaaaattgcgtatagtatataaaatactatacgcgcttggttgttttcacatatcaagtgggttaaaagccccgtatgcttggagaccaggtttgtttgccgacttacggaatgtcgttaaactctaggctttccggatggcttctaattatccgaggcccgtacgtgggctcgaagtttagtagagagtacgcgtacaaaagtcctagttgttttcatacatcaagtgggttaaaagccccgtgtacttggaggctaggcaacacgattacagtagcctgtactacctgaagcatgtagtaaaactgcacagttgaaaattgtcacaaacgggctgaaagcgtagggctggattgttgagggatagcattctgcgggatgtgaaagaacatgttagacatgtattatggtttttcccaatacgcagtctttgctgtgcgtgtgtaggcaaaaggaagtgagagagctgaccgtctctcatgggtatctaggttattcagagtacgctgctactgcggtagcggacacaacccaggtgttcgggtctctgtcttagaactattattgatggcgaaagttgttaatgggctctctaacgtcactcttaaatggtacgtgtcgattgagtttattgcaatgaatagccaaccctataatgatggaaccaatttacgagaatactaaaactgtaactgaaccaatactttactacccattccgttacaactggaatattaagattcttgacctcacagataaggagggtcaagagagtgtcaataagaagtttttaaggaagtttactaaacttaggaagctttgtttgagacttcaaaaggacactgccttctggaaaaatactagaagtaggttagatatgattcaggatgacatagacaaaatggtcgcacaaagtggccctgttatgagtcagagcttaagtgacagggttgaccgcatgtaccatgagttaatacatacgaatgtcgctcaaatgaatttctctataccgttttcacataatttgtccaaggattcaaaggcgtttcttactcaaacagtagacacttctcttgatggtatgaagcagatttctaatgaaacagtgaataccattaaggaagtgttcgaaacgtttttgactaaaatgacgactacatttgaacaatgtgcagaagctcattgtaaaattaaaagcttctgcacattgttcaaatgtagtcgtcattttaacaatgtgcaggaagcttttaattttacaatgagctttatgagatttttagctttggcttatgccatctttttcctcatttcacgagcaactaagttctttggagcgtcattttctacgatatctactgttctgataactcttattactatgacagtaactgacaagttagttaagaaatttttggtcgattactactcaaaacacatggaaaatgctaaaatgttagcccaagcaggagaggaagactcgtcttttctatcctacgtcattcccccattgtttttagaatcagttgtagatacaaaatctaacttgtttaagaggatttggaagagtaaagacctggaccttgttgttaagaggttgtcgtattttggtgatgctaaaatatacaatgcctttgacaatataggcacgtggttgactacgatgatcaacaagacagtaaattatgtaaaggttacactcttgggccatgatcctgaagaatttttggagaatcagagtgaccctctggtggattgggaagagcagtgcaggaaacatttcgtttcagacactgatagaatagcgatctatacagagtccacgttagcggacattaaacgtctgtacaatatgggcgttagttatatgcggcatcctctgtataaaccccaccagcgtgttatttctgagattctgaatcagttactcaggtttgctgataagatcaaaaagaaggtaggcacggatgcttctgttcgaaatcccccagttactctatatttatatggagaaacaggagtaggtaaatctactttgacgtatcctttgtgtgccactcttcttaaaaccatctttacaagagaggggaatacagtgatgcttgaatctcttaaacaacattacaaagagatgatatacgtgagagctgcagaacaagagttctgggacggctacacgcagcaattagtcactgtatttgatgatttcaatcagcaagttgattcttccgcaaacccaagtttggagttatttgaaattattaggagttctaatatatttccttatccattacacatggcatcgattgaagagaaggctaataccgtttttcaatcaaaggtgatattgtgttcttctaataataagactccaaaaactgaatctctaaattatccgaaggctttgttaagaaggttcgcgaaattcgtcgaagttaagagggctccttctgaaagtggtacattctctactgattgttatactttcgtggaatatgatccatttgaccactgcaacatcgttaaatcaatgtctttcaatgaattgatagatgaggtggttgccatgtatttccacgaaggagagtttgtatcttccgtagataaatttattatggagaatgtatttgctcagggaggaggctctttatcagacgaagaagatgattttattgaagctagttcttatggtgacagtaatctggatgaagccttgacacgtgaagaaaagaaagaaattattgagtgtatcaacgatcaatttaagaatgagaatgatactagaacttccttccagttgattagagactatttccattgtgctaaggactcgttacaagagaaatttttagcttatcgccgaaagtactctttcgacgattggtttagtttctcaaaagcgtccaaagtagtattgggaatactttctctcgtattggttgggtatggcatatattcatatgtcaaaggaaatcctgcaaaagactcagctgaatcctacgagccaaaggtggcgagtaaggccaaggttgagggaagtaatggcgttcccgaggcatatgaatctaaagtcaacagaaagatcaatgttgaagggtataatgcgagagatcttaagcgtaaagtagaggcttatgctcctaaagttaatcgaactgtgcgcgtggaatctagtgaggtgataatacatcctaattctctgatcgagaaaggtgatgatattgtacagtctgaagcatgtagcgatataaatgcttcggaacaactcactgctgttacgactaataacacctatgtaatgactatcttatctaaagaatctgttattagagtggggcactgcatttttctgaaaggaaagattgcagtagctcctggtcattatcttcgtatactccaacgcgcatatgagttagatgacggtgctattttacaatttaatcatccttacggtaagagaaacttctttacgtttatcggtgatatccagttctcgttgtataaaacgaaaaatatatccaaaacgaacgatttggattctcgtgacttgatgcattttgttgttgataagtcagtagttcacagagatatttcttcgtatttctgtgaacgtttagaactgcaatctgttggttctactcgaatccaattacctgttatgcgatgggtaagagatgttggatatattttcgttaagtcgggacaaggtactagttgtataaagaacgtttccaacgttagttatatgactgatactgatcccgacgctcgagaaattcgattgagggaagcatgggagtattctttagaaacaatatctggtgattgcggagctcccctttttgtaaccaatagtaaaataggacctggtaaaattataggaattcacacagctgggggtcatcgattcggagttggcagttgctttgccactccgttttacttagaggacgtgaaagagatcttgtctcggtacgattataaagcacagtcttgtgcttttgagttagtattgcgacaggatcttgaaccatgtgctctacctaaccacttggatgaatgcgaattcatcttgatgggaaaggtaaaggatcctccagttcaaccatctagaagtaaaatatctccatctcccttgtacggacacataactgaaccctctagtgccccaacttggttatatcctagggagcttgatggacagatttttgaccctttaaaatatagaactgctagacttggaaaagatagcgttcctattagaagtaagttaattaatctggccaaaatggctcttatagatgatatatattccgtgtacttgcaaaagaaagatcttttggacggacgatttccatcatcgttgacctttgatcaagcagtgttggggatacctggagaagactatgtcaattcaataaaacgtgatacctcttgcggttatcctttcgttaaggaaggatggacacgagctaaaatcttcggtaacggtgatgaatatgacatgtctacctcgggtgttcaaatgttacgagagaaagtacaggaatgcatagaggcggcgagacaagggaagatattggaccattattttatagatacattaaaggacgaaaggaagcctaaacataaggctcataagtctcgaatgttttctaatggaccaatagattatcttgtttggagtaagatgtattttaatccgatagtagcggtgttgtctgagcttaaaaatgtagaccatatttccgtggggtccaatgtgtattctacggactgggacgttattgcaaggtacttgaagtcgaaatctcaccatatggtggctggagacttcgagggctttgatgcttcggaacagtccgacatattgtacgctgcgggagaggttctgcaagagttgagtaagaaaatctttaactcaactgaggatgagatgttgcaacagagggctatcatccactcgttggtcaattcacttcatatcaatgagaacgggattgttcttcaatggtgcaagtctcttcctagtggccattatctcaccgctattattaattccgtctttgtgaatttggttatgtgtcttgtatttatggaagccaatcaaaaatattcatttacgactgcttcttcatttttccgtgaatgtggtatagtagcatatggagacgaccatgttgtctctgttcccgaaaaatacttgtctgtgtttaatcaacagacactaccagtgttgatgagtaaattcgggatgttctataccatagaaaccaaggatgacacagagattgatttcctttcgaggagattagaggatgtgtcgtacttgaaacggaattttgtttatgacgaatctaggcaacgttatattgctcctctctctttggatgttgtattggaaatgcctatgtggaccaaatccagcaaggacattgtaactaatgtattctgtaatttggaacacgccctcaaggagttatcattgcatgataaagaattgtgggaaaaatggagtcctgtattgcattcaaagagtgaggaagtcctgaaaatggtttcttctctgaaatttcaagatgaggtcagggagattgctcttggcctttcaggttatgagtagttttcttgacttctcttaaaaccaacaatgtgatcttgcttgcggaggcaaaatttgcacagtataaaatctgcaagtagtgctattgttggaatcaccgtacctatttaggtttacgctccaagatcggtggatagcagccctatcaatatctaggagaactgtgctatgtttagaagattaggtagtctctaaacagaacaatttacctgctgaacaaattaatgaaaattatgaaaataaacaacaacttgttgaacagactgaaattaccacctttgaaaacgatttgatagtgcttgaagatggaccgcagatggaagaacctcttccttatgcattccatggacagcatactgataatcgtcaacatacggtggttaatttcttgcaacgtccccaggttattttcgattcgtcttgggcgtctgatctccctcgaaacaaacaatttatggattcgattatgataccagatgatatcatttcttttccaatgtttgcggaaaaactcaaaggattttcttctttgagagcaacagctgtaataacagtgcaatttcagacgcaaccatttcaagcgggaagggtcatgttgggatcatttccattaccaacactcaacccaactagagttaagtttgccaccaatcatgtgtctcgtttaatgcttttaaaccatgtccagtgtgatattgccaaggaaactgaagtatccttacggattccttttgtttctccatacaattcatacgacttggtgtcgaagcgttttccgtgggctaaagtggttggtttggtgtactcacctcttactacgaccattcccgtagattatatagtatacggtcattttgaggacgtggagttgggttgtccaacttcaggaatgttggctcaagcaggtcttaaagtgcaacctcctacgaactctgactctcgacagcgtgccaaagagagtaagggaaagaaggattactctaagacaggcgcagcttttaaacaatctgtttcaaagctgggcgaacatttacctttcctcaaatctggagcgaactgggtcagtgagaacattctacaacctgcagatgaaatcataggacctattttatctctttttgggttctcgaagccccttttgcccattaccaatcccaccgttttacggccagcgaatacctttgctatcactgatacaaatgatatgtcgcatagtctggcgctttctaatgataccaatgtaccatttgttaaggcgctggatggttctggtttggacgaaatgagcttcgattacctgaagaagataccccaattcatacagtcaaaattcttcaccaccacgacaaaacctcaagaggttttgtttcagactaaagtaatgcctcattactttgtcccggctggcgatgtaactgtcgccatggataaagataaaactagaactatttggcaacctagccatttagcctatatcacttccatgtttaagtattggacgggttcgctcgtgtatacattcaaatttgttaaaacagactaccattctggtagggtggagatttctttccaccctttttctgattataccgctaactcctattcggattatacctataggattatagtggatttgagggaaaagtctgagttttcggttacaatacccttcatttctccagtaccatacaaacgcatatctaggccagattgggataaaccttattccaagtacgctcatgctagtacaggaactctggtgttgaaggcgttgacatcgttaaaggcgactaataccgtggtttccaattctgtggaaatcttgatagaagtcaatgctggcgacgatttcaacgttatcgctcctatcgaaaacatcttcttccccttctctctctctccagggaggaaggggatggttgctcaatccaattcggggactgaacaacaaaaccccagaggatcatctttgttaactgatccagaatctattacaaagtctgatccttacaatccgaatatttctctcttgattagtggagaagttttcacgaacttcagaaatttgatcaagagggtaaatttcagaaaggctactacgttgaatggaaaacgtatctcagatacgtttgacatcaacagcctgattgaagcaccccgtcttgatatagcgcaatatgtcgatactgaaacaaaggaggctaaatatggatttagctacttttggtcagctcccactaccttaaacatagtggcggagatgtatgcgctttatcgaggaggagttcgagttaaagtagttactgagaagggtgtagatttcgtcagagctaccgttagtcctcaacagacttatggtagcgatgtcgctcctactactcacatcagtactcctttggcaatagaacaaatacctataaagggagtcgcagagttccaaataccgtactatgctccatgtttgtcatcttcgtttagagcgaattcggaaacattttactatagttcaggtcggaataatctcgatatagccacttcacctcccaccgtcaatcgctattatgcggttggtgcgggagatgatatggacttttccatctttatcggtacgccgccctgtattcatgcatctcagacggcccagtttaccaagataaaacaaggtaaagtgtatgatttgaggtatgatcagtacgacccttttagggaagtccaggacggtacggcgttcctcaatgctcgtagtattgaggatagcgatttgttgtgagctcctttagagggagggctcactttatctattgcttaattcggtaagccacaaatttttctaagtgtcatgagtttcttctcggttcttctcatgattactaatcgaaccgtgtgtagagtcagaatgttgtggtttacgtttcttcttgttgc

SEQ ID NO: 2 - DNA, 8832 bp, Sacbrood virus
tacgaatcgtgattcgattcattatttcgcctgagtaaatcgagatttaccttgacggggtttgcttgacgttgcgtcagacccgttatctttgtgatttttaggttgtgaagatttattcgagtaagtttattaaacgtagagtttataatatagaaagaggcataataagtttattatggacgatatttctcctatgttttatggagatgttagaaataccaaccgattcctcagtagtggaggaatcagaagaaatcagtcttctgaatatagttcacgcgccagaatctataaaaccaagttggaggcgcgtaattgcggagtggaaagattatctacaatccttacctctagtaagaagacatttgatacagtggactcttataccgatttgtttaatggttgggtttctggtatgtttgttgacaagaacgtccactacaccgaaatgtccagtgatgagagtggacgaagaatctggaatgttagacgcgcagtgtcaattaagaccacagaaggaactatagtgtggcgaaaagttattacttcgtacagttgtaaggtagcttcagaactagctgctaagagtatattggtacaatttttaggtcctataaggacccagagtgatgaggtaccctcgaaggaatctattcagggggacgctacacagcagagttccaaggaggagaatacaataattacacgagatcagcaacaaactgtttcggaaaagataccatcaacagttggggatttggtaatagcatcttccgaaccaacgcaacaatttaggagtttaactaaccgttggatgcctattaattcaattagagtaacagtaaatggtaaaaggaatgatcttttggcacaatactatatcccagaagattttctgtcaactcacgctaagtgtgcacccaacactataccatttgagacttacgtgtatggaaaatacgagttggaaatgaagtttgtagctaatggtaataagttccagtgtgggaaagttattatttccgtaaagtttgatagttaccaagcagataatataaatacagggttccaggcagcgttatcgcgaccgcatattatgttagacttgtctaccaataatgagggagttcttaaaataccatttagatatcatcgcgcctttgttaggaaccaaacgcataaaacagctacggcagggataagacccgggaagtttgctagtatctatgtgcaagtgttatcaccgttacaaacaggagagggaggagcgaatgatatgtttatacgacctttttaccgttatacgcgtgctgaatttgcgggaatgtcatacaaagtcccattgacccagatggatgttataggtactttaatatccggggggccaacgccagctcttaaggatattttagtaggtgttgaaagaacactagatcaattgggccgaagtaataatcaagacaaaccgaaggatataagtagtataactataatcccgaaacctcgcttgggttttcctcatgggaaaggtaagagtgatgcagtagctatgcgagtgaacccggtagcattaacatcatttcaagatgtgggtgcttatcctgatgagccgcgcactacgttagatatagctcgtatatggggtttgagaagcacgtttaattggggatcaggagatgatcatgggaaagaattatttaatacagttttggatccaggtttgagattttatgaccaagattatgaagggcaaataacaccgatggaatatgtaactgggttgtataacttttggtcaggaccaatagaattacgttttgattttgtttcgaatgcgtttcatactggaactgtaattatatcagctgagtataatcgatcatctactaatacggatgagtgtcagtcccactcaacttacacaaaaacgttccatttgggagaacaaaaatcagtacattttactgtgccttacatatatgacactgtagtacgcagaaatacggctagcgcctatttaccggttactgattatgataaggtagataatgttagtagggcacaggctatggggattagagcagaatctaaaatgagagtgaaagtgagagtagttaatgttttgaggcccgtagcctccactacttcaactatagaagttttggtatatatgcgaggagggaaaaactacgcattgcatggattaaaacagtcgacttattggccgtcaaatagtgtggtacccatggatagttttccacctgatggctatgatccagttaagccaccaaatagatcaagaagggaggcctctccgaatagtgatggaggtaagggacaacctgaggtggcagtgtcagataatccgcatagatttttgcccgcaaacgtgtctaatcgttggaatgaatattctagcgcttatctgccacgggtacagatggacactggggctaaggaagatgaagatgaaactgcaaacttcagtgatggggttactgcgatgggttttcaatctttggatacccaagtgtcaattaaggatattttgcgtagaccagtgttgttgtttaatcatgtagagttggaccccgattacacaggtttctttatacctataatgccgccttctagaatgatgcaatataaatcaggagataaagaaacatcttttcagcggttaattgggcgtactccccaagcagccataatgaatttattcaggttttggagagggtcattgcgttatactataattatacatagcaccgatggtcaccctatatatgtgacacatgtaccccatacgggaaatagagtgtatggtttaatgaaagttaataatttacacgagtatactaaggttcccatttttgggtgtgggttaacaactgaaatgattattcctagtgtgaacccgagtatatgtgtagaagtaccatttgatacggaaaataattgggccgtgacatttgatgaggacgctcaaaggaattactcatggcgagataaaggggataccgtgaccgggcacttggttgtgacacctgtagtatcagtttatatgtctgtgtgggtagaagctggggatgattttgaggtttctaacttttatgggccaccaagtgtaaagacgaatgattggaactacgcattctctgacgagcatgtacaagttcagatggatgatagtgtagaaagagtttatgatgaagggaaccaagtctattactatccgccccctaaaccagagggttttagtttgaacaatgtacggacttcggttagtacgttgtgtaatatgcttggaaaagtagtaactcctgagagagcaatgaaaacagcgctgtgtgcaactccttattttggatcagcttatatgacagctactaccctagacgctataggtagtatgcagaataccgttacgggagctgcacaccagttgactgcatctgttgatgcgaggttagagcaattgtcagctaaatttggagattcaattgatgtaattactacagcggttaaggaggctataggtaaaatttcttccggtatgttcaatatggttaattatactggttattgtataaacgtgatcttggatatattggtggcatggattgatcgaagttggactgcagtcggagtgggaattattcgattcgtgactaaggttctagggttgggtgcaatttctaaagttatgaatatggccacatcttttgggcagcttatagccagagtatatgaacctccacgcccagttgtgcaggcaccacctcccactgaagctacattaactggagctttggcgggtatactgggtacgcttatgggggtttatatatcaccgttgtctggaggtagttattttaaaaatttgatgctcaggatgactagttcggctgggccttcttatttggtgggggttttacgttttgtcgaggcaacttttaatacagtaaaggatatgacattgaatgctttgggctatgtatctccagaaaatgcggcgctgaaaatgctgtccggaacatcgactacgatacagaattttataactgatgctcagcttattactacagaagctaatgcggcattggtgggacatcctagttttcgagctaagtactggaacacggtaatgcaagcgtatcaaatacaaaagttattattaactgtccctcaatctagcgcctccccaattctatctagattatgtagtgatgttatacgtaatagtaatgaaaagtttattgatatttcatcttcaccggtgcgttatgaaccttttgtaatttgtatcgagggcccagcgggtatagggaaatcggaaatagttgaaaccctggctactgaattattgaagggagttaatttaaaacgaccgcatagtggggctacgtatttccgaatgcctggttctcgattctggtctggttatagggatcaacccgtggtggtttacgatgattgggcgaatttaacggaaccccaagctttaatgcagcaaatatcggaattatatcagcttaaatcaacttctacttttattccggaaatggctcatttagaagaaaagaaaattaggggtaatcccctcatcgtgatattattgtgtaatcacgcttttccagatagtgcagttactaatatgtctcttgaacctagtgcaatttatcgtaggagagatgtgttactgtatgcggaaagaaaaccagaatatgaaggagttagtttgagagatatgagtgttaatgaacaaaccacgtttgctcatttgaatttttataagtataaggattccaccaactcatcttcgtgcacatccaaacccgttggatatgagttaactaaggattggttggttgcgaagtttgctaaatggcacgcgcaggagcaaattaaagtacagagacgtatggagaatatacgagcaggaatgtacgacgctgaggtaggatctttgcgtttggaagatccatttagtttatattactcagtttctagtgaagtcatcgaaaataatgaagatgttacgactgggtttcttcctagtgagattttggcttttgagtgtaagcgtatagcaaatgtgatagatgcccatcagtcctcggtaagggaaattgtgattccagatgagccaaaagatccatttgttactacacagggtgatttggcgggggtatttatgggagctgctttgggtcgagtggtactggaaaaagtttgtagcttttcatcggaacttattaattatgcggttgattggataatcagtaagcataatgtcacccacgagtgttgtgtgtgtaaagagacaaaaggtatctcatggtactgcttggattctgcgcaacttgcacctcaagctacgcattatatgtgtaacagttgtatggttgcatcgcgcgcagcaaaccgagaagtagtccagtgcccgatgtgtaggagtccaaattttgaaagatggggtacgtatcaacagatgacaggaataacgattgtggggcgtgcattaattatgggattgataacagttgataagggagttaatgtattacgtcgaatgttgggaggtacttttggtgctatgtatgcggctataatgcgcatagctgctacacttcacccttcgatgagtgagagaacagcggatttattaaggatgacaggggccttggtagatatgagtgaatatacggtgcgagaactgcaacatgtggttactcaaatggatgatccctttgaatcggatggtgaagatgatgatgttggtacaagtaaggtacattggcgagatattgtaacttttgatttcgaggaagacgtggctcgctcgttgatgcgagagagggaaattactaatataccttgccttcatatattgttggggggtgctttgcatcatgtctcgtatcgtgatggaggttacaacgtacccaatgggggaactatggtgagagtaccggagttgccgtgtacatcagattgttacttttctgatatggaagcatttaaaagttttgcccagcggtacaaagaggaaaagaagattgagatccaatcccatttattaggttttattaacaatcagcactctcaagattattataggaagcgagtcccgcgtattttccagcctcactggatgagagcgaatgaagatttagctttggaaatttctaatattacagcggatggttggtaccagagagtaggtgattcgtttgtgaattatagaactttgatagtggcggctgcgggtttagtgatggcagtggggagtatatttggaatgtataaattcttctctatcggtacgaatccagcgcgtgttgagtttgtacctagtggggatgaaattactagaaacttgaagcgaacaactaggactctgcaaaggacccgaacggagaggcctcactttcaacaagtgaacgaacacccatcccttgattcagtggttaagaagtatgtggctcgtaactatattactattagtttgtataaacccgcggggcgtgtgaagttaaccgcatgcggtatttatggaacagtggcgttattaccgaggcattatgtgcgtgccattaaggaggcttgggaaaagagtgtgaaaataactataactccggcactcttggagcatgaggagcatgtctatacttatgatgctgctgatttcactatatctgagtctacagatttggctatttgggtattgtctccgtcatttggaatgtttaaggatataaggaagtttatagccacagatgaggacctatctaaaccaattactacggaagggtccttgttgttggctccaaccaatcgtaatccagtgcttaaggaacagagtatagagatactgggactacaaaatgaaatgcaagtatctgagttaaatggcacggtattttatgcgaatgatgtaatctgttatgattattcacaacaaggagcttgtggatctttgtgttttttgtcccgctcgcaaagacctattgtgggaatgcattttgctggtcggggcgaaggatcctgtggagaaggttatggagttattttaactaaagaagccattggggacattttagcacttaagtcccaacctgtagtgcagttagaagattgggaaggacccagtttagaagaagcaaaaataattttacctgaaactaatgtgtcttatattggggcggtgacaaaggagcaaactccttacctccccaggaaaacgaagataaggccaagtcttattcagaatgttggtgaccttcacccagtgtcagaaccgtgtatattggataaaacggatcccagataccaacatgatgatactcctctagtagcggggtgtaagaaacatggaaggcttactgtggattttggtactactagagtagaaagtgctaaggaagctctttgggatggatggctatcgaaaatgaaacccctggtagtaaaacctaagttattaacgcccgaggaggctgctagtggttttccagatatacagtactatgatcctatgattctcaacaccagcgcgggttttccttatgtggcaacagaaaagaagcgtaaagaagattatatagtatttgagcgcaatgagaacgagcaaccgattggtgccactatagatcctggtgttttggaggagatgaagcgaaaatctgagttgagaaagcaaggggtgcagcctattacgccttttattgatacacttaaggatgaaaggaaattaccagaaaaagtacgaaagtatggtggaacccgagtgttttgtaaccctcctatcgattatattgtatcaatgaggcaatattatatgcactttgttgctgcatttatggaacagcgttttaagctaatgcatgcagtgggaattaatgttcagagtacagagtggacgcttttagcttctaagttgctagcgaaagggaataacatttgcaccattgattattcaaattttggtccgggttttaatgctcaaatagcgaaagctgctatggaattaatggtgcggtggactatggagcatgttgagggcgtaaacgagatagaggcgtatactttattacatgagtgtttaaattcggttcacttagtgtctaatacgctgtaccaacaaaagtgtggatcacctagtggcgcgcccattactgtagtgataaatactttggttaatattttatatatattcgtagcttgggagacgttagtaggaagtaaagaacgagggcaaacttgggaatcctttaaacaaaatgtagaattgttttgctatggtgatgatttaataatgtcagtaacagataaatataaggatgtttttaacgcattaacaataagtcaatttttggcacaatatggaatagtagccactgatgcaaataaaggagacgaagttgaggcttatacgacgttgttaaatagtacgtttttaaaacatgggtttcatccccacgaagtgtatccgcatttgtggcaatctgcgctggcttggagttctatcaatgatactacacaatggatatgggaatgtgctgacttgaagctggctactagggagaattgtcgagccgctctgtatcaagcgcatggtcatggaagcgtcgtttacaataagtttaagcaacaagtaaaccaagcattaattaagcggaaaatacaaccaattgctttatcttggaaagaaattgatgatttattttatcctgaaattagttattagtgttttttaaggtctcatataagctataaaggttatgggtactaatatagtggattaatatcgatatatggcatttt

SEQ ID NO: 3 - DNA, 9491 bp, Acute bee paralysis virus
cccgtcaaaataacaacttataacacgatgttacccgaagaaaccattttagtgtaacatttaagattagaagtagttcatctaatagagataggcactattagaaggaggccttttctaaaggagccgttagtcagcccagacaagcgcagtactttagaagagagaagttccccgatagcgaccgaaaagacgcgttttccgtgctaactaatttaaatgtgggaacgaatattattattgaaattatgtgagccacgtagcaatcaagtcatgtttttgtcactacgtttactcatctaatgtagataattttgtttaagtacctatttaggtgtcatcccaccagagaagaaataatacgtaccggaacccagagtacaccccttattttaagccttactgggcttctctgttagttagtaatctggcccacgttttgcgttgagtggggtcccaacagtaggaattcgacggacaagtagcaagcgagtcggtaccaattggtttagccttcgaaattactctgggcaggaagttactaaacgagaactttctgcttaaatcccaacgcacaaacaaatagagtaaataaataattataatgaattttacaaagcaaccagcaagtctcaaatatttatcaagcatgaaacttataacttcacaagaccaagatttctttaactttggagaagtttcacgagaatttatattggaacaggcatacgtcaatggatacgatttccacatgctacatcaagacatgaattgtataggattcgtactatcaatttttgatgaagatgctagagatgagtatgaatacaaagatctgaattgtgaatatcatgagaatttatttgatgcagtagtagattctgaatttgataaaatttggccacacttggttttgaaatatataacatattatccatgtagtttgaattggaggggtatgccaactatacctattgtttatgtttcaaaacatttttggtatgaattgtatagaactggttttttaaacaagttatatcattgtggctcatggactgacatattgttgttgttgtctggagatgtagaaaccaatccaggacctgttgaaacgtataaagacttatgcagaaggaaaaatattcgtaagagaaaatctcgaattcgagaagaaatcaaaatgcaacaacatattgataagataatagggcaggagaatgaagagtataagattataaacgtcaatatgcagggaatctttagttttaatgaagaaaaagaaataattaaaagtacggcttggaaattcaatagcactctagacaaaacaaattctataatagacaatttaataccccaattagaagaaactttagcaggtttcagaaaaacatattcaaaatgtgaatcaaaaatttttggtactataagtgtggttgatgtgtgtgtagatttgattagtgctttattacaagttagttttgctaaaccagcaatgaagatagcttcattagcagtagaagtttttagattaattaagaaatatgttagcaatattaatatcaatatcgataagattaaagaattgttatcttatggtaaggtagctcttaacaataataatccaattattcatgtaacaatgcaatctaattctcccattcttgaagttttattacaacccaacattatagttagcgccatatttatagcattaagcgtagtgttccacaaaaaatttacctacaaaaaactgggaattgaagcaatgattaaaagacttggagatttgggaagagcagccaaaggctgttcagatttgaatgtggtgctcaaccaggctataaccaaccacatgttagaacattttgggaagaatgttcttggtttaaaacaagaagatgaactcaaagtcctagtggaaggatatagaaattggtgtgatgaagtcagagatttagtaggacataaaatcaattcagatggggaattagacagcaaaagtatcgttgaaaatataatgaaggatgtttatgagatacaaagaattgagaatatgtataagaaaggtttggagatttctcgtaacatagctgaattaaagttaccaacaaaattaacaattagttttaatacgcacatgagatacttgactgaagttttcaaatcagttgacacatctggagcttttggaaacaaacctcgaacgcaaccaatagttatttggctttttggagaatcaggaagaggaaaatcggggatgacttggcctctagcaatagatctaaataacagcttacttgataatgtagatgaaatgaggaatttttcaaagaacatctatatgagaaatgttgaacaggaattctgggataattatcaaggacaaaatattgtatgtyatgatgattttggacaaatgagggattcatcatctaaccctaaccctgaatttatggagttaatacgtacagctaacatagctccataccccttacacatggctcacctcgaagataaaaggaaaacaaaattcacatcaaaagtaatcattatgacatctaatgtttttgaacaggatgttaattcactaacatttccagatgcatttaggagaagagtagatttgtgcgctgaggtaaagaataaagatgaatttacaaaaatgtgctggtctaaatcagcaggaaaaatggttcagagattagataagggaaaggttaagaaaataacaggagatattcattcaacagtaccatacattgttgatctgattgatccagaaagcggggaagtgtataagactggattagaatatgaagaatttctcgatatgtgtctagaaaagactagtcaatgtagagatgattctgcaaaattaaatgattttttaatggattatgcagagaaaagagcaaatagaagcagagaaattgatgaagtttgcgcacgtactatggatgaagcttttgttgacgcatatgatgacgtcatcgatgtaaacatgcaaattgaaacagttgatgaaatggaactgattgaacccaacaaattaagagagatgatagaacaatgctcaaataagatagtatacacgtatgaaggaatagctgttaaaataacatcattagcatttaaactagccacactaaactacgaagaacaatgggaacagattaaggaaatgaaatattatgttaaagtgagttcaggtgtgaactatcttaaaagagtgttaagtcagggtatgaaagtgtgtgaagaatggatgaaagaaatgattaactacgttaaggaacatccatggatgaccgttagtttaatactgggcactctcattggaatacttactgttgtagggttttggaaatggttatgtagtggcgataaaaagaagaatccgataaaaagacattttattaatacaggcaatgttctaatcttacccgatagagaattaaacaccttttggaaaaatcaagaatcattggacttaagggatatgtatattaatcgagttgaagaacacataattagcctattgaaattgcaacataaagtagtcttagttccaaaagttactaagtatattcttacaactgttgagaaccatgctaaaatatcagataaaatcattttgattacaagaaatagatatttgaattaccagggcaagtttgttgaattgatttgtggagaaattaatcaattcttcattgacccggaaacattagataccaacgtggaagcttttgcttcagctgatcttaagacatttgtacaaaggaaacctattgtcattgaaggacctgaatttgtagaggcacaaacatcaggagatcagattacattaaggaaacaaacacaaaaagtcatagaggcattcgctagttcagatgcaatcacaatggctcgcaaaacaccaaagtttgttgagagtgatgatgtggtcgaagtttcaatgcaaatgtggaaagatcaagttgcgcaaaagttgataactaaccgagttttaacaaacctgtataaaatttgtttagttaaggagaatggtgatatggtaccgctgctaaatggtttgtttgttcgttcaaacataatgttagcccctggacacttagtgggtttcttatcagatagtgatacaattgaaataagaaatctatttgatgtagttttcagagtaccatggaaagacgtgaagaaagttgacgtagtaaacgccttcggtgagagcaaagaagcggttttgttatgttttccgaaatttgtatgtcaacacacggatttggtgaagcattttcaagattcagaatctatgtcaaaattcaaaagatgtgaggtcactcttccagtgttgagatattcagataaaatgaatagatttttagcaacattaatagaatgtgacaaagttgaagcttatgatagaccatacactttaaatgactcatcaaaaggacaatatatattaagacaaggattggaatacaccatgccaacaacaaatggggattgtggtgcaccattagtaattaatgaaacccaagttatacgtaaaatagctggaattcatgttgctggtgatgcccgaggaaaagcttatgcagaatcaataagtcaaaaagatttaataagagctttttctaaaattgacgttagtatgcagattcaattggacctagatcagacattgaattttaaccaacagcagavaataataccaccaaacgcagaattcggacctgaggatttagatttttgcgatttgccttcacttaaaatgataccagtgggtagattgagtgaacctttgttcgaacctggtaagacagacatacgaccttccctggtatatggaaaaatctcagaaattaagacaaaacccgccatcctaagaaatgtgatagtggatggaaaaattgttaatataaaacataaaaacttgaagaaatgcgccatggacacaccctatgtgtcaaaagaaatgactgaagaagcttttcagttagttaaatcagtctggttaaagggaatgcgtaatgaattgaagaaagttttgacttatgaggaagctatttgtggaaatgattcaagtgaatttatatcagcaataaatagatctagttcaccgggtttcccatggatacgcgatagaattaaaggaactaaagggaagcaaggttggtttggtgcggaaggcgaatatattctggatgaagatgtctttgaagcggttaaaacacgtattcagaatgcaaagaatggtgtgagaacacctgtaatgtgggtggatacattaaaggatgagagaagaccaattgaaaaagtagatcaactgaaaacacgtgtgttttctaatgggcctatggacttttctatcacttttagaatgtactatttgggcttcatagcacaccttatggaaaatcgaataaccaatgaagtatccataggaactaatgtttattcccaagattggaataagacagttagaaaacttaaaactatgggacccaaggttattgcaggagatttctcaacctttgatggatctttgaatgtttgcattatggaaaaatttgctgacctagcgaatgaattttatgatgacggatcagagaatgcattaattcgacatgttttgcttatggatgtatataactcaacacacatttgtggtgattccgtatatatgatgacacacagtcaaccctctggtaatccggcaacaacacctctaaattgtttcataaacagtatgggcttgcgaatggtctttgaactttgttcaaagaaatattccgcccttaacggaacaaaatgctatgtaatgaaagacttttctaagcatgtaagtatagtttcttatggagatgataatgttattaactttagtgatgaagttagtgaatggttcaacatggaaactattactgaagcttttgagaagttagggtttacgtatactgacgaacttaaaggcaagaatggagaagtaccaaaatggcgaactattgaagatgtgcaatatctcaaaaggaaatttcgatatgattctaaacggaaagtatgggaagcgccattgtgtatggacacaatactggaaatgcctaattggtgtcgaggaagtctcgacattcaagaaggaactaaagttaattgtgaaaatgcaattatggagctttctatgcatgaggaatatgtatttgataagtggtccaaagtgatttctaaggcctatcagaaggccactggagattgtttggatatcagtacatataatggttatgctcaggagagattcctaaattactacttgtaatttgggaatcgcaacacaacatggttacccatagattgaggaaatttccaataaactcagtattaaggcttgttgtgttggacaaggtgccctatttagggtgaggagccttactggcagccccagtgaatcctccattggataggaacagctatattgggtagttgtagcagttgtattcaaatgaatgcagcgttccgaaatatcatacctgccgatcaagaaacaaatacttccaacgtacataatacgcaactcgcgtcgacctctgaagaaaactcagttgaaacggaacaaatcaccacctttcatgatgtggaaactccaaataggatcaatacccccatggctcaagacacttcatcggctcggagcatggatgatacgcacagtattattcagtttttacaacgccccgtactcattgaccacattgaggtcattgctggatcaacagcagatgataacaaacccctcaatagatatgtgttaaatcgacagaatccacaaccatttgttaaatcttggacattgccttcagtagttttaagtgctggaggtaagggacaaaaattagctaattttaaatatttacgatgtgatgttaaagtcaaaattgttctaaacgcaaatcctttcatagctggaagattatacttagcatattcaccttatgatgaccgagtggacccagcgcgttcaattttaaacacctcacgagctggagttacgggataccctggaatagagattgattttcaattagataattccgtagaaatgaccataccatacgcttcttttcaagaagcatatgatttagtcacaggtactgaagattttgtcaagctatatctatttacaataacgcccatattatccccgactagcacatctgctagttcaaaggtggacctttcagtttatatgtggttggataatatttccttagtcatacccacgtatcgcgttaacacgagcatcgtaccaaatgtggggactgttgttcagacagtacaaaatatgactacacgagacagtgaaacaattaggaaagcaatggttgcattaaggaaaaataataaatcaacttacgactatatagtgcaagctttatcttctgcagttccagaagttaagaatgtaactatgcagatcaattccaagaaaaataattccaataaaatggcaacacctgttaaggaaaaaacaaaaaatatacccaaaccaaagactgaaaatccgaagattggaccaatatcagaactagccacaggagtcaacaaggtggcgaatggtattgagagaatacctgtgattggagagatggcaaaacctgtaacttcaacaattaaatgggttgctgacaagattggatctgtggcagcaatttttggatggtcgaaacccagaaatctagaacaagttaatttatatcagaatgttcctggatggggttattcactctataagggaatagataatagtgtgccattggcttttgaccccaataacgaactaggtgatttgagagatgtatttccttctggagttgatgaaatggcgataggatatgtttgtggcaatcctgctgttaaacatgtgctatcttggaatactacggataaagttcaagcaccaataagtaatggagatgactggggaggagtgatacctgttggtatgccatgttattctaaaatcatacggacaacagagaacgatacgacacggactaatactgaaattatggatcctgccccttgtgaatatgtttgcaatatgttttcatattggcgagctactatgtgctatcgtatagctatagttaaaacagcttttcacactggtaggttaggaattttcttcggacctggtaagattccaataacgacgacgaaagataatatttccccggacttgactcagttagatggaattaaagcgccttctgataacaattacaaatacatcttggatctaactaatgatacggagatcaccataagggtaccttttgtttcaaacaaaatgttcatgaaatctacgggaatttatggtggaaattctgaaaataattgggatttctctgaatcatttactggatttttgtgcataagacctattacaaaatttatgtgtccagagactgtatccaataatgtgtcgatagttgtatggaagtgggctgaagatgtggtagtagtagaacctaagcctttactttcaggaccaacgcaagtgtttcaaccacctgtaacatctgcagattctatcaataccatagatgcttcaatgcaaattaacttagcaaataaagctgatgaaaatgtagttacattctttgattctgatgatgctgaagaaaggaacatggaagcattattgaaaggaagtggtgaacaaatcatgaatttgagatccttactaagaacgtttaggaccatatcagaaaattggaatttaccacctaacacaaaaacagcaataacagatttgactgacgttgcggataaagaaggtagggattatatgtcttatttatcatacatctatagattctatagaggagggagaagatataagtttttcaatacaacagctttgaaacaatctcaaacttgctatgttcgtagcttcttaataccgcgatattatactgctgataacacaaacaacgatggaccttcacatataacatatccagttcttaatccagttcatgaagtagaagtaccatactattgtcaatataggaaattaccagtagcatctacaaccgacaaagggtatgatgcatctttgatgtattattctaatgttggtaccaatcaaattgttgctcgagctggtaatgatgatttcacttttggatggctcataggaacaccgcaaactcaaggaataacgagaacggaaactaaataaatgaatgaagatgtactttagaggacagacataccctcttttgtatggctatagtctaaatttttcagataatttcaatttggaccgaaaaaccgagcaataggagcactatggttcgagaagacattataagacaaactcactagatggagggcttataattataagcttcttgacataatctaaccattgcgtcaaaatttcgaattagtaaattaaaaaaaaaaaaaaaaaaaaa

SEQ ID NO: 4 - DNA, 10152 bp, Kakugo virus
gaattctagggcgatttatgccttccatagcgaattacggtgcaactaacaattttagatagtagccatgaacaaacattatagtagctcactacgtattgatcatttttataatgacttgcgtagyatgaagcgctgcttgtagttgtaactatgttaytttgcaagttggagtttactattttggattatgaatatgtgcacttagtgtctgtatttatagtcgtttgtggttcaaggttttgtgttagtagtacatttatgtatgaatgtacctttagtatgaatgttatagaatgacaatatcgaaggaaaaatctttataaaatacaaaaatattgttttwattacttcgatatggtgttttatagagtagattgccatgtgaccgctcatagaagtccattatggtttatcaatcgaagttgaatgtatttataagaatattatacttaattagtaatattagtagtccgtaactattatcatccttttttacagtttgatgtgataatagaccactgcagtatcgagtagagtttcgaatgcgtagtgcaatagtacaatcactgtcaccgaccatctattgtaatgatagatctgtcggaaaccattatttatgaagtgactagcaatcatggattaaattagatggtattctagtttagaggtgattcggcgctgcggtgcgactgaaacttctaaattagcatgtcagattgtattatgaatgcgttagtagtaatttctgcgatagagctgggacccctcagtctctcaggtattgtatgaggcgaaagtgtgaaagttttgtatatgtttttatatatacgactgtatcgggaattcctttagcaagaatccttttaatacagtataatttgtgctacggtacgttacgttcgcagggcacccgttaatgtctcatagcccagacgatggcggatggaaagacatcatattttattttaatgctgtctttattgctgatttattttgctgtttttatttgctattttatatttgctaattttcattattgcgaaatatattacattgctatttttattatatacgctagattcaattttatttatcctatattttcaatttaattttgattttgaaggtaaatatatataattaattattagaaatggcctttagttgtggaactctctcttactctgccgtcacccaagctccgtctgtcgcctatgcacctcgtacatgggaagttgatgaagctaggcggcgccgagttattaaacgtttggcgctggagcaagaacgtattcgtaatgttcttgacgttgacgtctataaccaggcgacatgggaacaggaagacgtgcgcgataacgagttcctaacggaacaactaaacaatttatatactatttattccatcgctgaacgttgtacgcgccggcctatcaaagagtgctctcccatatcagtttcgaataggttcgccccattggaatcccttaaggtcgaaattggtcaagaagcaagcgaatgtatatttaagaaacctaaatatacgcgcgtttgcaagaaagtgaagcgtgttgcaactcgcttcgttcgcgaaaaagttgttcgtcctatgtgtcccagatcccctatgctattgtttaagcttaagaaaattatttatgatttgcatttatataggttaagaaaacagattaggatgttgagacgtcaaaaacagcgcgattatgaattagagtgtgtcactaatctgttacaattatcgaatccggtgcaggcaaaaccagagatggataaccctaatccaggacctgatggcgagggtgaagttgaattagaaaaagatagtaacgttgttttaacaactcagcgagatcctagtacatctattccagcgccggtgagcgtaaaatggagtagatggactagtaatgatgtagtagatgattacgccacaatcacatctcgatggtatcagattgctgaatttgtttggtcgaaggatgatccatttgataaggagttagcacgtttaattttgcctcgtgctttgttatctagtatagaggctaattctgatgctatatgtgatgtgcctaatactattccatttaaggtacccgcatattggcgaggcgatatggaagttagagttcaaattagttctaataaattccaagttggtcaattacaagctacttggtattattcggatcatgagaatttgaacatatcgtctaagagaagcgtttatggattttcacaaatggatcatgctttgattagtgcgtcagcaagtaatgaagcaaaattagttattccgttcaagcatgtttatccatttttaccgacaagaattgtgccagattggactactggcattttagatatgggtgctttgaacattcgtgtaattgctcccttacggatgagtgctactggtccaactacctgtaatgtcgtcgtgtttattaaattaaataacagcgagtttacagggacttcttctggtaagctttatgcgagtcaaatcagggcaaaacctgagrtggatcgtatattaaatttggcagagggattgctaaataacacgattggtggtaacaatatggataatccttcttatcaacaatctcctcgtcattttgtcccgactggtatgcacagtttagctttaggtactaatttagttgaaccattacatgcattacgtttggatgcggctggtacgacacaacatcctgtaggttgtgctcctgatgaagatatgactgtatcatccatagcatctcgatatggactaattagacagatacaatggaagaaagatcatgctaaaggatcacttttgttacagttagatgctgatccatttgtggagcaaagaattgaaggtacgaatccgatatctctgtattggttcgcacccgtgggtgtagtatctagtatgtttatgcaatggcgtggttcattagaatataggtttgatattatagcatcccaatttcatactggtaggttaattgtaggttatgtgcctggtttgacagcatctttacaacagcaaatggactatatgaagttgaagtcatcaagttatgtagtatttgatttacaagaaagtaatagctttacttttgaggtgccatatgtttcatacagaccatggtgggtgcgtaagtatggtggcaattatttaccctcgtcaactgacgctcctagcacattatttatgtatgtgcaggttccgttgatacctatggaagctgtttcagatactattgatatcaatgtgtacgtacggggcggtagttcatttgaagtttgtgttccagtccaacctagtttaggtttgaattggaatacagactttattttacgtaatgacgaagaatatagggctaagacaggttatgcaccatattatgctggagtatggcatagcttcaataatagtaactctcttgtttttaggtggggatctgcttctgatcaaattgctcagtggccaacaatttcagtaccaagaggtgagctagctttcttacgmattarggatggaaagcragctgctgtaggaactcaaccttggcgtacgatggttgtttggccttctggtcatggttataatattggtatacctacgtataatgctgaacgagctcgccagcttgcacagcatttatatggtggtggatcattaactgacgagaaggccaaacaattatttgttcctgctaatcaacaaggacctggtactgtaagtaatggaaatccagtatgggaagtcatgcgtgcaccattggcaacacaacgtgcgcatgttcaagattttgaatttattgaagctattccagaaggagaggagtctcgtaatactacagtcttggatacgaccactactttacagtcgagcggatttggtcgcgccttctttggagaagcttttaatgaccttaaaacgttaatgcgacgatatcaattatatggtcaattattattgtccgttactacggataaggatattgatcattgtatgtttaccttcccttgtttaccacaagggttagcgttagacattggttctgctggctctccacatgaaatctttaatagatgtcgtgatggtattataccattaattgcatctggatatagattttatagaggagayttgcgttataagattgtttttccaagtaatgttaatagcaacatttgggtacaacatcgaccggatcgtagrctggaaggatggtctgcggctaagattgtaaattgtgatgctgtgtctactggtcaaggggtgtataatcatggttatgctagtcacattcaaatcacgcgtgtaaataatgttatagaattggaagtcccattttataatgctacttgttacaattatttacaggcgtttaatgcgtctagcgctgcatctagttatgcagtatctttaggagaaatatcggttggttttcaagctacaagtgatgatattgcatctattgtyaacaaacctgtcactatttattatagtataggagatggtatgcaattttctcagtgggttggatatcaaccgatgatgatcctagaccagcttcctgcaccagtagtaagggccgtgcctgagggccctattgcgaagattaaaaacttcttccatcaaacagctgacgaggttagagaagctcaggcagcaaagatgcgtgaagatatgggtatggttgtccaagatgttattggagaacttagccaggccataccggatcttcaacaaccagaggttcaagcaaatgtcttctcactggtgtctcagttagtgcatgctattataggtactagtttaaagacagttgcttgggcgattgtttcgatttttgtgactttaggattaattggacgcgaaatgatgcattcagttattactgtagtcaagcggttacttgagaaatatcacttggcgacgcaaccccaggaatccgccagttcaagtactgttatatctgccgttccagaagctcccaatgctgaagcggaggaggcaagtgcttgggtatccattatttataatggtgtgtgtaatatgcttaatgtggctgctcaaaaaccgaaacaatttaaagattgggtaaaattagctactgtagattttagtaataattgtagaggtagtaatcaggtatttgtatttttcaagaatacatttgaagtgttgaagaaaatgtggggttatgtattttgtcagagtaatcctgcagcgcgtttgttgaaagctgtgaatgacgagcctgagattttgaaagcatgggtgaaggaatgtctgtatttggatgatcccaaatttagaatgcgtcgagcgcatgatcaagagtatatcgagagagtgtttgcggcacattcatatggacaaattttgctacatgatttaactgctgaaatgaatcaatcacgaaatttgagtgtgtttacacgtgtgtatgatcaaatttcaaaattgaagactgatcttatggaaatgggatcgaatccatatataaggcgtgaatgttttacgatatgcatgtgtggtgcatctggaattggaaaatcatatttgaccgattctttatgcagcgagctcttacgtgcgagtcgtactcctgtgacaacaggcataaaatgtgttgttaatccattatctgattattgggatcartgtgattttcagcctgttttgtgcgttgacgatatgtggagtgttgaaacatctactacgctygataagcagttgaayatgcttttycaggtccattcccctatcgtgctttctcctcctaaagctgatttagaaggcaagaaaatgcgatataacccggaaatattcatatacaatacgaataaacctttcccgaggtttgatcgtattgctatggaagctatttatcggcgtagaaatgttttgattgaatgcaaagcgagtgaagagaagaagcgagggtgcaagcattgtgagaatgatattcctattgctgaatgtagtcctaagatgttgaaagattttcatcatattaagtttaggtatgcacatgatgtatgtaattccgagaccacatggtctgaatggatgacgtataatgaatttcttgaatggataactcctgtgtatatggctaatcgtcgtaaggcgaatgaatcatttaagatgcgtgtggatgaaatgcaaatgttgcgtatggatgaaccattggaaggtgataatattctcaataagtacgttgaagtcaatcagcgcttagtggaggaaatgaaagcatttaaggagcgtacactatggtcagatttacatcgcgtaggtgcggaaattagtgcgtcagttaagaaagctttaccaaccatttccataactgaaaaactaccacattggactgttcaatgtggtattgctaaacctgagatggatcatgcttatgaggttatgagttcgtatgcagctggaatgaatgcagagattgaagcgcatgaacaagttcggcgttcatcagtggaatgtcaatatgcagagcctcaagctccaagaaaccctgatgacgaaggaccaactatagatgaagaacttatgggagacactgaatttacatcacaggctctagaacgtcttgtggatgaaggttatataactggaaaacagaagaaatacatagccacgtggtgtagtaagcgtcgtgaacatactgctgactttgatcttgtgtggactgataatttgcgtgtgttaagtgcgtatgtgcatgaacgttcagcttcaactcggctttctacggatgacgtcaagttatataaaacaattagtatgttgcatcaaaagtatgataccacagagtgtgctaagtgtcaacattggtatgctccgttgactgatatctatgttgatgacaagaaattgttttggtgtcagaaagagaaaaagacacttattgatgtccgaaaattgtcgaaagaagatgtgactgttcaatcaaaattgattaatttgtctgttccatgtggtgaagtgtgtatgttacattcaaaatatttcaattatcttttccataaagcatggttgtttgagaacccaacttggcgcctaatatataatggtactaagaagggtatgcccgagtactttatgaattgtgtggatgaaatttcattagattccaaatttggtaaagtgaaagtgtggttgcaagcgatcattgataagtatttaacccgtcccgtgaaaatgattcgtgattttcttttcaagtggtggccgcaagttgcgtatgtgttgagcttgctaggtataattggtataacagcgtatgaaatgagaaatccgaaaccaacttctgagcaattagctgatcattatgtaaataggcattgtagctctgatttttggtcaccagggttggcatcacctcaaggattgaaatatagtgaagcagtaacagcaaaggcacctagaattcatagattgccagttactactaagcctcagggatcaacacaacaagtagatgctgctgtgaataaaattttacaaaacatggtttacattggtgttgttttcccaaaagtgcctggtagtaagtggcgagatattaattttaggtgtcttatgcttcataataggcaatgtttaatgttgaggcattatattgagtcaactgccgcctttcctgagggaaccaagtactattttaagtatattcataatcaagagactagaatgtctggtgatatttctggtattgaaattgatttgttgaatttgcctagattgtattatggtggtctcgcgggagaggagtcatttgatagcaatatygtgcttgtgactatgcctaatcgtattcctgagtgtaagagcattattaaatttatagcgtcacataatgaacatatacgtgctcagaatgatggagtgttagtaactggcgaccatactcagctgttggctttcgagaataataataaaactccaataagtatcaacgctgatggtttgtatgaggttatacttcaaggagtatatacttatccataccatggcgatggtgtttgtggttcgatattgttgtctcggaatttacaacggccgattataggtatccatgttgctggtactgaaggattgcatggctttggagttgctgaaccacttgtacatgaaatgttcactggtaaagcaatcgagagtgaaagagagccgtatgatcgtgtgtatgaacttccgttgcgtgaattagatgaatctgatattggtttagatactgatttatatccaattggtagagtggatgcaaagctagctcatgctcaaagcccttctactgggattaaaaagacgcttatccatggaacatttgatgtaaggactgaaccaaatccgatgtcatcacgtgatccaagaayagcaccgcacgatcctttgaagttagggtgtgaaaagcatggcatgccctgttcaccgtttaataggaaacatctggaattagcgacaaatcatttgaaagaaaaattagtttcagtagttaaaccaataaatggttgcaagattagaagtttgcaagatgctgtatgtggtgtgcctggtttagatgggtttgattcaatatcttggaatactagtgctggttttcctttgtcttcattaaagccacctggagcatcaggtaagcgatggttgtttgacattgagctacaagactcgggatgttatctcttgcgtggaatgcgtcccgaacttgagattcaattatcaacgacacagttaatgaggaaaaagggaataaaacctcacactatattcacggattgtttgaaagatacttgtttgcctgtagaaaaatgtagaatacctggtaagactagaatatttagtataagtccagtacagtttactataccgtttagacagtattatttagattttatggcatcctatcgagctgcacgccttaatgctgagcatggtataggtattgatgttaatagcttagaatggacaaatttggcaacaagtttgtcaaagtatggcactcatatcgtgacgggtgactataagaattttggccctggattagattccgatgttgcagcttcggcgttcgaaattattatcgattgggtattacattatactgaagaagataataaagacgaaatgaagcgagtaatgtggaccatggcgcaagagattttagcgcctagtcatctatgtcgtgatttagtgtaccgggtaccttgtggaattccatcaggttctccgataacggacattttaaatacaatttcaaattgtctgttaattaggttagcttggttaggtattactgatttgcctttatccgagttctctcaaaatgttgttcttgtttgttatggtgatgatcttatcatgaatgttagtgataacatgattgataaatttaatgctgtaacaatagggaaattcttttcacaatatgagatggtatttacggatcaggacaaatcaggaaatactgtgaagtggcggacgttacagactgctactttcttgaagcatgggtttttaaaacatccaactagacctgtgtttctggctaacctagacaaggtttcggtagaaggaacgacgaattggacccatgctcgaggattgggtcgtcgtgcagcaaccatagagaatgctaaacaagcgctagagttagcattcggatggggtccagaatactttaactatgtcagaaatactattaaaatggcttttgacaagttgggtatttatgaagaccttatcacatgggaagaaatggatgttagatgttatgctagcgcgtagtatttaattttaaatacttattagttttaattttattttaggttattggaattgagggaagtaccaccccccaagaccttcgttttaaatctactaaaaggagtggacctatatataagagcctgaagacagagtggattagaccaccatttttagcttatatatgggaaaggttgagttgcctctaaagactcagctccatagtagagtagttttaattacgattaaagtggtactctaggttaggtgttactcgcgtattatcaactagtggtaatgcgtcctaattttagtatagttttaaccataatagt

SEQ ID NO: 5 - DNA, 10112 bp, Varroa destructor virus 1
gcatagcgaattacggtgcaactaacaattttagatagtagccatgaacaaacattatgattactcactacgtattgatcatttttacaatgacttgcgtagcatgaagcgcatgcttgtagttataactatgttattttgcaagttggagataattgtattggattatggatgcgtgcactaagtgtctacatctatagtcgtttgtggttcaagtttttgtgttagtagtacaatcttgaagaatgtaagtatcgtatgaatgatatttgaatgacaacactgaagtataaaatatataaaatccaaaaatatttttaatcttattcagtgtagtgtttgatagagtagaatgccatgtgaccgctcaaaggagtccattatggtatatcattcgaagtcgaatacttgtgtatagttattgtattttattagtaatattagcagtccgtaactatcataatcctattatagtttgattatatgatagaccactgcagtatcgagtagagtttagaaagagtagtgcaatagtaagatcactgtcaccgaccactcattgtaatagtgaggtttgtcggaaaccagttattgtgcagcgactagcaatcgtgaatcaatatagttggtattctaaatatgagacgattcggcgattttattgcgactgaaatttcatatttagcatgtcaggtcttattatgaatgctcgagtatttatttttgcggtagagtagggacccctctatctctcaggtactgtatgaggcgaaagtgtgaaagtaatttatgtctctatacataagtgactgtatcgggatttcctttggcaagaatccttttaattcagtataatttatgctacggtacgttacgttcgcagggcacccgttaatgtcacatagcccagacgatgacgaatggaaagacattactttttattttaatgctacgattattgctgttttattttgctgtttttatttgttattatattttgctattttattattgctaaatatatttctttactatttttgctttatatattagattcaattctttttattttatattttcaatttgattttgattttgaaggtaaatatatataaaaatggcatttagttgtggaactctttcttatgctgctgttgcccaagctccctctgtagctcatgctccccgtagttgggagattgatgaagctaggcgtcgacgcgttatcaagcgtttggcgttggaacaggaacggattcgaaacgttcttgatgtcactgtgtatgatcatacaacgtgggagcaagaggatgcgcgtgataatgagttccttatggaacaattgaataatttatatacgatatattctatagctgaaagatgtacccgccgccctgttcaagaacatgtccccatttcaatcagtaatagatattcccctttagaatcccttaagattgaggtaggaaaagacgcgggtgagttcgtatttaagaaacccaaatatacaaagatttgtaagaaagtgaaacgggtggcatcaaaatttgtgcgcgagaaagttgttaggcccgtttgtaatcgatcgcccatgttattatttaaaattaagaaagtaatatatgatctacatttgtatcggttacggaaacaagttcggcttctcagacgcgaaaaacagcgtgaatacgagttagagtgtgttactagtttgctacagctatctaatcctgtttcagctaaacctgagatggacaatcctaatcctggtccagatggtgaaggtgaagttgaattagaaaaggatagtaatgtagtattaactacacaacgtgatcctagcacctctattcctgctccaactagtgtgaagtggagtagatggactagtaatgatgttgtggatgattatgccactataacttcgcgttggtatcagattgccgaatttgtgtggtcaaaggatgatccatttgataaggaattggcgcgcttaattttacctcgagctttgttatctagtattgaggctaattctgacgctatttgtgatgtacctaatactattccgtttaaggtacatgcatattggcgtggagatatggaagttcgagtgcagattaactcgaataaattccaggttggtcaattacaggcaacttggtactattcggatcatgaaaatttgaatatccagacgaagcgaagtgtgtatggtttttcgcatatggatcatgctttgattagcgcatcagcgagtaatgaagcaaaattagtgataccttttaaacacgtatatccattcttaccaacgcgtgtcgttcctgattggacaactggtattcttgatatgggtaccttaaatattcgtgtaattgctccactacgtatgagtgcgacgggaccaaccacttgtaatgttgtagtatttattaagttaaataatagtgaattcactggcacttcttctggtaagttttacgcgaatcaaatcagggcaaaacctgaaatggaccgtgtgttaaatttggcagaaggattactaaataataccgtaggtggttgtaatatggataatccgtcatatcagcaatctccgcgtcattttgttcctactggtatgcatagtttagctttaggcactaatttagtagagcctttgcatgcattacgattagatgcatcaggtacaacacaacatccagttgggtgtgcgcctgatgaagatatgactgtatcttccattgcatcacgatatggtttaattcgccaagtgcaatggaagaaagaccatgcgaaaggatcattattattacaacttgatgctgatcctttcgttgaacagaaaattgagggaaccaatccaatttctttgtattggtttgctccggttggagtcgtatctagtatgtttatgcaatggagaggttctttagaatatagatttgatattatagcttcccaatttcatacgggtaggttaattgtaggttatgttcctggactgactgcttctttacaacgtcaaatggactatatgaaattgaagtcatctagttatgtggtgtttgatttacaggaaagtaatagttttacgtttgaagtgccctatgtgtcatacagaccgtggtgggtgcgtaagtatggtggtaattatctgccatcttctactgatgcgcctagcacactgtttatgtatgtacaagtaccattgatacctatggaagctgtttctgatactatagatatcaatgtgtatgtgcgtggtggcagttcgtttgaggtttgtgttccagtccaacctagtttaggtttgaactggaatacagatttcatattacgtaatgatgaggagtaccgcgcaaagaatggatatgcaccgtattatgctggtgtgtggcatagcttcaataatagtaattcgcttgtttttagatggggttcggcttcagatcaaattgctcaatggccaacaataacagtgcctcgaggagagttggcattcttgcgtatccgcgatgctaagcaagctgctgtaggaacgcaaccttggcgtactatggtcgtttggccttcaggtcatggatataatattggaataccaacttataatgctgaacgagcaagacaacttgctcagcatttgtatggtggtgggtctttgacagatgaaaaggctaagcaattatttgtgcctgctaaccagcaaggacccggcaaagtaagtaatggtaaccccgtctgggaagtaatgcgcgcgcctcttgcaactcagcaagcgcatatacaagattttgaatttgttgaagctgttccagaaggcgaagaatcacgcaacactacggtgttagacacgacaacaacgttacagtctagcggatttggtcgcgctttcttcggtgaggcatttaacgatcttaagacgttaatgcgccgataccaattatatggtcaattattgttatccgttactacggataaggatattgatcattgtatgtttaccttcccttgtttacctcaagggttagcgttagatataggttcggctggatctcctcatgaaatatttaatcgctgccgtgatggtatcattccattgatagcgtcagggtatcggttttatcgaggcgatttacggttcaaaattgttttcccaagtaacgttaatagcaatatttgggtacaacatcgaccagatcgtagactgaaaggatggtctgaagcgaaaatagtaaactgtgatgctgtatctactggacaaggtgtttataatcatggatatgctagtcatattcagattacgcgtgtaaataatgttatagaattggaagtcccgttttataacgctacgtgctataattatttgcaagcgtttaacccatctagtgcagcgtcgagttatgccgtttcgctcggagagatttcggttggttttcaggctactagtgatgacattgcagccatagttaataaacctgtaactatatattacagtattggcgatggtatgcagttttcgcagtgggttggttatcaaccaatgatgattctagatcaattgccagcaccagtagttagggctgtgcctgagggccctatagcgaagataaagaattttttccaccaaacggcagatgaagttcgagaagctcaggccgcaaagatgcgtgaagatatgggtatagtagtccaggacgttataggagagttaagtcaggctatacccgatcttcaacaaccggaagttcaagcgaatgttttttctctggtgtcacagttagtgcatgctatcatcggtactagccttaagacagttgcttgggcgattgtttcgatttttgtaactttaggtttgattggacgtgaaatgatgcattcagtcataactgtagttaagcggttattagaaaaatatcacttggcgacgcaaccccaggaatccgccaattcaggtacggttatttccgctattccagaagcacccaatgctgaagcagaggaggccagtgcctgggtatccattatttataatggtgtgtgtaatatgttgaatgtagccgctcaaaaaccgaaacaatttaaagattgggtaaaattagctaccgtagattttagtaataattgtagaggtagtaatcaggtatttgtgtttttcaagaatacgtttgaagtgttgaagaaaatgtggggttatgtgttttgtcagagtaatcctgcagcgcgactcttgaaagcagtgaatgatgaacctgagattttaaaagcgtgggttaaagaatgtctgtatttagatgatcctaaatttagaatgcgacgtgcgcatgatcaagagtatattgagagagtgtttgcggcccattcgtatggacaaattttattgcatgacttaacggctgaaatgaatcaatcgcgtaatttaagtgtgtttacgagagtgtatgatcaaatatctaaattgaagacggatctcatggaaatgggatcaaacccatatatcaggcgtgaatgctttacgatttgtatgtgtggtgcatctggaattggtaagtcttatttaactgattctttatgcagcgagctcttacgtgcgagtcgtactccagtgacaacgggcattaagtgtgtcgtgaaccctttgtctgattattgggatcagtgtgattttcagcccgttttatgtgttgatgacatgtggagtgttgaaacgtctactacgctcgataaacagttaaatatgctatttcaggttcattcaccaattgtactttcacctcctaaagctgatttagaaggtaagaaaatgcgttataatcctgaaatattcatatataatacgaataaaccttttccgaggtttgatcgtatagctatggaagctatttatcgacgtagaaacgttttaattgaatgtaaggctaatgaagagaagaagcgtggatgtaaacattgtgagaataatatacccattgctgaatgtagtccaaaaattttgaaagattttcatcacattaaatttcgttatgctcatgatgtgtgtaattctgaaactacgtggtctgagtggatgtcgtataatgaatttttggaatggattactcctgtatatatggctaatcgacgtaaagcaaatgaatcgtttaagatgcgtgttgatgaaatgcaaatgttgcgtatggatgagcccttggaaggcgataatattttaaataagtatgttgaagttaatcagcgcttagttgaggaaatgaaagcttttaaagagcgaaccctctgggctgatttacaacgtgttggctcagagattagtacttcagttaagaaagcattaccaactatttccattactgagaagctaccacattggactatccaatgtggcatagctaagcctgaaatggatcatgcttatgaagttatgagttcatatgcagcaggaatgaacgcagaaattgaagcgcatgaacaagttcgtcgttcttctttggaatgtcagtatattgagccttcaacttcaagacctctggatgaagagggtcctactatcgacgaggaattacttggcgaagtagaatttacttcttcagctttggagcgtttggttgatgaggggtatattactggtaaacaaaagaagtacatggcaacttggtgtacgaaacgaagagagcatgtatccgattttgatttagtatggacggataatttgcgtgttttgagtgcgtatgtccacgagcgttctacatctacgcgtttatctaccgatgatgttaaattatttaagacgattagtatgttacatcagaggtatgataccactgattgtgcaaaatgccaacattggtatgcaccattaacagctatttatgttgatgatagaaagctattttggtgccagaaggagactaagactttgatagatgttcgtaaattgtcgaaagaggacgttacagtccaatcgaaattaattaacttatcggttccgtgcggtgatgtatgtatgttacattctaagtactttaattatttattccataaagcgtggttgtttgaaaatccaacatggcgtttaatatataatggtactaagaaaggtatgcctgagtatttcatgaattgcgtggatgaaatttcattagattcaaaattttgtaaagtaaaggtttggcttcaagcaattattgataaatatttgactcgtccagtgaaaatgattcgtgactttctatttaaatggtggccgcaagtagcatacgtgttaagtttgttaggtataattggtataactgcgtatgagatgcgtaatcctaaatcaacagcagaagacttggctgagcactatgttaataggcattgtagttcagatttttggtcaccaggtatggcgactcctcagggattaaaatatagtgaagcgataacagctaaagcgcctagaatccatagattgcccgttactactagacctcagggatcaacgcaacaagttgacgccgctgtgaataagattttgcagaatatggtgtatatcggtgttgtgtttccgaaagtgcctggtagtaagtggcgagatattaattttagatgtcttatgcttcataatcggcaatgtttgatgttgcggcattacattgagtcgacggctgcttttccggagggtaccaaatactattttaagtatattcataatcaagaaactcgaatgtcaggtgatatatctggtattgagattgatttattgagtttacctagattgtattatggtggcttagctggggaagagtcgttcgatagcaatatagtgttagtaactatgccgaatagaattcctgagtgtaagagtattgtgaagtttatagcttcacatgctgaacatgctcgtgctcaaaatgatggtgtgttagttactggtgaacatactcagttattggcattcgagaataataataaaacacctataagtattaatgctgatggtttgtatgaggttatacttcaaggagtatacacttatccataccatggtgatggtgtttgtgggtctatattattgtctcgtaatttacaacgaccgattatagggatccatgtagctggtactgaaggattacatggctttggtgttgctgaacctcttgttcatgagatgttcactgggaaagcaatagagagtgaaagggaaccgtatgatcgtgtgtatgaattacctttgcgtgaattagatgaatctgatataggtttagatactgatttatatcctataggaagagttgatgcgaaattagctcatgcccaaagtccttcaacaggaattaaaaagacgcttattcatggtacttttgatgtttggactgaaccgaatccgatgtcatcacgagacccaagaatagcaccacatgatccgttgaagttagggtgtgagaaacatggtatgccatgttctccatttaatcgaaaacatttggaattagcaacgactcatttaaaggagaagttaatttccgtagttaaacctataaacggatgcaagattagaagtttgcaagatgctgtgtgtggtgtaccaggtttggatggctttgattcaatatcctggaatactagtgctggttttcctttatcttcattaaaaccgccaggctcttctggtaagcgatggttgtttgatattgaattacaagattcaggatgttatcttttgagagggatgagacctgaacttgagatacagttgacaacaactcagttaatgaggaagaagggaatgaagcctcacactatattcacggattgtttgaaagatacatgtttgcctgtggaaaaatgcagaatacctggtaagactagaatatttagtataagtcccgtccaatttacgattccattccgacaatactatctcgattttatggcgtcgtaccgtgccgctagacttaatgctgagcatggaataggtatagacgtgaacagcttggaatggacaaacttggcaacaagtctgtcgaagtatggcacgcatattgtgacaggagattacaagaattttggtcctgggttagattctgatgttgccgcttcagctttcgaaattatcattgattgggtgttaaattacactgaagaagatgataaagacgaaatgaagcgtgtaatgtggactatggctcaggaaatcttagctcctagtcacttatgtcgtgatttagtatatcgcgtaccatgcggtattccttctggatcaccaattacggacattttgaatactatttcgaattgtttgttaattcgattggcttggcaaggtattactgatttgcctttatccgaattttctagacatgtcgtgctagtttgttacggtgatgatctcatcatgaatgtaagtgatgagatgatagataaattcaacgctgtaacaattggcgatttcttttcgcgatataagatggaatttacggatcaggataaatctggaaatacagtgcggtggcgaactttacaaactgccacgtttttgaagcatgggttcttgaaacatccaacaagacccgtgtttctagccaatctggataaggtttctatagaaggaacaaccaattggacacatgctcgaggattgggtcgtcgagtagcaaccattgagaatgctaaacaagcgctagagttggcattcggatggggtcccgaatactttaatcatgttcggaataccattaaaatggcattcgacaagttaggtatttatgaggatctcatcacatgggaagaaatggatgttagatgttatgctagcgcgtaattttaagattttaatactcattaaaattaatttatatttaggttattggaattgagggaagtaccaccccccaagaccttcgttttaaatctactaagaggagtgaacttgcatataagagtctaaaagcagagtggattagaccaccacttttagcttatatgtgaggaaggttgagttgcctctaaagactcagctccgtagtagagtagttttagttacgattaaagtggtactctaggttaggtgttactcgcgtattgtcgcataacggcaatgcgtcctaattttagtatagtttaaccataatagg

SEQ ID NO: 6 - DNA, 9499 bp, Israel acute paralysis virus of bees
gagcgtcgatcccccgtatggagcggagaatataaggctcagctaggatgacacgcctgcactgtcgacattagttaagttgcaattacacgtctgttgccgaagaaaccattttagtcaactgattatgatttttgtataatgataaacagtgatgaactgtataactcatcaacaacaaaacggattacgaacctatttgtaactatcttgatcgaagtctagtagatccccaatatagccctgaaaagcttgagggacgagatagctctataaatagccgtgaggctttaaatcctgataagtacattacctgagaattccttcttttggagtttgaatttatataagttagtaccaatagttaatatcatttaagtatgttattattgctgaaggcatgtatttcggataataacctctacattgatatataaactatatgcaagtctcggtggatattgcattatggtcgcagttaacctgtagcttatatattcctgtgtcggagcagtggtaatggagccggacgatttcgccaaaaatgttcacttctcaacaaaataacaaaattactaaacaacccgcccccctttcttatcttgcaagtatgcgagcaattactatggatgaagagcaagaatattttcttactctaaagtctgtagaaagagctcaaatattgaagatggtttatgtggaccaaaattgatttctttatattacatcaagatatcaattgtaccggttttacattaactatagtagataaggatgaaagaacaaaggacctcgagtattttgaccttaattgtgagtattatgagaatttgtatgatgcattaatggattctgagttttctaaaacttggtttacattgttgctaaaatatattgattatgctccaattagtacgaacagtcgaggaatgccccgcccggagaccatctgtgtttcaaaacattggtggtatgagttatataggattggattcttgaataagttgtaccgatgtggagactgggatagtattttacttctcctttcaggagatattgaagaaaacccgggacctgttgatatttcttataaagaatcttgcagacagaagagaatgaagaaatgcgtttctaagacttatgaggaaatcaaaatgcaacagcatattgatagaatcaataatgaagagaaacgtgctcatatgacgaaaccccgtaagttaaaggatttgattgaagttgaaatgcaaggaatgtttaattggactgaagaaagggaaatcttgaagagtactgcattcaaattcaaccattcgatggaccgagcgaatcatattatggataatctgatcccacaacttgaggatactttgtctggtttcagacaaacgtatgcaaagtgtgaagcgaaattctttggatcaataagtgttattgatgtctgcatagatatcattagtgctttgttgcaagtgagcttcgctaaacctggactcaagttagcttctattgcagtagaagtgttcagacttattaagaaatatgtctcaggaattaagattaacaccgataagataaaagaacttttgacttttggtaaacaagctttgagtagtagtaaccctattattcaggtttccatgcaaatggatatgccagaagttgatccttcaattttattacaacctggtgttatagtaagtgcaatctttttagttttaagtgtagtttttactaagaccctcccaagtaagactggtgttgaggcgatgttaaagaggactggagaactaggacgctctgcaaagggcatcatggatctcaatacagttcttaatacatcagtaacctcaatgcttgaatactttggagtacatactttaggattaagacaagaagctgaacttcaagttctcgtagaaggttataaaacttggtgtgatgaagttgcggctttagtaggacataagattaacatggatggtactttagatggaagaagtattgttgaagatattatgagagatacaaaagaaatccaacgtgtagaaaatctctacaaacgtggattggaaatttctcgtaatattgcagacatgaaacttccaacaaaattaaccattagttttaatacacacatgagatacttgactgaagttttcaaagcagtagatacgtctggtgcttttggaaataaaccccgaactcaacctgtagttatttggctatatggtgagtctggagttggtaagtcaggtatgacatggcccctagctgtagatcttaataatagtttagtagataatgtagaggagatgcgtaatttttccaagaatatttacatgagaaatgtagaacaggaattttgggataattatcaaggacaaaacgttgtagtttatgatgattttggacagatgagggattcaacatctaatcctaatcctgaattcatggaattaatacgcacagctaacatagccccttatcctttacatatggctcatttagaagataagcgtaaaactaaatttacatctaaagtaattatcatgacatctaatgtttttgaacagtcagttaattcgttaacttttcctgatgcttttagacgcagagttgatctgtgtgctgaagtacgtaataaggttgagtttacgaaggaaggatattcaaagactaaaggatgcatggtaagacgcttggataaggatttagttaagaagaagactggagacatatgttcaacagaatgttatttagtagacttggttaatcccgagactggagagaaataccaaactgatttagaatatgaagattttttagatatgtgtttggagaaaactcaggagtgtagagataattctgctaagttgaacgaatttctgatgaactatgctgaaagtcgatcaaaacgacccgaacaaaaacacgataagtgccctgaattggaatttgaagatgcaattgaagtgtctatgcaagtagacgctgactcgtctttagttccaattgagaagtctcgtcttcaagagatgattgagagttgccaaggagttgtgtatgatgcctgcggcaagaccgtatacatttctaagttagcttttgaactagcccctcttgagtatgagaaacaaatggaaagaatttcagggatgaaattttatcagaaaatggcaagtggtgttgtataccttcgtcaagttcgtgacacgagtatgaaaatgcttaattcatggatggaagaatgtatacaatatgcaaaggatcacccttggacaatagtagctggagttctaggaaccttcattggcattctcaccattgttggtttctggaaatggctatgctctgatggacagaagaagaaacaggcaattaagcgtcatttcattaatactggatacacgcttattatacctgaacgagaattgaataaattctgggagttggatgaaactctcgatttacgtggaatgcctgtaaatcaaatagaggaacatctcgctctactactgaagccgcgtcatcgcgtggttttagtacctaaagccactaagtacataataagtttagtggataatcatgccaaattgacagataagattattcttataactgctaataggtatgtgttttataaaaatcaaaattatgaattagtgtttggagaattaaatcaatttttcgaaaaagacccagaatcccttgtgaatactcctaaggttgaagcttttgcttccgccgatttgagtacttacaaaaataggaccccgattgtgatcgaagcacagacatctggagataatgtgactcttaaacaacaaaaggttaaagtaattgaagcaaaaacatctactgatgaagttactttgaaacaacaaaaacctattgttatagaggcacagtcttctggtgattgtgtgacccgaaaacaacgagtacaacgagtgattgaagcatttgcaagtagtgatgctgtgacattgaagaaatctactgcgaaattcgtagaaagtgacccaaatgacatagttgatgttacaatgcaaatgtggaaagatcaagttgcccaacgattgataaccaaccgtgtattgacaaatttgtataaagtttgtttggtacacaatgacgatcgaataacacctcttttgaatggactttttgttcgttcaaatttgatgttagtacctggacatcttcttggattcattgctgagtatgacacaattgaaattcgaaatctctttgacgtggtatttagagtgccatggaaagatgtgaagaaagttccaattgttaatgcttttggtgaatctaaagaagcagcgttattggccttcccaaaattcgtttgccaacattctgatttagttaagcatttccaaaatgctgaatctatgtcgaaatttaaacgatgtgaagtcactctacccgttttacgtttctctgagaaagttggtaaatttttatcaacactcattgaatgtgatcgagtggaggcttatgatagaccttatacgctgaacgattctcaaaaaggacaatatattctacgtcaaggcttagaatatatgatgcccacgactaatggtgattgtggctcgccgctcatcattaatgaaacccaagttttgaggaaaattgctggtattcatgtagctggagctacaactggcaaagcctatgctgagtctataacccaaaaagatcttgagcgagcatttattaaaatagatgtaagcatgcagatccaattggatttggattcaacattggatttctcaaaacccgaacccaaattgccttctggtactgaatttggtcctgaagatctcagcttttgtgatcttcccgccctaaagatgttaccagttggtaaactttctgaatccttattcgaacctggcaagacggatataaggccctctttggtacatggtcaaattagtgacataaaaacaaaaccagcctatttacgtaatgtaattaaggatggagattttgttaatatgaaacataaaaatttgatgaaatgtgctatggatacaccctatatcgacaaggacatgattgatgaggcatatcagttaactaaatctgtttggttaaaaggtatgagagatgaattgaagaaggttctcacttatgaagaagccatttgtggctctgaagtaagtgagtacatttcttcaataaatcgaagtagttcccctggatatccttggattaaggatagaacaaaaggaactaaaggaaaacaaggctggtttggatctgaaggagaatatattctcaatgaagatgttagactggccgttcaacgacgaattcaggcagctcgtgaaggaaaacgattacctgtaatgtgggttgatacattgaaagatgagcgtcgacccattgaaaaagttaatcaattgaaaacacgagtattctcaaatggaccaatggatttctctatagcttttcgaatgtattatttgggctttatagctcatttgatggaaaatcgaattactaatgaggtgtccattggaacgaatgtgtattctcaagactggagtaaaactgttcgtaagttgactaaatttggaaataaagttattgcaggtgatttttcaacttttgatggatcactgaatgtatgtattatggaaaaatttgcagatttagcgaatgagttttatgatgatggaaaagaaaataatctgatcagacacgtattgttgatggatgtgtacaattctgtacacatttgcaatgactccgtgtatatgatgacacacagccaaccctctggaaatcccgcaacgactccgctcaattgcttcattaatagtatgggattacgaatgtgtttcgcaatttgtgttaagaatgcaggcataaagatgacaatgagagattttggtaagcatgtttccatggtctcttatggagatgacaatgtcataaacttcagtgatgaagtatgtgaatggtataacatggaaactattgctaaagcatttgaaacccttggattcacctatactgatgagcttaagggcgtaaatggcgaagtaccaaaatggcgatcaattaaggacgtgcagtatttaaaacgtaagtttagatacgatgaacaacggaaggtttgggaagccccactttgtatggacacaattcttgaaatgccaaactggtgtcgaggaggacttgacattcaagaaggtacaaagttgaattgtgaaaatgcaattatggagctttccatgcatgaagagagcgtttttaatacctggtctaaaataattgaccgagtatatgcaaatgcgactggagatcacctggacataaacacttatcgtggttatgctcaggagcggtttctggaatactatatgtaagtatagtgttctggaggcatcattctatggttacccatcattagaggaaatttccaataaactctggtgtaaggcttagagtgatggtcgaggtgccctatttagggtgaggagcctcggtggcagccccaccaaatcctctattggataggaacagctgtactgggcagttacagcagtcgtatggtaacacatgcggcgttccgaaataccatgcctggcgattcacaacaagaaagcaatactcccaacgtacacaatacggaactcgcttcgtccactagtgaaaactcggttgagacccaagaaatcacaacctttcatgatgtggaaactccaaataggatcgatacccccatggctcaggatacttcatcggctaggaacatggatgatacgcacagtattattcagtttttacagcgccccgttctcattgacaacattgagatcattgctggaacaacggccgatgcaaacaaaccccttagccgatatgtgttagatcaacaaaattcccaaaagtatgtacgaagctggacattaccatcaacggtgcttaaggctggcggaaaagctcaaaagcttgccaattttaagtacctgcgatgtgatgttcaggtgaagttagtacttaatgcgaatccctttgtagcaggaagaatgtatctagcatatagtccttacgatgataaagttgacacggcccgtagtgttttacaaacatcgcgagctggggtcacaggctatccgggagtcgaattagacttccaattggacaactctgtagaaatgactattccatatgcctctttccaagaggcttatgatttagttactggaacggaagattttgtacagttgtatttgttcccaatcacacctgtactaggacctaaatctgaatcagaaagttccaaagttgacatttcagtttatatgtggttgagtaacatatctcttgttattccaacttatcgcatgaatcctgatattgtcaaacaaggagcttcaaggatggtaactgaatttgttccaaatcctcttgaaaaagatgccaaaaccatagcagatgctcttaagaaagttcagaaaaataatccttctgggtataaatatattatgcatgtcttgactggctatgaacctgaagtaaagaatgtaacaatgcaagtgaacgctccaaaaacgaaaacaagtcaaaaatctacctcagaaaatcccaaagttggaccaatatctgaagtggcttctggagtgaagacaacagctaatggaattgagcgtatccctgtgataggtgaaattgcaaagcctgtaacaactgctgtaaagtggtttgcagatgttgtcggaactgtggcagctatttttggctggtccaaacctcgaaatcaacaacaggtatgtccattcaaaatgtgcctgcatggggatattctctctataaaggcatacgatatgagcgtaccattggcttatgatcctaataacgaacttggtgacttgaaggatgtttttccttctgcggttgacgaaatggctacagggtatgtttgcggcaatccagccgtgaaacatgttcttacctggaagacgactgacgtaattcagaaaccaatagcaaacggagatgattggggtggagttataccagtgggaatgccttgttattctaaatccattagaattacaagtatttcagaaacggaaaatcgtgaaactgaagtcatagatgccgctccatgtgaatatgttgctaacatgttctcgtattggcgtgcaactatgtgttataggattaccgtggtgaaaacagcttttcatactggcagacttgagattttctttgaaccaggagtgatacccgttaaacccactgttaataacattgggcctgatcaggatcaactcacaggaacggcggctccttccgataataactataagtacattttggacctgactaatgatacagaagttacagtacgtgttccttttgtttcaaataagatgttccttaagactgctggaatctatggtgctaacagtgaaaataactggaactttcatgaatcctttagtggattcttgtgtataagaccagtcactaaattgatggctcctgatactgtgtctgacaatgtatctatagttgtttggaagtgggcagaagatgtagtagtagtagaaccgaaaccattaacatccggaccaacgcaagtatatcgaccacccccaactgcttcaacagctgttgaagtcttaaatgtagaacttcaaattaatataggtaataagactaacgaaaatgtaatctcattttttgactctacagatgctgaaacacaaaatcacaacgctttaatgaaaggatgtggtgagtttattgtaaacttgcgaactcttctcagaacctttagaacaataacagataattggatattacaagctaataccaagacaccaatcacggacctcacaaacaccacagatgctcagggtcgagactatatgtcttacctgtcctatttataccgattttatcgaggaggtcggcgttataaattctttaataccacccctctcaaacaatctcaaacatgctatataagaagctttcttataccacgtaattactcagctgatgaaattaacgtagacggaccttcacatataacataccccgtaatcaatcctgtgcatgaagtagaagttccattctattctcagtataggaaaatacctatcgcttcaacatcggataaaggttatgattcctctctaatgtatttttcaaatacagcaacaactcaaattgttgccagagcaggaaacgatgactttacctttggttggatgataggtccaccccagctacaaggcgaatcacgctccgtagccccctagatgtgcactgggagacagacaaatctccctatgtatggctatagtctaaatttttcacaaaatttcagtttagaccgaaaaccgacacttgaactggatatagtacattaatgtcctgcagctaacactgtagtttatatctaggtagagtgggcaaaattttcgaattaggtaaatttaaaaaaaaaaaa

SEQ ID NO: 7 - DNA, 414 bp, Cloudy wing virus
gatgaacgtcgacctattgaaaaagttaatcaattgaaaacacgagtattctcaaatggaccaatggacttctcaattgcgtttcgaatgtattatttgggctttatagctcatttgatggagaatcgaattgcaaatgaagtgtctattggaacgaatgtttattcacaagactggagtaaaactgttaggaaattaaccaaatttggaaataaagtaattgctggtgatttttcaacttttgatggatcactaaacgtttgcattatggaaaaatttgcagatttagctaatgagttttacgatgatggaccagaaaatgctttgatccgtcatgtattattggtggatgtgtacaattctgtgcatatttgtaatgactcagtatacatgatgactcatagccaacccaca

SEQ ID NO: 8 - DNA, 9491 bp, Acute bee paralysis virus; identical to SEQ ID NO: 3

SEQ ID NO: 9 - DNA, 9524 bp, Kashmir bee virus
tacgtacaattttgacgcttcgttcatgcaacaatgaactcacatgtggcgctcggtagtaaccagaggggcgtcattcccccgtatggagtggagaatataagctaccgactcgagctgtagaataattcagcaacttataacgaacacgaattttagtcgacgaaaccattttagcctttaattctatgatttgattataatgataaacagctcatgtaactgtctaaactacataaatacaactggattacgaacctttaagtaactatcttagatgaagtctagtagtctcccaatatttccgtgaaaagaatgagggacgagatagctctatttaaagacgtgaggctttaaattctgataaatacattacctgagaattcctcctttaggagttagaatttgaaaagattagtacctatacttaatagaatttaaatatgttaataatgctgaagacaagtatttcgattattaacctctatatttctatataaagtatctgtgagtctcagtggacatcacagtaaggtcgcagttaacttgtaatcttttcattcctgtgtcggagcagtggtaatggagccggacgatttcgccaaaacatgttttcttcaactcaacaaaataacaagatgacaaaacaaccagcaactttaacctatctttcaagtatgaaggtgattagtatgccaccaagtgaattcttttcacttgatgacttgtgtcgccaacaaattttaaagatggtttatattgaccaatacgcttttcacatgttacatgaagacataaattgtatagggtttactctatcaatttatgatgaagataaacgaatgaaggacataacttattgggatctgaattgtgaatatcatgaaaatttatatgatgcactaatgtcggccgaatttgaacaagtttggtttacattattgcttaaatatcttgattttgtaccagtaccaatgaattggagaggaatgccagaatttcctaccatttatgtatcaaaacatttttggtatgaattatatcgcattggatttttgaataagttatataaatgtggaacttgggagtcagtattaaatctcttagccggagatatagaattgaatcctggacccactgatatttcttacaaagaacaatgccaacgacgacaacgacgcaaacgaatttctaaatcttatgaagaaatcaaaatgcaacaacatattgataaagtaataagagaagaatttcgttcccaccagacaaaacccaagaaattgaaagatgttattgatgtttctatgcagggactttttaattttcaagaagaaaaggatattattaagtcaactgcatataaattcaatgatactctggataaatctaatcatataatggataatcttataccacaattagaagaaacgttagcaggctttagaaggacttatgcgaagtgtgaacaaaagttatttggaactattagcattattgatgtctgtattgatatcattagtgctttgttacaagtaagttttgcgaaagcttcaatgaagttagcttctttagcagtagaagtatttagattaattaagaagtatgtaggcagtgttaagattaatattgataaaataaaggagttgttaacatttggtaagcaagcattagacgtggataatcccattattcaagttaaaatgcaaattgatatgccagattacacaactcttttacaacccaatgttattgttagtgctatatttttagtattaagtgttattttcaccagaactcttcccacaaaaactggaatggaagcaatgataaaaaggattggagatctaggacgtgctgcgaaaggcgtttctgatcttaattctgttttgaataattccatttcaactatgttggaacattttggcgttcatactttaggtttaaaacaagaggcagagcttcaacttttagtacaaggctataaggcctggtgcgatgaagtgagagctctagtaggacataagattaaattagacggagattttgatggaaaaagtattgttgaagaaataatgaaagatgtccacgaaattcagcgtgtagagaacctctacaagcaaggattggacattgctcgtaatatttctgatatgaaactcccatcaaaattgacaattagttttaatacccacatgagatatttgactgaagttttcaaagcagtagacacctctggcgcctttggaaacaaaccacggactcaacctgtagtcatttggctatatggtgagagtggacgtggtaagtcaggtatgacatggcccttagcagtagatttaaataatagtttattagatgatgtgacggagatgcgtaacttttccaagaatatctacatgagaaatgtagaacaggaattttgggataattatcaaggacaaaatatcgtagtttacgatgattttggacaaatgagagattcaacagctaacccaaacccagaattcatggaattgatacgtactgccaatatcgccccctatcctctacacatggcccatttggaagataagagaaagacgaagtttacgtcgaaagtgataatcatgacatccaatgtttttgaacaatctgtaaattcgcttacttttcctgatgctttcagacgcagagtagatctgtgtgctgaagtgcgcaataaggaagaatatacgaaggaaggttattctaagcagaagggatgcatggttaagcgattagatcgtgaaaaggtgcagaagttgacaggagatattcactcaacgaaaccatatttggttgacttagtgaatgcagagaccggagaaaaatataagactgacattgaatatgaagactttttagatatgtgcttggagaaaaccaagacgtgtcgagatgagtctgccaaactcaatgaatttcttatgaattatgctgaacaacgcaaagacagaagtagagatacttttatccatcctgaacctgaatatgacgatgatgagttcaaggacacattagaagtacagatgcaaattgatgctcctaatgatgaccttgttctcattgaacaagatagattgcgagagatgattgattcatgtaccggtgttgtttatgattgcaaacaacaagtagtgaagatatcaaaactcgcttttgatcttgccccattagactatgatgaacaaatgcaacgaattaaggaaatgaagtattaccagaaagtcgcaagtggcgtatcatatttgaagaaagttttggatgcaggtcttgcaatttgcaagacttggattgaagaaactgtcaaatatgtgcaggaacacccttggaccacagcaatggccattttaggaaccctattaggtattcttaccgtagtaggattttggaaatggctttgcagtggagaaaagaagaaaccacaagctacaaaacgacattttgtcaatactggtgtgactcttgtcataccacatcgagacctcaataagttttggcagttggatgaaacattagacgtatccaacatgcgtgttggagatgttgaagatcatctggcggccttacttaaacccagacatcgtgttgtcattgtacctagggtgactaaattcattttgagtattattgataaccactcgaaactctttgataaaacgattttaattaccaagaaccgattctttacttatgaaaataaatatattgaattggtgtgtggtgagatgaatcgtttctttgaagaagacccggaatcacttgtaaatacaccaaaagtagaagcttttgcttctgctgatttggctacttataaaaacaggactccgatagttattgaggcacaaacatcaggagataatatgactcttaaacaaccacgaccagttgttatagaagctcagacatctgctgattgtgttactttagctaaaaacacacaacgaatgattgaagcatttgcaagttctgatactgtaacactgaaaagaccaacaacaaaatatgttgaaggaactggatatgatacagttgatgtctctatgcaaatgtggagagatcaggtggcgcagaaattgatcactaaccgaattttaacaaatctgtataaaatttgtttagtaaatgacgacgacacagtaacaccacttttgaacggattatttattcgttcaaatgtgatgttagtacccggacatttgactggattcattgcagagcatgatacaattgaaatcagaaatctttttgatgtggtatttagagtaccatggaaagaagttaagaagataacagttgagaatgctcttggtgaatccaaggaagcagcgttattagcgttccctaagttcgtatgtcaacactctgacattgtaaagcactttcaaactgctgaatcaatgtcaaagtttaagcgatgtgaggtcacattacctgtattgcgttactctcaaaaattggaaagatttatgtcttcccttattgaatgtgataaagtagaggcatgtgataaaacttatacgctaaatgatgttaagaaaggacaatatatattgcgacaaggattagaatatacgatgccgacaattgatggtgattgtggagccccactaatcatcaatgaaacacaggttactagaaagatagctggtatacatgttgctggtgcagcatgtggtcgagcttatgcagaatctataacccaaaaagatttggagcgtacatttagtaaaatagatgttacgatgcaaatccaattggatttagattcttcattagatttttctagaaccgaacccaaaattcctgctggagtcgaatttggaccggaagctctcactttttgtgatcttccagcccttaagatgataccagtaggacgacttcccgaacccctatttgaaccaggcaaaacagatattaggccttccttagtacatggaatgatttctgatattaagactaaaccagcttacttacgtaatgtaagagtagatggtgaagttataaatatgaaacacagaaatttaatgaaatgtgctatggatacaccttatatcgacaaggacatgatcgaggaagcatatcagttaactaaatccgtttggttaaaaggtatgcgagatgaattgaaaaaggttctcacttatgaagaagccatttgtggctctgaagtaagtgaatacatttcttcaattaataggagtagctccccaggatatccttggataaaggatagagtgaaaggaactaaaggaaaacaaggctggtttggtactgatggagaatttattctcaacgaagatgtcgaattagccgtacaacgacgactacaagcagctcgtgaaggaaaacgattacctgtgatgtgggtcgacacattgaaagatgaacgtcgacctattgaaaaagttaatcaattgaaaacacgagtattctcaaatggaccaatggacttctcaattgcgtttcgaatgtattatttgggctttatagctcatttgatggaaaatcgaattacgaatgaagtgtctattggaacgaatgtttactcacaagactggagtaaaactgttaggaaattaaccaaatttggaaataaagtaattgctggtgatttttcaacttttgatggatcactaaacgtttgcattatggaaaaatttgcagatttagctaatgagttttacgatgacggaccggaaaatgctttgatacgtcatgttctattgatggatgtgtacaattctgtacatgtctgtaatgattcagtatacatgatgactcatagccaaccttcaggaaaccccgcaacaacaccccttaactgtttcattaatagcatgggattgagaatgtgtttctcaatttgtgctactaaagcagcggttaaaatgacgatgagagattttagtaaacatgtttccctcgtctcttatggagatgataatgtaattaacttcagtgatgaagttagtgcatggtataacatgtctactattgcagaggctttttcaacacttggattcacttatacagatgagctcaagggagttagaggcgaggtaccaaattggcgatcaatacaggacgtgcaatatcttaaacgtaagtttagatatgacaatcaacggaaagtttgggaagctccattgtgtatggacacgattcttgaaatgcctaattggtgtcgaggaggactcgatattcaagaaggtacaaaattgaactgtgaaaatgcaataatggaactttctatgcatgaagaggaagtctttgataagtggtcaaaagtaattgacaaagcttatgcaaaggctacaggagatcacctggacataaacacttatcgtggatatgctcaggagcggtatctcgagtattatatgtaaatataatacttgagatgcactgtttcatggttacccatcatttgaggaaatttccaataaacttgaatgtaaggcttgaaacagtggtctaggtgccctatttagggtgaggagcctagctggcagccccagtgaatcctctattggatagaaaccgctatatcgggtagctatagcagtcggatagtaatatatccggcgtttcgaaataccatacctgctgataaccaagaaaacgattctaccaatgtacataacacgaaactcgcgtcgacctcagcggagaatgccattgagaaggaacaaatcaccacctttcatgatgtggaaactccaaataggatcgatacccccatggctcaggatacttcatcggctaggagcatggatgatacgcacagtattattcagtttctacaacgccccgttctcattgacaacattgagattgttgcaggaacaactgccgataacaacacagcactcagtagatatgtgctagatagaacaaacccgcaaaaatacattaaacaatggacattaccatcaacagtgttgaaagctggtggaaaagcccaaaagcttgccaactttaaatatttgcgatgtgatgtacaagtgaaaattgtattgaatgctaatccattcattgctggtaggttatacctagcatattcaccttatgacgacaaagtagcacctgaacgtagaattatttatacttcccgtgcaggtgttacaggttatccgggagtcgaactagatttccaattagacaattcagttgagatgactattccatatgcatcttttcaagaagcatatgatttagttagtgggaatgaagattttgtgcagttgtacctttttacaattgcaccggttttgggaccttcagctgaatcagcgaattcaaaagtagacctttcagtctatatgtggttagataacatatctctcgttatccccacatatagattgaatccaaatcttccaaccggacaaactctaacccgcatagttcagaattccgattctgataaactcaaagaagcacttaagattgctaagtctaagaacccttcaggatataaatatatcatgggagttcttgaacaatacaatccaagtgtgaaacaagtttctatgcaaatcgcaacacctaacaaatcaaaatcaacaaaaccaacatccgaaaacccaaaaattggaccaatttccgaagtggcttcaggagttaagacagctgcaaatggcatcgagcgcattccagtgctaggtgaaattgcaaagccggtaactgctgcagttaaatggtttgctgatattgtaggaggtgtagcagccatattcgggtggtccaaaccccgaaatcagaatcaagtgatgccttatcagaatgtgcctggatggggatattccctatataaaggcattgacatgagtgtaccacttgcttatgaccccaataacgaattaggagacttgcgagatgtatttccatctgccgtagacgaaatggctattggatatgtttgtggcaatccagctataaaacatgtcctcacctggagtacgacagatgtggttcaaaacccgataagtaacggagatgattggggcggtgtaataccagtgggaatgccttgctactctaagactattagagcagttaaaggcgccacttcgacgtcaaaaaccgaagtgatggacccagcaccgtgtgaatatgttgcaaatcttttctcatattggcgtgcaactatgtgctatcgtattacggtagtaaagacagcttttcacacaggcaggttggaaatcttctttgaaccaggaagtattcccacggtaagaaccgcagataacttaggaccagatcagacacaattgaacggaacaatagctccatccgataacaactataagtatatattagacttaacaaatgatactgaggttacgatcaaagtaccatatgtttcgaataagatgtttatgaagaccgttggcatctacggtgcgcatgatgaggataattggaactttgatgaatccttcaccggattcttgtgcataaggccaattactaaactcatggcacctgatacggtatcgcagaaagtatctatagttgtatggaaatgggcagaagacgtagtagtagtagaacctaaaccactcacctcaggaccgactcaagtgtacaatccacctgcagtagctagagacctagttaaacagattgatgtttcaatgcaaattaatttaagtaacaagactgacgaaaacacaatctctttctttgactcaggcgacccagaacgaatgaataatgaggctctcatgaggggatgtggcgaacagatagtaaatttaagacccttacttcgcacattccgaacaataaatgataactggagtttggcagcaaacaccaagacaccgatcacagacctaacaaacaccgcagatgctgaaggccgagactatatgtcttatctttcttttctttatagattttatcgaggaggtagacgatataaattctttaacacgacccccctaaaacaatcacaaacctgttatgtgaggagttttctaattccccgtaactacacagccgacgaaattaacaccgacggaccatctcatattacatacccagtaattaacccagtacatgaagtagaagttcccttctactctcagtaccgcaaaattcctatcgcttcaacatcagacaaaggatacgattcatccctcatgtattacacaaatgttggtacccaacagattgtagcacgtgccgggaatgatgacttcacctttggttggatgataggcactccgcaacttcaaggtataactaaagaagtcgcaaactagatgtgcattaggagacagtaaaatctccttttgtatggctattagtctaaatttttcagaaaatttcagtttagaccgaaacagagtagtacgagcactatggttcgaaaagacgcttaaaagaaatctcactagaaggaggcttttaagctatcagctttttgacataatctaacgactacggcaaaatttcggaattaggataattttaaaaaaaaaaaaaaaaaa

SEQ ID NO: 10 - DNA, 10140 bp, Deformed wing virus
cgatttatgccttccatagcgaattacggtgcaactaacaattttagatagtagccatgaacaaacattatagtagctcactacgtattgatcatttttataatgacttgcgtagcatgaagcgcatgcttgtagttgtaactatgttactttrcaagttggagtttactatyttggattatgaatatgtgcacttagtgtctgtatttatagtcgtttgtggttcaaggttttgtgttagtagtacacttatgtatgaatgtayctttagtatgaatgttatagaatgacaatatcgaargaaaaatytttataaaatacaaaaatattgtttttattatttcgatatggtgttttatagagtagattgccatgtgaccgctcrtagaagtccattatggtttatcaatcgaagttgaatgtatttataagratattatacttaattagtaatattagtagtccgtaactattatcatcctttttcagtttgatgtgataatagaccactgcagtatcgagtagagtttcgaatgcgtagtgcaatagtataatyactgtcaccgaccatctattgtaatgatagatctgtcggaaaccattatttatgaagtgactagcaatcatggattaaattagatggtattctagtttagaggtgattcggcgctgcggtgcgactgaaacttctaaattagcatgtcagattatattatgaatgcgttagtagtaatttctgcgatagagctgggacccctcagtctctcaggtattgtacgaggcgaaagtgtgaaagttttgtatgtgtttttatatgtacgactgtatcgggaattcctttagcaagaatccttttaatacagtataatttgtgctacggtacgttacgttcgcagggcacccgttaatgtctcatagcccagacgatggcggatggaaagacatcatattttattttaatgctgtctttattgctgatttattttgctgtttttatttgctattttatatttgctaattytcattattgcgaaatatattacattgctatttttattatatacgctagattcaattttatttttyctatattttcaatttaattttgatttcgaaggtaaatatatataattrattattaaaaatggcctttagttgtggaactctytcttactctgccgtcgcccaagctccgtctgtcgcytatgcacctcgtacatgggaagttgatgaagctaggcggcgccgagtcattaaacgtttggcgctggagcaagaacgtattcgtaacgttcttgacgttgccgtctatgaccaggcgacatgggaacaggaggacgcgcgcgataatgagttcctaacggaacaattaaayaatttatatactatttattcgatcgctgaacgttgtacgcgtcggcctatcaaagagyactctcctatatcagtttcgaataggtttgctccactggartccctyaaggtcgaggtcggtcaagaagcargcgaatgtatrtttaagaaacctaaatatacgcgcrtttgcaagaaagtgaagcgtgttgcaactcgcttcgttcgtgaaaaagttgttcgtcctatgtgytcwagatcccctatgctattatttaagcttaagaaaattatttatgatttgcatttatatagattaagaaaacagattaggatgttgagacgtcaaaaacagcgcgattatgagttagagtgtgtcactaatctgytacaattatcgaatccagtgcaggcaaaaccagagatggataaccctaatccaggacctgatggcgagggtgaagttgaattagaaaaggatagcaatgttgttttaacaactcagcgagatcctagtacatctattccagcgccggtgagcgtaaaatggagtagatggactagtaatgacgtagtagatgattatgccacaatcacatctcgatggtaycagattgctgaatttgtttggtcgaaggatgatccatttgataaggagttagcacgtttaattttgcctcgtgctttgttatctagtatagaggctaattctgatgctatatgtgatgtgcctaatactatcccatttaaggtacacgcatattggcgaggcgatatggaagttagagttcaaattaattcaaataaattccaagttggtcaattacaagctacttggtattattcggatcatgagaatttgaatatatcgtctaagagaagcgtttatggattttcacaaatggatcatgctttgattagtgcgtcagcaagtaatgaagcaaaattagttattccatataagcatgtttatccatttttaccgacaagaattgtgccagattggactactggcattttagatatgggtgctttgaacattcgtgtaattgctcccttacggatgagtgctactggtccaactacctgtaatgtcgtcgtgtttattaaattaaataacagcgagtttacagggacttcttctggtaagttttatgcgagccaaatcagggcaaaacctgagatggatcgtatattaaatttggcagagggattgttgaataacacgattggtggtaataatatggataatccttcttatcaacaatctcctcgtcattttgtcccgactggtatgcacagcttagctttaggtactaatttagttgaaccattacatgcattacgtttrgatgcagccggtacgacacaacatcctgtaggttgtgctcctgatgaagatatgactgtatcctccattgcatctcgatatggactaattagacgggtacaatggaagaaagatcatgctaaaggatcacttttgttacaattagatgctgatccatttgtggagcaaagaattgaaggtacgaatccaatatcyttgtattggttcgcacccgtgggtgtagtatctagtatgtttatgcaatggcgcggttcattagaatataggtttgatattatagcatcccaatttcatactggtaggttaattgtaggttatgtgcccggtttgacagcatctttgcaacttcaaatggactatatgaaattgaagtcatcgagttatgtagtatttgatttacaagaaagtaatagcttcacttttgaggtgccataygtttcatatagaccatggtgggtgcgtaaatatggtggyaattatttaccctcgtcaactgacgctcctagtacattatttatgtatgtkcaggtwccrttgatacctatggaagctgtttcagatactattgatatcaatgtgtacgtacggggcggtagttcatttgaagtttgtgttccagtccaacctagtttaggtttgaattggaatacagactttattttacgtaatgaygaagaatacagggctaagacaggttatgcaccatattatgctggagtgtggcatagcttcaataatagtaattctcttgtttttaggtggggatctgyttccgaycaaattgctcagtggccgacaatttcagtaccaagaggtgagctagctttcttacgaattaaggatggaaagcaagctgctgtaggaacycaaccttggcgtacgatggttgtttggccttctggycatggttataatattggtatacctacgtataatgctgaacgagctcgccagcttgcacaacacttatatggtggtggatcattaactgatgagaaggccaaacaattatttgttcctgctaatcaacaaggacctggtaaggtaagtaatggaaatccggtatgggaagtcatgcgtgcaccattggcaacacagcgtgcgcatattcaagattttgaatttattgaagctattccagaaggagaggagtctcgtaatactacagtcttggatacgaccactactttacagtcgagtggatttggtcgcgcyttctttggagaagcttttaatgaycttaaaacgttaatgcgacgatatcaattatatggtcaattattattgtccgttactacggataaggatattgatcattgtatgtttaccttcccttgtttaccacaagggttagcgttagacattggttctgctggctctccacatgaaatctttaatagatgtcgtgatggtattataccattaattgcatctggatatagattttatagaggagatttgcgttataagattgtttttccaagtaatgttaatagcaacatttgggtacaacatcgaccggatcgtagactggaaggatggtccgcggctaagattgtaaattgtgatgctgtgtctactggtcaaggggtgtataatcatggttatgctagtcacattcaaatcacgcgtgtaaataatgttatagaattggaagttccattttataatgctacttgttataattatttacaggcgtttaatgcgtctagcgctgcatctagttatgcagtatctttaggagaaatatcggttggttttcaagctacaagtgatgatattgcatctattgttaacaaacctgttactatttattatagtattggagatggtatgcaattttctcagtgggttggatatcaaccgatgatgatcctagatcagctycctgcaccagtagtaagggccgtgcctgagggccctattgcgaagattaaaaacttcttccatcaaacagccgaygaagttagagaagctcaggcagcaaagatgcgtgaagatatgggtatggttgtccaagatgttattggagaacttagccaggcyataccggatcttcaacaaccggaggttcaagcaaatgtcttctcactggtgtctcagttagtgcatgctattataggtactagtttgaagacagttgcttgggcgattgtttcgatttttgtgactttaggattaattggacgcgaaatgatgcattcagttattactgtagtcaagcggttacttgagaaatatcacttggcgacgcaaccccaggaatccgccagttcaagtactgttatatctgccgttccagaagctcccaatgctgaagcggaggaggcaagtgcttgggtatccattatttataatggtgtgtgtaatatgcttaatgtrgctgctcaaaaaccgaaacaatttaaagattgggtaaaattagctactgtagattttagtaataattgtagaggtagtaaccaggtatttgtatttttcaagaatacatttgaagtgttgaagaaaatgtggggttatgtattttgtcagagtaatcctgcagcgcgtttgttgaaagctgtgaatgacgagcctgagattttgaaagcatgggtgaaggaatgtctgtatttggatgatcccaaattcagaatgcgtcgagcgcatgatcaagagtatatcgagagagtgtttgcggcacattcatatggacaaattttgctacatgatttaactgctgaaatgaatcaatcacgaaatttgagtgtgtttacacgtgtgtatgatcaaatttcaaaattgaagaccgatcttatggaaatgggatcgaatccatatataaggcgtgaatgttttacgatatgcatgtgtggtgcatctggaattggaaaatcatatttgaccgattctttatgcagcgagctcttacgtgcgagtcgtactcctgtgacaacaggcataaaatgtgttgttaatccattatctgattattgggatcaatgtgattttcagcctgttttgtgcgttgacgatatgtggagtgttgaaacatctactacgctygataagcagttgaatatgcttttccaggtccattcccctatcgtgctttctcctcctaaagctgatttagaaggtaagaaaatgcgatataacccggaaatattcatatacaatacgaataaacctttcccgaggtttgatcgtattgctatggaagctatttatcggcgtagaaatgttttgattgaatgtaaagcgagtgaagagaagaagcgaggatgtaagcattgtgagaatgatattcctattgctgaatgtagtcctaagatgttgaaagattttcatcatattaaatttaggtatgcgcatgatgtatgtaattccgagaccacatggtctgaatggatgacgtataatgaatttcttgaatggataactcctgtgtatatggctaaccgtcgtaaggcgaatgaatcgtttaagatgcgtgtggatgaaatgcaaatgttacgtatggatgaaccattggaaggtgataatattctcaataagtatgttgaagttaatcagcgcttagtggaggaaatgaaggcatttaaggagcgtacactatggtcagatttacatcgcgtaggtgcggaaattagtgcgtcagttaagaaagctttaccaaccatttccataaccgaaaaaytaccacattggactgttcaatgtggtattgctaaacctgaratggaccatgcttatgaggttatgagttcgtatgcagctggaatgaatgcagagattgaagcgcatgaacaagttcggcgttcrtcagtggaatgtcaatttgcagagcctcaagctycaagaaaycctgatgatgaaggaccaaccatagatgaagaacttatgggcgacactgaattcacatcacaggctctagaacgtcttgtggatgaaggttatataactggaaaacagaagaaatatatagctatgtggtgtagtaagcgtcgtgaacatactgctgactttgatcttgtgtggactgataatttgcgtgtgttaagtgcgtatgtgcatgaacgttcatcttcaactcggctttctacggatgacgtcaagttatataaaacgattagcatgttacatcaaaagtatgataccacagagtgtgctaaatgtcaacattggtatgctccgttgactgatatctatgttgatgacaagaaattgttytggtgtcagaaagagaaaaagacacttattgatgtccgaaaattgtcgaaagaagatgtgactgttcaatcraaattgrttaatttatctgttccttgtggtgaagtktgtatgttacattcaaaatatttyaattatcttttccataaagcatggttgtttgagaacccaacttggcgcctaatatataatggtaccaagaagggtatgcccgagtactttatgaattgtgtggatgaaatttcattagattccaaatttggtaaagtgaaagtgtggttgcaagcgatcattgataagtatttaactcgtcccgtgaaaatgattcgtgattttcttttcaagtggtggccgcaagttgcgtatgtgttgagcttgctaggtataatyggtataactgcgtatgaaatgagaaatccgaaaccaacttctgaggaattagctgatcattatgtgaataggcattgtagctctgatttttggtcaccaggactggcatcacctcaaggattgaaatatagtgaagcagtaacagtaaaggcacctagaatccatagattgccagttactactaagcctcagggatcaacacaacaagtagacgctgctgtgaataaaattttacagaayatggtttacattggtgttgttttcccaaaagtgcctggtagtaagtggcgagatattaattttaggtgtcttatgcttcataataggcaatgtttaatgttgaggcattatattgagtcractgctgcctttcctgagggaaccaagtactatttyaagtatattcataatcaagagactagaatgtctggtgatatttctggtattgaaattgatttgttgaatttacctagattgtattatggtggtctcgcgggagaggagtcatttgatagcaatatcgtgcttgtgactatgcctaatcgtattcctgagtgtaagagcattattaaatttatagcgtcacataatgaacatatacgtgctcagaatgatggagtgttagtaactggcgaccatactcagttattggctttcgagaataataataagaccccaataagtatcaacgctgatggtttgtatgaggttatacttcaaggagtatatacttatccataccatggcgatggtgtttgtggttcgatattgctgtctcggaatttacaacggccaattataggtatccatgttgctggtactgaaggattgcatggctttggagtygctgaaccaytggtacatgaaatgttcaccggtaaagcaatcgagagtgaaagagagccgtatgatcgtgtgtatgaacttccgttgcgtgaattagatgaatctgatattggtttagataccgatttatatccgattggtagagtggatgcaaagttagctcatgctcaaagcccttctactgggatcaaaaagacgcttatccatggaacatttgatgtaaggactgaaccaaatccgatgtcgtcacgtgatccaagaatagcgccgcatgatcctttgaagttagggtgtgaaaagcatggtatgccttgttcaccgtttaataggaaacatctggaattagcgacaaatcatttgaaagaaaaattagtttcagtagttaaaccaataaatggttgcaagattagaagtttgcaagatgctrtatgtggtgtgcctggtttagatgggtttgattcgatatcttggaatactagtgctggttttcctttgtcttcattaaagccacctggaacatcaggyaagcgatggttgtttgayattgagctacaagaytcgggatgttatctcytgcgtggaatgcgtcccgaacttgagattcaattatcaacgacacagttaatgaggaaaaagggaataaaacctcacactatattcacggattgtttgaaagatacttgtttgcctgttgaaaaatgtagaatacctggtaagactagaatatttagtataagtccggtacagtttaccataccgtttcgacagtattacttagactttatggcatcctatcgagctgcacgacttaatgctgagcatggtattggtattgatgttaacagcttagagtggacaaatttggcaacaaggttgtctaagtwtggcactcacatcgtgacaggagattataagaattttggtcctgggttagattccgatgttgcagcttcagcgttcgaaattattatcgactgggtattacattacaccgaagaagataataaagaygaaatgaagcgagtaatgtggaccatggcgcaagagatcttagcgcctagtcatctatatcgcgacytggtgtaccgagtaccttgtggaattccatcaggttctccaataacggacatattgaayacaatttcaaattgtttgttaattaggttagcttggttaggtattactgacttgcctttgtccgagttctctcaaaatgttgttcttgtctgttatggcgacgatcttatcatgaatgttagygataacatgattgataagtttaatgccgtgacgataggaaaattcttttcacaatataagatggaatttacggatcaggataaatcaggaaatactgtaaagtggcggacgttacagactgctactttcttaaaacatgggttcttaaaacatccaactagacctgtgtttctagctaacctggacaaggtctcggtagaaggaacgacgaattggactcatgctcgaggattgggtcgtcgtacagcaaccatagaaaatgctaaacaagcgttagagttagcatttgggtggggtcctgaatattttaattatgtcagaaataccattaaaatggcttttgacaagttgggtatttatgaggaccttatcacatgggaagaaatggatgttagatgttacgctagtgcgtaatattaaattttaaatactcattaattttaattttattttaggttattggaattgagggaagtaccaccccccaagaccttcgttttaaatctactaagaggagtaaacctatatataagagtctaaagacagagtggattagaccatcatctttagcttatatacggggaaggttgagttgcctctaaagactcagctccatagtagagtagttttaattacgattaaagtggtactctaggttaggtgttactcgcgtattatcaactagtggtaatgcgtcctaattttagtatagttttaaccataatagt

SEQ ID NO: 11 - DNA, 1414 bp, Paenibacillus larvae
aatcgctgcaaacgatgattttgcaattgagggaagtgcctgcaacatgaatccgggaaaattaaaccgccggatcacatttcaaaagcacggtgaaacgacgaatgaaaacgggtttaaaacagatggctgggtggatgtgcagacggtttgggcgtgcatcaagacgctgaaagggaaagaattttatgaagcctctactacacagaaccaaaatacaacacggtttatcatccggtatcgaaaagggcttcaccctgacatgaggatcaaatataataaccgatattttgatattgaagccatcattaatgacgacgaaatgaataaaaccctgacgatacacgccaaggagagggtacaatgagctttcaagtgtctggtatggaggaattattagcccaactccgccatatgggagaaaaaggagacaaaataaaagagcaggccgagatggaaggtgcaaaaatcatgcagcaagccatcaaggaaggtactcctattggtcctcataccaaacacgctagagaccatgtagagattgaaaagatagacgacggcatgatagtgggctacggtgaagagcatttttacatgctttttctggaagccgggacatctgagcgatatacaaaaacaaagaaatacaaaggtaaagtatccgcaagaggaaatgtagagcggatctataatagcaacgagaaaaaggcactgaaagctatgcaggaggcggtgaaacgtgagttgaacctatgaccatacaaagtttgatacttagcaaactaagggaactacccgttccagtggcgtttgagacgcattttgagaaagagaatatgtatgtggtcttttttatcaacgacgaacgcccgctgttttgtgcagatgacgaagagcaactgaccaagtactttatccaggttgatatctggtcaaaaggggattacacggaaatagagaaacaagttaagcagaagatgcaggagctgggtgccatacggacaagtgcgtttggtctttatgctcccgacatacagatgtatcaaaaagtcttgcgttttgtgatgagcatgcctgcctaggcgtgctttttatttgtaaacaagggggaacaactatgggagtaccgattggggtaaggaatttatatgtagccatcttaaaaaccgatgataaaaatggtgcgacgtacgacaaacccgtccacctggctaaagcggttgagatcagcgtaaaaccgaatgtttcatccaccacgttttacgcggatgaccaagcatctgaatctgaatccacattggccgacattgaagtagagattacggtagatcaaattggatctaaaaacgccgccatgcttctgggggctaaagtggatgaaaacggagtgctggtttggaacagagatgatcaa

SEQ ID NO: 12 - DNA, 684 bp, Nosema ceranae
gcttaacttcggagagctgacgagttccggtgttttacagtagatatggccgtagctaagtactgcatagataaaattttattaaattaatttattgaaaaagtagttttcatattattttctaaattttcaaacttttaaattatagtacaattattttgagaaatttataattcattgatatattcttaaaagtaatctattaacattaaattataaaaatttttatgtactttgtaattacattataacacgataaaaataataatacacttttgtatttatctaatagatttatataataaacattaatgattctttttaattgttactaatttatgccatatattatatacatttctaaaattaaatcaaaaaagttatttattcttgaggagcaattttttcttatttaaaaattttctaatctgtaaattagtgattgatcaataaattactgatttattaaatgatttttttgaacccttgttaaaaaattatttattttaatttgataatatatcaatatgttttgtactttatttttattatagttttcatatattatatctgtggaatgtgttctttagaaatttattgtttctaattattttcttttatatactgacctttatggttatatataatgttgtatacacacaccaggttgattctgcctgacgt

SEQ ID NO: 13 - DNA, 692 bp, Nosema ceranae
gcttaacttcggagagctgacgagttccggtgttttacagtagatatggccgtagctaaatgccgcatagattaaattttattaaactaatttattgaaaaaatagttttcatattatttttaaattttcaaacttttaaattatagtacaattattttgagaaatttataattcactgatatattcttaaaagtaatctattaacattaaattataaaaattttttgtactttgtaattacattataacacgataaaaataataatacacttttgtatttatctaatagatttatataataaacataaaaatgattttttttaattgttactaatttatgccatatattatatacatttctaaaattaaatcaaaaaagttatttattcttgaggagcaaatttttcttatttaaaattttctaatctgtaaattagtgattgatcaataaattactgatttattaaatgatttttttgaacccttgttaaaaaaattatttatttcaatttgatgatatatcaatatgttttgtactttatttttatttatagttttcatatattatatctgtgaaatatgtatatgtatctttagaaatttactgtttctaattattttcttttatatactgacttttatggttatatataatgttgtatacacacaccaggttgattctgcctgacgt

SEQ ID NO: 14 - DNA, 686 bp, Nosema ceranae
gcttaacttcggagagctgatgagttccggtgttttacagtagatatggccgtagctaagcgctggatagattaaattttattaaactaatttattgaaaaagtagttttcacattattttctaaattttcaaacttttaaattatagtacaattattttgcgaaatttataattcattgatatattcttaaaagtaatctattaacattaaattataaaaatttttatgtactttgtaattacattataacacgataaaaataataatacacttttgtatttatctaatagatttatataataaacattaatgattctttttagttgttactaatttatgccatatattatatacatttctataattaaatcaaaaaagttatttattcttgaggagcaattttttcttatttaaaaattttctaatctgtaaattagtgattgatcaataaattactgatttattaaatgatttttaaacccttgttaaaaaaattatttattttaatttgataatatatcaatatgtcttgtactttatttttatttatatagttttcatatattatatctgtggaatgtgttctttagaaatttattatttctaattattttcttttatatactggcttttatggttatatataatgttgtatacacacaccaggttgattctgcctgacgt

SEQ ID NO: 15 - DNA, 2183 bp, Nosema apis
tacttgaacaaagttaaaaaaatactcgaaagtgtgtgtttttattgttcaaaaataaaagttgataaaaaaattttaaaaccagatttaaattctgtgtggaattattgtaaatctaaaactacttgtgaaggtgaaaatacaccagacggttatactggttgtggtaataaacaacctcttattaaaaaagaaggacttggactcgttgcttttatgaaaggggaagaaaactccgacggtaaagttattttaaatggagaaagggttttgagtattttgaaaaaaatttctgaacaagatgctaattatatgggatttgattttgttaatagtaaacccgaatggttaattttgactgttttgctagttcctcctccttctgtaagaccttctattgttatggagggaatgttaagagcagaagatgatctaacacacaaattggctgatattataaaagcaaatacatatttaaaaaaatatgagttggaaggcgctcctggtcatgttataagggattatgaacaattactacaatttcatatggctacaatggtagataatgatttaagtggacaaccacaagctttacaaaaaagtggaaggcctataaagtcgattagtgctagattaaaaggaaaagaaggtcgagtacgaggaaatttgatgggcaaaagggtagattttagtgcaagatctgttatcacaccagatgcaaatatttcattaatagaacttggagttccagtagaaattgctaaaattcayacatttcctgaagcaatcacctcatacaatattcacaagttgtctgaacttgtatcaaatggaccaaacgaatatcctggtgcaaattatgttataagatctgatggtcaaagaattgatctaaaatttaatagaagtgatattaaattagaagagggatatattgtcgaaagacatatgcaaaatggggayatagtyytatttaatagacaaccttcattacataaaatgtctatgatgggtcattacgtcagagtgatggaaggaaaaacrtttagattaaatttgagtgtcacaactccgtataatgcagattttgacggagatgaaatgaatttacacatgccacaatcacataattcaagagcagagcttgaagaactctgtctggtatctaaacaagtattgacaccacaagctaatcgtcctataatgggtattgtacaagayacactaactggacttcgtttgtttactttaagagactcgttttttgataaacgagaaacgatgctattactttattcagtagatcttgagaaatatgaaaatttaaaagaaggtggaatttgtgaatttatgaatygtccagcaatttcatatccaaagmaatattggacaggaaaacaaattatcagttttattttacctgatataatttttaatggaaattcaaatgaatttgatgargaggatttagaaaatgttaaagatttaaaaatttatttaagaaacggagaacttttatctggaattttagacaaaaaaactgtcggtgctacacaaggtggttttattcatataattgcaaatgattttggatctgaacgcgtcactgcattttttgatgacgtgcaaaaattgatcaataaatttattacgyatataaatatttttagtatgggaattggagacgcagtagctgatcaagatactatgttttatgtcaaggaatctatagaaagtgctaaagagaaagtakgtgatattataaaaaaagcacataaaaattcactagaaagattgccaggtatgtcyatgaaagaaagtttcgaaagtcaagttaatcatattttaaataaagcaagagacgtttctggtacctcaactcaaaaaagtttaaatttatctaataatctaaaaactatggttttgtctggatcaaaaggttcatttatcaatatttcacaggtaatggcttgtgtaggtcagcaaaatgttgaaggaaaacgaattccttttggattcaaatatcgaactctaccacattttttgaaagaagattattctggaaaaagtcgtggttttgtagaaaacagttatgttaaaggtttatcacctgaagaattttatttccatgccatgggtggtcgtgaaggattaattgatacagctattaaaactgcagaaac

SEQ ID NO: 16 - DNA, 9499 bp, Israel acute paralysis virus of bees; identical to SEQ ID NO: 6

SEQ ID NO: 17 - DNA, 241 bp, Nosema apis
tgccgacgatgtgatatgagatgttgtattacattatagaaattagagttttttggctctggggatagtatgatcgcaagattgaaaattaaagaaattgacggaagaataccacaaggagtggattgtgcggcttaatttgactcaacgcgaggtaacttaccaatattttattgttctgcgaggatatgatctgaggatgataatagtggtgcatggccgttttcaatggatgctgtga

SEQ ID NO: 18 - DNA, 241 bp, Nosema apis; identical to SEQ ID NO: 17

SEQ ID NO: 19 - DNA, 241 bp, Nosema apis; identical to SEQ ID NO: 17

SEQ ID NO: 20 - DNA, 8302 bp, Black queen cell virus
catatcaagtgggttaaagccccgtatgcttggagaccaggtttgtttgccgacttacggaatgtcgttaaactctaggctttccggatggcttctaattatccgaggcccgtacgtgggctcgaagtttagtagagagtacgcgtacaaaagtcctagttgttttcatacatcaagtgggttgaaagccccgtgtacttggaggctaggcagcacgattacagtagcctgtactacctgaagcatgtagtaaaactgcacagttgaacattgtcacaaacgggctgatagcgtatagctggattgttgagagatagcatcttgcgggatgtgaaagagcatgttagacatgtattatggcttttctcaatacgcagtctttgctatgcgtgtgtaggcaaaaggaagtgagagagctgaccgtctctcatgggtatttaggttattcagagtacgctgctactgcggtagcggacacaacccaggtgttcgggtctctgtcttagaaactatatgaaaggcgaaagttgtgattgaactttctaacgtcactcttaattggtacgtgtcgattaagttcatagcaatgaatagccaaccctataatgatggaaccaatttacgcaaatagacctaatgtatactattatcctttcaaacacaactgggaaccaagaatcttgatccttactgataaagaaggacaagagagcgtgaacaagaagtttctgagaaaattctctaaacttcgtaatttgtgtttgcgcctgcaaaaggacactacattttggaaaaatactgctggtagactggatatgatccaggatgacattgaaagtatggttgctcaaagtggccctgttatgagtcagagcttaagtgacagggttgaccgaatgtaccatgaactgatacatactaatgttgcccagatgaacttttccataccattttcgcataatttgtctaaggactcgaaagcgttccttactcaaaccgtggatacctctcttggtggtatgagacaaatttctaatgaaacagttaatactattaaagaggtgtttgagacatttttgaccaagatgacgaccacttttgaacaatgtgccgaagcttttaactttactatgagctttatgagatttttagcattagcctatgctattttctttcttatatctcgagcgactaaatttttcggggcctctttttctactatatctactgttttgataactcttatcactatgacagttacagataagttggttaagaagttcctcgttgattattattcgaaacacatggagaatgcgaaaatgttggcacaagcaggagaagaagattcgtcatttttgtcttatgttatcccaccattgttcctagaatctgtagtcgattctaaatcaaatttgtttaagcgaatttggagaagtaaagatttggatttaatagtcaagcggttatcttattttggagattccaagatatataacgcgtttgacaatattggaacttggttaacaactatgataaacacaacggtgaattatgtgaaggttacgctcctgggtcatgatcctgaagaatttctggagaatcagagtgaccctttggtggattgggaagagcagtgtaggaaacattttgtttcagatactgacagaatagcgatctatacagagtctacgttagcggatatcaaacgtctgtacaatatgggcgttagttatatgcgacatcctttgtataaaccccaccagcgtgttatttctgaaattctcaatcagttgcttaggtttgcggataagataaagaagaaggtcggtacagatgcttctgttcgaaaccccccagttactctgtatttatatggagaaacaggggtagggaagtctactttgacataccctttgtgtgccacccttcttaagactatctttaccagagaggggaatacagtgatgcttgattctcttaaacaacattataaagagatgatatacgtaagagctgcagaacaagagttctgggatggttatacgcagcaattagtcactgtatttgatgattttaatcaacaagttgattcctctgcaaatccaagtttggagttgtttgaaattattaggagttctaatatatttccttatccattacatatggcatcgatcgaagagaaagctaacactgtttttcaatcaaaggtgatattgtgttcttctaacaataagactccaaaaactgaatccctaaactacccgaaagctttgttgaggaggtttgcgaaatttgttgaagtaaagagagctccttctgaaagtggtacattttctactgattgttatacctttgtggaatatgatccattcgaccattgtaatatcgtcaaatcaatgtctttcaaagagttgatagatgaagtggtcgctatgtatttccacgaaggagagttcgtatcttccgtagataaatttatcatggaaaatgtgtttgctcagggaggaggctctttatcagatgaggaggatgatttcactgaggctagctcctatggtgatagtaatctggatgaaaccttgactcgtgaagaaaagaaagagatcatagagtgcatcaacgaccaacttaagaatgaaaatgatactagaacttcttttcagttgattagagattatttccattgtgctaaggattcgctacaagagaaattttcagcctatcgccgaaagtactctttcgacgaatggtttagtttctcaaaggcatctaaagtagtgttgggaatactctctttggtactggttggatatggtatatattcatatgttaaaggaactcctgcgaaagactcagcggaatcttacgaaccaaaagtggcgagtaaggttaaggttgagggaaataacagtgttcctgaggcgtacgaaccaaaagttagtagaaaagtcaaggttgaaggatacaatgcgagagagattaaacgtaaagtggaagcttatgctcccaaagttagtcgagctgtgcgcgtcgaatctagtgaggttgtaatacatcctaattctctgattgagaagggtgatgatattgtgcaatctgaagcatgtagtgatataaatgcttcggaacaactcactgctgttacgacaaataacacctatgtaatgaccattttatctaaagaatctgttattagagtggggcactgtatttttctgaaaggaaaaattgcagtagctcctggtcattatttacgtatacttcagcgcgcatatgagttagatgacggtgctattttacagtttaatcatccttacgggaagaggaacttctttacgtttgttggtgacatccaattctcgttgtataaaacgaaaaatatatctaaaacaaatgatctggattctcgtgacttgatgcactttgttgttgataagtcagtagttcacagggatatttcttcatatttctgtgaacgtttagagttgcaatccgtgggttcaactcgaatccagttacctgttatgcgatgggtaagagatgttggatatattttcgttaagtcgggacagggtactagttgtataaagaacgtttctaacgttagctatatgactgataccgatcctgatgcgcgagaaattcgattgagggaagcgtgggagtattcattagaaacgatatctggggatgggggagctcctcttttcgtaactaatagtaaaataggacctggtaagatcataggaattcatacagctggaggtcaccgttttggagttggcagttgctttgccactccgttttatatagaggatgtgaaagagatcttgtctcgatatgactataaagcgcaatcttgtgcttttgagttagtgttgcgacaggatctcgaaccatgtgctttacctaaccatttagatgaatgtgagttcatcttaatggggaaggttaaggatcccccagttcaaccatctagaagtaaaatttctccatctcccttatacggacacataactgaaccctctagtgcccctacttggttatatcctagagagcttgatggacagatttttgaccctctaaaatataggactgctagactcggaaaagatagtgttcctattaggagtaagttaattaatctggctaaaatggctctcatagacgatatatattctgtgtacttacaaaagaaagatctcttggatgggcgatttccatcatcattaacctttgatcaggcagtgttgggaatacccggggaggattatgtcaactcaataaaacgcgatacctcttgcggatatcctttcgttaaagaaggatggacgcgagctaaaatctttggtaatggcgatgagtatgacatgtccacttcgggcgttcaaatgctaagggaaaaagtacaagaatgcatagaggcggcaagacaggggaagatattggaccattatttcattgatacattaaaagatgaaaggaagcctaaacataaggctcataagtctcgaatgttttctaatggaccgatagattaccttgtctggagcaagatgtattttaatccaatagtagcggtgttatctgagctcaaaaatgtggatcatatttccgtagggtccaatgtgtattctacggactgggatgttatcgcaagatacttgaagtcaaaatctcaccatatggtggcaggagactttgaaggcttcgatgcttcggaacagtccgacatattgtacgctgcgggagaagttttacaagagttgagtaagaaaatttttaactcaaccgaggatgagattttgcagcagaaggctatccttcattcgttggttaattctcttcatatcaatgaaaatggaattgtccttcaatggtgcaagtctcttcctagtggccattatctcaccgctattattaattccgtctttgtgaacttggttatgtgtctcgtatttatggaagctaatcaaaaatattcatttacgactgcttcttcatttttccgtgaatgtggtatagtagcatatggagatgatcatgtcgtttctgttcctgaaaaatacttatctgtgtttaatcaacagacacttccagtgttgatgagtaaattcgggatgttttataccatagaaaccaaggatgacacagagattgatttcctttcgaggaaattggaagatgtgtcgtacttgaagcggaattttgtttatgacgaatctaggcaacgttatattgctcctctttctctggatgttatattggaaatgcccatgtggaccaaatctagcagggacattgtaacaaatgtattctgtaatttggaacacgctctcaaggaattatcattacatgataaggaattgtgggataaatggagtcctgtactgcattcgaagagcgaggaagttctgaaaatggtttcttctctgaaatttcaagatgaggttagggaaattgctcttggccttttaggttacgagtagttttcttatcaccttttaaaccaacaatgtgatcttgctcgcagaggcaaaaatttgcacagtataaaatctgcaagtagtgctattgttggaatcaccgtacctatttaggtttacgctccaagatcggtggatagcagccctatcaatatctaggagaactgtgctatgtttagaagattaggtagtctctaaacagaacaatttacctgctgaacaaattaatgaaaattatgaaaataaacaacaacttgttgaacagaccgaaattaccacctttgaaaacgatttgatcgtgctagaggatgggccgcaaatggaagaatctcttccttttgcgtttcacgggcagcacactgataatcgtcaacatacagtggttaatttcttgcaacgtccccaggttatttttgattcgtcttgggcgtctgatgtacctcgaaacaagcaattcatggattcgattatgatacctgatgatatcatctcttttccgatgtttgcagagaaactcaaagggttttcttctttgagagcaacagctgtgataacagtacagtttcagacgcaaccatttcaagcgggaagagttatgttgggatcattcccattaccaactttaaatccaactagggttaagtttgctactaaccatgtgtcccggttgatgcttttgaaccacgtgcaatgtgatattgccaaggagactgaggtttcgttacgaattccttttgtttccccatacaattcatatgatttggtttcgaagcgttttccgtgggcaaaggtggttgggttagtgtactcccccctaactacaactattcccgtagatttcatagtatacggtcattttgaggacgtggagttgggttgcccaacttctgggatgttggctcaagccggtctgaaggtacaacctcctacaaactctgactctcgacagcgtgccaaagagagtaagggcaaaaaggattactctaagacaggagcagcttttaaacaatctgtttcgaagctgggcgaacatctacctttcctcaaatcaggagcgaactgggtcagtgagaatattctgcaacctgcagatgaaatcataggacctatattgtctctttttgggttctcgaagcctcttttgcccattactaatcccaccgttttgcggcctgcgaatacctttgctatcactgataccaatgatatgtcgcatagtctggcgctttctaacgatactaatgtaccgtttgttaaggcgcttgatgggtcaggtttggacgaaatgagtttcgattacctaaagaaaataccccaattcatacagtcaaagttcttcaccacctcaactaaacctcaagaggttctgtttcagactaaagtgatgccacattactttgtccctgctggtgatgtgaatatcgctatggacaaggatacgattagaacgatctggcaacccagtcatttagcttatatcacttccatgttcaagtattggacgggttcgctcgtgtatactttcaaatttgttaaaacagactaccattctggtagggtggaaatttctttccaccctttttctgattataccgctggtacctattcggattatacttataggatcatagtggatttgagggaaaagtctgagttttcggtcacaatacctttcatttctccagttccatataaacgcatatctaagccagattgggataagccctattccaaatttgctcatgctagtacgggtactctagtcttgaaggcgttgacatcgttaaaagcaactaataccgtggtttccaattctgtggaaatcttgatagaagttaatgctggagacgacttcaacgttattgctcccatcgaaaacatctttttccccttctctctgtctccagggagagggagtatggttgctcaatctaattcggggactgaacaacaaaatcccaggggatcttctttgttaactgacccagagtcaataacgaagtctgatccttacaatccgaatatttctctcttgattagcggagaagtttttactaacttcagaaacttgattaagagagtaaatttcagaaaggctactacattgaatggaaagcgtatcggagatacgtttcccgttaatagcctgattgaagcaccccgtcttgatatagctcaatacgtcgatactgaaaccaaggaggctaaatatggatttagtttcttttggtcggctcccactaccttaaacatagtggcggagatgtatgcgctatatcgaggaggagttcgagttaaagtagttactgagaagggtgtggattacgtccgagctactataagtcctcaacagacttatggtagtgacgtcgctccaactacccatattagtactcctttggcaatagaacaaataccaataaagggagtcgcagagttccaaataccgtactatgctccatgtttatcatcttcgtttagagcgaattcagaaacattttactatagttcaggtcggaataatctcgatatagccacttcacctccctccatcaatcgctattatgcggttggtgcgggagatgatatggacttttccatctttatcggtacgccgccctgtattcatgcatctcagacggctcagtttaccaagataaaacaaggtaaagtgtatgatttgaggtatgatcagtacgaccccttccgggaagtccaggacggtacggctttcctcaatgctcgaagtattgaggatagcgatttgttgtgagctcctttagagggagggctcactttatctattgcttaat

SEQ ID NO: 21 - DNA, 442 bp, Melissococcus plutonius
ttatattgatactgaaacaatgcatttgcaccatgataaacatcataatacttatgtaactaaattgaatgaagcaattgaaaaacatcctgaacttggaaatcaatctgttgaggaattaattacaaatatgaatgcgattcccgaagatattcgtttagctgttcgcaataatggtggggggcatgtgaatcattcatttttctggaaagttatggggccaaatgctggtggtgaaccaactggtgctgtaaaagaagctattaatcaaacttttggtagtttcgaaaaaatgaaggaacaattcaatgcagctgcagctagtcggtttggttccggttgggcttggttggtcgttgacaaaaacaaaaaattgtcaattctatctacagccaaccaagattcaccactaatggaaggaaaaacaccaattttaggatta

SEQ ID NO: 22 - DNA, 242 bp, Nosema apis
ttgccgacgatgtgatatgagatgttgtattacattatagaaattagagttttttggctctggggatagtatgatcgcaagattgaaaattaaagaaattgacggaagaataccacaaggagtggattgtgcggcttaatttgactcaacgcgaggtaacttaccaatattttattgttctgcgaggatatgatctgaggatgataatagtggtgcatggccgttttcaatggatgctgtga

SEQ ID NO: 23 - DNA, 2305 bp, Chronic bee paralysis virus
gtaaaccttaggctttcatctatggatagagtcctaccattatccttcatctactactccttagctgagcagttacgcattgctgccatcatctctagcacattccacactcccgtcgttgtgttctccttggaccctcgttggactgacgccgacgccctatctcaccaaggcctacgttatctcaggtccggcaacgaacttgctgttctctccagggccgcccaacgaactttcatctgtccatctcaatacaccgaatacacaaccatcccattggactgtgacgaactcaatgtgcgatggcccgttcacgctcaatctcccgcagacgctctcgatcattgagcgccagtcgtcgtccgagccgaccacgccggtccattctagaccgcatcggccgtgcctttcaacgagtccttgccaatccaactgctgtggtagccttcgtcgtatgcgcgatcttagctgtttcccatacatcagatccagccaaatcaatcgtggttaccctcgggcagaagctccaaactgtcaatgccctcaaattcatcggggacttcatcacagaacatccggaacagacgataggcgccgtagctgtttctgctgcggtactcagctcagctcgacgctcagagaagtttgcttatatgatcggggcaatcctggtcgtatatgtgttgcctgcaacagatgcttggacatatggcgcttgggccgccgccctggcgttatttctccaactccgaaccatcgaggatcgcattctcctcagcgtctttgctctcggcgtttatgtctggactctccagactcaacagacagctcctccagcacagtaagcagcccggagaattcaagcgggatgtacacaccacccgccgggtccgattttctcgcccgacgtatcaaggccatgcttattctacccctcgccttatccatcataacatccattctgcctcccgcctccgccgcgcccaaacaaataccaatcgccaacttcaacgaattcctcatcaagaatcgtctaccaccatatcttcccttcagcatcaacgattcgaaactgttccactactacccaccgttacagttgagacgccggtgtgttgagattctacacaccagtaaacttgctcctgccgattgtagcctgccttcgtattgtggtcaggtccattggtcaaccttccaatccacctggtacgggagcgaagttggcgcatgtgttggtacaggcgtccatccgcctgttaggtacgagccatctccattttatcatatcctcaatcagggaaagtggttccggtcccataccatcataagtaccaatcaaccatatccttatcccattgtcaaaattcacaagatagacacacaagccacgctctcagaactccgcctgcttgagggcccagacgagtggcttttggtcactgctcgccagcttgacttctccttatatgtcaccgacaatcttgacgaacccaaatatcctaagtacgactggcttggaagcggtggctcttactgtttggtacagcctgaccggttcttcccacttcaaccccttgcacgcgccgacaaccctgactctctactcgaggtcttacccgtcttggtatcagcagacatcaagatatccaacatccaccgagacgttaacacaaccggactttgttatcctctctccacctactgcgtctttcggtccggttatgtcgacagccactctaacatctcacaggctgtcacttgtgatccatttaagatgacgacgcagtataacatccctgggtattcctggctcaagaaggcaatcttgttttttattgagtcagtcgttgacactctcatttccatcatattgtctctctttgatgagttcttatctttactgaggactctcaatgagaagtaccgtgtcttcgaatacctcgctctcattgggttctgcctctggcgtttccagaacccctggccaactgtatcaattgttggcttcactttggccatgatcggccttgcacggtagatactaccgttatatcgtctgacctactacactggtgccactgacagctaataacgcggtcaacaccactattctgggtcaggctggacttggtaattgggcatctgccaaccccactgtacgggcccataccgagacggatgcagcccctcttcaggaggccatgcaccctcttaccagtcctggataggtgctgtacctattcctatatgggggaacacagcagccatcgatagataagtcgtcatacgccctatcatggtt

SEQ ID NO: 24 - DNA, 617 bp, Artificial sequence
  Multiple parasites immunity SiRNA construct
aagaaatcacaacctttcatgatgtggaaactccaaataggatcgatacccccatggctcaggatacttcatcggctaggaacatggatgatacgcacagtattattcagtttttacagcgccccgttctcattgacaacattgagatcaaatacctataaagggagtcgcagagttccaaataccgtactatgctccatgtttgtcatcttcgtttagagcgaattcggaaacattttactatagttcaggtcggaataatctcgatatagccacttcacctcccaccgtcaatcgctattaacgttaatgcgacgatatcaattatatggtcaattattattgtccgttactacggataaggatattgatcattgtatgtttaccttcccttgtttaccacaagggttagcgttagacattggttctgctggctctccacatgaaatctttaatgttggaggcgcgtaattgcggagtggaaagattatctacaatccttacctctagtaagaagacatttgatacagtggactcttataccgatttgtttaatggttgggtttctggtatgtttgttgacaagaacgtccactacaccgaaatgtccagtgatg

SEQ ID NO: 25 - DNA, 22 bp, Artificial sequence
  Single strand DNA oligonucleotide
aagaaatcaacctttcatgatg

SEQ ID NO: 26 - DNA, 21 bp, Artificial sequence
  Single strand DNA oligonucleotide
atctcaatgttgtcaatgaga

SEQ ID NO: 27 - DNA, 23 bp, Artificial sequence
  Single strand DNA oligonucleotide
caatacctataaagggagtcgca

SEQ ID NO: 28 - DNA, 20 bp, Artificial sequence
  Single strand DNA oligonucleotide
taatagcgattgacggtggg

SEQ ID NO: 29 - DNA, 22 bp, Artificial sequence
  Single strand DNA oligonucleotide
acgttaatgcgacgatatcaat

SEQ ID NO: 30 - DNA, 23 bp, Artificial sequence
  Single strand DNA oligonucleotide
attaaagatttcatgtggagagc

SEQ ID NO: 31 - DNA, 19 bp, Artificial sequence
  Single strand DNA oligonucleotide
gttggaggcgcgtaattgc

SEQ ID NO: 32 - DNA, 23 bp, Artificial sequence
  Single strand DNA oligonucleotide
catcactggacatttcgtgtagt

SEQ ID NO: 33 - DNA, 427 bp, Israel acute paralysis virus of bees
gacacaattcttgaaatgccaaactggtgtcgaggaggacttgacattcaagaaggtacaaagttgaattgtgaaaatgcaattatggagctttccatgcatgaagagagcgtttttaatacctggtctaaaataattgaccgagtatatgcaaatgcgactggagatcacctggacataaacacttatcgtggttatgctcaggagcggtttctggaatactatatgtaagtatagtgttctggaggcatcattctatggttacccatcattagaggaaatttccaataaactctggtgtaaggcttagagtgatggtcgaggtgccctatttagggtgaggagcctcggtggcagccccaccaaatcctctattggataggaacagctgtactgggcagttacagcagtcgtatggtaacacatg

SEQ ID NO: 34 - DNA, 434 bp, Israel acute paralysis virus of bees
ccacccctctcaaacaatctcaaacatgctatataagaagctttcttataccacgtaattactcagctgatgaaattaacgtagacggaccttcacatataacataccccgtaatcaatcctgtgcatgaagtagaagttccattctattctcagtataggaaaatacctatcgcttcaacatcggataaaggttatgattcctctctaatgtatttttcaaatacagcaacaactcaaattgttgccagagcaggaaacgatgactttacctttggttggatgataggtccaccccagctacaaggcgaatcacgctccgtagccccctagatgtgcactgggagacagacaaatctccctatgtatggctatagtctaaatttttcacaaaatttcagtttagaccgaaaaccgacacttgaactggatata

SEQ ID NO: 35 - DNA, 22 bp, Artificial sequence
  Single strand DNA oligonucleotide
agacaccaatcacggacctcac

SEQ ID NO: 36 - DNA, 21 bp, Artificial sequence
  Single strand DNA oligonucleotide
gagattgtttgagaggggtgg

SEQ ID NO: 37 - DNA, 20 bp, Artificial sequence
  Single strand DNA oligonucleotide
atgaagatccttacagaaag

SEQ ID NO: 38 - DNA, 20 bp, Artificial sequence
  Single strand DNA oligonucleotide
tcttgtttagagatccacat

SEQ ID NO: 39 - DNA, 49 bp, Artificial sequence
  Single strand DNA oligonucleotide
taatacgactcactatagggcgaccacccctctcaaacaatctcaaaca

SEQ ID NO: 40 - DNA, 49 bp, Artificial sequence
  Single strand DNA oligonucleotide
taatacgactcactatagggcgatatatccagttcaagtgtcggttttc

SEQ ID NO: 41 - DNA, 48 bp, Artificial sequence
  Single strand DNA oligonucleotide
taatacgactcactatagggcgagacacaattcttgaaatgccaaact

SEQ ID NO: 42 - DNA, 49 bp, Artificial sequence
  Single strand DNA oligonucleotide
taatacgactcactatagggcgacatgtgttaccatacgactgctgtaa

SEQ ID NO: 43 - DNA, 49 bp, Artificial sequence
  Single strand DNA oligonucleotide
taatacgactcactatagggcgagccaacacttgtcactactttctctt

SEQ ID NO: 44 - DNA, 49 bp, Artificial sequence
  Single strand DNA oligonucleotide
taatacgactcactatagggcgaaggtaatggttgtctggtaaaaggac

SEQ ID NO: 45 - DNA, 20 bp, Artificial sequence
  Single strand DNA oligonucleotide
tgccaacactgtcctttctg

SEQ ID NO: 46 - DNA, 21 bp, Artificial sequence
  Single strand DNA oligonucleotide
ttgcattctatctgcgattcc

SEQ ID NO: 47 - DNA, 148 bp, Israel acute paralysis virus of bees
aagaaatcacaacctttcatgatgtggaaactccaaataggatcgatacccccatggctcaggatacttcatcggctaggaacatggatgatacgcacagtattattcagtttttacagcgccccgttctcattgacaacattgagat

SEQ ID NO: 48 - DNA, 155 bp, Black queen cell virus
caaatacctataaagggagtcgcagagttccaaataccgtactatgctccatgtttgtcatcttcgtttagagcgaattcggaaacattttactatagttcaggtcggaataatctcgatatagccacttcacctcccaccgtcaatcgctatta

SEQ ID NO: 49 - DNA, 153 bp, Deformed Wing Virus
acgttaatgcgacgatatcaattatatggtcaattattattgtccgttactacggataaggatattgatcattgtatgtttaccttcccttgtttaccacaagggttagcgttagacattggttctgctggctctccacatgaaatctttaat

SEQ ID NO: 50 - DNA, 161 bp, Sacbrood virus
gttggaggcgcgtaattgcggagtggaaagattatctacaatccttacctctagtaagaagacatttgatacagtggactcttataccgatttgtttaatggttgggtttctggtatgtttgttgacaagaacgtccactacaccgaaatgtccagtgatg

SEQ ID NO: 51 - protein, 1900 aa, Israel acute paralysis virus of bees
MWTKIDFFILHQDINCTGFTLTIVDKDERTKDLEYFDLNCEYYENLYDALMDSEFSKTWFTLLLKYIDYAPISTNSRGMPRPETICVSKHWWYELYRIGFLNKLYRCGDWDSILLLLSGDIEENPGPVDISYKESCRQKRMKKCVSKTYEEIKMQQHIDRINNEEKRAHMTKPRKLKDLIEVEMQGMFNWTEEREILKSTAFKFNHSMDRANHIMDNLIPQLEDTLSGFRQTYAKCEAKFFGSISVIDVCIDIISALLQVSFAKPGLKLASIAVEVFRLIKKYVSGIKINTDKIKELLTFGKQALSSSNPIIQVSMQMDMPEVDPSILLQPGVIVSAIFLVLSVVFTKTLPSKTGVEAMLKRTGELGRSAKGIMDLNTVLNTSVTSMLEYFGVHTLGLRQEAELQVLVEGYKTWCDEVAALVGHKINMDGTLDGRSIVEDIMRDTKEIQRVENLYKRGLEISRNIADMKLPTKLTISFNTHMRYLTEVFKAVDTSGAFGNKPRTQPVVIWLYGESGVGKSGMTWPLAVDLNNSLVDNVEEMRNFSKNIYMRNVEQEFWDNYQGQNVVVYDDFGQMRDSTSNPNPEFMELIRTANIAPYPLHMAHLEDKRKTKFTSKVIIMTSNVFEQSVNSLTFPDAFRRRVDLCAEVRNKVEFTKEGYSKTKGCMVRRLDKDLVKKKTGDICSTECYLVDLVNPETGEKYQTDLEYEDFLDMCLEKTQECRDNSAKLNEFLMNYAESRSKRPEQKHDKCPELEFEDAIEVSMQVDADSSLVPIEKSRLQEMIESCQGVVYDACGKTVYISKLAFELAPLEYEKQMERISGMKFYQKMASGVVYLRQVRDTSMKMLNSWMEECIQYAKDHPWTIVAGVLGTFIGILTIVGFWKWLCSDGQKKKQAIKRHFINTGYTLIIPERELNKFWELDETLDLRGMPVNQIEEHLALLLKPRHRVVLVPKATKYIISLVDNHAKLTDKIILITANRYVFYKNQNYELVFGELNQFFEKDPESLVNTPKVEAFASADLSTYKNRTPIVIEAQTSGDNVTLKQQKVKVIEAKTSTDEVTLKQQKPIVIEAQSSGDCVTRKQRVQRVIEAFASSDAVTLKKSTAKFVESDPNDIVDVTMQMWKDQVAQRLITNRVLTNLYKVCLVHNDDRITPLLNGLFVRSNLMLVPGHLLGFIAEYDTIEIRNLFDVVFRVPWKDVKKVPIVNAFGESKEAALLAFPKFVCQHSDLVKHFQNAESMSKFKRCEVTLPVLRFSEKVGKFLSTLIECDRVEAYDRPYTLNDSQKGQYILRQGLEYMMPTTNGDCGSPLIINETQVLRKIAGIHVAGATTGKAYAESITQKDLERAFIKIDVSMQIQLDLDSTLDFSKPEPKLPSGTEFGPEDLSFCDLPALKMLPVGKLSESLFEPGKTDIRPSLVHGQISDIKTKPAYLRNVIKDGDFVNMKHKNLMKCAMDTPYIDKDMIDEAYQLTKSVWLKGMRDELKKVLTYEEAICGSEVSEYISSINRSSSPGYPWIKDRTKGTKGKQGWFGSEGEYILNEDVRLAVQRRIQAAREGKRLPVMWVDTLKDERRPIEKVNQLKTRVFSNGPMDFSIAFRMYYLGFIAHLMENRITNEVSIGTNVYSQDWSKTVRKLTKFGNKVIAGDFSTFDGSLNVCIMEKFADLANEFYDDGKENNLIRHVLLMDVYNSVHICNDSVYMMTHSQPSGNPATTPLNCFINSMGLRMCFAICVKNAGIKMTMRDFGKHVSMVSYGDDNVINFSDEVCEWYNMETIAKAFETLGFTYTDELKGVNGEVPKWRSIKDVQYLKRKFRYDEQRKVWEAPLCMDTILEMPNWCRGGLDIQEGTKLNCENAIMELSMHEESVFNTWSKIIDRVYANATGDHLDINTYRGYAQERFLEYYM

SEQ ID NO: 52 - protein, 908 aa, Israel acute paralysis virus of bees
MVTHAAFRNTMPGDSQQESNTPNVHNTELASSTSENSVETQEITTFHDVETPNRIDTPMAQDTSSARNMDDTHSIIQFLQRPVLIDNIEIIAGTTADANKPLSRYVLDQQNSQKYVRSWTLPSTVLKAGGKAQKLANFKYLRCDVQVKLVLNANPFVAGRMYLAYSPYDDKVDTARSVLQTSRAGVTGYPGVELDFQLDNSVEMTIPYASFQEAYDLVTGTEDFVQLYLFPITPVLGPKSESESSKVDISVYMWLSNISLVIPTYRMNPDIVKQGASRMVTEFVPNPLEKDAKTIADALKKVQKNNPSGYKYIMHVLTGYEPEVKNVTMQVNAPKTKTSQKSTSENPKVGPISEVASGVKTTANGIERIPVIGEIAKPVTTAVKWFADVVGTVAAIFGWSKPRNQQQVCPFKMCLHGDILSIKAYDMSVPLAYDPNNELGDLKDVFPSAVDEMATGYVCGNPAVKHVLTWKTTDVIQKPIANGDDWGGVIPVGMPCYSKSIRITSISETENRETEVIDAAPCEYVANMFSYWRATMCYRITVVKTAFHTGRLEIFFEPGVIPVKPTVNNIGPDQDQLTGTAAPSDNNYKYILDLTNDTEVTVRVPFVSNKMFLKTAGIYGANSENNWNFHESFSGFLCIRPVTKLMAPDTVSDNVSIVVWKWAEDVVVVEPKPLTSGPTQVYRPPPTASTAVEVLNVELQINIGNKTNENVISFFDSTDAETQNHNALMKGCGEFIVNLRTLLRTFRTITDNWILQANTKTPITDLTNTTDAQGRDYMSYLSYLYRFYRGGRRYKFFNTTPLKQSQTCYIRSFLIPRNYSADEINVDGPSHITYPVINPVHEVEVPFYSQYRKIPIASTSDKGYDSSLMYFSNTATTQIVARAGNDDFTFGWMIGPPQLQGESRSVAP

SEQ ID NO: 53 - DNA, 10140 bp, Deformed Wing Virus; identical to SEQ ID NO: 10

SEQ ID NO: 54 - DNA, 21 bp, Artificial sequence
  SiRNA target sequence
gagcgtcgatcccccgtatgg

SEQ ID NO: 55 - DNA, 21 bp, Artificial sequence
  SiRNA target sequence
agcgtcgatcccccgtatgga

SEQ ID NO: 56 - DNA, 21 bp, Artificial sequence
  SiRNA target sequence
gcgtcgatcccccgtatggag

SEQ ID NO: 57 - DNA, 21 bp, Artificial sequence
  SiRNA target sequence
cgtcgatcccccgtatggagc

SEQ ID NO: 58 - DNA, 21 bp, Artificial sequence
  SiRNA target sequence
gtcgatcccccgtatggagcg

SEQ ID NO: 59 - DNA, 21 bp, Artificial sequence
  SiRNA target sequence
tcgatcccccgtatggagcgg

SEQ ID NO: 60 - DNA, 21 bp, Artificial sequence
  SiRNA target sequence
cgatcccccgtatggagcgga

SEQ ID NO: 61 - DNA, 21 bp, Artificial sequence
  SiRNA target sequence
gatcccccgtatggagcggag

SEQ ID NO: 62 - DNA, 21 bp, Artificial sequence
  SiRNA target sequence
atcccccgtatggagcggaga

SEQ ID NO: 63 - DNA, 21 bp, Artificial sequence
  SiRNA target sequence
tcccccgtatggagcggagaa

SEQ ID NO: 64 - DNA, 21 bp, Artificial sequence
  SiRNA target sequence
cccccgtatggagcggagaat

SEQ ID NO: 65 - DNA, 21 bp, Artificial sequence
  SiRNA target sequence
ccccgtatggagcggagaata

SEQ ID NO: 66 - DNA, 21 bp, Artificial sequence
  SiRNA target sequence
cccgtatggagcggagaatat

SEQ ID NO: 67 - DNA, 21 bp, Artificial sequence
  SiRNA target sequence
ccgtatggagcggagaatata

SEQ ID NO: 68 - DNA, 21 bp, Artificial sequence
  SiRNA target sequence
cgtatggagcggagaatataa

SEQ ID NO: 69 - DNA, 21 bp, Artificial sequence
  SiRNA target sequence
gtatggagcggagaatataag

SEQ ID NO: 70 - DNA, 21 bp, Artificial sequence
  SiRNA target sequence
tatggagcggagaatataagg

SEQ ID NO: 71 - DNA, 21 bp, Artificial sequence
  SiRNA target sequence
atggagcggagaatataaggc

SEQ ID NO: 72 - DNA, 21 bp, Artificial sequence
  SiRNA target sequence
tggagcggagaatataaggct

SEQ ID NO: 73 - DNA, 21 bp, Artificial sequence
  SiRNA target sequence
ggagcggagaatataaggctc

SEQ ID NO: 74 - DNA, 21 bp, Artificial sequence
  SiRNA target sequence
gagcggagaatataaggctca

SEQ ID NO: 75 - DNA, 21 bp, Artificial sequence
  SiRNA target sequence
agcggagaatataaggctcag

SEQ ID NO: 76 - DNA, 21 bp, Artificial sequence
  SiRNA target sequence
gcggagaatataaggctcagc

SEQ ID NO: 77 - DNA, 21 bp, Artificial sequence
  SiRNA target sequence
cggagaatataaggctcagct

SEQ ID NO: 78 - DNA, 21 bp, Artificial sequence
  SiRNA target sequence
ggagaatataaggctcagcta

SEQ ID NO: 79 - DNA, 21 bp, Artificial sequence
  SiRNA target sequence
gagaatataaggctcagctag

SEQ ID NO: 80 - DNA, 21 bp, Artificial sequence
  SiRNA target sequence
agaatataaggctcagctagg

SEQ ID NO: 81 - DNA, 21 bp, Artificial sequence
  SiRNA target sequence
gaatataaggctcagctagga

SEQ ID NO: 82 - DNA, 21 bp, Artificial sequence
  SiRNA target sequence
aatataaggctcagctaggat

SEQ ID NO: 83 - DNA, 21 bp, Artificial sequence
  SiRNA target sequence
atataaggctcagctaggatg

SEQ ID NO: 84 - DNA, 21 bp, Artificial sequence
  SiRNA target sequence
tataaggctcagctaggatga

SEQ ID NO: 85 - DNA, 21 bp, Artificial sequence
  SiRNA target sequence
ataaggctcagctaggatgac

SEQ ID NO: 86 - DNA, 21 bp, Artificial sequence
  SiRNA target sequence
taaggctcagctaggatgaca

SEQ ID NO: 87 - DNA, 21 bp, Artificial sequence
  SiRNA target sequence
aaggctcagctaggatgacac

SEQ ID NO: 88 - DNA, 21 bp, Artificial sequence
  SiRNA target sequence
aggctcagctaggatgacacg

SEQ ID NO: 89 - DNA, 21 bp, Artificial sequence
  SiRNA target sequence
ggctcagctaggatgacacgc

SEQ ID NO: 90 - DNA, 21 bp, Artificial sequence
  SiRNA target sequence
gctcagctaggatgacacgcc

SEQ ID NO: 91 - DNA, 21 bp, Artificial sequence
  SiRNA target sequence
ctcagctaggatgacacgcct

SEQ ID NO: 92 - DNA, 21 bp, Artificial sequence
  SiRNA target sequence
tcagctaggatgacacgcctg

SEQ ID NO: 93 - DNA, 21 bp, Artificial sequence
  SiRNA target sequence
cagctaggatgacacgcctgc

SEQ ID NO: 94 - DNA, 21 bp, Artificial sequence
  SiRNA target sequence
agctaggatgacacgcctgca

SEQ ID NO: 95 - DNA, 21 bp, Artificial sequence
  SiRNA target sequence
gctaggatgacacgcctgcac

SEQ ID NO: 96 - DNA, 21 bp, Artificial sequence
  SiRNA target sequence
ctaggatgacacgcctgcact

SEQ ID NO: 97 - DNA, 21 bp, Artificial sequence
  SiRNA target sequence
taggatgacacgcctgcactg

SEQ ID NO: 98 - DNA, 21 bp, Artificial sequence
  SiRNA target sequence
aggatgacacgcctgcactgt

SEQ ID NO: 99 - DNA, 21 bp, Artificial sequence
  SiRNA target sequence
ggatgacacgcctgcactgtc

SEQ ID NO: 100 - DNA, 21 bp, Artificial sequence
  SiRNA target sequence
gatgacacgcctgcactgtcg

SEQ ID NO: 101 - DNA, 21 bp, Artificial sequence
  SiRNA target sequence
atgacacgcctgcactgtcga

SEQ ID NO: 102 - DNA, 21 bp, Artificial sequence
  SiRNA target sequence
tgacacgcctgcactgtcgac

SEQ ID NO: 103 - DNA, 21 bp, Artificial sequence
  SiRNA target sequence
gacacgcctgcactgtcgaca

SEQ ID NO: 104 - DNA, 21 bp, Artificial sequence
  SiRNA target sequence
acacgcctgcactgtcgacat

SEQ ID NO: 105 - DNA, 21 bp, Artificial sequence
  SiRNA target sequence
cacgcctgcactgtcgacatt

SEQ ID NO: 106 - DNA, 21 bp, Artificial sequence
  SiRNA target sequence
acgcctgcactgtcgacatta

SEQ ID NO: 107 - DNA, 21 bp, Artificial sequence
  SiRNA target sequence
cgcctgcactgtcgacattag

SEQ ID NO: 108 - DNA, 21 bp, Artificial sequence
  SiRNA target sequence
gcctgcactgtcgacattagt

SEQ ID NO: 109 - DNA, 21 bp, Artificial sequence
  SiRNA target sequence
cctgcactgtcgacattagtt

SEQ ID NO: 110 - DNA, 21 bp, Artificial sequence
  SiRNA target sequence
ctgcactgtcgacattagtta

SEQ ID NO: 111 - DNA, 21 bp, Artificial sequence
  SiRNA target sequence
tgcactgtcgacattagttaa

SEQ ID NO: 112 - DNA, 21 bp, Artificial sequence
  SiRNA target sequence
gcactgtcgacattagttaag

SEQ ID NO: 113 - DNA, 21 bp, Artificial sequence
  SiRNA target sequence
cactgtcgacattagttaagt

SEQ ID NO: 114 - DNA, 21 bp, Artificial sequence
  SiRNA target sequence
actgtcgacattagttaagtt

SEQ ID NO: 115 - DNA, 21 bp, Artificial sequence
  SiRNA target sequence
ctgtcgacattagttaagttg

SEQ ID NO: 116 - DNA, 21 bp, Artificial sequence
  SiRNA target sequence
tgtcgacattagttaagttgc

SEQ ID NO: 117 - DNA, 21 bp, Artificial sequence
  SiRNA target sequence
gtcgacattagttaagttgca

SEQ ID NO: 118 - DNA, 21 bp, Artificial sequence
  SiRNA target sequence
tcgacattagttaagttgcaa

SEQ ID NO: 119 - DNA, 21 bp, Artificial sequence
  SiRNA target sequence
cgacattagttaagttgcaat

SEQ ID NO: 120 - DNA, 21 bp, Artificial sequence
  SiRNA target sequence
gacattagttaagttgcaatt

SEQ ID NO: 121 - DNA, 21 bp, Artificial sequence
  SiRNA target sequence
acattagttaagttgcaatta

SEQ ID NO: 122 - DNA, 21 bp, Artificial sequence
  SiRNA target sequence
cattagttaagttgcaattac

SEQ ID NO: 123 - DNA, 21 bp, Artificial sequence
  SiRNA target sequence
attagttaagttgcaattaca

SEQ ID NO: 124 - DNA, 21 bp, Artificial sequence
  SiRNA target sequence
ttagttaagttgcaattacac

SEQ ID NO: 125 - DNA, 21 bp, Artificial sequence
  SiRNA target sequence
tagttaagttgcaattacacg

SEQ ID NO: 126 - DNA, 21 bp, Artificial sequence
  SiRNA target sequence
agttaagttgcaattacacgt

SEQ ID NO: 127 - DNA, 21 bp, Artificial sequence
  SiRNA target sequence
gttaagttgcaattacacgtc

SEQ ID NO: 128 - DNA, 21 bp, Artificial sequence
  SiRNA target sequence
ttaagttgcaattacacgtct

SEQ ID NO: 129 - DNA, 21 bp, Artificial sequence
  SiRNA target sequence
taagttgcaattacacgtctg

SEQ ID NO: 130 - DNA, 21 bp, Artificial sequence
  SiRNA target sequence
aagttgcaattacacgtctgt

SEQ ID NO: 131 - DNA, 21 bp, Artificial sequence
  SiRNA target sequence
agttgcaattacacgtctgtt

SEQ ID NO: 132 - DNA, 21 bp, Artificial sequence
  SiRNA target sequence
gttgcaattacacgtctgttg

SEQ ID NO: 133 - DNA, 21 bp, Artificial sequence
  SiRNA target sequence
ttgcaattacacgtctgttgc

SEQ ID NO: 134 - DNA, 21 bp, Artificial sequence
  SiRNA target sequence
tgcaattacacgtctgttgcc

SEQ ID NO: 135 - DNA, 21 bp, Artificial sequence
  SiRNA target sequence
gcaattacacgtctgttgccg

SEQ ID NO: 136 - DNA, 21 bp, Artificial sequence
  SiRNA target sequence
caattacacgtctgttgccga

SEQ ID NO: 137 - DNA, 21 bp, Artificial sequence
  SiRNA target sequence
aattacacgtctgttgccgaa

SEQ ID NO: 138 - DNA, 21 bp, Artificial sequence
  SiRNA target sequence
attacacgtctgttgccgaag

SEQ ID NO: 139 - DNA, 21 bp, Artificial sequence
  SiRNA target sequence
ttacacgtctgttgccgaaga

SEQ ID NO: 140 - DNA, 21 bp, Artificial sequence
  SiRNA target sequence
tacacgtctgttgccgaagaa

SEQ ID NO: 141 - DNA, 21 bp, Artificial sequence
  SiRNA target sequence
acacgtctgttgccgaagaaa

SEQ ID NO: 142 - DNA, 21 bp, Artificial sequence
  SiRNA target sequence
cacgtctgttgccgaagaaac

SEQ ID NO: 143 - DNA, 21 bp, Artificial sequence
  SiRNA target sequence
acgtctgttgccgaagaaacc

SEQ ID NO: 144 - DNA, 21 bp, Artificial sequence
  SiRNA target sequence
cgtctgttgccgaagaaacca

SEQ ID NO: 145 - DNA, 21 bp, Artificial sequence
  SiRNA target sequence
gtctgttgccgaagaaaccat

SEQ ID NO: 146 - DNA, 21 bp, Artificial sequence
  SiRNA target sequence
tctgttgccgaagaaaccatt

SEQ ID NO: 147 - DNA, 21 bp, Artificial sequence
  SiRNA target sequence
ctgttgccgaagaaaccattt

SEQ ID NO: 148 - DNA, 21 bp, Artificial sequence
  SiRNA target sequence
tgttgccgaagaaaccatttt

SEQ ID NO: 149 - DNA, 21 bp, Artificial sequence
  SiRNA target sequence
gttgccgaagaaaccatttta

SEQ ID NO: 150 - DNA, 21 bp, Artificial sequence
  SiRNA target sequence
ttgccgaagaaaccattttag

SEQ ID NO: 151 - DNA, 21 bp, Artificial sequence
  SiRNA target sequence
tgccgaagaaaccattttagt

SEQ ID NO: 152 - DNA, 21 bp, Artificial sequence
  SiRNA target sequence
gccgaagaaaccattttagtc

SEQ ID NO: 153 - DNA, 21 bp, Artificial sequence
  SiRNA target sequence
ccgaagaaaccattttagtca

SEQ ID NO: 154 - DNA, 21 bp, Artificial sequence
  SiRNA target sequence
cgaagaaaccattttagtcaa

SEQ ID NO: 155 - DNA, 21 bp, Artificial sequence
  SiRNA target sequence
gaagaaaccattttagtcaac

SEQ ID NO: 156 - DNA, 21 bp, Artificial sequence
  SiRNA target sequence
aagaaaccattttagtcaact

SEQ ID NO: 157 - DNA, 21 bp, Artificial sequence
  SiRNA target sequence
agaaaccattttagtcaactg

SEQ ID NO: 158 - DNA, 21 bp, Artificial sequence
  SiRNA target sequence
gaaaccattttagtcaactga

SEQ ID NO: 159 - DNA, 21 bp, Artificial sequence
  SiRNA target sequence
aaaccattttagtcaactgat

SEQ ID NO: 160 - DNA, 21 bp, Artificial sequence
  SiRNA target sequence
aaccattttagtcaactgatt

SEQ ID NO: 161 - DNA, 21 bp, Artificial sequence
  SiRNA target sequence
accattttagtcaactgatta

SEQ ID NO: 162 - DNA, 21 bp, Artificial sequence
  SiRNA target sequence
ccattttagtcaactgattat

SEQ ID NO: 163 - DNA, 21 bp, Artificial sequence
  SiRNA target sequence
cattttagtcaactgattatg

SEQ ID NO: 164 - DNA, 21 bp, Artificial sequence
  SiRNA target sequence
attttagtcaactgattatga

SEQ ID NO: 165 - DNA, 21 bp, Artificial sequence
  SiRNA target sequence
ttttagtcaactgattatgat

SEQ ID NO: 166 - DNA, 21 bp, Artificial sequence
  SiRNA target sequence
tttagtcaactgattatgatt

SEQ ID NO: 167 - DNA, 21 bp, Artificial sequence
  SiRNA target sequence
ttagtcaactgattatgattt

SEQ ID NO: 168 - DNA, 21 bp, Artificial sequence
  SiRNA target sequence
tagtcaactgattatgatttt

SEQ ID NO: 169 - DNA, 21 bp, Artificial sequence
  SiRNA target sequence
agtcaactgattatgattttt

SEQ ID NO: 170 - DNA, 21 bp, Artificial sequence
  SiRNA target sequence
gtcaactgattatgatttttg

SEQ ID NO: 171 - DNA, 21 bp, Artificial sequence
  SiRNA target sequence
tcaactgattatgatttttgt

SEQ ID NO: 172 - DNA, 21 bp, Artificial sequence
  SiRNA target sequence
caactgattatgatttttgta

SEQ ID NO: 173 - DNA, 21 bp, Artificial sequence
  SiRNA target sequence
aactgattatgatttttgtat

SEQ ID NO: 174 - DNA, 21 bp, Artificial sequence
  SiRNA target sequence
actgattatgatttttgtata

SEQ ID NO: 175 - DNA, 21 bp, Artificial sequence
  SiRNA target sequence
ctgattatgatttttgtataa

SEQ ID NO: 176 - DNA, 21 bp, Artificial sequence
  SiRNA target sequence
tgattatgatttttgtataat

SEQ ID NO: 177 - DNA, 21 bp, Artificial sequence
  SiRNA target sequence
gattatgatttttgtataatg

SEQ ID NO: 178 - DNA, 21 bp, Artificial sequence
  SiRNA target sequence
attatgatttttgtataatga

SEQ ID NO: 179 - DNA, 21 bp, Artificial sequence
  SiRNA target sequence
ttatgatttttgtataatgat

SEQ ID NO: 180 - DNA, 21 bp, Artificial sequence
  SiRNA target sequence
tatgatttttgtataatgata

SEQ ID NO: 181 - DNA, 21 bp, Artificial sequence
  SiRNA target sequence
atgatttttgtataatgataa

SEQ ID NO: 182 - DNA, 21 bp, Artificial sequence
  SiRNA target sequence
tgatttttgtataatgataaa

SEQ ID NO: 183 - DNA, 21 bp, Artificial sequence
  SiRNA target sequence
gatttttgtataatgataaac

SEQ ID NO: 184 - DNA, 21 bp, Artificial sequence
  SiRNA target sequence
atttttgtataatgataaaca

SEQ ID NO: 185 - DNA, 21 bp, Artificial sequence
  SiRNA target sequence
tttttgtataatgataaacag

SEQ ID NO: 186 - DNA, 21 bp, Artificial sequence
  SiRNA target sequence
ttttgtataatgataaacagt

SEQ ID NO: 187 - DNA, 21 bp, Artificial sequence
  SiRNA target sequence
tttgtataatgataaacagtg

SEQ ID NO: 188 - DNA, 21 bp, Artificial sequence
  SiRNA target sequence
ttgtataatgataaacagtga

SEQ ID NO: 189 - DNA, 21 bp, Artificial sequence
  SiRNA target sequence
tgtataatgataaacagtgat

SEQ ID NO: 190 - DNA, 21 bp, Artificial sequence
  SiRNA target sequence
gtataatgataaacagtgatg

SEQ ID NO: 191 - DNA, 21 bp, Artificial sequence
  SiRNA target sequence
tataatgataaacagtgatga

SEQ ID NO: 192 - DNA, 21 bp, Artificial sequence
  SiRNA target sequence
ataatgataaacagtgatgaa

SEQ ID NO: 193 - DNA, 21 bp, Artificial sequence
  SiRNA target sequence
taatgataaacagtgatgaac

SEQ ID NO: 194 - DNA, 21 bp, Artificial sequence
  SiRNA target sequence
aatgataaacagtgatgaact

SEQ ID NO: 195 - DNA, 21 bp, Artificial sequence
  SiRNA target sequence
atgataaacagtgatgaactg

SEQ ID NO: 196 - DNA, 21 bp, Artificial sequence
  SiRNA target sequence
tgataaacagtgatgaactgt

SEQ ID NO: 197 - DNA, 21 bp, Artificial sequence
  SiRNA target sequence
gataaacagtgatgaactgta

SEQ ID NO: 198 - DNA, 21 bp, Artificial sequence
  SiRNA target sequence
ataaacagtgatgaactgtat

SEQ ID NO: 199 - DNA, 21 bp, Artificial sequence
  SiRNA target sequence
taaacagtgatgaactgtata

SEQ ID NO: 200 - DNA, 21 bp, Artificial sequence
  SiRNA target sequence
aaacagtgatgaactgtataa

SEQ ID NO: 201 - DNA, 21 bp, Artificial sequence
  SiRNA target sequence
aacagtgatgaactgtataac

SEQ ID NO: 202 - DNA, 21 bp, Artificial sequence
  SiRNA target sequence
acagtgatgaactgtataact

SEQ ID NO: 203 - DNA, 21 bp, Artificial sequence
  SiRNA target sequence
cagtgatgaactgtataactc

SEQ ID NO: 204 - DNA, 21 bp, Artificial sequence
  SiRNA target sequence
agtgatgaactgtataactca

SEQ ID NO: 205 - DNA, 21 bp, Artificial sequence
  SiRNA target sequence
gtgatgaactgtataactcat

SEQ ID NO: 206 - DNA, 21 bp, Artificial sequence
  SiRNA target sequence
tgatgaactgtataactcatc

SEQ ID NO: 207 - DNA, 21 bp, Artificial sequence
  SiRNA target sequence
gatgaactgtataactcatca

SEQ ID NO: 208 - DNA, 21 bp, Artificial sequence
  SiRNA target sequence
atgaactgtataactcatcaa

SEQ ID NO: 209 - DNA, 21 bp, Artificial sequence
  SiRNA target sequence
tgaactgtataactcatcaac

SEQ ID NO: 210 - DNA, 21 bp, Artificial sequence
  SiRNA target sequence
gaactgtataactcatcaaca

SEQ ID NO: 211 - DNA, 21 bp, Artificial sequence
  SiRNA target sequence
aactgtataactcatcaacaa

SEQ ID NO: 212 - DNA, 21 bp, Artificial sequence
  SiRNA target sequence
actgtataactcatcaacaac

SEQ ID NO: 213 - DNA, 21 bp, Artificial sequence
  SiRNA target sequence
ctgtataactcatcaacaaca

SEQ ID NO: 214 - DNA, 21 bp, Artificial sequence
  SiRNA target sequence
tgtataactcatcaacaacaa

SEQ ID NO: 215 - DNA, 21 bp, Artificial sequence
  SiRNA target sequence
gtataactcatcaacaacaaa

SEQ ID NO: 216 - DNA, 21 bp, Artificial sequence
  SiRNA target sequence
tataactcatcaacaacaaaa

SEQ ID NO: 217 - DNA, 21 bp, Artificial sequence
  SiRNA target sequence
ataactcatcaacaacaaaac

SEQ ID NO: 218 - DNA, 21 bp, Artificial sequence
  SiRNA target sequence
taactcatcaacaacaaaacg

SEQ ID NO: 219 - DNA, 21 bp, Artificial sequence
  SiRNA target sequence
aactcatcaacaacaaaacgg

SEQ ID NO: 220 - DNA, 21 bp, Artificial sequence
  SiRNA target sequence
actcatcaacaacaaaacgga

SEQ ID NO: 221 - DNA, 21 bp, Artificial sequence
  SiRNA target sequence
ctcatcaacaacaaaacggat

SEQ ID NO: 222 - DNA, 21 bp, Artificial sequence
  SiRNA target sequence
tcatcaacaacaaaacggatt

SEQ ID NO: 223 - DNA, 21 bp, Artificial sequence
  SiRNA target sequence
catcaacaacaaaacggatta

SEQ ID NO: 224 - DNA, 21 bp, Artificial sequence
  SiRNA target sequence
atcaacaacaaaacggattac

SEQ ID NO: 225 - DNA, 21 bp, Artificial sequence
  SiRNA target sequence
tcaacaacaaaacggattacg

SEQ ID NO: 226 - DNA, 21 bp, Artificial sequence
  SiRNA target sequence
caacaacaaaacggattacga

SEQ ID NO: 227 - DNA, 21 bp, Artificial sequence
  SiRNA target sequence
aacaacaaaacggattacgaa

SEQ ID NO: 228 - DNA, 21 bp, Artificial sequence
  SiRNA target sequence
acaacaaaacggattacgaac

SEQ ID NO: 229 - DNA, 21 bp, Artificial sequence
  SiRNA target sequence
caacaaaacggattacgaacc

SEQ ID NO: 230 - DNA, 21 bp, Artificial sequence
  SiRNA target sequence
aacaaaacggattacgaacct

SEQ ID NO: 231 - DNA, 21 bp, Artificial sequence
  SiRNA target sequence
acaaaacggattacgaaccta

SEQ ID NO: 232 - DNA, 21 bp, Artificial sequence
  SiRNA target sequence
caaaacggattacgaacctat

SEQ ID NO: 233 - DNA, 21 bp, Artificial sequence
  SiRNA target sequence
aaaacggattacgaacctatt

SEQ ID NO: 234 - DNA, 21 bp, Artificial sequence
  SiRNA target sequence
aaacggattacgaacctattt

SEQ ID NO: 235 - DNA, 21 bp, Artificial sequence
  SiRNA target sequence
aacggattacgaacctatttg

SEQ ID NO: 236 - DNA, 21 bp, Artificial sequence
  SiRNA target sequence
acggattacgaacctatttgt

SEQ ID NO: 237 - DNA, 21 bp, Artificial sequence
  SiRNA target sequence
cggattacgaacctatttgta

SEQ ID NO: 238 - DNA, 21 bp, Artificial sequence
  SiRNA target sequence
ggattacgaacctatttgtaa

SEQ ID NO: 239 - DNA, 21 bp, Artificial sequence
  SiRNA target sequence
gattacgaacctatttgtaac

SEQ ID NO: 240 - DNA, 21 bp, Artificial sequence
  SiRNA target sequence
attacgaacctatttgtaact

SEQ ID NO: 241 - DNA, 21 bp, Artificial sequence
  SiRNA target sequence
ttacgaacctatttgtaacta

SEQ ID NO: 242 - DNA, 21 bp, Artificial sequence
  SiRNA target sequence
tacgaacctatttgtaactat

SEQ ID NO: 243 - DNA, 21 bp, Artificial sequence
  SiRNA target sequence
acgaacctatttgtaactatc

SEQ ID NO: 244 - DNA, 21 bp, Artificial sequence
  SiRNA target sequence
cgaacctatttgtaactatct

SEQ ID NO: 245 - DNA, 21 bp, Artificial sequence
  SiRNA target sequence
gaacctatttgtaactatctt

SEQ ID NO: 246 - DNA, 21 bp, Artificial sequence
  SiRNA target sequence
aacctatttgtaactatcttg

SEQ ID NO: 247 - DNA, 21 bp, Artificial sequence
  SiRNA target sequence
acctatttgtaactatcttga

SEQ ID NO: 248 - DNA, 21 bp, Artificial sequence
  SiRNA target sequence
cctatttgtaactatcttgat

SEQ ID NO: 249 - DNA, 21 bp, Artificial sequence
  SiRNA target sequence
ctatttgtaactatcttgatc

SEQ ID NO: 250 - DNA, 21 bp, Artificial sequence
  SiRNA target sequence
tatttgtaactatcttgatcg

SEQ ID NO: 251 - DNA, 21 bp, Artificial sequence
  SiRNA target sequence
atttgtaactatcttgatcga

SEQ ID NO: 252 - DNA, 21 bp, Artificial sequence
  SiRNA target sequence
tttgtaactatcttgatcgaa

SEQ ID NO: 253 - DNA, 21 bp, Artificial sequence
  SiRNA target sequence
ttgtaactatcttgatcgaag

SEQ ID NO: 254 - DNA, 21 bp, Artificial sequence
  SiRNA target sequence
tgtaactatcttgatcgaagt

SEQ ID NO: 255 - DNA, 21 bp, Artificial sequence
  SiRNA target sequence
gtaactatcttgatcgaagtc

SEQ ID NO: 256 - DNA, 21 bp, Artificial sequence
  SiRNA target sequence
taactatcttgatcgaagtct

SEQ ID NO: 257 - DNA, 21 bp, Artificial sequence
  SiRNA target sequence
aactatcttgatcgaagtcta

SEQ ID NO: 258 - DNA, 21 bp, Artificial sequence
  SiRNA target sequence
actatcttgatcgaagtctag

SEQ ID NO: 259 - DNA, 21 bp, Artificial sequence
  SiRNA target sequence
ctatcttgatcgaagtctagt

SEQ ID NO: 260 - DNA, 21 bp, Artificial sequence
  SiRNA target sequence
tatcttgatcgaagtctagta

SEQ ID NO: 261 - DNA, 21 bp, Artificial sequence
  SiRNA target sequence
atcttgatcgaagtctagtag

SEQ ID NO: 262 - DNA, 21 bp, Artificial sequence
  SiRNA target sequence
tcttgatcgaagtctagtaga

SEQ ID NO: 263 - DNA, 21 bp, Artificial sequence
  SiRNA target sequence
cttgatcgaagtctagtagat

SEQ ID NO: 264 - DNA, 21 bp, Artificial sequence
  SiRNA target sequence
ttgatcgaagtctagtagatc

SEQ ID NO: 265 - DNA, 21 bp, Artificial sequence
  SiRNA target sequence
tgatcgaagtctagtagatcc

SEQ ID NO: 266 - DNA, 21 bp, Artificial sequence
  SiRNA target sequence
gatcgaagtctagtagatccc

SEQ ID NO: 267 - DNA, 21 bp, Artificial sequence
  SiRNA target sequence
atcgaagtctagtagatcccc

SEQ ID NO: 268 - DNA, 21 bp, Artificial sequence
  SiRNA target sequence
tcgaagtctagtagatcccca

SEQ ID NO: 269 - DNA, 21 bp, Artificial sequence
  SiRNA target sequence
cgaagtctagtagatccccaa

SEQ ID NO: 270 - DNA, 21 bp, Artificial sequence
  SiRNA target sequence
gaagtctagtagatccccaat

SEQ ID NO: 271 - DNA, 21 bp, Artificial sequence
  SiRNA target sequence
aagtctagtagatccccaata

SEQ ID NO: 272 - DNA, 21 bp, Artificial sequence
  SiRNA target sequence
agtctagtagatccccaatat

SEQ ID NO: 273 - DNA, 21 bp, Artificial sequence
  SiRNA target sequence
gtctagtagatccccaatata

SEQ ID NO: 274 - DNA, 21 bp, Artificial sequence
  SiRNA target sequence
tctagtagatccccaatatag

SEQ ID NO: 275 - DNA, 21 bp, Artificial sequence
  SiRNA target sequence
ctagtagatccccaatatagc

SEQ ID NO: 276 - DNA, 21 bp, Artificial sequence
  SiRNA target sequence
tagtagatccccaatatagcc

SEQ ID NO: 277 - DNA, 21 bp, Artificial sequence
  SiRNA target sequence
agtagatccccaatatagccc

SEQ ID NO: 278 - DNA, 21 bp, Artificial sequence
  SiRNA target sequence
gtagatccccaatatagccct

SEQ ID NO: 279 - DNA, 21 bp, Artificial sequence
  SiRNA target sequence
tagatccccaatatagccctg

SEQ ID NO: 280 - DNA, 21 bp, Artificial sequence
  SiRNA target sequence
agatccccaatatagccctga

SEQ ID NO: 281 - DNA, 21 bp, Artificial sequence
  SiRNA target sequence
gatccccaatatagccctgaa

SEQ ID NO: 282 - DNA, 21 bp, Artificial sequence
  SiRNA target sequence
atccccaatatagccctgaaa

SEQ ID NO: 283 - DNA, 21 bp, Artificial sequence
  SiRNA target sequence
tccccaatatagccctgaaaa

SEQ ID NO: 284 - DNA, 21 bp, Artificial sequence
  SiRNA target sequence
ccccaatatagccctgaaaag

SEQ ID NO: 285 - DNA, 21 bp, Artificial sequence
  SiRNA target sequence
cccaatatagccctgaaaagc

SEQ ID NO: 286 - DNA, 21 bp, Artificial sequence
  SiRNA target sequence
ccaatatagccctgaaaagct

SEQ ID NO: 287 - DNA, 21 bp, Artificial sequence
  SiRNA target sequence
caatatagccctgaaaagctt

SEQ ID NO: 288 - DNA, 21 bp, Artificial sequence
  SiRNA target sequence
aatatagccctgaaaagcttg

SEQ ID NO: 289 - DNA, 21 bp, Artificial sequence
  SiRNA target sequence
atatagccctgaaaagcttga

SEQ ID NO: 290 - DNA, 21 bp, Artificial sequence
  SiRNA target sequence
tatagccctgaaaagcttgag

SEQ ID NO: 291 - DNA, 21 bp, Artificial sequence
  SiRNA target sequence
atagccctgaaaagcttgagg

SEQ ID NO: 292 - DNA, 21 bp, Artificial sequence
  SiRNA target sequence
tagccctgaaaagcttgaggg

SEQ ID NO: 293 - DNA, 21 bp, Artificial sequence
  SiRNA target sequence
agccctgaaaagcttgaggga

SEQ ID NO: 294 - DNA, 21 bp, Artificial sequence
  SiRNA target sequence
gccctgaaaagcttgagggac

SEQ ID NO: 295 - DNA, 21 bp, Artificial sequence
  SiRNA target sequence
ccctgaaaagcttgagggacg

SEQ ID NO: 296 - DNA, 21 bp, Artificial sequence
  SiRNA target sequence
cctgaaaagcttgagggacga

SEQ ID NO: 297 - DNA, 21 bp, Artificial sequence
  SiRNA target sequence
ctgaaaagcttgagggacgag

SEQ ID NO: 298 - DNA, 21 bp, Artificial sequence
  SiRNA target sequence
tgaaaagcttgagggacgaga

SEQ ID NO: 299 - DNA, 21 bp, Artificial sequence
  SiRNA target sequence
gaaaagcttgagggacgagat

SEQ ID NO: 300 - DNA, 21 bp, Artificial sequence
  SiRNA target sequence
aaaagcttgagggacgagata

SEQ ID NO: 301 - DNA, 21 bp, Artificial sequence
  SiRNA target sequence
aaagcttgagggacgagatag

SEQ ID NO: 302 - DNA, 21 bp, Artificial sequence
  SiRNA target sequence
aagcttgagggacgagatagc

SEQ ID NO: 303 - DNA, 21 bp, Artificial sequence
  SiRNA target sequence
agcttgagggacgagatagct

SEQ ID NO: 304 - DNA, 21 bp, Artificial sequence
  SiRNA target sequence
gcttgagggacgagatagctc

SEQ ID NO: 305 - DNA, 21 bp, Artificial sequence
  SiRNA target sequence
cttgagggacgagatagctct

SEQ ID NO: 306 - DNA, 21 bp, Artificial sequence
  SiRNA target sequence
ttgagggacgagatagctcta

SEQ ID NO: 307 - DNA, 21 bp, Artificial sequence
  SiRNA target sequence
tgagggacgagatagctctat

SEQ ID NO: 308 - DNA, 21 bp, Artificial sequence
  SiRNA target sequence
gagggacgagatagctctata

SEQ ID NO: 309 - DNA, 21 bp, Artificial sequence
  SiRNA target sequence
agggacgagatagctctataa

SEQ ID NO: 310 - DNA, 21 bp, Artificial sequence
  SiRNA target sequence
gggacgagatagctctataaa

SEQ ID NO: 311 - DNA, 21 bp, Artificial sequence
  SiRNA target sequence
ggacgagatagctctataaat

SEQ ID NO: 312 - DNA, 21 bp, Artificial sequence
  SiRNA target sequence
gacgagatagctctataaata

SEQ ID NO: 313 - DNA, 21 bp, Artificial sequence
  SiRNA target sequence
acgagatagctctataaatag

SEQ ID NO: 314 - DNA, 21 bp, Artificial sequence
  SiRNA target sequence
cgagatagctctataaatagc

SEQ ID NO: 315 - DNA, 21 bp, Artificial sequence
  SiRNA target sequence
gagatagctctataaatagcc

SEQ ID NO: 316 - DNA, 21 bp, Artificial sequence
  SiRNA target sequence
agatagctctataaatagccg

SEQ ID NO: 317 - DNA, 21 bp, Artificial sequence
  SiRNA target sequence
gatagctctataaatagccgt

SEQ ID NO: 318 - DNA, 21 bp, Artificial sequence
  SiRNA target sequence
atagctctataaatagccgtg

SEQ ID NO: 319 - DNA, 21 bp, Artificial sequence
  SiRNA target sequence
tagctctataaatagccgtga

SEQ ID NO: 320 - DNA, 21 bp, Artificial sequence
  SiRNA target sequence
agctctataaatagccgtgag

SEQ ID NO: 321 - DNA, 21 bp, Artificial sequence
  SiRNA target sequence
gctctataaatagccgtgagg

SEQ ID NO: 322 - DNA, 21 bp, Artificial sequence
  SiRNA target sequence
ctctataaatagccgtgaggc

SEQ ID NO: 323 - DNA, 21 bp, Artificial sequence
  SiRNA target sequence
tctataaatagccgtgaggct

SEQ ID NO: 324 - DNA, 21 bp, Artificial sequence
  SiRNA target sequence
ctataaatagccgtgaggctt

SEQ ID NO: 325 - DNA, 21 bp, Artificial sequence
  SiRNA target sequence
tataaatagccgtgaggcttt

SEQ ID NO: 326 - DNA, 21 bp, Artificial sequence
  SiRNA target sequence
ataaatagccgtgaggcttta

SEQ ID NO: 327 - DNA, 21 bp, Artificial sequence
  SiRNA target sequence
taaatagccgtgaggctttaa

SEQ ID NO: 328 - DNA, 21 bp, Artificial sequence
  SiRNA target sequence
aaatagccgtgaggctttaaa

SEQ ID NO: 329 - DNA, 21 bp, Artificial sequence
  SiRNA target sequence
aatagccgtgaggctttaaat

SEQ ID NO: 330 - DNA, 21 bp, Artificial sequence
  SiRNA target sequence
atagccgtgaggctttaaatc

SEQ ID NO: 331 - DNA, 21 bp, Artificial sequence
  SiRNA target sequence
tagccgtgaggctttaaatcc

SEQ ID NO: 332 - DNA, 21 bp, Artificial sequence
  SiRNA target sequence
agccgtgaggctttaaatcct

SEQ ID NO: 333 - DNA, 21 bp, Artificial sequence
  SiRNA target sequence
gccgtgaggctttaaatcctg

SEQ ID NO: 334 - DNA, 21 bp, Artificial sequence
  SiRNA target sequence
ccgtgaggctttaaatcctga

SEQ ID NO: 335 - DNA, 21 bp, Artificial sequence
  SiRNA target sequence
cgtgaggctttaaatcctgat

SEQ ID NO: 336 - DNA, 21 bp, Artificial sequence
  SiRNA target sequence
gtgaggctttaaatcctgata

SEQ ID NO: 337 - DNA, 21 bp, Artificial sequence
  SiRNA target sequence
tgaggctttaaatcctgataa

SEQ ID NO: 338 - DNA, 21 bp, Artificial sequence
  SiRNA target sequence
gaggctttaaatcctgataag

SEQ ID NO: 339 - DNA, 21 bp, Artificial sequence
  SiRNA target sequence
aggctttaaatcctgataagt

SEQ ID NO: 340 - DNA, 21 bp, Artificial sequence
  SiRNA target sequence
ggctttaaatcctgataagta

SEQ ID NO: 341 - DNA, 21 bp, Artificial sequence
  SiRNA target sequence
gctttaaatcctgataagtac

SEQ ID NO: 342 - DNA, 21 bp, Artificial sequence
  SiRNA target sequence
ctttaaatcctgataagtaca

SEQ ID NO: 343 - DNA, 21 bp, Artificial sequence
  SiRNA target sequence
tttaaatcctgataagtacat

SEQ ID NO: 344 - DNA, 21 bp, Artificial sequence
  SiRNA target sequence
ttaaatcctgataagtacatt

SEQ ID NO: 345 - DNA, 21 bp, Artificial sequence
  SiRNA target sequence
taaatcctgataagtacatta

SEQ ID NO: 346 - DNA, 21 bp, Artificial sequence
  SiRNA target sequence
aaatcctgataagtacattac

SEQ ID NO: 347 - DNA, 21 bp, Artificial sequence
  SiRNA target sequence
aatcctgataagtacattacc

SEQ ID NO: 348 - DNA, 21 bp, Artificial sequence
  SiRNA target sequence
atcctgataagtacattacct

SEQ ID NO: 349 - DNA, 21 bp, Artificial sequence
  SiRNA target sequence
tcctgataagtacattacctg

SEQ ID NO: 350 - DNA, 21 bp, Artificial sequence
  SiRNA target sequence
cctgataagtacattacctga

SEQ ID NO: 351 - DNA, 21 bp, Artificial sequence
  SiRNA target sequence
ctgataagtacattacctgag

SEQ ID NO: 352 - DNA, 21 bp, Artificial sequence
  SiRNA target sequence
tgataagtacattacctgaga

SEQ ID NO: 353 - DNA, 21 bp, Artificial sequence
  SiRNA target sequence
gataagtacattacctgagaa

SEQ ID NO: 354 - DNA, 21 bp, Artificial sequence
  SiRNA target sequence
ataagtacattacctgagaat

SEQ ID NO: 355 - DNA, 21 bp, Artificial sequence
  SiRNA target sequence
taagtacattacctgagaatt

SEQ ID NO: 356 - DNA, 21 bp, Artificial sequence
  SiRNA target sequence
aagtacattacctgagaattc

SEQ ID NO: 357 - DNA, 21 bp, Artificial sequence
  SiRNA target sequence
agtacattacctgagaattcc

SEQ ID NO: 358 - DNA, 21 bp, Artificial sequence
  SiRNA target sequence
gtacattacctgagaattcct

SEQ ID NO: 359 - DNA, 21 bp, Artificial sequence
  SiRNA target sequence
tacattacctgagaattcctt

SEQ ID NO: 360 - DNA, 21 bp, Artificial sequence
  SiRNA target sequence
acattacctgagaattccttc

SEQ ID NO: 361 - DNA, 21 bp, Artificial sequence
  SiRNA target sequence
cattacctgagaattccttct

SEQ ID NO: 362 - DNA, 21 bp, Artificial sequence
  SiRNA target sequence
attacctgagaattccttctt

SEQ ID NO: 363 - DNA, 21 bp, Artificial sequence
  SiRNA target sequence
ttacctgagaattccttcttt

SEQ ID NO: 364 - DNA, 21 bp, Artificial sequence
  SiRNA target sequence
tacctgagaattccttctttt

SEQ ID NO: 365 - DNA, 21 bp, Artificial sequence
  SiRNA target sequence
acctgagaattccttcttttg

SEQ ID NO: 366 - DNA, 21 bp, Artificial sequence
  SiRNA target sequence
cctgagaattccttcttttgg

SEQ ID NO: 367 - DNA, 21 bp, Artificial sequence
  SiRNA target sequence
ctgagaattccttcttttgga

SEQ ID NO: 368 - DNA, 21 bp, Artificial sequence
  SiRNA target sequence
tgagaattccttcttttggag

SEQ ID NO: 369 - DNA, 21 bp, Artificial sequence
  SiRNA target sequence
gagaattccttcttttggagt

SEQ ID NO: 370 - DNA, 21 bp, Artificial sequence
  SiRNA target sequence
agaattccttcttttggagtt

SEQ ID NO: 371 - DNA, 21 bp, Artificial sequence
  SiRNA target sequence
gaattccttcttttggagttt

SEQ ID NO: 372 - DNA, 21 bp, Artificial sequence
  SiRNA target sequence
aattccttcttttggagtttg

SEQ ID NO: 373 - DNA, 21 bp, Artificial sequence
  SiRNA target sequence
attccttcttttggagtttga

SEQ ID NO: 374 - DNA, 21 bp, Artificial sequence
  SiRNA target sequence
ttccttcttttggagtttgaa

SEQ ID NO: 375 - DNA, 21 bp, Artificial sequence
  SiRNA target sequence
tccttcttttggagtttgaat

SEQ ID NO: 376 - DNA, 21 bp, Artificial sequence
  SiRNA target sequence
ccttcttttggagtttgaatt

SEQ ID NO: 377 - DNA, 21 bp, Artificial sequence
  SiRNA target sequence
cttcttttggagtttgaattt

SEQ ID NO: 378 - DNA, 21 bp, Artificial sequence
  SiRNA target sequence
ttcttttggagtttgaattta

SEQ ID NO: 379 - DNA, 21 bp, Artificial sequence
  SiRNA target sequence
tcttttggagtttgaatttat

SEQ ID NO: 380 - DNA, 21 bp, Artificial sequence
  SiRNA target sequence
cttttggagtttgaatttata

SEQ ID NO: 381 - DNA, 21 bp, Artificial sequence
  SiRNA target sequence
ttttggagtttgaatttatat

SEQ ID NO: 382 - DNA, 21 bp, Artificial sequence
  SiRNA target sequence
tttggagtttgaatttatata

SEQ ID NO: 383 - DNA, 21 bp, Artificial sequence
  SiRNA target sequence
ttggagtttgaatttatataa

SEQ ID NO: 384 - DNA, 21 bp, Artificial sequence
  SiRNA target sequence
tggagtttgaatttatataag

SEQ ID NO: 385 - DNA, 21 bp, Artificial sequence
  SiRNA target sequence
ggagtttgaatttatataagt

SEQ ID NO: 386 - DNA, 21 bp, Artificial sequence
  SiRNA target sequence
gagtttgaatttatataagtt

SEQ ID NO: 387 - DNA, 21 bp, Artificial sequence
  SiRNA target sequence
agtttgaatttatataagtta

SEQ ID NO: 388 - DNA, 21 bp, Artificial sequence
  SiRNA target sequence
gtttgaatttatataagttag

SEQ ID NO: 389 - DNA, 21 bp, Artificial sequence
  SiRNA target sequence
tttgaatttatataagttagt

SEQ ID NO: 390 - DNA, 21 bp, Artificial sequence
  SiRNA target sequence
ttgaatttatataagttagta

SEQ ID NO: 391 - DNA, 21 bp, Artificial sequence
  SiRNA target sequence
tgaatttatataagttagtac

SEQ ID NO: 392 - DNA, 21 bp, Artificial sequence
  SiRNA target sequence
gaatttatataagttagtacc

SEQ ID NO: 393 - DNA, 21 bp, Artificial sequence
  SiRNA target sequence
aatttatataagttagtacca

SEQ ID NO: 394 - DNA, 21 bp, Artificial sequence
  SiRNA target sequence
atttatataagttagtaccaa

SEQ ID NO: 395 - DNA, 21 bp, Artificial sequence
  SiRNA target sequence
tttatataagttagtaccaat

SEQ ID NO: 396 - DNA, 21 bp, Artificial sequence
  SiRNA target sequence
ttatataagttagtaccaata

SEQ ID NO: 397 - DNA, 21 bp, Artificial sequence
  SiRNA target sequence
tatataagttagtaccaatag

SEQ ID NO: 398 - DNA, 21 bp, Artificial sequence
  SiRNA target sequence
atataagttagtaccaatagt

SEQ ID NO: 399 - DNA, 21 bp, Artificial sequence
  SiRNA target sequence
tataagttagtaccaatagtt

SEQ ID NO: 400 - DNA, 21 bp, Artificial sequence
  SiRNA target sequence
ataagttagtaccaatagtta

SEQ ID NO: 401 - DNA, 21 bp, Artificial sequence
  SiRNA target sequence
taagttagtaccaatagttaa

SEQ ID NO: 402 - DNA, 21 bp, Artificial sequence
  SiRNA target sequence
aagttagtaccaatagttaat

SEQ ID NO: 403 - DNA, 21 bp, Artificial sequence
  SiRNA target sequence
agttagtaccaatagttaata

SEQ ID NO: 404 - DNA, 21 bp, Artificial sequence
  SiRNA target sequence
gttagtaccaatagttaatat

SEQ ID NO: 405 - DNA, 21 bp, Artificial sequence
  SiRNA target sequence
ttagtaccaatagttaatatc

SEQ ID NO: 406 - DNA, 21 bp, Artificial sequence
  SiRNA target sequence
tagtaccaatagttaatatca

SEQ ID NO: 407 - DNA, 21 bp, Artificial sequence
  SiRNA target sequence
agtaccaatagttaatatcat

SEQ ID NO: 408 - DNA, 21 bp, Artificial sequence
  SiRNA target sequence
gtaccaatagttaatatcatt

SEQ ID NO: 409 - DNA, 21 bp, Artificial sequence
  SiRNA target sequence
taccaatagttaatatcattt

SEQ ID NO: 410 - DNA, 21 bp, Artificial sequence
  SiRNA target sequence
accaatagttaatatcattta

SEQ ID NO: 411 - DNA, 21 bp, Artificial sequence
  SiRNA target sequence
ccaatagttaatatcatttaa

SEQ ID NO: 412 - DNA, 21 bp, Artificial sequence
  SiRNA target sequence
caatagttaatatcatttaag

SEQ ID NO: 413 - DNA, 21 bp, Artificial sequence
  SiRNA target sequence
aatagttaatatcatttaagt

SEQ ID NO: 414 - DNA, 21 bp, Artificial sequence
  SiRNA target sequence
atagttaatatcatttaagta

SEQ ID NO: 415 - DNA, 21 bp, Artificial sequence
  SiRNA target sequence
tagttaatatcatttaagtat

SEQ ID NO: 416 - DNA, 21 bp, Artificial sequence
  SiRNA target sequence
agttaatatcatttaagtatg

SEQ ID NO: 417 - DNA, 21 bp, Artificial sequence
  SiRNA target sequence
gttaatatcatttaagtatgt

SEQ ID NO: 418 - DNA, 21 bp, Artificial sequence
  SiRNA target sequence
ttaatatcatttaagtatgtt

SEQ ID NO: 419 - DNA, 21 bp, Artificial sequence
  SiRNA target sequence
taatatcatttaagtatgtta

SEQ ID NO: 420 - DNA, 21 bp, Artificial sequence
  SiRNA target sequence
aatatcatttaagtatgttat

SEQ ID NO: 421 - DNA, 21 bp, Artificial sequence
  SiRNA target sequence
atatcatttaagtatgttatt

SEQ ID NO: 422 - DNA, 21 bp, Artificial sequence
  SiRNA target sequence
tatcatttaagtatgttatta

SEQ ID NO: 423 - DNA, 21 bp, Artificial sequence
  SiRNA target sequence
atcatttaagtatgttattat

SEQ ID NO: 424 - DNA, 21 bp, Artificial sequence
  SiRNA target sequence
tcatttaagtatgttattatt

SEQ ID NO: 425 - DNA, 21 bp, Artificial sequence
  SiRNA target sequence
catttaagtatgttattattg

SEQ ID NO: 426 - DNA, 21 bp, Artificial sequence
  SiRNA target sequence
atttaagtatgttattattgc

SEQ ID NO: 427 - DNA, 21 bp, Artificial sequence
  SiRNA target sequence
tttaagtatgttattattgct

SEQ ID NO: 428 - DNA, 21 bp, Artificial sequence
  SiRNA target sequence
ttaagtatgttattattgctg

SEQ ID NO: 429 - DNA, 21 bp, Artificial sequence
  SiRNA target sequence
taagtatgttattattgctga

SEQ ID NO: 430 - DNA, 21 bp, Artificial sequence
  SiRNA target sequence
aagtatgttattattgctgaa

SEQ ID NO: 431 - DNA, 21 bp, Artificial sequence
  SiRNA target sequence
agtatgttattattgctgaag

SEQ ID NO: 432 - DNA, 21 bp, Artificial sequence
  SiRNA target sequence
gtatgttattattgctgaagg

SEQ ID NO: 433 - DNA, 21 bp, Artificial sequence
  SiRNA target sequence
tatgttattattgctgaaggc

SEQ ID NO: 434 - DNA, 21 bp, Artificial sequence
  SiRNA target sequence
atgttattattgctgaaggca

SEQ ID NO: 435 - DNA, 21 bp, Artificial sequence
  SiRNA target sequence
tgttattattgctgaaggcat

SEQ ID NO: 436 - DNA, 21 bp, Artificial sequence
  SiRNA target sequence
gttattattgctgaaggcatg

SEQ ID NO: 437 - DNA, 21 bp, Artificial sequence
  SiRNA target sequence
ttattattgctgaaggcatgt

SEQ ID NO: 438 - DNA, 21 bp, Artificial sequence
  SiRNA target sequence
tattattgctgaaggcatgta

SEQ ID NO: 439 - DNA, 21 bp, Artificial sequence
  SiRNA target sequence
attattgctgaaggcatgtat

SEQ ID NO: 440 - DNA, 21 bp, Artificial sequence
  SiRNA target sequence
ttattgctgaaggcatgtatt

SEQ ID NO: 441 - DNA, 21 bp, Artificial sequence
  SiRNA target sequence
tattgctgaaggcatgtattt

SEQ ID NO: 442 - DNA, 21 bp, Artificial sequence
  SiRNA target sequence
attgctgaaggcatgtatttc

SEQ ID NO: 443 - DNA, 21 bp, Artificial sequence
  SiRNA target sequence
ttgctgaaggcatgtatttcg

SEQ ID NO: 444 - DNA, 21 bp, Artificial sequence
  SiRNA target sequence
tgctgaaggcatgtatttcgg

SEQ ID NO: 445 - DNA, 21 bp, Artificial sequence
  SiRNA target sequence
gctgaaggcatgtatttcgga

SEQ ID NO: 446 - DNA, 21 bp, Artificial sequence
  SiRNA target sequence
ctgaaggcatgtatttcggat

SEQ ID NO: 447 - DNA, 21 bp, Artificial sequence
  SiRNA target sequence
tgaaggcatgtatttcggata

SEQ ID NO: 448 - DNA, 21 bp, Artificial sequence
  SiRNA target sequence
gaaggcatgtatttcggataa

SEQ ID NO: 449 - DNA, 21 bp, Artificial sequence
  SiRNA target sequence
aaggcatgtatttcggataat

SEQ ID NO: 450 - DNA, 21 bp, Artificial sequence
  SiRNA target sequence
aggcatgtatttcggataata

SEQ ID NO: 451 - DNA, 21 bp, Artificial sequence
  SiRNA target sequence
ggcatgtatttcggataataa

SEQ ID NO: 452 - DNA, 21 bp, Artificial sequence
  SiRNA target sequence
gcatgtatttcggataataac

SEQ ID NO: 453 - DNA, 21 bp, Artificial sequence
  SiRNA target sequence
catgtatttcggataataacc

SEQ ID NO: 454 - DNA, 21 bp, Artificial sequence
  SiRNA target sequence
atgtatttcggataataacct

SEQ ID NO: 455 - DNA, 21 bp, Artificial sequence
  SiRNA target sequence
tgtatttcggataataacctc

SEQ ID NO: 456 - DNA, 21 bp, Artificial sequence
  SiRNA target sequence
gtatttcggataataacctct

SEQ ID NO: 457 - DNA, 21 bp, Artificial sequence
  SiRNA target sequence
tatttcggataataacctcta

SEQ ID NO: 458 - DNA, 21 bp, Artificial sequence
  SiRNA target sequence
atttcggataataacctctac

SEQ ID NO: 459 - DNA, 21 bp, Artificial sequence
  SiRNA target sequence
tttcggataataacctctaca

SEQ ID NO: 460 - DNA, 21 bp, Artificial sequence
  SiRNA target sequence
ttcggataataacctctacat

SEQ ID NO: 461 - DNA, 21 bp, Artificial sequence
  SiRNA target sequence
tcggataataacctctacatt

SEQ ID NO: 462 - DNA, 21 bp, Artificial sequence
  SiRNA target sequence
cggataataacctctacattg

SEQ ID NO: 463 - DNA, 21 bp, Artificial sequence
  SiRNA target sequence
ggataataacctctacattga

SEQ ID NO: 464 - DNA, 21 bp, Artificial sequence
  SiRNA target sequence
gataataacctctacattgat

SEQ ID NO: 465 - DNA, 21 bp, Artificial sequence
  SiRNA target sequence
ataataacctctacattgata

SEQ ID NO: 466 - DNA, 21 bp, Artificial sequence
  SiRNA target sequence
taataacctctacattgatat

SEQ ID NO: 467 - DNA, 21 bp, Artificial sequence
  SiRNA target sequence
aataacctctacattgatata

SEQ ID NO: 468 - DNA, 21 bp, Artificial sequence
  SiRNA target sequence
ataacctctacattgatatat

SEQ ID NO: 469 - DNA, 21 bp, Artificial sequence
  SiRNA target sequence
taacctctacattgatatata

SEQ ID NO: 470 - DNA, 21 bp, Artificial sequence
  SiRNA target sequence
aacctctacattgatatataa

SEQ ID NO: 471 - DNA, 21 bp, Artificial sequence
  SiRNA target sequence
acctctacattgatatataaa

SEQ ID NO: 472 - DNA, 21 bp, Artificial sequence
  SiRNA target sequence
cctctacattgatatataaac

SEQ ID NO: 473 - DNA, 21 bp, Artificial sequence
  SiRNA target sequence
ctctacattgatatataaact

SEQ ID NO: 474 - DNA, 21 bp, Artificial sequence
  SiRNA target sequence
tctacattgatatataaacta

SEQ ID NO: 475 - DNA, 21 bp, Artificial sequence
  SiRNA target sequence
ctacattgatatataaactat

SEQ ID NO: 476 - DNA, 21 bp, Artificial sequence
  SiRNA target sequence
tacattgatatataaactata

SEQ ID NO: 477 - DNA, 21 bp, Artificial sequence
  SiRNA target sequence
acattgatatataaactatat

SEQ ID NO: 478 - DNA, 21 bp, Artificial sequence
  SiRNA target sequence
cattgatatataaactatatg

SEQ ID NO: 479 - DNA, 21 bp, Artificial sequence
  SiRNA target sequence
attgatatataaactatatgc

SEQ ID NO: 480 - DNA, 21 bp, Artificial sequence
  SiRNA target sequence
ttgatatataaactatatgca

SEQ ID NO: 481 - DNA, 21 bp, Artificial sequence
  SiRNA target sequence
tgatatataaactatatgcaa

SEQ ID NO: 482 - DNA, 21 bp, Artificial sequence
  SiRNA target sequence
gatatataaactatatgcaag

SEQ ID NO: 483 - DNA, 21 bp, Artificial sequence
  SiRNA target sequence
atatataaactatatgcaagt

SEQ ID NO: 484 - DNA, 21 bp, Artificial sequence
  SiRNA target sequence
tatataaactatatgcaagtc

SEQ ID NO: 485 - DNA, 21 bp, Artificial sequence
  SiRNA target sequence
atataaactatatgcaagtct

SEQ ID NO: 486 - DNA, 21 bp, Artificial sequence
  SiRNA target sequence
tataaactatatgcaagtctc

SEQ ID NO: 487 - DNA, 21 bp, Artificial sequence
  SiRNA target sequence
ataaactatatgcaagtctcg

SEQ ID NO: 488 - DNA, 21 bp, Artificial sequence
  SiRNA target sequence
taaactatatgcaagtctcgg

SEQ ID NO: 489 - DNA, 21 bp, Artificial sequence
  SiRNA target sequence
aaactatatgcaagtctcggt

SEQ ID NO: 490 - DNA, 21 bp, Artificial sequence
  SiRNA target sequence
aactatatgcaagtctcggtg

SEQ ID NO: 491 - DNA, 21 bp, Artificial sequence
  SiRNA target sequence
actatatgcaagtctcggtgg

SEQ ID NO: 492 - DNA, 21 bp, Artificial sequence
  SiRNA target sequence
ctatatgcaagtctcggtgga

SEQ ID NO: 493 - DNA, 21 bp, Artificial sequence
  SiRNA target sequence
tatatgcaagtctcggtggat

SEQ ID NO: 494 - DNA, 21 bp, Artificial sequence
  SiRNA target sequence
atatgcaagtctcggtggata

SEQ ID NO: 495 - DNA, 21 bp, Artificial sequence
  SiRNA target sequence
tatgcaagtctcggtggatat

SEQ ID NO: 496 - DNA, 21 bp, Artificial sequence
  SiRNA target sequence
atgcaagtctcggtggatatt

SEQ ID NO: 497 - DNA, 21 bp, Artificial sequence
  SiRNA target sequence
tgcaagtctcggtggatattg

SEQ ID NO: 498 - DNA, 21 bp, Artificial sequence
  SiRNA target sequence
gcaagtctcggtggatattgc

SEQ ID NO: 499 - DNA, 21 bp, Artificial sequence
  SiRNA target sequence
caagtctcggtggatattgca

SEQ ID NO: 500 - DNA, 21 bp, Artificial sequence
  SiRNA target sequence
aagtctcggtggatattgcat

SEQ ID NO: 501 - DNA, 21 bp, Artificial sequence
  SiRNA target sequence
agtctcggtggatattgcatt

SEQ ID NO: 502 - DNA, 21 bp, Artificial sequence
  SiRNA target sequence
gtctcggtggatattgcatta

SEQ ID NO: 503 - DNA, 21 bp, Artificial sequence
  SiRNA target sequence
tctcggtggatattgcattat

SEQ ID NO: 504 - DNA, 21 bp, Artificial sequence
  SiRNA target sequence
ctcggtggatattgcattatg

SEQ ID NO: 505 - DNA, 21 bp, Artificial sequence
  SiRNA target sequence
tcggtggatattgcattatgg

SEQ ID NO: 506 - DNA, 21 bp, Artificial sequence
  SiRNA target sequence
cggtggatattgcattatggt

SEQ ID NO: 507 - DNA, 21 bp, Artificial sequence
  SiRNA target sequence
ggtggatattgcattatggtc

SEQ ID NO: 508 - DNA, 21 bp, Artificial sequence
  SiRNA target sequence
gtggatattgcattatggtcg

SEQ ID NO: 509 - DNA, 21 bp, Artificial sequence
  SiRNA target sequence
tggatattgcattatggtcgc

SEQ ID NO: 510 - DNA, 21 bp, Artificial sequence
  SiRNA target sequence
ggatattgcattatggtcgca

SEQ ID NO: 511 - DNA, 21 bp, Artificial sequence
  SiRNA target sequence
gatattgcattatggtcgcag

SEQ ID NO: 512 - DNA, 21 bp, Artificial sequence
  SiRNA target sequence
atattgcattatggtcgcagt

SEQ ID NO: 513 - DNA, 21 bp, Artificial sequence
  SiRNA target sequence
tattgcattatggtcgcagtt

SEQ ID NO: 514 - DNA, 21 bp, Artificial sequence
  SiRNA target sequence
attgcattatggtcgcagtta

SEQ ID NO: 515 - DNA, 21 bp, Artificial sequence
  SiRNA target sequence
ttgcattatggtcgcagttaa

SEQ ID NO: 516 - DNA, 21 bp, Artificial sequence
  SiRNA target sequence
tgcattatggtcgcagttaac

SEQ ID NO: 517 - DNA, 21 bp, Artificial sequence
  SiRNA target sequence
gcattatggtcgcagttaacc

SEQ ID NO: 518 - DNA, 21 bp, Artificial sequence
  SiRNA target sequence
cattatggtcgcagttaacct

SEQ ID NO: 519 - DNA, 21 bp, Artificial sequence
  SiRNA target sequence
attatggtcgcagttaacctg

SEQ ID NO: 520 - DNA, 21 bp, Artificial sequence
  SiRNA target sequence
ttatggtcgcagttaacctgt

SEQ ID NO: 521 - DNA, 21 bp, Artificial sequence
  SiRNA target sequence
tatggtcgcagttaacctgta

SEQ ID NO: 522 - DNA, 21 bp, Artificial sequence
  SiRNA target sequence
atggtcgcagttaacctgtag

SEQ ID NO: 523 - DNA, 21 bp, Artificial sequence
  SiRNA target sequence
tggtcgcagttaacctgtagc

SEQ ID NO: 524 - DNA, 21 bp, Artificial sequence
  SiRNA target sequence
ggtcgcagttaacctgtagct

SEQ ID NO: 525 - DNA, 21 bp, Artificial sequence
  SiRNA target sequence
gtcgcagttaacctgtagctt

SEQ ID NO: 526 - DNA, 21 bp, Artificial sequence
  SiRNA target sequence
tcgcagttaacctgtagctta

SEQ ID NO: 527 - DNA, 21 bp, Artificial sequence
  SiRNA target sequence
cgcagttaacctgtagcttat

SEQ ID NO: 528 - DNA, 21 bp, Artificial sequence
  SiRNA target sequence
gcagttaacctgtagcttata

SEQ ID NO: 529 - DNA, 21 bp, Artificial sequence
  SiRNA target sequence
cagttaacctgtagcttatat

SEQ ID NO: 530 - DNA, 21 bp, Artificial sequence
  SiRNA target sequence
agttaacctgtagcttatata

SEQ ID NO: 531 - DNA, 21 bp, Artificial sequence
  SiRNA target sequence
gttaacctgtagcttatatat

SEQ ID NO: 532 - DNA, 21 bp, Artificial sequence
  SiRNA target sequence
ttaacctgtagcttatatatt

SEQ ID NO: 533 - DNA, 21 bp, Artificial sequence
  SiRNA target sequence
taacctgtagcttatatattc

SEQ ID NO: 534 - DNA, 21 bp, Artificial sequence
  SiRNA target sequence
aacctgtagcttatatattcc

SEQ ID NO: 535 - DNA, 21 bp, Artificial sequence
  SiRNA target sequence
acctgtagcttatatattcct

SEQ ID NO: 536 - DNA, 21 bp, Artificial sequence
  SiRNA target sequence
cctgtagcttatatattcctg

SEQ ID NO: 537 - DNA, 21 bp, Artificial sequence
  SiRNA target sequence
ctgtagcttatatattcctgt

SEQ ID NO: 538 - DNA, 21 bp, Artificial sequence
  SiRNA target sequence
tgtagcttatatattcctgtg

SEQ ID NO: 539 - DNA, 21 bp, Artificial sequence
  SiRNA target sequence
gtagcttatatattcctgtgt

SEQ ID NO: 540 - DNA, 21 bp, Artificial sequence
  SiRNA target sequence
tagcttatatattcctgtgtc

SEQ ID NO: 541 - DNA, 21 bp, Artificial sequence
  SiRNA target sequence
agcttatatattcctgtgtcg

SEQ ID NO: 542 - DNA, 21 bp, Artificial sequence
  SiRNA target sequence
gcttatatattcctgtgtcgg

SEQ ID NO: 543 - DNA, 21 bp, Artificial sequence
  SiRNA target sequence
cttatatattcctgtgtcgga

SEQ ID NO: 544 - DNA, 21 bp, Artificial sequence
  SiRNA target sequence
ttatatattcctgtgtcggag

SEQ ID NO: 545 - DNA, 21 bp, Artificial sequence
  SiRNA target sequence
tatatattcctgtgtcggagc

SEQ ID NO: 546 - DNA, 21 bp, Artificial sequence
  SiRNA target sequence
atatattcctgtgtcggagca

SEQ ID NO: 547 - DNA, 21 bp, Artificial sequence
  SiRNA target sequence
tatattcctgtgtcggagcag

SEQ ID NO: 548 - DNA, 21 bp, Artificial sequence
  SiRNA target sequence
atattcctgtgtcggagcagt

SEQ ID NO: 549 - DNA, 21 bp, Artificial sequence
  SiRNA target sequence
tattcctgtgtcggagcagtg

SEQ ID NO: 550 - DNA, 21 bp, Artificial sequence
  SiRNA target sequence
attcctgtgtcggagcagtgg

SEQ ID NO: 551 - DNA, 21 bp, Artificial sequence
  SiRNA target sequence
ttcctgtgtcggagcagtggt

SEQ ID NO: 552 - DNA, 21 bp, Artificial sequence
  SiRNA target sequence
tcctgtgtcggagcagtggta

SEQ ID NO: 553 - DNA, 21 bp, Artificial sequence
  SiRNA target sequence
cctgtgtcggagcagtggtaa

SEQ ID NO: 554 - DNA, 21 bp, Artificial sequence
  SiRNA target sequence
ctgtgtcggagcagtggtaat

SEQ ID NO: 555 - DNA, 21 bp, Artificial sequence
  SiRNA target sequence
tgtgtcggagcagtggtaatg

SEQ ID NO: 556 - DNA, 21 bp, Artificial sequence
  SiRNA target sequence
gtgtcggagcagtggtaatgg

SEQ ID NO: 557 - DNA, 21 bp, Artificial sequence
  SiRNA target sequence
tgtcggagcagtggtaatgga

SEQ ID NO: 558 - DNA, 21 bp, Artificial sequence
  SiRNA target sequence
gtcggagcagtggtaatggag

SEQ ID NO: 559 - DNA, 21 bp, Artificial sequence
  SiRNA target sequence
tcggagcagtggtaatggagc

SEQ ID NO: 560 - DNA, 21 bp, Artificial sequence
  SiRNA target sequence
cggagcagtggtaatggagcc

SEQ ID NO: 561 - DNA, 21 bp, Artificial sequence
  SiRNA target sequence
ggagcagtggtaatggagccg

SEQ ID NO: 562 - DNA, 21 bp, Artificial sequence
  SiRNA target sequence
gagcagtggtaatggagccgg

SEQ ID NO: 563 - DNA, 21 bp, Artificial sequence
  SiRNA target sequence
agcagtggtaatggagccgga

SEQ ID NO: 564 - DNA, 21 bp, Artificial sequence
  SiRNA target sequence
gcagtggtaatggagccggac

SEQ ID NO: 565 - DNA, 21 bp, Artificial sequence
  SiRNA target sequence
cagtggtaatggagccggacg

SEQ ID NO: 566 - DNA, 21 bp, Artificial sequence
  SiRNA target sequence
agtggtaatggagccggacga

SEQ ID NO: 567 - DNA, 21 bp, Artificial sequence
  SiRNA target sequence
gtggtaatggagccggacgat

SEQ ID NO: 568 - DNA, 21 bp, Artificial sequence
  SiRNA target sequence
tggtaatggagccggacgatt

SEQ ID NO: 569 - DNA, 21 bp, Artificial sequence
  SiRNA target sequence
ggtaatggagccggacgattt

SEQ ID NO: 570 - DNA, 21 bp, Artificial sequence
  SiRNA target sequence
gtaatggagccggacgatttc

SEQ ID NO: 571 - DNA, 21 bp, Artificial sequence
  SiRNA target sequence
taatggagccggacgatttcg

SEQ ID NO: 572 - DNA, 21 bp, Artificial sequence
  SiRNA target sequence
aatggagccggacgatttcgc

SEQ ID NO: 573 - DNA, 21 bp, Artificial sequence
  SiRNA target sequence
atggagccggacgatttcgcc

SEQ ID NO: 574 - DNA, 21 bp, Artificial sequence
  SiRNA target sequence
tggagccggacgatttcgcca

SEQ ID NO: 575 - DNA, 21 bp, Artificial sequence
  SiRNA target sequence
ggagccggacgatttcgccaa

SEQ ID NO: 576 - DNA, 21 bp, Artificial sequence
  SiRNA target sequence
gagccggacgatttcgccaaa

SEQ ID NO: 577 - DNA, 21 bp, Artificial sequence
  SiRNA target sequence
agccggacgatttcgccaaaa

SEQ ID NO: 578 - DNA, 21 bp, Artificial sequence
  SiRNA target sequence
gccggacgatttcgccaaaaa

SEQ ID NO: 579 - DNA, 21 bp, Artificial sequence
  SiRNA target sequence
ccggacgatttcgccaaaaat

SEQ ID NO: 580 - DNA, 21 bp, Artificial sequence
  SiRNA target sequence
cggacgatttcgccaaaaatg

SEQ ID NO: 581 - DNA, 21 bp, Artificial sequence
  SiRNA target sequence
ggacgatttcgccaaaaatgt

SEQ ID NO: 582 - DNA, 21 bp, Artificial sequence
  SiRNA target sequence
gacgatttcgccaaaaatgtt

SEQ ID NO: 583 - DNA, 21 bp, Artificial sequence
  SiRNA target sequence
acgatttcgccaaaaatgttc

SEQ ID NO: 584 - DNA, 21 bp, Artificial sequence
  SiRNA target sequence
cgatttcgccaaaaatgttca

SEQ ID NO: 585 - DNA, 21 bp, Artificial sequence
  SiRNA target sequence
gatttcgccaaaaatgttcac

SEQ ID NO: 586 - DNA, 21 bp, Artificial sequence
  SiRNA target sequence
atttcgccaaaaatgttcact

SEQ ID NO: 587 - DNA, 21 bp, Artificial sequence
  SiRNA target sequence
tttcgccaaaaatgttcactt

SEQ ID NO: 588 - DNA, 21 bp, Artificial sequence
  SiRNA target sequence
ttcgccaaaaatgttcacttc

SEQ ID NO: 589 - DNA, 21 bp, Artificial sequence
  SiRNA target sequence
tcgccaaaaatgttcacttct

SEQ ID NO: 590 - DNA, 21 bp, Artificial sequence
  SiRNA target sequence
cgccaaaaatgttcacttctc

SEQ ID NO: 591 - DNA, 21 bp, Artificial sequence
  SiRNA target sequence
gccaaaaatgttcacttctca

SEQ ID NO: 592 - DNA, 21 bp, Artificial sequence
  SiRNA target sequence
ccaaaaatgttcacttctcaa

SEQ ID NO: 593 - DNA, 21 bp, Artificial sequence
  SiRNA target sequence
caaaaatgttcacttctcaac

SEQ ID NO: 594 - DNA, 21 bp, Artificial sequence
  SiRNA target sequence
aaaaatgttcacttctcaaca

SEQ ID NO: 595 - DNA, 21 bp, Artificial sequence
  SiRNA target sequence
aaaatgttcacttctcaacaa

SEQ ID NO: 596 - DNA, 21 bp, Artificial sequence
  SiRNA target sequence
aaatgttcacttctcaacaaa

SEQ ID NO: 597 - DNA, 21 bp, Artificial sequence
  SiRNA target sequence
aatgttcacttctcaacaaaa

SEQ ID NO: 598 - DNA, 21 bp, Artificial sequence
  SiRNA target sequence
atgttcacttctcaacaaaat

SEQ ID NO: 599 - DNA, 21 bp, Artificial sequence
  SiRNA target sequence
tgttcacttctcaacaaaata

SEQ ID NO: 600 - DNA, 21 bp, Artificial sequence
  SiRNA target sequence
gttcacttctcaacaaaataa

SEQ ID NO: 601 - DNA, 21 bp, Artificial sequence
  SiRNA target sequence
ttcacttctcaacaaaataac

SEQ ID NO: 602 - DNA, 21 bp, Artificial sequence
  SiRNA target sequence
tcacttctcaacaaaataaca

SEQ ID NO: 603 - DNA, 21 bp, Artificial sequence
  SiRNA target sequence
cacttctcaacaaaataacaa

SEQ ID NO: 604 - DNA, 21 bp, Artificial sequence
  SiRNA target sequence
acttctcaacaaaataacaaa

SEQ ID NO: 605 - DNA, 21 bp, Artificial sequence
  SiRNA target sequence
cttctcaacaaaataacaaaa

SEQ ID NO: 606 - DNA, 21 bp, Artificial sequence
  SiRNA target sequence
ttctcaacaaaataacaaaat

SEQ ID NO: 607 - DNA, 21 bp, Artificial sequence
  SiRNA target sequence
tctcaacaaaataacaaaatt

SEQ ID NO: 608 - DNA, 21 bp, Artificial sequence
  SiRNA target sequence
ctcaacaaaataacaaaatta

SEQ ID NO: 609 - DNA, 21 bp, Artificial sequence
  SiRNA target sequence
tcaacaaaataacaaaattac

SEQ ID NO: 610 - DNA, 21 bp, Artificial sequence
  SiRNA target sequence
caacaaaataacaaaattact

SEQ ID NO: 611 - DNA, 21 bp, Artificial sequence
  SiRNA target sequence
aacaaaataacaaaattacta

SEQ ID NO: 612 - DNA, 21 bp, Artificial sequence
  SiRNA target sequence
acaaaataacaaaattactaa

SEQ ID NO: 613 - DNA, 21 bp, Artificial sequence
  SiRNA target sequence
caaaataacaaaattactaaa

SEQ ID NO: 614 - DNA, 21 bp, Artificial sequence
  SiRNA target sequence
aaaataacaaaattactaaac

SEQ ID NO: 615 - DNA, 21 bp, Artificial sequence
  SiRNA target sequence
aaataacaaaattactaaaca

SEQ ID NO: 616 - DNA, 21 bp, Artificial sequence
  SiRNA target sequence
aataacaaaattactaaacaa

SEQ ID NO: 617 - DNA, 21 bp, Artificial sequence
  SiRNA target sequence
ataacaaaattactaaacaac

SEQ ID NO: 618 - DNA, 21 bp, Artificial sequence
  SiRNA target sequence
taacaaaattactaaacaacc

SEQ ID NO: 619 - DNA, 21 bp, Artificial sequence
  SiRNA target sequence
aacaaaattactaaacaaccc

SEQ ID NO: 620 - DNA, 21 bp, Artificial sequence
  SiRNA target sequence
acaaaattactaaacaacccg

SEQ ID NO: 621 - DNA, 21 bp, Artificial sequence
  SiRNA target sequence
caaaattactaaacaacccgc

SEQ ID NO: 622 - DNA, 21 bp, Artificial sequence
  SiRNA target sequence
aaaattactaaacaacccgcc

SEQ ID NO: 623 - DNA, 21 bp, Artificial sequence
  SiRNA target sequence
aaattactaaacaacccgccc

SEQ ID NO: 624 - DNA, 21 bp, Artificial sequence
  SiRNA target sequence
aattactaaacaacccgcccc

SEQ ID NO: 625 - DNA, 21 bp, Artificial sequence
  SiRNA target sequence
attactaaacaacccgccccc

SEQ ID NO: 626 - DNA, 21 bp, Artificial sequence
  SiRNA target sequence
ttactaaacaacccgcccccc

SEQ ID NO: 627 - DNA, 21 bp, Artificial sequence
  SiRNA target sequence
tactaaacaacccgcccccct

SEQ ID NO: 628 - DNA, 21 bp, Artificial sequence
  SiRNA target sequence
actaaacaacccgcccccctt

SEQ ID NO: 629 - DNA, 21 bp, Artificial sequence
  SiRNA target sequence
ctaaacaacccgccccccttt

SEQ ID NO: 630 - DNA, 21 bp, Artificial sequence
  SiRNA target sequence
taaacaacccgcccccctttc

SEQ ID NO: 631 - DNA, 21 bp, Artificial sequence
  SiRNA target sequence
aaacaacccgcccccctttct

SEQ ID NO: 632 - DNA, 21 bp, Artificial sequence
  SiRNA target sequence
aacaacccgcccccctttctt

SEQ ID NO: 633 - DNA, 21 bp, Artificial sequence
  SiRNA target sequence
acaacccgcccccctttctta

SEQ ID NO: 634 - DNA, 21 bp, Artificial sequence
  SiRNA target sequence
caacccgcccccctttcttat

SEQ ID NO: 635 - DNA, 21 bp, Artificial sequence
  SiRNA target sequence
aacccgcccccctttcttatc

SEQ ID NO: 636 - DNA, 21 bp, Artificial sequence
  SiRNA target sequence
acccgcccccctttcttatct

SEQ ID NO: 637 - DNA, 21 bp, Artificial sequence
  SiRNA target sequence
cccgcccccctttcttatctt

SEQ ID NO: 638 - DNA, 21 bp, Artificial sequence
  SiRNA target sequence
ccgcccccctttcttatcttg

SEQ ID NO: 639 - DNA, 21 bp, Artificial sequence
  SiRNA target sequence
cgcccccctttcttatcttgc

SEQ ID NO: 640 - DNA, 21 bp, Artificial sequence
  SiRNA target sequence
gcccccctttcttatcttgca

SEQ ID NO: 641 - DNA, 21 bp, Artificial sequence
  SiRNA target sequence
cccccctttcttatcttgcaa

SEQ ID NO: 642 - DNA, 21 bp, Artificial sequence
  SiRNA target sequence
ccccctttcttatcttgcaag

SEQ ID NO: 643 - DNA, 21 bp, Artificial sequence
  SiRNA target sequence
cccctttcttatcttgcaagt

SEQ ID NO: 644 - DNA, 21 bp, Artificial sequence
  SiRNA target sequence
ccctttcttatcttgcaagta

SEQ ID NO: 645 - DNA, 21 bp, Artificial sequence
  SiRNA target sequence
cctttcttatcttgcaagtat

SEQ ID NO: 646 - DNA, 21 bp, Artificial sequence
  SiRNA target sequence
ctttcttatcttgcaagtatg

SEQ ID NO: 647 - DNA, 21 bp, Artificial sequence
  SiRNA target sequence
tttcttatcttgcaagtatgc

SEQ ID NO: 648 - DNA, 21 bp, Artificial sequence
  SiRNA target sequence
ttcttatcttgcaagtatgcg

SEQ ID NO: 649 - DNA, 21 bp, Artificial sequence
  SiRNA target sequence
tcttatcttgcaagtatgcga

SEQ ID NO: 650 - DNA, 21 bp, Artificial sequence
  SiRNA target sequence
cttatcttgcaagtatgcgag

SEQ ID NO: 651 - DNA, 21 bp, Artificial sequence
  SiRNA target sequence
ttatcttgcaagtatgcgagc

SEQ ID NO: 652 - DNA, 21 bp, Artificial sequence
  SiRNA target sequence
tatcttgcaagtatgcgagca

SEQ ID NO: 653 - DNA, 21 bp, Artificial sequence
  SiRNA target sequence
atcttgcaagtatgcgagcaa

SEQ ID NO: 654 - DNA, 21 bp, Artificial sequence
  SiRNA target sequence
tcttgcaagtatgcgagcaat

SEQ ID NO: 655 - DNA, 21 bp, Artificial sequence
  SiRNA target sequence
cttgcaagtatgcgagcaatt

SEQ ID NO: 656 - DNA, 21 bp, Artificial sequence
  SiRNA target sequence
ttgcaagtatgcgagcaatta

SEQ ID NO: 657 - DNA, 21 bp, Artificial sequence
  SiRNA target sequence
tgcaagtatgcgagcaattac

SEQ ID NO: 658 - DNA, 21 bp, Artificial sequence
  SiRNA target sequence
gcaagtatgcgagcaattact

SEQ ID NO: 659 - DNA, 21 bp, Artificial sequence
  SiRNA target sequence
caagtatgcgagcaattacta

SEQ ID NO: 660 - DNA, 21 bp, Artificial sequence
  SiRNA target sequence
aagtatgcgagcaattactat

SEQ ID NO: 661 - DNA, 21 bp, Artificial sequence
  SiRNA target sequence
agtatgcgagcaattactatg

SEQ ID NO: 662 - DNA, 21 bp, Artificial sequence
  SiRNA target sequence
gtatgcgagcaattactatgg

SEQ ID NO: 663 - DNA, 21 bp, Artificial sequence
  SiRNA target sequence
tatgcgagcaattactatgga

SEQ ID NO: 664 - DNA, 21 bp, Artificial sequence
  SiRNA target sequence
atgcgagcaattactatggat

SEQ ID NO: 665 - DNA, 21 bp, Artificial sequence
  SiRNA target sequence
tgcgagcaattactatggatg

SEQ ID NO: 666 - DNA, 21 bp, Artificial sequence
  SiRNA target sequence
gcgagcaattactatggatga

SEQ ID NO: 667 - DNA, 21 bp, Artificial sequence
  SiRNA target sequence
cgagcaattactatggatgaa

SEQ ID NO: 668 - DNA, 21 bp, Artificial sequence
  SiRNA target sequence
gagcaattactatggatgaag

SEQ ID NO: 669 - DNA, 21 bp, Artificial sequence
  SiRNA target sequence
agcaattactatggatgaaga

SEQ ID NO: 670 - DNA, 21 bp, Artificial sequence
  SiRNA target sequence
gcaattactatggatgaagag

SEQ ID NO: 671 - DNA, 21 bp, Artificial sequence
  SiRNA target sequence
caattactatggatgaagagc

SEQ ID NO: 672 - DNA, 21 bp, Artificial sequence
  SiRNA target sequence
aattactatggatgaagagca

SEQ ID NO: 673 - DNA, 21 bp, Artificial sequence
  SiRNA target sequence
attactatggatgaagagcaa

SEQ ID NO: 674 - DNA, 21 bp, Artificial sequence
  SiRNA target sequence
ttactatggatgaagagcaag

SEQ ID NO: 675 - DNA, 21 bp, Artificial sequence
  SiRNA target sequence
tactatggatgaagagcaaga

SEQ ID NO: 676 - DNA, 21 bp, Artificial sequence
  SiRNA target sequence
actatggatgaagagcaagaa

SEQ ID NO: 677 - DNA, 21 bp, Artificial sequence
  SiRNA target sequence
ctatggatgaagagcaagaat

SEQ ID NO: 678 - DNA, 21 bp, Artificial sequence
  SiRNA target sequence
tatggatgaagagcaagaata

SEQ ID NO: 679 - DNA, 21 bp, Artificial sequence
  SiRNA target sequence
atggatgaagagcaagaatat

SEQ ID NO: 680 - DNA, 21 bp, Artificial sequence
  SiRNA target sequence
tggatgaagagcaagaatatt

SEQ ID NO: 681 - DNA, 21 bp, Artificial sequence
  SiRNA target sequence
ggatgaagagcaagaatattt

SEQ ID NO: 682 - DNA, 21 bp, Artificial sequence
  SiRNA target sequence
gatgaagagcaagaatatttt

SEQ ID NO: 683 - DNA, 21 bp, Artificial sequence
  SiRNA target sequence
atgaagagcaagaatattttc

SEQ ID NO: 684 - DNA, 21 bp, Artificial sequence
  SiRNA target sequence
tgaagagcaagaatattttct

SEQ ID NO: 685 - DNA, 21 bp, Artificial sequence
  SiRNA target sequence
gaagagcaagaatattttctt

SEQ ID NO: 686 - DNA, 21 bp, Artificial sequence
  SiRNA target sequence
aagagcaagaatattttctta

SEQ ID NO: 687 - DNA, 21 bp, Artificial sequence
  SiRNA target sequence
agagcaagaatattttcttac

SEQ ID NO: 688 - DNA, 21 bp, Artificial sequence
  SiRNA target sequence
gagcaagaatattttcttact

SEQ ID NO: 689 - DNA, 21 bp, Artificial sequence
  SiRNA target sequence
agcaagaatattttcttactc

SEQ ID NO: 690 - DNA, 21 bp, Artificial sequence
  SiRNA target sequence
gcaagaatattttcttactct

SEQ ID NO: 691 - DNA, 21 bp, Artificial sequence
  SiRNA target sequence
caagaatattttcttactcta

SEQ ID NO: 692 - DNA, 21 bp, Artificial sequence
  SiRNA target sequence
aagaatattttcttactctaa

SEQ ID NO: 693 - DNA, 21 bp, Artificial sequence
  SiRNA target sequence
agaatattttcttactctaaa

SEQ ID NO: 694 - DNA, 21 bp, Artificial sequence
  SiRNA target sequence
gaatattttcttactctaaag

SEQ ID NO: 695 - DNA, 21 bp, Artificial sequence
  SiRNA target sequence
aatattttcttactctaaagt

SEQ ID NO: 696 - DNA, 21 bp, Artificial sequence
  SiRNA target sequence
atattttcttactctaaagtc

SEQ ID NO: 697 - DNA, 21 bp, Artificial sequence
  SiRNA target sequence
tattttcttactctaaagtct

SEQ ID NO: 698 - DNA, 21 bp, Artificial sequence
  SiRNA target sequence
attttcttactctaaagtctg

SEQ ID NO: 699 - DNA, 21 bp, Artificial sequence
  SiRNA target sequence
ttttcttactctaaagtctgt

SEQ ID NO: 700 - DNA, 21 bp, Artificial sequence
  SiRNA target sequence
tttcttactctaaagtctgta

SEQ ID NO: 701 - DNA, 21 bp, Artificial sequence
  SiRNA target sequence
ttcttactctaaagtctgtag

SEQ ID NO: 702 - DNA, 21 bp, Artificial sequence
  SiRNA target sequence
tcttactctaaagtctgtaga

SEQ ID NO: 703 - DNA, 21 bp, Artificial sequence
  SiRNA target sequence
cttactctaaagtctgtagaa

SEQ ID NO: 704 - DNA, 21 bp, Artificial sequence
  SiRNA target sequence
ttactctaaagtctgtagaaa

SEQ ID NO: 705 - DNA, 21 bp, Artificial sequence
  SiRNA target sequence
tactctaaagtctgtagaaag

SEQ ID NO: 706 - DNA, 21 bp, Artificial sequence
  SiRNA target sequence
actctaaagtctgtagaaaga

SEQ ID NO: 707 - DNA, 21 bp, Artificial sequence
  SiRNA target sequence
ctctaaagtctgtagaaagag

SEQ ID NO: 708 - DNA, 21 bp, Artificial sequence
  SiRNA target sequence
tctaaagtctgtagaaagagc

SEQ ID NO: 709 - DNA, 21 bp, Artificial sequence
  SiRNA target sequence
ctaaagtctgtagaaagagct

SEQ ID NO: 710 - DNA, 21 bp, Artificial sequence
  SiRNA target sequence
taaagtctgtagaaagagctc

SEQ ID NO: 711 - DNA, 21 bp, Artificial sequence
  SiRNA target sequence
aaagtctgtagaaagagctca

SEQ ID NO: 712 - DNA, 21 bp, Artificial sequence
  SiRNA target sequence
aagtctgtagaaagagctcaa

SEQ ID NO: 713 - DNA, 21 bp, Artificial sequence
  SiRNA target sequence
agtctgtagaaagagctcaaa

SEQ ID NO: 714 - DNA, 21 bp, Artificial sequence
  SiRNA target sequence
gtctgtagaaagagctcaaat

SEQ ID NO: 715 - DNA, 21 bp, Artificial sequence
  SiRNA target sequence
tctgtagaaagagctcaaata

SEQ ID NO: 716 - DNA, 21 bp, Artificial sequence
  SiRNA target sequence
ctgtagaaagagctcaaatat

SEQ ID NO: 717 - DNA, 21 bp, Artificial sequence
  SiRNA target sequence
tgtagaaagagctcaaatatt

SEQ ID NO: 718 - DNA, 21 bp, Artificial sequence
  SiRNA target sequence
gtagaaagagctcaaatattg

SEQ ID NO: 719 - DNA, 21 bp, Artificial sequence
  SiRNA target sequence
tagaaagagctcaaatattga

SEQ ID NO: 720 - DNA, 21 bp, Artificial sequence
  SiRNA target sequence
agaaagagctcaaatattgaa

SEQ ID NO: 721 - DNA, 21 bp, Artificial sequence
  SiRNA target sequence
gaaagagctcaaatattgaag

SEQ ID NO: 722 - DNA, 21 bp, Artificial sequence
  SiRNA target sequence
aaagagctcaaatattgaaga

SEQ ID NO: 723 - DNA, 21 bp, Artificial sequence
  SiRNA target sequence
aagagctcaaatattgaagat

SEQ ID NO: 724 - DNA, 21 bp, Artificial sequence
  SiRNA target sequence
agagctcaaatattgaagatg

SEQ ID NO: 725 - DNA, 21 bp, Artificial sequence
  SiRNA target sequence
gagctcaaatattgaagatgg

SEQ ID NO: 726 - DNA, 21 bp, Artificial sequence
  SiRNA target sequence
agctcaaatattgaagatggt

SEQ ID NO: 727 - DNA, 21 bp, Artificial sequence
  SiRNA target sequence
gctcaaatattgaagatggtt

SEQ ID NO: 728 - DNA, 21 bp, Artificial sequence
  SiRNA target sequence
ctcaaatattgaagatggttt

SEQ ID NO: 729 - DNA, 21 bp, Artificial sequence
  SiRNA target sequence
tcaaatattgaagatggttta

SEQ ID NO: 730 - DNA, 21 bp, Artificial sequence
  SiRNA target sequence
caaatattgaagatggtttat

SEQ ID NO: 731 - DNA, 21 bp, Artificial sequence
  SiRNA target sequence
aaatattgaagatggtttatg

SEQ ID NO: 732 - DNA, 21 bp, Artificial sequence
  SiRNA target sequence
aatattgaagatggtttatgt

SEQ ID NO: 733 - DNA, 21 bp, Artificial sequence
  SiRNA target sequence
atattgaagatggtttatgtg

SEQ ID NO: 734 - DNA, 21 bp, Artificial sequence
  SiRNA target sequence
tattgaagatggtttatgtgg

SEQ ID NO: 735 - DNA, 21 bp, Artificial sequence
  SiRNA target sequence
attgaagatggtttatgtgga

SEQ ID NO: 736 - DNA, 21 bp, Artificial sequence
  SiRNA target sequence
ttgaagatggtttatgtggac

SEQ ID NO: 737 - DNA, 21 bp, Artificial sequence
  SiRNA target sequence
tgaagatggtttatgtggacc

SEQ ID NO: 738 - DNA, 21 bp, Artificial sequence
  SiRNA target sequence
gaagatggtttatgtggacca

SEQ ID NO: 739 - DNA, 21 bp, Artificial sequence
  SiRNA target sequence
aagatggtttatgtggaccaa

SEQ ID NO: 740 - DNA, 21 bp, Artificial sequence
  SiRNA target sequence
agatggtttatgtggaccaaa

SEQ ID NO: 741 - DNA, 21 bp, Artificial sequence
  SiRNA target sequence
gatggtttatgtggaccaaaa

SEQ ID NO: 742 - DNA, 21 bp, Artificial sequence
  SiRNA target sequence
atggtttatgtggaccaaaat

SEQ ID NO: 743 - DNA, 21 bp, Artificial sequence
  SiRNA target sequence
tggtttatgtggaccaaaatt

SEQ ID NO: 744 - DNA, 21 bp, Artificial sequence
  SiRNA target sequence
ggtttatgtggaccaaaattg

SEQ ID NO: 745 - DNA, 21 bp, Artificial sequence
  SiRNA target sequence
gtttatgtggaccaaaattga

SEQ ID NO: 746 - DNA, 21 bp, Artificial sequence
  SiRNA target sequence
tttatgtggaccaaaattgat

SEQ ID NO: 747 - DNA, 21 bp, Artificial sequence
  SiRNA target sequence
ttatgtggaccaaaattgatt

SEQ ID NO: 748 - DNA, 21 bp, Artificial sequence
  SiRNA target sequence
tatgtggaccaaaattgattt

SEQ ID NO: 749 - DNA, 21 bp, Artificial sequence
  SiRNA target sequence
atgtggaccaaaattgatttc

SEQ ID NO: 750 - DNA, 21 bp, Artificial sequence
  SiRNA target sequence
tgtggaccaaaattgatttct

SEQ ID NO: 751 - DNA, 21 bp, Artificial sequence
  SiRNA target sequence
gtggaccaaaattgatttctt

SEQ ID NO: 752 - DNA, 21 bp, Artificial sequence
  SiRNA target sequence
tggaccaaaattgatttcttt

SEQ ID NO: 753 - DNA, 21 bp, Artificial sequence
  SiRNA target sequence
ggaccaaaattgatttcttta

SEQ ID NO: 754 - DNA, 21 bp, Artificial sequence
  SiRNA target sequence
gaccaaaattgatttctttat

SEQ ID NO: 755 - DNA, 21 bp, Artificial sequence
  SiRNA target sequence
accaaaattgatttctttata

SEQ ID NO: 756 - DNA, 21 bp, Artificial sequence
  SiRNA target sequence
ccaaaattgatttctttatat

SEQ ID NO: 757 - DNA, 21 bp, Artificial sequence
  SiRNA target sequence
caaaattgatttctttatatt

SEQ ID NO: 758 - DNA, 21 bp, Artificial sequence
  SiRNA target sequence
aaaattgatttctttatatta

SEQ ID NO: 759 - DNA, 21 bp, Artificial sequence
  SiRNA target sequence
aaattgatttctttatattac

SEQ ID NO: 760 - DNA, 21 bp, Artificial sequence
  SiRNA target sequence
aattgatttctttatattaca

SEQ ID NO: 761 - DNA, 21 bp, Artificial sequence
  SiRNA target sequence
attgatttctttatattacat

SEQ ID NO: 762 - DNA, 21 bp, Artificial sequence
  SiRNA target sequence
ttgatttctttatattacatc

SEQ ID NO: 763 - DNA, 21 bp, Artificial sequence
  SiRNA target sequence
tgatttctttatattacatca

SEQ ID NO: 764 - DNA, 21 bp, Artificial sequence
  SiRNA target sequence
gatttctttatattacatcaa

SEQ ID NO: 765 - DNA, 21 bp, Artificial sequence
  SiRNA target sequence
atttctttatattacatcaag

SEQ ID NO: 766 - DNA, 21 bp, Artificial sequence
  SiRNA target sequence
tttctttatattacatcaaga

SEQ ID NO: 767 - DNA, 21 bp, Artificial sequence
  SiRNA target sequence
ttctttatattacatcaagat

SEQ ID NO: 768 - DNA, 21 bp, Artificial sequence
  SiRNA target sequence
tctttatattacatcaagata

SEQ ID NO: 769 - DNA, 21 bp, Artificial sequence
  SiRNA target sequence
ctttatattacatcaagatat

SEQ ID NO: 770 - DNA, 21 bp, Artificial sequence
  SiRNA target sequence
tttatattacatcaagatatc

SEQ ID NO: 771 - DNA, 21 bp, Artificial sequence
  SiRNA target sequence
ttatattacatcaagatatca

SEQ ID NO: 772 - DNA, 21 bp, Artificial sequence
  SiRNA target sequence
tatattacatcaagatatcaa

SEQ ID NO: 773 - DNA, 21 bp, Artificial sequence
  SiRNA target sequence
atattacatcaagatatcaat

SEQ ID NO: 774 - DNA, 21 bp, Artificial sequence
  SiRNA target sequence
tattacatcaagatatcaatt

SEQ ID NO: 775 - DNA, 21 bp, Artificial sequence
  SiRNA target sequence
attacatcaagatatcaattg

SEQ ID NO: 776 - DNA, 21 bp, Artificial sequence
  SiRNA target sequence
ttacatcaagatatcaattgt

SEQ ID NO: 777 - DNA, 21 bp, Artificial sequence
  SiRNA target sequence
tacatcaagatatcaattgta

SEQ ID NO: 778 - DNA, 21 bp, Artificial sequence
  SiRNA target sequence
acatcaagatatcaattgtac

SEQ ID NO: 779 - DNA, 21 bp, Artificial sequence
  SiRNA target sequence
catcaagatatcaattgtacc

SEQ ID NO: 780 - DNA, 21 bp, Artificial sequence
  SiRNA target sequence
atcaagatatcaattgtaccg

SEQ ID NO: 781 - DNA, 21 bp, Artificial sequence
  SiRNA target sequence
tcaagatatcaattgtaccgg

SEQ ID NO: 782 - DNA, 21 bp, Artificial sequence
  SiRNA target sequence
caagatatcaattgtaccggt

SEQ ID NO: 783 - DNA, 21 bp, Artificial sequence
  SiRNA target sequence
aagatatcaattgtaccggtt

SEQ ID NO: 784 - DNA, 21 bp, Artificial sequence
  SiRNA target sequence
agatatcaattgtaccggttt

SEQ ID NO: 785 - DNA, 21 bp, Artificial sequence
  SiRNA target sequence
gatatcaattgtaccggtttt

SEQ ID NO: 786 - DNA, 21 bp, Artificial sequence
  SiRNA target sequence
atatcaattgtaccggtttta

SEQ ID NO: 787 - DNA, 21 bp, Artificial sequence
  SiRNA target sequence
tatcaattgtaccggttttac

SEQ ID NO: 788 - DNA, 21 bp, Artificial sequence
  SiRNA target sequence
atcaattgtaccggttttaca

SEQ ID NO: 789 - DNA, 21 bp, Artificial sequence
  SiRNA target sequence
tcaattgtaccggttttacat

SEQ ID NO: 790 - DNA, 21 bp, Artificial sequence
  SiRNA target sequence
caattgtaccggttttacatt

SEQ ID NO: 791 - DNA, 21 bp, Artificial sequence
  SiRNA target sequence
aattgtaccggttttacatta

SEQ ID NO: 792 - DNA, 21 bp, Artificial sequence
  SiRNA target sequence
attgtaccggttttacattaa

SEQ ID NO: 793 - DNA, 21 bp, Artificial sequence
  SiRNA target sequence
ttgtaccggttttacattaac

SEQ ID NO: 794 - DNA, 21 bp, Artificial sequence
  SiRNA target sequence
tgtaccggttttacattaact

SEQ ID NO: 795 - DNA, 21 bp, Artificial sequence
  SiRNA target sequence
gtaccggttttacattaacta

SEQ ID NO: 796 - DNA, 21 bp, Artificial sequence
  SiRNA target sequence
taccggttttacattaactat

SEQ ID NO: 797 - DNA, 21 bp, Artificial sequence
  SiRNA target sequence
accggttttacattaactata

SEQ ID NO: 798 - DNA, 21 bp, Artificial sequence
  SiRNA target sequence
ccggttttacattaactatag

SEQ ID NO: 799 - DNA, 21 bp, Artificial sequence
  SiRNA target sequence
cggttttacattaactatagt

SEQ ID NO: 800 - DNA, 21 bp, Artificial sequence
  SiRNA target sequence
ggttttacattaactatagta

SEQ ID NO: 801 - DNA, 21 bp, Artificial sequence
  SiRNA target sequence
gttttacattaactatagtag

SEQ ID NO: 802 - DNA, 21 bp, Artificial sequence
  SiRNA target sequence
ttttacattaactatagtaga

SEQ ID NO: 803 - DNA, 21 bp, Artificial sequence
  SiRNA target sequence
tttacattaactatagtagat

SEQ ID NO: 804 - DNA, 21 bp, Artificial sequence
  SiRNA target sequence
ttacattaactatagtagata

SEQ ID NO: 805 - DNA, 21 bp, Artificial sequence
  SiRNA target sequence
tacattaactatagtagataa

SEQ ID NO: 806 - DNA, 21 bp, Artificial sequence
  SiRNA target sequence
acattaactatagtagataag

SEQ ID NO: 807 - DNA, 21 bp, Artificial sequence
  SiRNA target sequence
cattaactatagtagataagg

SEQ ID NO: 808 - DNA, 21 bp, Artificial sequence
  SiRNA target sequence
attaactatagtagataagga

SEQ ID NO: 809 - DNA, 21 bp, Artificial sequence
  SiRNA target sequence
ttaactatagtagataaggat

SEQ ID NO: 810 - DNA, 21 bp, Artificial sequence
  SiRNA target sequence
taactatagtagataaggatg

SEQ ID NO: 811 - DNA, 21 bp, Artificial sequence
  SiRNA target sequence
aactatagtagataaggatga

SEQ ID NO: 812 - DNA, 21 bp, Artificial sequence
  SiRNA target sequence
actatagtagataaggatgaa

SEQ ID NO: 813 - DNA, 21 bp, Artificial sequence
  SiRNA target sequence
ctatagtagataaggatgaaa

SEQ ID NO: 814 - DNA, 21 bp, Artificial sequence
  SiRNA target sequence
tatagtagataaggatgaaag

SEQ ID NO: 815 - DNA, 21 bp, Artificial sequence
  SiRNA target sequence
atagtagataaggatgaaaga

SEQ ID NO: 816 - DNA, 21 bp, Artificial sequence
  SiRNA target sequence
tagtagataaggatgaaagaa

SEQ ID NO: 817 - DNA, 21 bp, Artificial sequence
  SiRNA target sequence
agtagataaggatgaaagaac

SEQ ID NO: 818 - DNA, 21 bp, Artificial sequence
  SiRNA target sequence
gtagataaggatgaaagaaca

SEQ ID NO: 819 - DNA, 21 bp, Artificial sequence
  SiRNA target sequence
tagataaggatgaaagaacaa

SEQ ID NO: 820 - DNA, 21 bp, Artificial sequence
  SiRNA target sequence
agataaggatgaaagaacaaa

SEQ ID NO: 821 - DNA, 21 bp, Artificial sequence
  SiRNA target sequence
gataaggatgaaagaacaaag

SEQ ID NO: 822 - DNA, 21 bp, Artificial sequence
  SiRNA target sequence
ataaggatgaaagaacaaagg

SEQ ID NO: 823 - DNA, 21 bp, Artificial sequence
  SiRNA target sequence
taaggatgaaagaacaaagga

SEQ ID NO: 824 - DNA, 21 bp, Artificial sequence
  SiRNA target sequence
aaggatgaaagaacaaaggac

SEQ ID NO: 825 - DNA, 21 bp, Artificial sequence
  SiRNA target sequence
aggatgaaagaacaaaggacc

SEQ ID NO: 826 - DNA, 21 bp, Artificial sequence
  SiRNA target sequence
ggatgaaagaacaaaggacct

SEQ ID NO: 827 - DNA, 21 bp, Artificial sequence
  SiRNA target sequence
gatgaaagaacaaaggacctc

SEQ ID NO: 828 - DNA, 21 bp, Artificial sequence
  SiRNA target sequence
atgaaagaacaaaggacctcg

SEQ ID NO: 829 - DNA, 21 bp, Artificial sequence
  SiRNA target sequence
tgaaagaacaaaggacctcga

SEQ ID NO: 830 - DNA, 21 bp, Artificial sequence
  SiRNA target sequence
gaaagaacaaaggacctcgag

SEQ ID NO: 831 - DNA, 21 bp, Artificial sequence
  SiRNA target sequence
aaagaacaaaggacctcgagt

SEQ ID NO: 832 - DNA, 21 bp, Artificial sequence
  SiRNA target sequence
aagaacaaaggacctcgagta

SEQ ID NO: 833 - DNA, 21 bp, Artificial sequence
  SiRNA target sequence
agaacaaaggacctcgagtat

SEQ ID NO: 834 - DNA, 21 bp, Artificial sequence
  SiRNA target sequence
gaacaaaggacctcgagtatt

SEQ ID NO: 835 - DNA, 21 bp, Artificial sequence
  SiRNA target sequence
aacaaaggacctcgagtattt

SEQ ID NO: 836 - DNA, 21 bp, Artificial sequence
  SiRNA target sequence
acaaaggacctcgagtatttt

SEQ ID NO: 837 - DNA, 21 bp, Artificial sequence
  SiRNA target sequence
caaaggacctcgagtattttg

SEQ ID NO: 838 - DNA, 21 bp, Artificial sequence
  SiRNA target sequence
aaaggacctcgagtattttga

SEQ ID NO: 839 - DNA, 21 bp, Artificial sequence
  SiRNA target sequence
aaggacctcgagtattttgac

SEQ ID NO: 840 - DNA, 21 bp, Artificial sequence
  SiRNA target sequence
aggacctcgagtattttgacc

SEQ ID NO: 841 - DNA, 21 bp, Artificial sequence
  SiRNA target sequence
ggacctcgagtattttgacct

SEQ ID NO: 842 - DNA, 21 bp, Artificial sequence
  SiRNA target sequence
gacctcgagtattttgacctt

SEQ ID NO: 843 - DNA, 21 bp, Artificial sequence
  SiRNA target sequence
acctcgagtattttgacctta

SEQ ID NO: 844 - DNA, 21 bp, Artificial sequence
  SiRNA target sequence
cctcgagtattttgaccttaa

SEQ ID NO: 845 - DNA, 21 bp, Artificial sequence
  SiRNA target sequence
ctcgagtattttgaccttaat

SEQ ID NO: 846 - DNA, 21 bp, Artificial sequence
  SiRNA target sequence
tcgagtattttgaccttaatt

SEQ ID NO: 847 - DNA, 21 bp, Artificial sequence
  SiRNA target sequence
cgagtattttgaccttaattg

SEQ ID NO: 848 - DNA, 21 bp, Artificial sequence
  SiRNA target sequence
gagtattttgaccttaattgt

SEQ ID NO: 849 - DNA, 21 bp, Artificial sequence
  SiRNA target sequence
agtattttgaccttaattgtg

SEQ ID NO: 850 - DNA, 21 bp, Artificial sequence
  SiRNA target sequence
gtattttgaccttaattgtga

SEQ ID NO: 851 - DNA, 21 bp, Artificial sequence
  SiRNA target sequence
tattttgaccttaattgtgag

SEQ ID NO: 852 - DNA, 21 bp, Artificial sequence
  SiRNA target sequence
attttgaccttaattgtgagt

SEQ ID NO: 853 - DNA, 21 bp, Artificial sequence
  SiRNA target sequence
ttttgaccttaattgtgagta

SEQ ID NO: 854 - DNA, 21 bp, Artificial sequence
  SiRNA target sequence
tttgaccttaattgtgagtat

SEQ ID NO: 855 - DNA, 21 bp, Artificial sequence
  SiRNA target sequence
ttgaccttaattgtgagtatt

SEQ ID NO: 856 - DNA, 21 bp, Artificial sequence
  SiRNA target sequence
tgaccttaattgtgagtatta

SEQ ID NO: 857 - DNA, 21 bp, Artificial sequence
  SiRNA target sequence
gaccttaattgtgagtattat

SEQ ID NO: 858 - DNA, 21 bp, Artificial sequence
  SiRNA target sequence
accttaattgtgagtattatg

SEQ ID NO: 859 - DNA, 21 bp, Artificial sequence
  SiRNA target sequence
ccttaattgtgagtattatga

SEQ ID NO: 860 - DNA, 21 bp, Artificial sequence
  SiRNA target sequence
cttaattgtgagtattatgag

SEQ ID NO: 861 - DNA, 21 bp, Artificial sequence
  SiRNA target sequence
ttaattgtgagtattatgaga

SEQ ID NO: 862 - DNA, 21 bp, Artificial sequence
  SiRNA target sequence
taattgtgagtattatgagaa

SEQ ID NO: 863 - DNA, 21 bp, Artificial sequence
  SiRNA target sequence
aattgtgagtattatgagaat

SEQ ID NO: 864 - DNA, 21 bp, Artificial sequence
  SiRNA target sequence
attgtgagtattatgagaatt

SEQ ID NO: 865 - DNA, 21 bp, Artificial sequence
  SiRNA target sequence
ttgtgagtattatgagaattt

SEQ ID NO: 866 - DNA, 21 bp, Artificial sequence
  SiRNA target sequence
tgtgagtattatgagaatttg

SEQ ID NO: 867 - DNA, 21 bp, Artificial sequence
  SiRNA target sequence
gtgagtattatgagaatttgt

SEQ ID NO: 868 - DNA, 21 bp, Artificial sequence
  SiRNA target sequence
tgagtattatgagaatttgta

SEQ ID NO: 869 - DNA, 21 bp, Artificial sequence
  SiRNA target sequence
gagtattatgagaatttgtat

SEQ ID NO: 870 - DNA, 21 bp, Artificial sequence
  SiRNA target sequence
agtattatgagaatttgtatg

SEQ ID NO: 871 - DNA, 21 bp, Artificial sequence
  SiRNA target sequence
gtattatgagaatttgtatga

SEQ ID NO: 872 - DNA, 21 bp, Artificial sequence
  SiRNA target sequence
tattatgagaatttgtatgat

SEQ ID NO: 873 - DNA, 21 bp, Artificial sequence
  SiRNA target sequence
attatgagaatttgtatgatg

SEQ ID NO: 874 - DNA, 21 bp, Artificial sequence
  SiRNA target sequence
ttatgagaatttgtatgatgc

SEQ ID NO: 875 - DNA, 21 bp, Artificial sequence
  SiRNA target sequence
tatgagaatttgtatgatgca

SEQ ID NO: 876 - DNA, 21 bp, Artificial sequence
  SiRNA target sequence
atgagaatttgtatgatgcat

SEQ ID NO: 877 - DNA, 21 bp, Artificial sequence
  SiRNA target sequence
tgagaatttgtatgatgcatt

SEQ ID NO: 878 - DNA, 21 bp, Artificial sequence
  SiRNA target sequence
gagaatttgtatgatgcatta

SEQ ID NO: 879 - DNA, 21 bp, Artificial sequence
  SiRNA target sequence
agaatttgtatgatgcattaa

SEQ ID NO: 880 - DNA, 21 bp, Artificial sequence
  SiRNA target sequence
gaatttgtatgatgcattaat

SEQ ID NO: 881 - DNA, 21 bp, Artificial sequence
  SiRNA target sequence
aatttgtatgatgcattaatg

SEQ ID NO: 882 - DNA, 21 bp, Artificial sequence
  SiRNA target sequence
atttgtatgatgcattaatgg

SEQ ID NO: 883 - DNA, 21 bp, Artificial sequence
  SiRNA target sequence
tttgtatgatgcattaatgga

SEQ ID NO: 884 - DNA, 21 bp, Artificial sequence
  SiRNA target sequence
ttgtatgatgcattaatggat

SEQ ID NO: 885 - DNA, 21 bp, Artificial sequence
  SiRNA target sequence
tgtatgatgcattaatggatt

SEQ ID NO: 886 - DNA, 21 bp, Artificial sequence
  SiRNA target sequence
gtatgatgcattaatggattc

SEQ ID NO: 887 - DNA, 21 bp, Artificial sequence
  SiRNA target sequence
tatgatgcattaatggattct

SEQ ID NO: 888 - DNA, 21 bp, Artificial sequence
  SiRNA target sequence
atgatgcattaatggattctg

SEQ ID NO: 889 - DNA, 21 bp, Artificial sequence
  SiRNA target sequence
tgatgcattaatggattctga

SEQ ID NO: 890 - DNA, 21 bp, Artificial sequence
  SiRNA target sequence
gatgcattaatggattctgag

SEQ ID NO: 891 - DNA, 21 bp, Artificial sequence
  SiRNA target sequence
atgcattaatggattctgagt

SEQ ID NO: 892 - DNA, 21 bp, Artificial sequence
  SiRNA target sequence
tgcattaatggattctgagtt

SEQ ID NO: 893 - DNA, 21 bp, Artificial sequence
  SiRNA target sequence
gcattaatggattctgagttt

SEQ ID NO: 894 - DNA, 21 bp, Artificial sequence
  SiRNA target sequence
cattaatggattctgagtttt

SEQ ID NO: 895 - DNA, 21 bp, Artificial sequence
  SiRNA target sequence
attaatggattctgagttttc

SEQ ID NO: 896 - DNA, 21 bp, Artificial sequence
  SiRNA target sequence
ttaatggattctgagttttct

SEQ ID NO: 897 - DNA, 21 bp, Artificial sequence
  SiRNA target sequence
taatggattctgagttttcta

SEQ ID NO: 898 - DNA, 21 bp, Artificial sequence
  SiRNA target sequence
aatggattctgagttttctaa

SEQ ID NO: 899 - DNA, 21 bp, Artificial sequence
  SiRNA target sequence
atggattctgagttttctaaa

SEQ ID NO: 900 - DNA, 21 bp, Artificial sequence
  SiRNA target sequence
tggattctgagttttctaaaa

SEQ ID NO: 901 - DNA, 21 bp, Artificial sequence
  SiRNA target sequence
ggattctgagttttctaaaac

SEQ ID NO: 902 - DNA, 21 bp, Artificial sequence
  SiRNA target sequence
gattctgagttttctaaaact

SEQ ID NO: 903 - DNA, 21 bp, Artificial sequence
  SiRNA target sequence
attctgagttttctaaaactt

SEQ ID NO: 904 - DNA, 21 bp, Artificial sequence
  SiRNA target sequence
ttctgagttttctaaaacttg

SEQ ID NO: 905 - DNA, 21 bp, Artificial sequence
  SiRNA target sequence
tctgagttttctaaaacttgg

SEQ ID NO: 906 - DNA, 21 bp, Artificial sequence
  SiRNA target sequence
ctgagttttctaaaacttggt

SEQ ID NO: 907 - DNA, 21 bp, Artificial sequence
  SiRNA target sequence
tgagttttctaaaacttggtt

SEQ ID NO: 908 - DNA, 21 bp, Artificial sequence
  SiRNA target sequence
gagttttctaaaacttggttt

SEQ ID NO: 909 - DNA, 21 bp, Artificial sequence
  SiRNA target sequence
agttttctaaaacttggttta

SEQ ID NO: 910 - DNA, 21 bp, Artificial sequence
  SiRNA target sequence
gttttctaaaacttggtttac

SEQ ID NO: 911 - DNA, 21 bp, Artificial sequence
  SiRNA target sequence
ttttctaaaacttggtttaca

SEQ ID NO: 912 - DNA, 21 bp, Artificial sequence
  SiRNA target sequence
tttctaaaacttggtttacat

SEQ ID NO: 913 - DNA, 21 bp, Artificial sequence
  SiRNA target sequence
ttctaaaacttggtttacatt

SEQ ID NO: 914 - DNA, 21 bp, Artificial sequence
  SiRNA target sequence
tctaaaacttggtttacattg

SEQ ID NO: 915 - DNA, 21 bp, Artificial sequence
  SiRNA target sequence
ctaaaacttggtttacattgt

SEQ ID NO: 916 - DNA, 21 bp, Artificial sequence
  SiRNA target sequence
taaaacttggtttacattgtt

SEQ ID NO: 917 - DNA, 21 bp, Artificial sequence
  SiRNA target sequence
aaaacttggtttacattgttg

SEQ ID NO: 918 - DNA, 21 bp, Artificial sequence
  SiRNA target sequence
aaacttggtttacattgttgc

SEQ ID NO: 919 - DNA, 21 bp, Artificial sequence
  SiRNA target sequence
aacttggtttacattgttgct

SEQ ID NO: 920 - DNA, 21 bp, Artificial sequence
  SiRNA target sequence
acttggtttacattgttgcta

SEQ ID NO: 921 - DNA, 21 bp, Artificial sequence
  SiRNA target sequence
cttggtttacattgttgctaa

SEQ ID NO: 922 - DNA, 21 bp, Artificial sequence
  SiRNA target sequence
ttggtttacattgttgctaaa

SEQ ID NO: 923 - DNA, 21 bp, Artificial sequence
  SiRNA target sequence
tggtttacattgttgctaaaa

SEQ ID NO: 924 - DNA, 21 bp, Artificial sequence
  SiRNA target sequence
ggtttacattgttgctaaaat

SEQ ID NO: 925 - DNA, 21 bp, Artificial sequence
  SiRNA target sequence
gtttacattgttgctaaaata

SEQ ID NO: 926 - DNA, 21 bp, Artificial sequence
  SiRNA target sequence
tttacattgttgctaaaatat

SEQ ID NO: 927 - DNA, 21 bp, Artificial sequence
  SiRNA target sequence
ttacattgttgctaaaatata

SEQ ID NO: 928 - DNA, 21 bp, Artificial sequence
  SiRNA target sequence
tacattgttgctaaaatatat

SEQ ID NO: 929 - DNA, 21 bp, Artificial sequence
  SiRNA target sequence
acattgttgctaaaatatatt

SEQ ID NO: 930 - DNA, 21 bp, Artificial sequence
  SiRNA target sequence
cattgttgctaaaatatattg

SEQ ID NO: 931 - DNA, 21 bp, Artificial sequence
  SiRNA target sequence
attgttgctaaaatatattga

SEQ ID NO: 932 - DNA, 21 bp, Artificial sequence
  SiRNA target sequence
ttgttgctaaaatatattgat

SEQ ID NO: 933 - DNA, 21 bp, Artificial sequence
  SiRNA target sequence
tgttgctaaaatatattgatt

SEQ ID NO: 934 - DNA, 21 bp, Artificial sequence
  SiRNA target sequence
gttgctaaaatatattgatta

SEQ ID NO: 935 - DNA, 21 bp, Artificial sequence
  SiRNA target sequence
ttgctaaaatatattgattat

SEQ ID NO: 936 - DNA, 21 bp, Artificial sequence
  SiRNA target sequence
tgctaaaatatattgattatg

SEQ ID NO: 937 - DNA, 21 bp, Artificial sequence
  SiRNA target sequence
gctaaaatatattgattatgc

SEQ ID NO: 938 - DNA, 21 bp, Artificial sequence
  SiRNA target sequence
ctaaaatatattgattatgct

SEQ ID NO: 939 - DNA, 21 bp, Artificial sequence
  SiRNA target sequence
taaaatatattgattatgctc

SEQ ID NO: 940 - DNA, 21 bp, Artificial sequence
  SiRNA target sequence
aaaatatattgattatgctcc

SEQ ID NO: 941 - DNA, 21 bp, Artificial sequence
  SiRNA target sequence
aaatatattgattatgctcca

SEQ ID NO: 942 - DNA, 21 bp, Artificial sequence
  SiRNA target sequence
aatatattgattatgctccaa

SEQ ID NO: 943 - DNA, 21 bp, Artificial sequence
  SiRNA target sequence
atatattgattatgctccaat

SEQ ID NO: 944 - DNA, 21 bp, Artificial sequence
  SiRNA target sequence
tatattgattatgctccaatt

SEQ ID NO: 945 - DNA, 21 bp, Artificial sequence
  SiRNA target sequence
atattgattatgctccaatta

SEQ ID NO: 946 - DNA, 21 bp, Artificial sequence
  SiRNA target sequence
tattgattatgctccaattag

SEQ ID NO: 947 - DNA, 21 bp, Artificial sequence
  SiRNA target sequence
attgattatgctccaattagt

SEQ ID NO: 948 - DNA, 21 bp, Artificial sequence
  SiRNA target sequence
ttgattatgctccaattagta

SEQ ID NO: 949 - DNA, 21 bp, Artificial sequence
  SiRNA target sequence
tgattatgctccaattagtac

SEQ ID NO: 950 - DNA, 21 bp, Artificial sequence
  SiRNA target sequence
gattatgctccaattagtacg

SEQ ID NO: 951 - DNA, 21 bp, Artificial sequence
  SiRNA target sequence
attatgctccaattagtacga

SEQ ID NO: 952 - DNA, 21 bp, Artificial sequence
  SiRNA target sequence
ttatgctccaattagtacgaa

SEQ ID NO: 953 - DNA, 21 bp, Artificial sequence
  SiRNA target sequence
tatgctccaattagtacgaac

SEQ ID NO: 954 - DNA, 21 bp, Artificial sequence
  SiRNA target sequence
atgctccaattagtacgaaca

SEQ ID NO: 955 - DNA, 21 bp, Artificial sequence
  SiRNA target sequence
tgctccaattagtacgaacag

SEQ ID NO: 956 - DNA, 21 bp, Artificial sequence
  SiRNA target sequence
gctccaattagtacgaacagt

SEQ ID NO: 957 - DNA, 21 bp, Artificial sequence
  SiRNA target sequence
ctccaattagtacgaacagtc

SEQ ID NO: 958 - DNA, 21 bp, Artificial sequence
  SiRNA target sequence
tccaattagtacgaacagtcg

SEQ ID NO: 959 - DNA, 21 bp, Artificial sequence
  SiRNA target sequence
ccaattagtacgaacagtcga

SEQ ID NO: 960 - DNA, 21 bp, Artificial sequence
  SiRNA target sequence
caattagtacgaacagtcgag

SEQ ID NO: 961 - DNA, 21 bp, Artificial sequence
  SiRNA target sequence
aattagtacgaacagtcgagg

SEQ ID NO: 962 - DNA, 21 bp, Artificial sequence
  SiRNA target sequence
attagtacgaacagtcgagga

SEQ ID NO: 963 - DNA, 21 bp, Artificial sequence
  SiRNA target sequence
ttagtacgaacagtcgaggaa

SEQ ID NO: 964 - DNA, 21 bp, Artificial sequence
  SiRNA target sequence
tagtacgaacagtcgaggaat

SEQ ID NO: 965 - DNA, 21 bp, Artificial sequence
  SiRNA target sequence
agtacgaacagtcgaggaatg

SEQ ID NO: 966 - DNA, 21 bp, Artificial sequence
  SiRNA target sequence
gtacgaacagtcgaggaatgc

SEQ ID NO: 967 - DNA, 21 bp, Artificial sequence
  SiRNA target sequence
tacgaacagtcgaggaatgcc

SEQ ID NO: 968 - DNA, 21 bp, Artificial sequence
  SiRNA target sequence
acgaacagtcgaggaatgccc

SEQ ID NO: 969 - DNA, 21 bp, Artificial sequence
  SiRNA target sequence
cgaacagtcgaggaatgcccc

SEQ ID NO: 970 - DNA, 21 bp, Artificial sequence
  SiRNA target sequence
gaacagtcgaggaatgccccg

SEQ ID NO: 971 - DNA, 21 bp, Artificial sequence
  SiRNA target sequence
aacagtcgaggaatgccccgc

SEQ ID NO: 972 - DNA, 21 bp, Artificial sequence
  SiRNA target sequence
acagtcgaggaatgccccgcc

SEQ ID NO: 973 - DNA, 21 bp, Artificial sequence
  SiRNA target sequence
cagtcgaggaatgccccgccc

SEQ ID NO: 974 - DNA, 21 bp, Artificial sequence
  SiRNA target sequence
agtcgaggaatgccccgcccg

SEQ ID NO: 975 - DNA, 21 bp, Artificial sequence
  SiRNA target sequence
gtcgaggaatgccccgcccgg

SEQ ID NO: 976 - DNA, 21 bp, Artificial sequence
  SiRNA target sequence
tcgaggaatgccccgcccgga

SEQ ID NO: 977 - DNA, 21 bp, Artificial sequence
  SiRNA target sequence
cgaggaatgccccgcccggag

SEQ ID NO: 978 - DNA, 21 bp, Artificial sequence
  SiRNA target sequence
gaggaatgccccgcccggaga

SEQ ID NO: 979 - DNA, 21 bp, Artificial sequence
  SiRNA target sequence
aggaatgccccgcccggagac

SEQ ID NO: 980 - DNA, 21 bp, Artificial sequence
  SiRNA target sequence
ggaatgccccgcccggagacc

SEQ ID NO: 981 - DNA, 21 bp, Artificial sequence
  SiRNA target sequence
gaatgccccgcccggagacca

SEQ ID NO: 982 - DNA, 21 bp, Artificial sequence
  SiRNA target sequence
aatgccccgcccggagaccat

SEQ ID NO: 983 - DNA, 21 bp, Artificial sequence
  SiRNA target sequence
atgccccgcccggagaccatc

SEQ ID NO: 984 - DNA, 21 bp, Artificial sequence
  SiRNA target sequence
tgccccgcccggagaccatct

SEQ ID NO: 985 - DNA, 21 bp, Artificial sequence
  SiRNA target sequence
gccccgcccggagaccatctg

SEQ ID NO: 986 - DNA, 21 bp, Artificial sequence
  SiRNA target sequence
ccccgcccggagaccatctgt

SEQ ID NO: 987 - DNA, 21 bp, Artificial sequence
  SiRNA target sequence
cccgcccggagaccatctgtg

SEQ ID NO: 988 - DNA, 21 bp, Artificial sequence
  SiRNA target sequence
ccgcccggagaccatctgtgt

SEQ ID NO: 989 - DNA, 21 bp, Artificial sequence
  SiRNA target sequence
cgcccggagaccatctgtgtt

SEQ ID NO: 990 - DNA, 21 bp, Artificial sequence
  SiRNA target sequence
gcccggagaccatctgtgttt

SEQ ID NO: 991 - DNA, 21 bp, Artificial sequence
  SiRNA target sequence
cccggagaccatctgtgtttc

SEQ ID NO: 992 - DNA, 21 bp, Artificial sequence
  SiRNA target sequence
ccggagaccatctgtgtttca

SEQ ID NO: 993 - DNA, 21 bp, Artificial sequence
  SiRNA target sequence
cggagaccatctgtgtttcaa

SEQ ID NO: 994 - DNA, 21 bp, Artificial sequence
  SiRNA target sequence
ggagaccatctgtgtttcaaa

SEQ ID NO: 995 - DNA, 21 bp, Artificial sequence
  SiRNA target sequence
gagaccatctgtgtttcaaaa

SEQ ID NO: 996 - DNA, 21 bp, Artificial sequence
  SiRNA target sequence
agaccatctgtgtttcaaaac

SEQ ID NO: 997 - DNA, 21 bp, Artificial sequence
  SiRNA target sequence
gaccatctgtgtttcaaaaca

SEQ ID NO: 998 - DNA, 21 bp, Artificial sequence
  SiRNA target sequence
accatctgtgtttcaaaacat

SEQ ID NO: 999 - DNA, 21 bp, Artificial sequence
  SiRNA target sequence
ccatctgtgtttcaaaacatt

SEQ ID NO: 1000 - DNA, 21 bp, Artificial sequence
  SiRNA target sequence
catctgtgtttcaaaacattg

SEQ ID NO: 1001 - DNA, 21 bp, Artificial sequence
  SiRNA target sequence
atctgtgtttcaaaacattgg

SEQ ID NO: 1002 - DNA, 21 bp, Artificial sequence
  SiRNA target sequence
tctgtgtttcaaaacattggt

SEQ ID NO: 1003 - DNA, 21 bp, Artificial sequence
  SiRNA target sequence
ctgtgtttcaaaacattggtg

SEQ ID NO: 1004 - DNA, 21 bp, Artificial sequence
  SiRNA target sequence
tgtgtttcaaaacattggtgg

SEQ ID NO: 1005 - DNA, 21 bp, Artificial sequence
  SiRNA target sequence
gtgtttcaaaacattggtggt

SEQ ID NO: 1006 - DNA, 21 bp, Artificial sequence
  SiRNA target sequence
tgtttcaaaacattggtggta

SEQ ID NO: 1007 - DNA, 21 bp, Artificial sequence
  SiRNA target sequence
gtttcaaaacattggtggtat

SEQ ID NO: 1008 - DNA, 21 bp, Artificial sequence
  SiRNA target sequence
tttcaaaacattggtggtatg

SEQ ID NO: 1009 - DNA, 21 bp, Artificial sequence
  SiRNA target sequence
ttcaaaacattggtggtatga

SEQ ID NO: 1010 - DNA, 21 bp, Artificial sequence
  SiRNA target sequence
tcaaaacattggtggtatgag

SEQ ID NO: 1011 - DNA, 21 bp, Artificial sequence
  SiRNA target sequence
caaaacattggtggtatgagt

SEQ ID NO: 1012 - DNA, 21 bp, Artificial sequence
  SiRNA target sequence
aaaacattggtggtatgagtt

SEQ ID NO: 1013 - DNA, 21 bp, Artificial sequence
  SiRNA target sequence
aaacattggtggtatgagtta

SEQ ID NO: 1014 - DNA, 21 bp, Artificial sequence
  SiRNA target sequence
aacattggtggtatgagttat

SEQ ID NO: 1015 - DNA, 21 bp, Artificial sequence
  SiRNA target sequence
acattggtggtatgagttata

SEQ ID NO: 1016 - DNA, 21 bp, Artificial sequence
  SiRNA target sequence
cattggtggtatgagttatat

SEQ ID NO: 1017 - DNA, 21 bp, Artificial sequence
  SiRNA target sequence
attggtggtatgagttatata

SEQ ID NO: 1018 - DNA, 21 bp, Artificial sequence
  SiRNA target sequence
ttggtggtatgagttatatag

SEQ ID NO: 1019 - DNA, 21 bp, Artificial sequence
  SiRNA target sequence
tggtggtatgagttatatagg

SEQ ID NO: 1020 - DNA, 21 bp, Artificial sequence
  SiRNA target sequence
ggtggtatgagttatatagga

SEQ ID NO: 1021 - DNA, 21 bp, Artificial sequence
  SiRNA target sequence
gtggtatgagttatataggat

SEQ ID NO: 1022 - DNA, 21 bp, Artificial sequence
  SiRNA target sequence
tggtatgagttatataggatt

SEQ ID NO: 1023 - DNA, 21 bp, Artificial sequence
  SiRNA target sequence
ggtatgagttatataggattg

SEQ ID NO: 1024 - DNA, 21 bp, Artificial sequence
  SiRNA target sequence
gtatgagttatataggattgg

SEQ ID NO: 1025 - DNA, 21 bp, Artificial sequence
  SiRNA target sequence
tatgagttatataggattgga

SEQ ID NO: 1026 - DNA, 21 bp, Artificial sequence
  SiRNA target sequence
atgagttatataggattggat

SEQ ID NO: 1027 - DNA, 21 bp, Artificial sequence
  SiRNA target sequence
tgagttatataggattggatt

SEQ ID NO: 1028 - DNA, 21 bp, Artificial sequence
  SiRNA target sequence
gagttatataggattggattc

SEQ ID NO: 1029 - DNA, 21 bp, Artificial sequence
  SiRNA target sequence
agttatataggattggattct

SEQ ID NO: 1030 - DNA, 21 bp, Artificial sequence
  SiRNA target sequence
gttatataggattggattctt

SEQ ID NO: 1031 - DNA, 21 bp, Artificial sequence
  SiRNA target sequence
ttatataggattggattcttg

SEQ ID NO: 1032 - DNA, 21 bp, Artificial sequence
  SiRNA target sequence
tatataggattggattcttga

SEQ ID NO: 1033 - DNA, 21 bp, Artificial sequence
  SiRNA target sequence
atataggattggattcttgaa

SEQ ID NO: 1034 - DNA, 21 bp, Artificial sequence
  SiRNA target sequence
tataggattggattcttgaat

SEQ ID NO: 1035 - DNA, 21 bp, Artificial sequence
  SiRNA target sequence
ataggattggattcttgaata

SEQ ID NO: 1036 - DNA, 21 bp, Artificial sequence
  SiRNA target sequence
taggattggattcttgaataa

SEQ ID NO: 1037 - DNA, 21 bp, Artificial sequence
  SiRNA target sequence
aggattggattcttgaataag

SEQ ID NO: 1038 - DNA, 21 bp, Artificial sequence
  SiRNA target sequence
ggattggattcttgaataagt

SEQ ID NO: 1039 - DNA, 21 bp, Artificial sequence
  SiRNA target sequence
gattggattcttgaataagtt

SEQ ID NO: 1040 - DNA, 21 bp, Artificial sequence
  SiRNA target sequence
attggattcttgaataagttg

SEQ ID NO: 1041 - DNA, 21 bp, Artificial sequence
  SiRNA target sequence
ttggattcttgaataagttgt

SEQ ID NO: 1042 - DNA, 21 bp, Artificial sequence
  SiRNA target sequence
tggattcttgaataagttgta

SEQ ID NO: 1043 - DNA, 21 bp, Artificial sequence
  SiRNA target sequence
ggattcttgaataagttgtac

SEQ ID NO: 1044 - DNA, 21 bp, Artificial sequence
  SiRNA target sequence
gattcttgaataagttgtacc

SEQ ID NO: 1045 - DNA, 21 bp, Artificial sequence
  SiRNA target sequence
attcttgaataagttgtaccg

SEQ ID NO: 1046 - DNA, 21 bp, Artificial sequence
  SiRNA target sequence
ttcttgaataagttgtaccga

SEQ ID NO: 1047 - DNA, 21 bp, Artificial sequence
  SiRNA target sequence
tcttgaataagttgtaccgat

SEQ ID NO: 1048 - DNA, 21 bp, Artificial sequence
  SiRNA target sequence
cttgaataagttgtaccgatg

SEQ ID NO: 1049 - DNA, 21 bp, Artificial sequence
  SiRNA target sequence
ttgaataagttgtaccgatgt

SEQ ID NO: 1050 - DNA, 21 bp, Artificial sequence
  SiRNA target sequence
tgaataagttgtaccgatgtg

SEQ ID NO: 1051 - DNA, 21 bp, Artificial sequence
  SiRNA target sequence
gaataagttgtaccgatgtgg

SEQ ID NO: 1052 - DNA, 21 bp, Artificial sequence
  SiRNA target sequence
aataagttgtaccgatgtgga

SEQ ID NO: 1053 - DNA, 21 bp, Artificial sequence
  SiRNA target sequence
ataagttgtaccgatgtggag

SEQ ID NO: 1054 - DNA, 21 bp, Artificial sequence
  SiRNA target sequence
taagttgtaccgatgtggaga

SEQ ID NO: 1055 - DNA, 21 bp, Artificial sequence
  SiRNA target sequence
aagttgtaccgatgtggagac

SEQ ID NO: 1056 - DNA, 21 bp, Artificial sequence
  SiRNA target sequence
agttgtaccgatgtggagact

SEQ ID NO: 1057 - DNA, 21 bp, Artificial sequence
  SiRNA target sequence
gttgtaccgatgtggagactg

SEQ ID NO: 1058 - DNA, 21 bp, Artificial sequence
  SiRNA target sequence
ttgtaccgatgtggagactgg

SEQ ID NO: 1059 - DNA, 21 bp, Artificial sequence
  SiRNA target sequence
tgtaccgatgtggagactggg

SEQ ID NO: 1060 - DNA, 21 bp, Artificial sequence
  SiRNA target sequence
gtaccgatgtggagactggga

SEQ ID NO: 1061 - DNA, 21 bp, Artificial sequence
  SiRNA target sequence
taccgatgtggagactgggat

SEQ ID NO: 1062 - DNA, 21 bp, Artificial sequence
  SiRNA target sequence
accgatgtggagactgggata

SEQ ID NO: 1063 - DNA, 21 bp, Artificial sequence
  SiRNA target sequence
ccgatgtggagactgggatag

SEQ ID NO: 1064 - DNA, 21 bp, Artificial sequence
  SiRNA target sequence
cgatgtggagactgggatagt

SEQ ID NO: 1065 - DNA, 21 bp, Artificial sequence
  SiRNA target sequence
gatgtggagactgggatagta

SEQ ID NO: 1066 - DNA, 21 bp, Artificial sequence
  SiRNA target sequence
atgtggagactgggatagtat

SEQ ID NO: 1067 - DNA, 21 bp, Artificial sequence
  SiRNA target sequence
tgtggagactgggatagtatt

SEQ ID NO: 1068 - DNA, 21 bp, Artificial sequence
  SiRNA target sequence
gtggagactgggatagtattt

SEQ ID NO: 1069 - DNA, 21 bp, Artificial sequence
  SiRNA target sequence
tggagactgggatagtatttt

SEQ ID NO: 1070 - DNA, 21 bp, Artificial sequence
  SiRNA target sequence
ggagactgggatagtatttta

SEQ ID NO: 1071 - DNA, 21 bp, Artificial sequence
  SiRNA target sequence
gagactgggatagtattttac

SEQ ID NO: 1072 - DNA, 21 bp, Artificial sequence
  SiRNA target sequence
agactgggatagtattttact

SEQ ID NO: 1073 - DNA, 21 bp, Artificial sequence
  SiRNA target sequence
gactgggatagtattttactt

SEQ ID NO: 1074 - DNA, 21 bp, Artificial sequence
  SiRNA target sequence
actgggatagtattttacttc

SEQ ID NO: 1075 - DNA, 21 bp, Artificial sequence
  SiRNA target sequence
ctgggatagtattttacttct

SEQ ID NO: 1076 - DNA, 21 bp, Artificial sequence
  SiRNA target sequence
tgggatagtattttacttctc

SEQ ID NO: 1077 - DNA, 21 bp, Artificial sequence
  SiRNA target sequence
gggatagtattttacttctcc

SEQ ID NO: 1078 - DNA, 21 bp, Artificial sequence
  SiRNA target sequence
ggatagtattttacttctcct

SEQ ID NO: 1079 - DNA, 21 bp, Artificial sequence
  SiRNA target sequence
gatagtattttacttctcctt

SEQ ID NO: 1080 - DNA, 21 bp, Artificial sequence
  SiRNA target sequence
atagtattttacttctccttt

SEQ ID NO: 1081 - DNA, 21 bp, Artificial sequence
  SiRNA target sequence
tagtattttacttctcctttc

SEQ ID NO: 1082 - DNA, 21 bp, Artificial sequence
  SiRNA target sequence
agtattttacttctcctttca

SEQ ID NO: 1083 - DNA, 21 bp, Artificial sequence
  SiRNA target sequence
gtattttacttctcctttcag

SEQ ID NO: 1084 - DNA, 21 bp, Artificial sequence
  SiRNA target sequence
tattttacttctcctttcagg

SEQ ID NO: 1085 - DNA, 21 bp, Artificial sequence
  SiRNA target sequence
attttacttctcctttcagga

SEQ ID NO: 1086 - DNA, 21 bp, Artificial sequence
  SiRNA target sequence
ttttacttctcctttcaggag

SEQ ID NO: 1087 - DNA, 21 bp, Artificial sequence
  SiRNA target sequence
tttacttctcctttcaggaga

SEQ ID NO: 1088 - DNA, 21 bp, Artificial sequence
  SiRNA target sequence
ttacttctcctttcaggagat

SEQ ID NO: 1089 - DNA, 21 bp, Artificial sequence
  SiRNA target sequence
tacttctcctttcaggagata

SEQ ID NO: 1090 - DNA, 21 bp, Artificial sequence
  SiRNA target sequence
acttctcctttcaggagatat

SEQ ID NO: 1091 - DNA, 21 bp, Artificial sequence
  SiRNA target sequence
cttctcctttcaggagatatt

SEQ ID NO: 1092 - DNA, 21 bp, Artificial sequence
  SiRNA target sequence
ttctcctttcaggagatattg

SEQ ID NO: 1093 - DNA, 21 bp, Artificial sequence
  SiRNA target sequence
tctcctttcaggagatattga

SEQ ID NO: 1094 - DNA, 21 bp, Artificial sequence
  SiRNA target sequence
ctcctttcaggagatattgaa

SEQ ID NO: 1095 - DNA, 21 bp, Artificial sequence
  SiRNA target sequence
tcctttcaggagatattgaag

SEQ ID NO: 1096 - DNA, 21 bp, Artificial sequence
  SiRNA target sequence
cctttcaggagatattgaaga

SEQ ID NO: 1097 - DNA, 21 bp, Artificial sequence
  SiRNA target sequence
ctttcaggagatattgaagaa

SEQ ID NO: 1098 - DNA, 21 bp, Artificial sequence
  SiRNA target sequence
tttcaggagatattgaagaaa

SEQ ID NO: 1099 - DNA, 21 bp, Artificial sequence
  SiRNA target sequence
ttcaggagatattgaagaaaa

SEQ ID NO: 1100 - DNA, 21 bp, Artificial sequence
  SiRNA target sequence
tcaggagatattgaagaaaac

SEQ ID NO: 1101 - DNA, 21 bp, Artificial sequence
  SiRNA target sequence
caggagatattgaagaaaacc

SEQ ID NO: 1102 - DNA, 21 bp, Artificial sequence
  SiRNA target sequence
aggagatattgaagaaaaccc

SEQ ID NO: 1103 - DNA, 21 bp, Artificial sequence
  SiRNA target sequence
ggagatattgaagaaaacccg

SEQ ID NO: 1104 - DNA, 21 bp, Artificial sequence
  SiRNA target sequence
gagatattgaagaaaacccgg

SEQ ID NO: 1105 - DNA, 21 bp, Artificial sequence
  SiRNA target sequence
agatattgaagaaaacccggg

SEQ ID NO: 1106 - DNA, 21 bp, Artificial sequence
  SiRNA target sequence
gatattgaagaaaacccggga

SEQ ID NO: 1107 - DNA, 21 bp, Artificial sequence
  SiRNA target sequence
atattgaagaaaacccgggac

SEQ ID NO: 1108 - DNA, 21 bp, Artificial sequence
  SiRNA target sequence
tattgaagaaaacccgggacc

SEQ ID NO: 1109 - DNA, 21 bp, Artificial sequence
  SiRNA target sequence
attgaagaaaacccgggacct

SEQ ID NO: 1110 - DNA, 21 bp, Artificial sequence
  SiRNA target sequence
ttgaagaaaacccgggacctg

SEQ ID NO: 1111 - DNA, 21 bp, Artificial sequence
  SiRNA target sequence
tgaagaaaacccgggacctgt

SEQ ID NO: 1112 - DNA, 21 bp, Artificial sequence
  SiRNA target sequence
gaagaaaacccgggacctgtt

SEQ ID NO: 1113 - DNA, 21 bp, Artificial sequence
  SiRNA target sequence
aagaaaacccgggacctgttg

SEQ ID NO: 1114 - DNA, 21 bp, Artificial sequence
  SiRNA target sequence
agaaaacccgggacctgttga

SEQ ID NO: 1115 - DNA, 21 bp, Artificial sequence
  SiRNA target sequence
gaaaacccgggacctgttgat

SEQ ID NO: 1116 - DNA, 21 bp, Artificial sequence
  SiRNA target sequence
aaaacccgggacctgttgata

SEQ ID NO: 1117 - DNA, 21 bp, Artificial sequence
  SiRNA target sequence
aaacccgggacctgttgatat

SEQ ID NO: 1118 - DNA, 21 bp, Artificial sequence
  SiRNA target sequence
aacccgggacctgttgatatt

SEQ ID NO: 1119 - DNA, 21 bp, Artificial sequence
  SiRNA target sequence
acccgggacctgttgatattt

SEQ ID NO: 1120 - DNA, 21 bp, Artificial sequence
  SiRNA target sequence
cccgggacctgttgatatttc

SEQ ID NO: 1121 - DNA, 21 bp, Artificial sequence
  SiRNA target sequence
ccgggacctgttgatatttct

SEQ ID NO: 1122 - DNA, 21 bp, Artificial sequence
  SiRNA target sequence
cgggacctgttgatatttctt

SEQ ID NO: 1123 - DNA, 21 bp, Artificial sequence
  SiRNA target sequence
gggacctgttgatatttctta

SEQ ID NO: 1124 - DNA, 21 bp, Artificial sequence
  SiRNA target sequence
ggacctgttgatatttcttat

SEQ ID NO: 1125 - DNA, 21 bp, Artificial sequence
  SiRNA target sequence
gacctgttgatatttcttata

SEQ ID NO: 1126 - DNA, 21 bp, Artificial sequence
  SiRNA target sequence
acctgttgatatttcttataa

SEQ ID NO: 1127 - DNA, 21 bp, Artificial sequence
  SiRNA target sequence
cctgttgatatttcttataaa

SEQ ID NO: 1128 - DNA, 21 bp, Artificial sequence
  SiRNA target sequence
ctgttgatatttcttataaag

SEQ ID NO: 1129 - DNA, 21 bp, Artificial sequence
  SiRNA target sequence
tgttgatatttcttataaaga

SEQ ID NO: 1130 - DNA, 21 bp, Artificial sequence
  SiRNA target sequence
gttgatatttcttataaagaa

SEQ ID NO: 1131 - DNA, 21 bp, Artificial sequence
  SiRNA target sequence
ttgatatttcttataaagaat

SEQ ID NO: 1132 - DNA, 21 bp, Artificial sequence
  SiRNA target sequence
tgatatttcttataaagaatc

SEQ ID NO: 1133 - DNA, 21 bp, Artificial sequence
  SiRNA target sequence
gatatttcttataaagaatct

SEQ ID NO: 1134 - DNA, 21 bp, Artificial sequence
  SiRNA target sequence
atatttcttataaagaatctt

SEQ ID NO: 1135 - DNA, 21 bp, Artificial sequence
  SiRNA target sequence
tatttcttataaagaatcttg

SEQ ID NO: 1136 - DNA, 21 bp, Artificial sequence
  SiRNA target sequence
atttcttataaagaatcttgc

SEQ ID NO: 1137 - DNA, 21 bp, Artificial sequence
  SiRNA target sequence
tttcttataaagaatcttgca

SEQ ID NO: 1138 - DNA, 21 bp, Artificial sequence
  SiRNA target sequence
ttcttataaagaatcttgcag

SEQ ID NO: 1139 - DNA, 21 bp, Artificial sequence
  SiRNA target sequence
tcttataaagaatcttgcaga

SEQ ID NO: 1140 - DNA, 21 bp, Artificial sequence
  SiRNA target sequence
cttataaagaatcttgcagac

SEQ ID NO: 1141 - DNA, 21 bp, Artificial sequence
  SiRNA target sequence
ttataaagaatcttgcagaca

SEQ ID NO: 1142 - DNA, 21 bp, Artificial sequence
  SiRNA target sequence
tataaagaatcttgcagacag

SEQ ID NO: 1143 - DNA, 21 bp, Artificial sequence
  SiRNA target sequence
ataaagaatcttgcagacaga

SEQ ID NO: 1144 - DNA, 21 bp, Artificial sequence
  SiRNA target sequence
taaagaatcttgcagacagaa

SEQ ID NO: 1145 - DNA, 21 bp, Artificial sequence
  SiRNA target sequence
aaagaatcttgcagacagaag

SEQ ID NO: 1146 - DNA, 21 bp, Artificial sequence
  SiRNA target sequence
aagaatcttgcagacagaaga

SEQ ID NO: 1147 - DNA, 21 bp, Artificial sequence
  SiRNA target sequence
agaatcttgcagacagaagag

SEQ ID NO: 1148 - DNA, 21 bp, Artificial sequence
  SiRNA target sequence
gaatcttgcagacagaagaga

SEQ ID NO: 1149 - DNA, 21 bp, Artificial sequence
  SiRNA target sequence
aatcttgcagacagaagagaa

SEQ ID NO: 1150 - DNA, 21 bp, Artificial sequence
  SiRNA target sequence
atcttgcagacagaagagaat

SEQ ID NO: 1151 - DNA, 21 bp, Artificial sequence
  SiRNA target sequence
tcttgcagacagaagagaatg

SEQ ID NO: 1152 - DNA, 21 bp, Artificial sequence
  SiRNA target sequence
cttgcagacagaagagaatga

SEQ ID NO: 1153 - DNA, 21 bp, Artificial sequence
  SiRNA target sequence
ttgcagacagaagagaatgaa

SEQ ID NO: 1154 - DNA, 21 bp, Artificial sequence
  SiRNA target sequence
tgcagacagaagagaatgaag

SEQ ID NO: 1155 - DNA, 21 bp, Artificial sequence
  SiRNA target sequence
gcagacagaagagaatgaaga

SEQ ID NO: 1156 - DNA, 21 bp, Artificial sequence
  SiRNA target sequence
cagacagaagagaatgaagaa

SEQ ID NO: 1157 - DNA, 21 bp, Artificial sequence
  SiRNA target sequence
agacagaagagaatgaagaaa

SEQ ID NO: 1158 - DNA, 21 bp, Artificial sequence
  SiRNA target sequence
gacagaagagaatgaagaaat

SEQ ID NO: 1159 - DNA, 21 bp, Artificial sequence
  SiRNA target sequence
acagaagagaatgaagaaatg

SEQ ID NO: 1160 - DNA, 21 bp, Artificial sequence
  SiRNA target sequence
cagaagagaatgaagaaatgc

SEQ ID NO: 1161 - DNA, 21 bp, Artificial sequence
  SiRNA target sequence
agaagagaatgaagaaatgcg

SEQ ID NO: 1162 - DNA, 21 bp, Artificial sequence
  SiRNA target sequence
gaagagaatgaagaaatgcgt

SEQ ID NO: 1163 - DNA, 21 bp, Artificial sequence
  SiRNA target sequence
aagagaatgaagaaatgcgtt

SEQ ID NO: 1164 - DNA, 21 bp, Artificial sequence
  SiRNA target sequence
agagaatgaagaaatgcgttt

SEQ ID NO: 1165 - DNA, 21 bp, Artificial sequence
  SiRNA target sequence
gagaatgaagaaatgcgtttc

SEQ ID NO: 1166 - DNA, 21 bp, Artificial sequence
  SiRNA target sequence
agaatgaagaaatgcgtttct

SEQ ID NO: 1167 - DNA, 21 bp, Artificial sequence
  SiRNA target sequence
gaatgaagaaatgcgtttcta

SEQ ID NO: 1168 - DNA, 21 bp, Artificial sequence
  SiRNA target sequence
aatgaagaaatgcgtttctaa

SEQ ID NO: 1169 - DNA, 21 bp, Artificial sequence
  SiRNA target sequence
atgaagaaatgcgtttctaag

SEQ ID NO: 1170 - DNA, 21 bp, Artificial sequence
  SiRNA target sequence
tgaagaaatgcgtttctaaga

SEQ ID NO: 1171 - DNA, 21 bp, Artificial sequence
  SiRNA target sequence
gaagaaatgcgtttctaagac

SEQ ID NO: 1172 - DNA, 21 bp, Artificial sequence
  SiRNA target sequence
aagaaatgcgtttctaagact

SEQ ID NO: 1173 - DNA, 21 bp, Artificial sequence
  SiRNA target sequence
agaaatgcgtttctaagactt

SEQ ID NO: 1174 - DNA, 21 bp, Artificial sequence
  SiRNA target sequence
gaaatgcgtttctaagactta

SEQ ID NO: 1175 - DNA, 21 bp, Artificial sequence
  SiRNA target sequence
aaatgcgtttctaagacttat

SEQ ID NO: 1176 - DNA, 21 bp, Artificial sequence
  SiRNA target sequence
aatgcgtttctaagacttatg

SEQ ID NO: 1177 - DNA, 21 bp, Artificial sequence
  SiRNA target sequence
atgcgtttctaagacttatga

SEQ ID NO: 1178 - DNA, 21 bp, Artificial sequence
  SiRNA target sequence
tgcgtttctaagacttatgag

SEQ ID NO: 1179 - DNA, 21 bp, Artificial sequence
  SiRNA target sequence
gcgtttctaagacttatgagg

SEQ ID NO: 1180 - DNA, 21 bp, Artificial sequence
  SiRNA target sequence
cgtttctaagacttatgagga

SEQ ID NO: 1181 - DNA, 21 bp, Artificial sequence
  SiRNA target sequence
gtttctaagacttatgaggaa

SEQ ID NO: 1182 - DNA, 21 bp, Artificial sequence
  SiRNA target sequence
tttctaagacttatgaggaaa

SEQ ID NO: 1183 - DNA, 21 bp, Artificial sequence
  SiRNA target sequence
ttctaagacttatgaggaaat

SEQ ID NO: 1184 - DNA, 21 bp, Artificial sequence
  SiRNA target sequence
tctaagacttatgaggaaatc

SEQ ID NO: 1185 - DNA, 21 bp, Artificial sequence
  SiRNA target sequence
ctaagacttatgaggaaatca

SEQ ID NO: 1186 - DNA, 21 bp, Artificial sequence
  SiRNA target sequence
taagacttatgaggaaatcaa

SEQ ID NO: 1187 - DNA, 21 bp, Artificial sequence
  SiRNA target sequence
aagacttatgaggaaatcaaa

SEQ ID NO: 1188 - DNA, 21 bp, Artificial sequence
  SiRNA target sequence
agacttatgaggaaatcaaaa

SEQ ID NO: 1189 - DNA, 21 bp, Artificial sequence
  SiRNA target sequence
gacttatgaggaaatcaaaat

SEQ ID NO: 1190 - DNA, 21 bp, Artificial sequence
  SiRNA target sequence
acttatgaggaaatcaaaatg

SEQ ID NO: 1191 - DNA, 21 bp, Artificial sequence
  SiRNA target sequence
cttatgaggaaatcaaaatgc

SEQ ID NO: 1192 - DNA, 21 bp, Artificial sequence
  SiRNA target sequence
ttatgaggaaatcaaaatgca

SEQ ID NO: 1193 - DNA, 21 bp, Artificial sequence
  SiRNA target sequence
tatgaggaaatcaaaatgcaa

SEQ ID NO: 1194 - DNA, 21 bp, Artificial sequence
  SiRNA target sequence
atgaggaaatcaaaatgcaac

SEQ ID NO: 1195 - DNA, 21 bp, Artificial sequence
  SiRNA target sequence
tgaggaaatcaaaatgcaaca

SEQ ID NO: 1196 - DNA, 21 bp, Artificial sequence
  SiRNA target sequence
gaggaaatcaaaatgcaacag

SEQ ID NO: 1197 - DNA, 21 bp, Artificial sequence
  SiRNA target sequence
aggaaatcaaaatgcaacagc

SEQ ID NO: 1198 - DNA, 21 bp, Artificial sequence
  SiRNA target sequence
ggaaatcaaaatgcaacagca

SEQ ID NO: 1199 - DNA, 21 bp, Artificial sequence
  SiRNA target sequence
gaaatcaaaatgcaacagcat

SEQ ID NO: 1200 - DNA, 21 bp, Artificial sequence
  SiRNA target sequence
aaatcaaaatgcaacagcata

SEQ ID NO: 1201 - DNA, 21 bp, Artificial sequence
  SiRNA target sequence
aatcaaaatgcaacagcatat

SEQ ID NO: 1202 - DNA, 21 bp, Artificial sequence
  SiRNA target sequence
atcaaaatgcaacagcatatt

SEQ ID NO: 1203 - DNA, 21 bp, Artificial sequence
  SiRNA target sequence
tcaaaatgcaacagcatattg

SEQ ID NO: 1204 - DNA, 21 bp, Artificial sequence
  SiRNA target sequence
caaaatgcaacagcatattga

SEQ ID NO: 1205 - DNA, 21 bp, Artificial sequence
  SiRNA target sequence
aaaatgcaacagcatattgat

SEQ ID NO: 1206 - DNA, 21 bp, Artificial sequence
  SiRNA target sequence
aaatgcaacagcatattgata

SEQ ID NO: 1207 - DNA, 21 bp, Artificial sequence
  SiRNA target sequence
aatgcaacagcatattgatag

SEQ ID NO: 1208 - DNA, 21 bp, Artificial sequence
  SiRNA target sequence
atgcaacagcatattgataga

SEQ ID NO: 1209 - DNA, 21 bp, Artificial sequence
  SiRNA target sequence
tgcaacagcatattgatagaa

SEQ ID NO: 1210 - DNA, 21 bp, Artificial sequence
  SiRNA target sequence
gcaacagcatattgatagaat

SEQ ID NO: 1211 - DNA, 21 bp, Artificial sequence
  SiRNA target sequence
caacagcatattgatagaatc

SEQ ID NO: 1212 - DNA, 21 bp, Artificial sequence
  SiRNA target sequence
aacagcatattgatagaatca

SEQ ID NO: 1213 - DNA, 21 bp, Artificial sequence
  SiRNA target sequence
acagcatattgatagaatcaa

SEQ ID NO: 1214 - DNA, 21 bp, Artificial sequence
  SiRNA target sequence
cagcatattgatagaatcaat

SEQ ID NO: 1215 - DNA, 21 bp, Artificial sequence
  SiRNA target sequence
agcatattgatagaatcaata

SEQ ID NO: 1216 - DNA, 21 bp, Artificial sequence
  SiRNA target sequence
gcatattgatagaatcaataa

SEQ ID NO: 1217 - DNA, 21 bp, Artificial sequence
  SiRNA target sequence
catattgatagaatcaataat

SEQ ID NO: 1218 - DNA, 21 bp, Artificial sequence
  SiRNA target sequence
atattgatagaatcaataatg

SEQ ID NO: 1219 - DNA, 21 bp, Artificial sequence
  SiRNA target sequence
tattgatagaatcaataatga

SEQ ID NO: 1220 - DNA, 21 bp, Artificial sequence
  SiRNA target sequence
attgatagaatcaataatgaa

SEQ ID NO: 1221 - DNA, 21 bp, Artificial sequence
  SiRNA target sequence
ttgatagaatcaataatgaag

SEQ ID NO: 1222 - DNA, 21 bp, Artificial sequence
  SiRNA target sequence
tgatagaatcaataatgaaga

SEQ ID NO: 1223 - DNA, 21 bp, Artificial sequence
  SiRNA target sequence
gatagaatcaataatgaagag

SEQ ID NO: 1224 - DNA, 21 bp, Artificial sequence
  SiRNA target sequence
atagaatcaataatgaagaga

SEQ ID NO: 1225 - DNA, 21 bp, Artificial sequence
  SiRNA target sequence
tagaatcaataatgaagagaa

SEQ ID NO: 1226 - DNA, 21 bp, Artificial sequence
  SiRNA target sequence
agaatcaataatgaagagaaa

SEQ ID NO: 1227 - DNA, 21 bp, Artificial sequence
  SiRNA target sequence
gaatcaataatgaagagaaac

SEQ ID NO: 1228 - DNA, 21 bp, Artificial sequence
  SiRNA target sequence
aatcaataatgaagagaaacg

SEQ ID NO: 1229 - DNA, 21 bp, Artificial sequence
  SiRNA target sequence
atcaataatgaagagaaacgt

SEQ ID NO: 1230 - DNA, 21 bp, Artificial sequence
  SiRNA target sequence
tcaataatgaagagaaacgtg

SEQ ID NO: 1231 - DNA, 21 bp, Artificial sequence
  SiRNA target sequence
caataatgaagagaaacgtgc

SEQ ID NO: 1232 - DNA, 21 bp, Artificial sequence
  SiRNA target sequence
aataatgaagagaaacgtgct

SEQ ID NO: 1233 - DNA, 21 bp, Artificial sequence
  SiRNA target sequence
ataatgaagagaaacgtgctc

SEQ ID NO: 1234 - DNA, 21 bp, Artificial sequence
  SiRNA target sequence
taatgaagagaaacgtgctca

SEQ ID NO: 1235 - DNA, 21 bp, Artificial sequence
  SiRNA target sequence
aatgaagagaaacgtgctcat

SEQ ID NO: 1236 - DNA, 21 bp, Artificial sequence
  SiRNA target sequence
atgaagagaaacgtgctcata

SEQ ID NO: 1237 - DNA, 21 bp, Artificial sequence
  SiRNA target sequence
tgaagagaaacgtgctcatat

SEQ ID NO: 1238 - DNA, 21 bp, Artificial sequence
  SiRNA target sequence
gaagagaaacgtgctcatatg

SEQ ID NO: 1239 - DNA, 21 bp, Artificial sequence
  SiRNA target sequence
aagagaaacgtgctcatatga

SEQ ID NO: 1240 - DNA, 21 bp, Artificial sequence
  SiRNA target sequence
agagaaacgtgctcatatgac

SEQ ID NO: 1241 - DNA, 21 bp, Artificial sequence
  SiRNA target sequence
gagaaacgtgctcatatgacg

SEQ ID NO: 1242 - DNA, 21 bp, Artificial sequence
  SiRNA target sequence
agaaacgtgctcatatgacga

SEQ ID NO: 1243 - DNA, 21 bp, Artificial sequence
  SiRNA target sequence
gaaacgtgctcatatgacgaa

SEQ ID NO: 1244 - DNA, 21 bp, Artificial sequence
  SiRNA target sequence
aaacgtgctcatatgacgaaa

SEQ ID NO: 1245 - DNA, 21 bp, Artificial sequence
  SiRNA target sequence
aacgtgctcatatgacgaaac

SEQ ID NO: 1246 - DNA, 21 bp, Artificial sequence
  SiRNA target sequence
acgtgctcatatgacgaaacc

SEQ ID NO: 1247 - DNA, 21 bp, Artificial sequence
  SiRNA target sequence
cgtgctcatatgacgaaaccc

SEQ ID NO: 1248 - DNA, 21 bp, Artificial sequence
  SiRNA target sequence
gtgctcatatgacgaaacccc

SEQ ID NO: 1249 - DNA, 21 bp, Artificial sequence
  SiRNA target sequence
tgctcatatgacgaaaccccg

SEQ ID NO: 1250 - DNA, 21 bp, Artificial sequence
  SiRNA target sequence
gctcatatgacgaaaccccgt

SEQ ID NO: 1251 - DNA, 21 bp, Artificial sequence
  SiRNA target sequence
ctcatatgacgaaaccccgta

SEQ ID NO: 1252 - DNA, 21 bp, Artificial sequence
  SiRNA target sequence
tcatatgacgaaaccccgtaa

SEQ ID NO: 1253 - DNA, 21 bp, Artificial sequence
  SiRNA target sequence
catatgacgaaaccccgtaag

SEQ ID NO: 1254 - DNA, 21 bp, Artificial sequence
  SiRNA target sequence
atatgacgaaaccccgtaagt

SEQ ID NO: 1255 - DNA, 21 bp, Artificial sequence
  SiRNA target sequence
tatgacgaaaccccgtaagtt

SEQ ID NO: 1256 - DNA, 21 bp, Artificial sequence
  SiRNA target sequence
atgacgaaaccccgtaagtta

SEQ ID NO: 1257 - DNA, 21 bp, Artificial sequence
  SiRNA target sequence
tgacgaaaccccgtaagttaa

SEQ ID NO: 1258 - DNA, 21 bp, Artificial sequence
  SiRNA target sequence
gacgaaaccccgtaagttaaa

SEQ ID NO: 1259 - DNA, 21 bp, Artificial sequence
  SiRNA target sequence
acgaaaccccgtaagttaaag

SEQ ID NO: 1260 - DNA, 21 bp, Artificial sequence
  SiRNA target sequence
cgaaaccccgtaagttaaagg

SEQ ID NO: 1261 - DNA, 21 bp, Artificial sequence
  SiRNA target sequence
gaaaccccgtaagttaaagga

SEQ ID NO: 1262 - DNA, 21 bp, Artificial sequence
  SiRNA target sequence
aaaccccgtaagttaaaggat

SEQ ID NO: 1263 - DNA, 21 bp, Artificial sequence
  SiRNA target sequence
aaccccgtaagttaaaggatt

SEQ ID NO: 1264 - DNA, 21 bp, Artificial sequence
  SiRNA target sequence
accccgtaagttaaaggattt

SEQ ID NO: 1265 - DNA, 21 bp, Artificial sequence
  SiRNA target sequence
ccccgtaagttaaaggatttg

SEQ ID NO: 1266 - DNA, 21 bp, Artificial sequence
  SiRNA target sequence
cccgtaagttaaaggatttga

SEQ ID NO: 1267 - DNA, 21 bp, Artificial sequence
  SiRNA target sequence
ccgtaagttaaaggatttgat

SEQ ID NO: 1268 - DNA, 21 bp, Artificial sequence
  SiRNA target sequence
cgtaagttaaaggatttgatt

SEQ ID NO: 1269 - DNA, 21 bp, Artificial sequence
  SiRNA target sequence
gtaagttaaaggatttgattg

SEQ ID NO: 1270 - DNA, 21 bp, Artificial sequence
  SiRNA target sequence
taagttaaaggatttgattga

SEQ ID NO: 1271 - DNA, 21 bp, Artificial sequence
  SiRNA target sequence
aagttaaaggatttgattgaa

SEQ ID NO: 1272 - DNA, 21 bp, Artificial sequence
  SiRNA target sequence
agttaaaggatttgattgaag

SEQ ID NO: 1273 - DNA, 21 bp, Artificial sequence
  SiRNA target sequence
gttaaaggatttgattgaagt

SEQ ID NO: 1274 - DNA, 21 bp, Artificial sequence
  SiRNA target sequence
ttaaaggatttgattgaagtt

SEQ ID NO: 1275 - DNA, 21 bp, Artificial sequence
  SiRNA target sequence
taaaggatttgattgaagttg

SEQ ID NO: 1276 - DNA, 21 bp, Artificial sequence
  SiRNA target sequence
aaaggatttgattgaagttga

SEQ ID NO: 1277 - DNA, 21 bp, Artificial sequence
  SiRNA target sequence
aaggatttgattgaagttgaa

SEQ ID NO: 1278 - DNA, 21 bp, Artificial sequence
  SiRNA target sequence
aggatttgattgaagttgaaa

SEQ ID NO: 1279 - DNA, 21 bp, Artificial sequence
  SiRNA target sequence
ggatttgattgaagttgaaat

SEQ ID NO: 1280 - DNA, 21 bp, Artificial sequence
  SiRNA target sequence
gatttgattgaagttgaaatg

SEQ ID NO: 1281 - DNA, 21 bp, Artificial sequence
  SiRNA target sequence
atttgattgaagttgaaatgc

SEQ ID NO: 1282 - DNA, 21 bp, Artificial sequence
  SiRNA target sequence
tttgattgaagttgaaatgca

SEQ ID NO: 1283 - DNA, 21 bp, Artificial sequence
  SiRNA target sequence
ttgattgaagttgaaatgcaa

SEQ ID NO: 1284 - DNA, 21 bp, Artificial sequence
  SiRNA target sequence
tgattgaagttgaaatgcaag

SEQ ID NO: 1285 - DNA, 21 bp, Artificial sequence
  SiRNA target sequence
gattgaagttgaaatgcaagg

SEQ ID NO: 1286 - DNA, 21 bp, Artificial sequence
  SiRNA target sequence
attgaagttgaaatgcaagga

SEQ ID NO: 1287 - DNA, 21 bp, Artificial sequence
  SiRNA target sequence
ttgaagttgaaatgcaaggaa

SEQ ID NO: 1288 - DNA, 21 bp, Artificial sequence
  SiRNA target sequence
tgaagttgaaatgcaaggaat

SEQ ID NO: 1289 - DNA, 21 bp, Artificial sequence
  SiRNA target sequence
gaagttgaaatgcaaggaatg

SEQ ID NO: 1290 - DNA, 21 bp, Artificial sequence
  SiRNA target sequence
aagttgaaatgcaaggaatgt

SEQ ID NO: 1291 - DNA, 21 bp, Artificial sequence
  SiRNA target sequence
agttgaaatgcaaggaatgtt

SEQ ID NO: 1292 - DNA, 21 bp, Artificial sequence
  SiRNA target sequence
gttgaaatgcaaggaatgttt

SEQ ID NO: 1293 - DNA, 21 bp, Artificial sequence
  SiRNA target sequence
ttgaaatgcaaggaatgttta

SEQ ID NO: 1294 - DNA, 21 bp, Artificial sequence
  SiRNA target sequence
tgaaatgcaaggaatgtttaa

SEQ ID NO: 1295 - DNA, 21 bp, Artificial sequence
  SiRNA target sequence
gaaatgcaaggaatgtttaat

SEQ ID NO: 1296 - DNA, 21 bp, Artificial sequence
  SiRNA target sequence
aaatgcaaggaatgtttaatt

SEQ ID NO: 1297 - DNA, 21 bp, Artificial sequence
  SiRNA target sequence
aatgcaaggaatgtttaattg

SEQ ID NO: 1298 - DNA, 21 bp, Artificial sequence
  SiRNA target sequence
atgcaaggaatgtttaattgg

SEQ ID NO: 1299 - DNA, 21 bp, Artificial sequence
  SiRNA target sequence
tgcaaggaatgtttaattgga

SEQ ID NO: 1300 - DNA, 21 bp, Artificial sequence
  SiRNA target sequence
gcaaggaatgtttaattggac

SEQ ID NO: 1301 - DNA, 21 bp, Artificial sequence
  SiRNA target sequence
caaggaatgtttaattggact

SEQ ID NO: 1302 - DNA, 21 bp, Artificial sequence
  SiRNA target sequence
aaggaatgtttaattggactg

SEQ ID NO: 1303 - DNA, 21 bp, Artificial sequence
  SiRNA target sequence
aggaatgtttaattggactga

SEQ ID NO: 1304 - DNA, 21 bp, Artificial sequence
  SiRNA target sequence
ggaatgtttaattggactgaa

SEQ ID NO: 1305 - DNA, 21 bp, Artificial sequence
  SiRNA target sequence
gaatgtttaattggactgaag

SEQ ID NO: 1306 - DNA, 21 bp, Artificial sequence
  SiRNA target sequence
aatgtttaattggactgaaga

SEQ ID NO: 1307 - DNA, 21 bp, Artificial sequence
  SiRNA target sequence
atgtttaattggactgaagaa

SEQ ID NO: 1308 - DNA, 21 bp, Artificial sequence
  SiRNA target sequence
tgtttaattggactgaagaaa

SEQ ID NO: 1309 - DNA, 21 bp, Artificial sequence
  SiRNA target sequence
gtttaattggactgaagaaag

SEQ ID NO: 1310 - DNA, 21 bp, Artificial sequence
  SiRNA target sequence
tttaattggactgaagaaagg

SEQ ID NO: 1311 - DNA, 21 bp, Artificial sequence
  SiRNA target sequence
ttaattggactgaagaaaggg

SEQ ID NO: 1312 - DNA, 21 bp, Artificial sequence
  SiRNA target sequence
taattggactgaagaaaggga

SEQ ID NO: 1313 - DNA, 21 bp, Artificial sequence
  SiRNA target sequence
aattggactgaagaaagggaa

SEQ ID NO: 1314 - DNA, 21 bp, Artificial sequence
  SiRNA target sequence
attggactgaagaaagggaaa

SEQ ID NO: 1315 - DNA, 21 bp, Artificial sequence
  SiRNA target sequence
ttggactgaagaaagggaaat

SEQ ID NO: 1316 - DNA, 21 bp, Artificial sequence
  SiRNA target sequence
tggactgaagaaagggaaatc

SEQ ID NO: 1317 - DNA, 21 bp, Artificial sequence
  SiRNA target sequence
ggactgaagaaagggaaatct

SEQ ID NO: 1318 - DNA, 21 bp, Artificial sequence
  SiRNA target sequence
gactgaagaaagggaaatctt

SEQ ID NO: 1319 - DNA, 21 bp, Artificial sequence
  SiRNA target sequence
actgaagaaagggaaatcttg

SEQ ID NO: 1320 - DNA, 21 bp, Artificial sequence
  SiRNA target sequence
ctgaagaaagggaaatcttga

SEQ ID NO: 1321 - DNA, 21 bp, Artificial sequence
  SiRNA target sequence
tgaagaaagggaaatcttgaa

SEQ ID NO: 1322 - DNA, 21 bp, Artificial sequence
  SiRNA target sequence
gaagaaagggaaatcttgaag

SEQ ID NO: 1323 - DNA, 21 bp, Artificial sequence
  SiRNA target sequence
aagaaagggaaatcttgaaga

SEQ ID NO: 1324 - DNA, 21 bp, Artificial sequence
  SiRNA target sequence
agaaagggaaatcttgaagag

SEQ ID NO: 1325 - DNA, 21 bp, Artificial sequence
  SiRNA target sequence
gaaagggaaatcttgaagagt

SEQ ID NO: 1326 - DNA, 21 bp, Artificial sequence
  SiRNA target sequence
aaagggaaatcttgaagagta

SEQ ID NO: 1327 - DNA, 21 bp, Artificial sequence
  SiRNA target sequence
aagggaaatcttgaagagtac

SEQ ID NO: 1328 - DNA, 21 bp, Artificial sequence
  SiRNA target sequence
agggaaatcttgaagagtact

SEQ ID NO: 1329 - DNA, 21 bp, Artificial sequence
  SiRNA target sequence
gggaaatcttgaagagtactg

SEQ ID NO: 1330 - DNA, 21 bp, Artificial sequence
  SiRNA target sequence
ggaaatcttgaagagtactgc

SEQ ID NO: 1331 - DNA, 21 bp, Artificial sequence
  SiRNA target sequence
gaaatcttgaagagtactgca

SEQ ID NO: 1332 - DNA, 21 bp, Artificial sequence
  SiRNA target sequence
aaatcttgaagagtactgcat

SEQ ID NO: 1333 - DNA, 21 bp, Artificial sequence
  SiRNA target sequence
aatcttgaagagtactgcatt

SEQ ID NO: 1334 - DNA, 21 bp, Artificial sequence
  SiRNA target sequence
atcttgaagagtactgcattc

SEQ ID NO: 1335 - DNA, 21 bp, Artificial sequence
  SiRNA target sequence
tcttgaagagtactgcattca

SEQ ID NO: 1336 - DNA, 21 bp, Artificial sequence
  SiRNA target sequence
cttgaagagtactgcattcaa

SEQ ID NO: 1337 - DNA, 21 bp, Artificial sequence
  SiRNA target sequence
ttgaagagtactgcattcaaa

SEQ ID NO: 1338 - DNA, 21 bp, Artificial sequence
  SiRNA target sequence
tgaagagtactgcattcaaat

SEQ ID NO: 1339 - DNA, 21 bp, Artificial sequence
  SiRNA target sequence
gaagagtactgcattcaaatt

SEQ ID NO: 1340 - DNA, 21 bp, Artificial sequence
  SiRNA target sequence
aagagtactgcattcaaattc

SEQ ID NO: 1341 - DNA, 21 bp, Artificial sequence
  SiRNA target sequence
agagtactgcattcaaattca

SEQ ID NO: 1342 - DNA, 21 bp, Artificial sequence
  SiRNA target sequence
gagtactgcattcaaattcaa

SEQ ID NO: 1343 - DNA, 21 bp, Artificial sequence
  SiRNA target sequence
agtactgcattcaaattcaac

SEQ ID NO: 1344 - DNA, 21 bp, Artificial sequence
  SiRNA target sequence
gtactgcattcaaattcaacc

SEQ ID NO: 1345 - DNA, 21 bp, Artificial sequence
  SiRNA target sequence
tactgcattcaaattcaacca

SEQ ID NO: 1346 - DNA, 21 bp, Artificial sequence
  SiRNA target sequence
actgcattcaaattcaaccat

SEQ ID NO: 1347 - DNA, 21 bp, Artificial sequence
  SiRNA target sequence
ctgcattcaaattcaaccatt

SEQ ID NO: 1348 - DNA, 21 bp, Artificial sequence
  SiRNA target sequence
tgcattcaaattcaaccattc

SEQ ID NO: 1349 - DNA, 21 bp, Artificial sequence
  SiRNA target sequence
gcattcaaattcaaccattcg

SEQ ID NO: 1350 - DNA, 21 bp, Artificial sequence
  SiRNA target sequence
cattcaaattcaaccattcga

SEQ ID NO: 1351 - DNA, 21 bp, Artificial sequence
  SiRNA target sequence
attcaaattcaaccattcgat

SEQ ID NO: 1352 - DNA, 21 bp, Artificial sequence
  SiRNA target sequence
ttcaaattcaaccattcgatg

SEQ ID NO: 1353 - DNA, 21 bp, Artificial sequence
  SiRNA target sequence
tcaaattcaaccattcgatgg

SEQ ID NO: 1354 - DNA, 21 bp, Artificial sequence
  SiRNA target sequence
caaattcaaccattcgatgga

SEQ ID NO: 1355 - DNA, 21 bp, Artificial sequence
  SiRNA target sequence
aaattcaaccattcgatggac

SEQ ID NO: 1356 - DNA, 21 bp, Artificial sequence
  SiRNA target sequence
aattcaaccattcgatggacc

SEQ ID NO: 1357 - DNA, 21 bp, Artificial sequence
  SiRNA target sequence
attcaaccattcgatggaccg

SEQ ID NO: 1358 - DNA, 21 bp, Artificial sequence
  SiRNA target sequence
ttcaaccattcgatggaccga

SEQ ID NO: 1359 - DNA, 21 bp, Artificial sequence
  SiRNA target sequence
tcaaccattcgatggaccgag

SEQ ID NO: 1360 - DNA, 21 bp, Artificial sequence
  SiRNA target sequence
caaccattcgatggaccgagc

SEQ ID NO: 1361 - DNA, 21 bp, Artificial sequence
  SiRNA target sequence
aaccattcgatggaccgagcg

SEQ ID NO: 1362 - DNA, 21 bp, Artificial sequence
  SiRNA target sequence
accattcgatggaccgagcga

SEQ ID NO: 1363 - DNA, 21 bp, Artificial sequence
  SiRNA target sequence
ccattcgatggaccgagcgaa

SEQ ID NO: 1364 - DNA, 21 bp, Artificial sequence
  SiRNA target sequence
cattcgatggaccgagcgaat

SEQ ID NO: 1365 - DNA, 21 bp, Artificial sequence
  SiRNA target sequence
attcgatggaccgagcgaatc

SEQ ID NO: 1366 - DNA, 21 bp, Artificial sequence
  SiRNA target sequence
ttcgatggaccgagcgaatca

SEQ ID NO: 1367 - DNA, 21 bp, Artificial sequence
  SiRNA target sequence
tcgatggaccgagcgaatcat

SEQ ID NO: 1368 - DNA, 21 bp, Artificial sequence
  SiRNA target sequence
cgatggaccgagcgaatcata

SEQ ID NO: 1369 - DNA, 21 bp, Artificial sequence
  SiRNA target sequence
gatggaccgagcgaatcatat

SEQ ID NO: 1370 - DNA, 21 bp, Artificial sequence
  SiRNA target sequence
atggaccgagcgaatcatatt

SEQ ID NO: 1371 - DNA, 21 bp, Artificial sequence
  SiRNA target sequence
tggaccgagcgaatcatatta

SEQ ID NO: 1372 - DNA, 21 bp, Artificial sequence
  SiRNA target sequence
ggaccgagcgaatcatattat

SEQ ID NO: 1373 - DNA, 21 bp, Artificial sequence
  SiRNA target sequence
gaccgagcgaatcatattatg

SEQ ID NO: 1374 - DNA, 21 bp, Artificial sequence
  SiRNA target sequence
accgagcgaatcatattatgg

SEQ ID NO: 1375 - DNA, 21 bp, Artificial sequence
  SiRNA target sequence
ccgagcgaatcatattatgga

SEQ ID NO: 1376 - DNA, 21 bp, Artificial sequence
  SiRNA target sequence
cgagcgaatcatattatggat

SEQ ID NO: 1377 - DNA, 21 bp, Artificial sequence
  SiRNA target sequence
gagcgaatcatattatggata

SEQ ID NO: 1378 - DNA, 21 bp, Artificial sequence
  SiRNA target sequence
agcgaatcatattatggataa

SEQ ID NO: 1379 - DNA, 21 bp, Artificial sequence
  SiRNA target sequence
gcgaatcatattatggataat

SEQ ID NO: 1380 - DNA, 21 bp, Artificial sequence
  SiRNA target sequence
cgaatcatattatggataatc

SEQ ID NO: 1381 - DNA, 21 bp, Artificial sequence
  SiRNA target sequence
gaatcatattatggataatct

SEQ ID NO: 1382 - DNA, 21 bp, Artificial sequence
  SiRNA target sequence
aatcatattatggataatctg

SEQ ID NO: 1383 - DNA, 21 bp, Artificial sequence
  SiRNA target sequence
atcatattatggataatctga

SEQ ID NO: 1384 - DNA, 21 bp, Artificial sequence
  SiRNA target sequence
tcatattatggataatctgat

SEQ ID NO: 1385 - DNA, 21 bp, Artificial sequence
  SiRNA target sequence
catattatggataatctgatc

SEQ ID NO: 1386 - DNA, 21 bp, Artificial sequence
  SiRNA target sequence
atattatggataatctgatcc

SEQ ID NO: 1387 - DNA, 21 bp, Artificial sequence
  SiRNA target sequence
tattatggataatctgatccc

SEQ ID NO: 1388 - DNA, 21 bp, Artificial sequence
  SiRNA target sequence
attatggataatctgatccca

SEQ ID NO: 1389 - DNA, 21 bp, Artificial sequence
  SiRNA target sequence
ttatggataatctgatcccac

SEQ ID NO: 1390 - DNA, 21 bp, Artificial sequence
  SiRNA target sequence
tatggataatctgatcccaca

SEQ ID NO: 1391 - DNA, 21 bp, Artificial sequence
  SiRNA target sequence
atggataatctgatcccacaa

SEQ ID NO: 1392 - DNA, 21 bp, Artificial sequence
  SiRNA target sequence
tggataatctgatcccacaac

SEQ ID NO: 1393 - DNA, 21 bp, Artificial sequence
  SiRNA target sequence
ggataatctgatcccacaact

SEQ ID NO: 1394 - DNA, 21 bp, Artificial sequence
  SiRNA target sequence
gataatctgatcccacaactt

SEQ ID NO: 1395 - DNA, 21 bp, Artificial sequence
  SiRNA target sequence
ataatctgatcccacaacttg

SEQ ID NO: 1396 - DNA, 21 bp, Artificial sequence
  SiRNA target sequence
taatctgatcccacaacttga

SEQ ID NO: 1397 - DNA, 21 bp, Artificial sequence
  SiRNA target sequence
aatctgatcccacaacttgag

SEQ ID NO: 1398 - DNA, 21 bp, Artificial sequence
  SiRNA target sequence
atctgatcccacaacttgagg

SEQ ID NO: 1399 - DNA, 21 bp, Artificial sequence
  SiRNA target sequence
tctgatcccacaacttgagga

SEQ ID NO: 1400 - DNA, 21 bp, Artificial sequence
  SiRNA target sequence
ctgatcccacaacttgaggat

SEQ ID NO: 1401 - DNA, 21 bp, Artificial sequence
  SiRNA target sequence
tgatcccacaacttgaggata

SEQ ID NO: 1402 - DNA, 21 bp, Artificial sequence
  SiRNA target sequence
gatcccacaacttgaggatac

SEQ ID NO: 1403 - DNA, 21 bp, Artificial sequence
  SiRNA target sequence
atcccacaacttgaggatact

SEQ ID NO: 1404 - DNA, 21 bp, Artificial sequence
  SiRNA target sequence
tcccacaacttgaggatactt

SEQ ID NO: 1405 - DNA, 21 bp, Artificial sequence
  SiRNA target sequence
cccacaacttgaggatacttt

SEQ ID NO: 1406 - DNA, 21 bp, Artificial sequence
  SiRNA target sequence
ccacaacttgaggatactttg

SEQ ID NO: 1407 - DNA, 21 bp, Artificial sequence
  SiRNA target sequence
cacaacttgaggatactttgt

SEQ ID NO: 1408 - DNA, 21 bp, Artificial sequence
  SiRNA target sequence
acaacttgaggatactttgtc

SEQ ID NO: 1409 - DNA, 21 bp, Artificial sequence
  SiRNA target sequence
caacttgaggatactttgtct

SEQ ID NO: 1410 - DNA, 21 bp, Artificial sequence
  SiRNA target sequence
aacttgaggatactttgtctg

SEQ ID NO: 1411 - DNA, 21 bp, Artificial sequence
  SiRNA target sequence
acttgaggatactttgtctgg

SEQ ID NO: 1412 - DNA, 21 bp, Artificial sequence
  SiRNA target sequence
cttgaggatactttgtctggt

SEQ ID NO: 1413 - DNA, 21 bp, Artificial sequence
  SiRNA target sequence
ttgaggatactttgtctggtt

SEQ ID NO: 1414 - DNA, 21 bp, Artificial sequence
  SiRNA target sequence
tgaggatactttgtctggttt

SEQ ID NO: 1415 - DNA, 21 bp, Artificial sequence
  SiRNA target sequence
gaggatactttgtctggtttc

SEQ ID NO: 1416 - DNA, 21 bp, Artificial sequence
  SiRNA target sequence
aggatactttgtctggtttca

SEQ ID NO: 1417 - DNA, 21 bp, Artificial sequence
  SiRNA target sequence
ggatactttgtctggtttcag

SEQ ID NO: 1418 - DNA, 21 bp, Artificial sequence
  SiRNA target sequence
gatactttgtctggtttcaga

SEQ ID NO: 1419 - DNA, 21 bp, Artificial sequence
  SiRNA target sequence
atactttgtctggtttcagac

SEQ ID NO: 1420 - DNA, 21 bp, Artificial sequence
  SiRNA target sequence
tactttgtctggtttcagaca

SEQ ID NO: 1421 - DNA, 21 bp, Artificial sequence
  SiRNA target sequence
actttgtctggtttcagacaa

SEQ ID NO: 1422 - DNA, 21 bp, Artificial sequence
  SiRNA target sequence
ctttgtctggtttcagacaaa

SEQ ID NO: 1423 - DNA, 21 bp, Artificial sequence
  SiRNA target sequence
tttgtctggtttcagacaaac

SEQ ID NO: 1424 - DNA, 21 bp, Artificial sequence
  SiRNA target sequence
ttgtctggtttcagacaaacg

SEQ ID NO: 1425 - DNA, 21 bp, Artificial sequence
  SiRNA target sequence
tgtctggtttcagacaaacgt

SEQ ID NO: 1426 - DNA, 21 bp, Artificial sequence
  SiRNA target sequence
gtctggtttcagacaaacgta

SEQ ID NO: 1427 - DNA, 21 bp, Artificial sequence
  SiRNA target sequence
tctggtttcagacaaacgtat

SEQ ID NO: 1428 - DNA, 21 bp, Artificial sequence
  SiRNA target sequence
ctggtttcagacaaacgtatg

SEQ ID NO: 1429 - DNA, 21 bp, Artificial sequence
  SiRNA target sequence
tggtttcagacaaacgtatgc

SEQ ID NO: 1430 - DNA, 21 bp, Artificial sequence
  SiRNA target sequence
ggtttcagacaaacgtatgca

SEQ ID NO: 1431 - DNA, 21 bp, Artificial sequence
  SiRNA target sequence
gtttcagacaaacgtatgcaa

SEQ ID NO: 1432 - DNA, 21 bp, Artificial sequence
  SiRNA target sequence
tttcagacaaacgtatgcaaa

SEQ ID NO: 1433 - DNA, 21 bp, Artificial sequence
  SiRNA target sequence
ttcagacaaacgtatgcaaag

SEQ ID NO: 1434 - DNA, 21 bp, Artificial sequence
  SiRNA target sequence
tcagacaaacgtatgcaaagt

SEQ ID NO: 1435 - DNA, 21 bp, Artificial sequence
  SiRNA target sequence
cagacaaacgtatgcaaagtg

SEQ ID NO: 1436 - DNA, 21 bp, Artificial sequence
  SiRNA target sequence
agacaaacgtatgcaaagtgt

SEQ ID NO: 1437 - DNA, 21 bp, Artificial sequence
  SiRNA target sequence
gacaaacgtatgcaaagtgtg

SEQ ID NO: 1438 - DNA, 21 bp, Artificial sequence
  SiRNA target sequence
acaaacgtatgcaaagtgtga

SEQ ID NO: 1439 - DNA, 21 bp, Artificial sequence
  SiRNA target sequence
caaacgtatgcaaagtgtgaa

SEQ ID NO: 1440 - DNA, 21 bp, Artificial sequence
  SiRNA target sequence
aaacgtatgcaaagtgtgaag

SEQ ID NO: 1441 - DNA, 21 bp, Artificial sequence
  SiRNA target sequence
aacgtatgcaaagtgtgaagc

SEQ ID NO: 1442 - DNA, 21 bp, Artificial sequence
  SiRNA target sequence
acgtatgcaaagtgtgaagcg

SEQ ID NO: 1443 - DNA, 21 bp, Artificial sequence
  SiRNA target sequence
cgtatgcaaagtgtgaagcga

SEQ ID NO: 1444 - DNA, 21 bp, Artificial sequence
  SiRNA target sequence
gtatgcaaagtgtgaagcgaa

SEQ ID NO: 1445 - DNA, 21 bp, Artificial sequence
  SiRNA target sequence
tatgcaaagtgtgaagcgaaa

SEQ ID NO: 1446 - DNA, 21 bp, Artificial sequence
  SiRNA target sequence
atgcaaagtgtgaagcgaaat

SEQ ID NO: 1447 - DNA, 21 bp, Artificial sequence
  SiRNA target sequence
tgcaaagtgtgaagcgaaatt

SEQ ID NO: 1448 - DNA, 21 bp, Artificial sequence
  SiRNA target sequence
gcaaagtgtgaagcgaaattc

SEQ ID NO: 1449 - DNA, 21 bp, Artificial sequence
  SiRNA target sequence
caaagtgtgaagcgaaattct

SEQ ID NO: 1450 - DNA, 21 bp, Artificial sequence
  SiRNA target sequence
aaagtgtgaagcgaaattctt

SEQ ID NO: 1451 - DNA, 21 bp, Artificial sequence
  SiRNA target sequence
aagtgtgaagcgaaattcttt

SEQ ID NO: 1452 - DNA, 21 bp, Artificial sequence
  SiRNA target sequence
agtgtgaagcgaaattctttg

SEQ ID NO: 1453 - DNA, 21 bp, Artificial sequence
  SiRNA target sequence
gtgtgaagcgaaattctttgg

SEQ ID NO: 1454 - DNA, 21 bp, Artificial sequence
  SiRNA target sequence
tgtgaagcgaaattctttgga

SEQ ID NO: 1455 - DNA, 21 bp, Artificial sequence
  SiRNA target sequence
gtgaagcgaaattctttggat

SEQ ID NO: 1456 - DNA, 21 bp, Artificial sequence
  SiRNA target sequence
tgaagcgaaattctttggatc

SEQ ID NO: 1457 - DNA, 21 bp, Artificial sequence
  SiRNA target sequence
gaagcgaaattctttggatca

SEQ ID NO: 1458 - DNA, 21 bp, Artificial sequence
  SiRNA target sequence
aagcgaaattctttggatcaa

SEQ ID NO: 1459 - DNA, 21 bp, Artificial sequence
  SiRNA target sequence
agcgaaattctttggatcaat

SEQ ID NO: 1460 - DNA, 21 bp, Artificial sequence
  SiRNA target sequence
gcgaaattctttggatcaata

SEQ ID NO: 1461 - DNA, 21 bp, Artificial sequence
  SiRNA target sequence
cgaaattctttggatcaataa

SEQ ID NO: 1462 - DNA, 21 bp, Artificial sequence
  SiRNA target sequence
gaaattctttggatcaataag

SEQ ID NO: 1463 - DNA, 21 bp, Artificial sequence
  SiRNA target sequence
aaattctttggatcaataagt

SEQ ID NO: 1464 - DNA, 21 bp, Artificial sequence
  SiRNA target sequence
aattctttggatcaataagtg

SEQ ID NO: 1465 - DNA, 21 bp, Artificial sequence
  SiRNA target sequence
attctttggatcaataagtgt

SEQ ID NO: 1466 - DNA, 21 bp, Artificial sequence
  SiRNA target sequence
ttctttggatcaataagtgtt

SEQ ID NO: 1467 - DNA, 21 bp, Artificial sequence
  SiRNA target sequence
tctttggatcaataagtgtta

SEQ ID NO: 1468 - DNA, 21 bp, Artificial sequence
  SiRNA target sequence
ctttggatcaataagtgttat

SEQ ID NO: 1469 - DNA, 21 bp, Artificial sequence
  SiRNA target sequence
tttggatcaataagtgttatt

SEQ ID NO: 1470 - DNA, 21 bp, Artificial sequence
  SiRNA target sequence
ttggatcaataagtgttattg

SEQ ID NO: 1471 - DNA, 21 bp, Artificial sequence
  SiRNA target sequence
tggatcaataagtgttattga

SEQ ID NO: 1472 - DNA, 21 bp, Artificial sequence
  SiRNA target sequence
ggatcaataagtgttattgat

SEQ ID NO: 1473 - DNA, 21 bp, Artificial sequence
  SiRNA target sequence
gatcaataagtgttattgatg

SEQ ID NO: 1474 - DNA, 21 bp, Artificial sequence
  SiRNA target sequence
atcaataagtgttattgatgt

SEQ ID NO: 1475 - DNA, 21 bp, Artificial sequence
  SiRNA target sequence
tcaataagtgttattgatgtc

SEQ ID NO: 1476 - DNA, 21 bp, Artificial sequence
  SiRNA target sequence
caataagtgttattgatgtct

SEQ ID NO: 1477 - DNA, 21 bp, Artificial sequence
  SiRNA target sequence
aataagtgttattgatgtctg

SEQ ID NO: 1478 - DNA, 21 bp, Artificial sequence
  SiRNA target sequence
ataagtgttattgatgtctgc

SEQ ID NO: 1479 - DNA, 21 bp, Artificial sequence
  SiRNA target sequence
taagtgttattgatgtctgca

SEQ ID NO: 1480 - DNA, 21 bp, Artificial sequence
  SiRNA target sequence
aagtgttattgatgtctgcat

SEQ ID NO: 1481 - DNA, 21 bp, Artificial sequence
  SiRNA target sequence
agtgttattgatgtctgcata

SEQ ID NO: 1482 - DNA, 21 bp, Artificial sequence
  SiRNA target sequence
gtgttattgatgtctgcatag

SEQ ID NO: 1483 - DNA, 21 bp, Artificial sequence
  SiRNA target sequence
tgttattgatgtctgcataga

SEQ ID NO: 1484 - DNA, 21 bp, Artificial sequence
  SiRNA target sequence
gttattgatgtctgcatagat

SEQ ID NO: 1485 - DNA, 21 bp, Artificial sequence
  SiRNA target sequence
ttattgatgtctgcatagata

SEQ ID NO: 1486 - DNA, 21 bp, Artificial sequence
  SiRNA target sequence
tattgatgtctgcatagatat

SEQ ID NO: 1487 - DNA, 21 bp, Artificial sequence
  SiRNA target sequence
attgatgtctgcatagatatc

SEQ ID NO: 1488 - DNA, 21 bp, Artificial sequence
  SiRNA target sequence
ttgatgtctgcatagatatca

SEQ ID NO: 1489 - DNA, 21 bp, Artificial sequence
  SiRNA target sequence
tgatgtctgcatagatatcat

SEQ ID NO: 1490 - DNA, 21 bp, Artificial sequence
  SiRNA target sequence
gatgtctgcatagatatcatt

SEQ ID NO: 1491 - DNA, 21 bp, Artificial sequence
  SiRNA target sequence
atgtctgcatagatatcatta

SEQ ID NO: 1492 - DNA, 21 bp, Artificial sequence
  SiRNA target sequence
tgtctgcatagatatcattag

SEQ ID NO: 1493 - DNA, 21 bp, Artificial sequence
  SiRNA target sequence
gtctgcatagatatcattagt

SEQ ID NO: 1494 - DNA, 21 bp, Artificial sequence
  SiRNA target sequence
tctgcatagatatcattagtg

SEQ ID NO: 1495 - DNA, 21 bp, Artificial sequence
  SiRNA target sequence
ctgcatagatatcattagtgc

SEQ ID NO: 1496 - DNA, 21 bp, Artificial sequence
  SiRNA target sequence
tgcatagatatcattagtgct

SEQ ID NO: 1497 - DNA, 21 bp, Artificial sequence
  SiRNA target sequence
gcatagatatcattagtgctt

SEQ ID NO: 1498 - DNA, 21 bp, Artificial sequence
  SiRNA target sequence
catagatatcattagtgcttt

SEQ ID NO: 1499 - DNA, 21 bp, Artificial sequence
  SiRNA target sequence
atagatatcattagtgctttg

SEQ ID NO: 1500 - DNA, 21 bp, Artificial sequence
  SiRNA target sequence
tagatatcattagtgctttgt

SEQ ID NO: 1501 - DNA, 21 bp, Artificial sequence
  SiRNA target sequence
agatatcattagtgctttgtt

SEQ ID NO: 1502 - DNA, 21 bp, Artificial sequence
  SiRNA target sequence
gatatcattagtgctttgttg

SEQ ID NO: 1503 - DNA, 21 bp, Artificial sequence
  SiRNA target sequence
atatcattagtgctttgttgc

SEQ ID NO: 1504 - DNA, 21 bp, Artificial sequence
  SiRNA target sequence
tatcattagtgctttgttgca

SEQ ID NO: 1505 - DNA, 21 bp, Artificial sequence
  SiRNA target sequence
atcattagtgctttgttgcaa

SEQ ID NO: 1506 - DNA, 21 bp, Artificial sequence
  SiRNA target sequence
tcattagtgctttgttgcaag

SEQ ID NO: 1507 - DNA, 21 bp, Artificial sequence
  SiRNA target sequence
cattagtgctttgttgcaagt

SEQ ID NO: 1508 - DNA, 21 bp, Artificial sequence
  SiRNA target sequence
attagtgctttgttgcaagtg

SEQ ID NO: 1509 - DNA, 21 bp, Artificial sequence
  SiRNA target sequence
ttagtgctttgttgcaagtga

SEQ ID NO: 1510 - DNA, 21 bp, Artificial sequence
  SiRNA target sequence
tagtgctttgttgcaagtgag

SEQ ID NO: 1511 - DNA, 21 bp, Artificial sequence
  SiRNA target sequence
agtgctttgttgcaagtgagc

SEQ ID NO: 1512 - DNA, 21 bp, Artificial sequence
  SiRNA target sequence
gtgctttgttgcaagtgagct

SEQ ID NO: 1513 - DNA, 21 bp, Artificial sequence
  SiRNA target sequence
tgctttgttgcaagtgagctt

SEQ ID NO: 1514 - DNA, 21 bp, Artificial sequence
  SiRNA target sequence
gctttgttgcaagtgagcttc

SEQ ID NO: 1515 - DNA, 21 bp, Artificial sequence
  SiRNA target sequence
ctttgttgcaagtgagcttcg

SEQ ID NO: 1516 - DNA, 21 bp, Artificial sequence
  SiRNA target sequence
tttgttgcaagtgagcttcgc

SEQ ID NO: 1517 - DNA, 21 bp, Artificial sequence
  SiRNA target sequence
ttgttgcaagtgagcttcgct

SEQ ID NO: 1518 - DNA, 21 bp, Artificial sequence
  SiRNA target sequence
tgttgcaagtgagcttcgcta

SEQ ID NO: 1519 - DNA, 21 bp, Artificial sequence
  SiRNA target sequence
gttgcaagtgagcttcgctaa

SEQ ID NO: 1520 - DNA, 21 bp, Artificial sequence
  SiRNA target sequence
ttgcaagtgagcttcgctaaa

SEQ ID NO: 1521 - DNA, 21 bp, Artificial sequence
  SiRNA target sequence
tgcaagtgagcttcgctaaac

SEQ ID NO: 1522 - DNA, 21 bp, Artificial sequence
  SiRNA target sequence
gcaagtgagcttcgctaaacc

SEQ ID NO: 1523 - DNA, 21 bp, Artificial sequence
  SiRNA target sequence
caagtgagcttcgctaaacct

SEQ ID NO: 1524 - DNA, 21 bp, Artificial sequence
  SiRNA target sequence
aagtgagcttcgctaaacctg

SEQ ID NO: 1525 - DNA, 21 bp, Artificial sequence
  SiRNA target sequence
agtgagcttcgctaaacctgg

SEQ ID NO: 1526 - DNA, 21 bp, Artificial sequence
  SiRNA target sequence
gtgagcttcgctaaacctgga

SEQ ID NO: 1527 - DNA, 21 bp, Artificial sequence
  SiRNA target sequence
tgagcttcgctaaacctggac

SEQ ID NO: 1528 - DNA, 21 bp, Artificial sequence
  SiRNA target sequence
gagcttcgctaaacctggact

SEQ ID NO: 1529 - DNA, 21 bp, Artificial sequence
  SiRNA target sequence
agcttcgctaaacctggactc

SEQ ID NO: 1530 - DNA, 21 bp, Artificial sequence
  SiRNA target sequence
gcttcgctaaacctggactca

SEQ ID NO: 1531 - DNA, 21 bp, Artificial sequence
  SiRNA target sequence
cttcgctaaacctggactcaa

SEQ ID NO: 1532 - DNA, 21 bp, Artificial sequence
  SiRNA target sequence
ttcgctaaacctggactcaag

SEQ ID NO: 1533 - DNA, 21 bp, Artificial sequence
  SiRNA target sequence
tcgctaaacctggactcaagt

SEQ ID NO: 1534 - DNA, 21 bp, Artificial sequence
  SiRNA target sequence
cgctaaacctggactcaagtt

SEQ ID NO: 1535 - DNA, 21 bp, Artificial sequence
  SiRNA target sequence
gctaaacctggactcaagtta

SEQ ID NO: 1536 - DNA, 21 bp, Artificial sequence
  SiRNA target sequence
ctaaacctggactcaagttag

SEQ ID NO: 1537 - DNA, 21 bp, Artificial sequence
  SiRNA target sequence
taaacctggactcaagttagc

SEQ ID NO: 1538 - DNA, 21 bp, Artificial sequence
  SiRNA target sequence
aaacctggactcaagttagct

SEQ ID NO: 1539 - DNA, 21 bp, Artificial sequence
  SiRNA target sequence
aacctggactcaagttagctt

SEQ ID NO: 1540 - DNA, 21 bp, Artificial sequence
  SiRNA target sequence
acctggactcaagttagcttc

SEQ ID NO: 1541 - DNA, 21 bp, Artificial sequence
  SiRNA target sequence
cctggactcaagttagcttct

SEQ ID NO: 1542 - DNA, 21 bp, Artificial sequence
  SiRNA target sequence
ctggactcaagttagcttcta

SEQ ID NO: 1543 - DNA, 21 bp, Artificial sequence
  SiRNA target sequence
tggactcaagttagcttctat

SEQ ID NO: 1544 - DNA, 21 bp, Artificial sequence
  SiRNA target sequence
ggactcaagttagcttctatt

SEQ ID NO: 1545 - DNA, 21 bp, Artificial sequence
  SiRNA target sequence
gactcaagttagcttctattg

SEQ ID NO: 1546 - DNA, 21 bp, Artificial sequence
  SiRNA target sequence
actcaagttagcttctattgc

SEQ ID NO: 1547 - DNA, 21 bp, Artificial sequence
  SiRNA target sequence
ctcaagttagcttctattgca

SEQ ID NO: 1548 - DNA, 21 bp, Artificial sequence
  SiRNA target sequence
tcaagttagcttctattgcag

SEQ ID NO: 1549 - DNA, 21 bp, Artificial sequence
  SiRNA target sequence
caagttagcttctattgcagt

SEQ ID NO: 1550 - DNA, 21 bp, Artificial sequence
  SiRNA target sequence
aagttagcttctattgcagta

SEQ ID NO: 1551 - DNA, 21 bp, Artificial sequence
  SiRNA target sequence
agttagcttctattgcagtag

SEQ ID NO: 1552 - DNA, 21 bp, Artificial sequence
  SiRNA target sequence
gttagcttctattgcagtaga

SEQ ID NO: 1553 - DNA, 21 bp, Artificial sequence
  SiRNA target sequence
ttagcttctattgcagtagaa

SEQ ID NO: 1554 - DNA, 21 bp, Artificial sequence
  SiRNA target sequence
tagcttctattgcagtagaag

SEQ ID NO: 1555 - DNA, 21 bp, Artificial sequence
  SiRNA target sequence
agcttctattgcagtagaagt

SEQ ID NO: 1556 - DNA, 21 bp, Artificial sequence
  SiRNA target sequence
gcttctattgcagtagaagtg

SEQ ID NO: 1557 - DNA, 21 bp, Artificial sequence
  SiRNA target sequence
cttctattgcagtagaagtgt

SEQ ID NO: 1558 - DNA, 21 bp, Artificial sequence
  SiRNA target sequence
ttctattgcagtagaagtgtt

SEQ ID NO: 1559 - DNA, 21 bp, Artificial sequence
  SiRNA target sequence
tctattgcagtagaagtgttc

SEQ ID NO: 1560 - DNA, 21 bp, Artificial sequence
  SiRNA target sequence
ctattgcagtagaagtgttca

SEQ ID NO: 1561 - DNA, 21 bp, Artificial sequence
  SiRNA target sequence
tattgcagtagaagtgttcag

SEQ ID NO: 1562 - DNA, 21 bp, Artificial sequence
  SiRNA target sequence
attgcagtagaagtgttcaga

SEQ ID NO: 1563 - DNA, 21 bp, Artificial sequence
  SiRNA target sequence
ttgcagtagaagtgttcagac

SEQ ID NO: 1564 - DNA, 21 bp, Artificial sequence
  SiRNA target sequence
tgcagtagaagtgttcagact

SEQ ID NO: 1565 - DNA, 21 bp, Artificial sequence
  SiRNA target sequence
gcagtagaagtgttcagactt

SEQ ID NO: 1566 - DNA, 21 bp, Artificial sequence
  SiRNA target sequence
cagtagaagtgttcagactta

SEQ ID NO: 1567 - DNA, 21 bp, Artificial sequence
  SiRNA target sequence
agtagaagtgttcagacttat

SEQ ID NO: 1568 - DNA, 21 bp, Artificial sequence
  SiRNA target sequence
gtagaagtgttcagacttatt

SEQ ID NO: 1569 - DNA, 21 bp, Artificial sequence
  SiRNA target sequence
tagaagtgttcagacttatta

SEQ ID NO: 1570 - DNA, 21 bp, Artificial sequence
  SiRNA target sequence
agaagtgttcagacttattaa

SEQ ID NO: 1571 - DNA, 21 bp, Artificial sequence
  SiRNA target sequence
gaagtgttcagacttattaag

SEQ ID NO: 1572 - DNA, 21 bp, Artificial sequence
  SiRNA target sequence
aagtgttcagacttattaaga

SEQ ID NO: 1573 - DNA, 21 bp, Artificial sequence
  SiRNA target sequence
agtgttcagacttattaagaa

SEQ ID NO: 1574 - DNA, 21 bp, Artificial sequence
  SiRNA target sequence
gtgttcagacttattaagaaa

SEQ ID NO: 1575 - DNA, 21 bp, Artificial sequence
  SiRNA target sequence
tgttcagacttattaagaaat

SEQ ID NO: 1576 - DNA, 21 bp, Artificial sequence
  SiRNA target sequence
gttcagacttattaagaaata

SEQ ID NO: 1577 - DNA, 21 bp, Artificial sequence
  SiRNA target sequence
ttcagacttattaagaaatat

SEQ ID NO: 1578 - DNA, 21 bp, Artificial sequence
  SiRNA target sequence
tcagacttattaagaaatatg

SEQ ID NO: 1579 - DNA, 21 bp, Artificial sequence
  SiRNA target sequence
cagacttattaagaaatatgt

SEQ ID NO: 1580 - DNA, 21 bp, Artificial sequence
  SiRNA target sequence
agacttattaagaaatatgtc

SEQ ID NO: 1581 - DNA, 21 bp, Artificial sequence
  SiRNA target sequence
gacttattaagaaatatgtct

SEQ ID NO: 1582 - DNA, 21 bp, Artificial sequence
  SiRNA target sequence
acttattaagaaatatgtctc

SEQ ID NO: 1583 - DNA, 21 bp, Artificial sequence
  SiRNA target sequence
cttattaagaaatatgtctca

SEQ ID NO: 1584 - DNA, 21 bp, Artificial sequence
  SiRNA target sequence
ttattaagaaatatgtctcag

SEQ ID NO: 1585 - DNA, 21 bp, Artificial sequence
  SiRNA target sequence
tattaagaaatatgtctcagg

SEQ ID NO: 1586 - DNA, 21 bp, Artificial sequence
  SiRNA target sequence
attaagaaatatgtctcagga

SEQ ID NO: 1587 - DNA, 21 bp, Artificial sequence
  SiRNA target sequence
ttaagaaatatgtctcaggaa

SEQ ID NO: 1588 - DNA, 21 bp, Artificial sequence
  SiRNA target sequence
taagaaatatgtctcaggaat

SEQ ID NO: 1589 - DNA, 21 bp, Artificial sequence
  SiRNA target sequence
aagaaatatgtctcaggaatt

SEQ ID NO: 1590 - DNA, 21 bp, Artificial sequence
  SiRNA target sequence
agaaatatgtctcaggaatta

SEQ ID NO: 1591 - DNA, 21 bp, Artificial sequence
  SiRNA target sequence
gaaatatgtctcaggaattaa

SEQ ID NO: 1592 - DNA, 21 bp, Artificial sequence
  SiRNA target sequence
aaatatgtctcaggaattaag

SEQ ID NO: 1593 - DNA, 21 bp, Artificial sequence
  SiRNA target sequence
aatatgtctcaggaattaaga

SEQ ID NO: 1594 - DNA, 21 bp, Artificial sequence
  SiRNA target sequence
atatgtctcaggaattaagat

SEQ ID NO: 1595 - DNA, 21 bp, Artificial sequence
  SiRNA target sequence
tatgtctcaggaattaagatt

SEQ ID NO: 1596 - DNA, 21 bp, Artificial sequence
  SiRNA target sequence
atgtctcaggaattaagatta

SEQ ID NO: 1597 - DNA, 21 bp, Artificial sequence
  SiRNA target sequence
tgtctcaggaattaagattaa

SEQ ID NO: 1598 - DNA, 21 bp, Artificial sequence
  SiRNA target sequence
gtctcaggaattaagattaac

SEQ ID NO: 1599 - DNA, 21 bp, Artificial sequence
  SiRNA target sequence
tctcaggaattaagattaaca

SEQ ID NO: 1600 - DNA, 21 bp, Artificial sequence
  SiRNA target sequence
ctcaggaattaagattaacac

SEQ ID NO: 1601 - DNA, 21 bp, Artificial sequence
  SiRNA target sequence
tcaggaattaagattaacacc

SEQ ID NO: 1602 - DNA, 21 bp, Artificial sequence
  SiRNA target sequence
caggaattaagattaacaccg

SEQ ID NO: 1603 - DNA, 21 bp, Artificial sequence
  SiRNA target sequence
aggaattaagattaacaccga

SEQ ID NO: 1604 - DNA, 21 bp, Artificial sequence
  SiRNA target sequence
ggaattaagattaacaccgat

SEQ ID NO: 1605 - DNA, 21 bp, Artificial sequence
  SiRNA target sequence
gaattaagattaacaccgata

SEQ ID NO: 1606 - DNA, 21 bp, Artificial sequence
  SiRNA target sequence
aattaagattaacaccgataa

SEQ ID NO: 1607 - DNA, 21 bp, Artificial sequence
  SiRNA target sequence
attaagattaacaccgataag

SEQ ID NO: 1608 - DNA, 21 bp, Artificial sequence
  SiRNA target sequence
ttaagattaacaccgataaga

SEQ ID NO: 1609 - DNA, 21 bp, Artificial sequence
  SiRNA target sequence
taagattaacaccgataagat

SEQ ID NO: 1610 - DNA, 21 bp, Artificial sequence
  SiRNA target sequence
aagattaacaccgataagata

SEQ ID NO: 1611 - DNA, 21 bp, Artificial sequence
  SiRNA target sequence
agattaacaccgataagataa

SEQ ID NO: 1612 - DNA, 21 bp, Artificial sequence
  SiRNA target sequence
gattaacaccgataagataaa

SEQ ID NO: 1613 - DNA, 21 bp, Artificial sequence
  SiRNA target sequence
attaacaccgataagataaaa

SEQ ID NO: 1614 - DNA, 21 bp, Artificial sequence
  SiRNA target sequence
ttaacaccgataagataaaag

SEQ ID NO: 1615 - DNA, 21 bp, Artificial sequence
  SiRNA target sequence
taacaccgataagataaaaga

SEQ ID NO: 1616 - DNA, 21 bp, Artificial sequence
  SiRNA target sequence
aacaccgataagataaaagaa

SEQ ID NO: 1617 - DNA, 21 bp, Artificial sequence
  SiRNA target sequence
acaccgataagataaaagaac

SEQ ID NO: 1618 - DNA, 21 bp, Artificial sequence
  SiRNA target sequence
caccgataagataaaagaact

SEQ ID NO: 1619 - DNA, 21 bp, Artificial sequence
  SiRNA target sequence
accgataagataaaagaactt

SEQ ID NO: 1620 - DNA, 21 bp, Artificial sequence
  SiRNA target sequence
ccgataagataaaagaacttt

SEQ ID NO: 1621 - DNA, 21 bp, Artificial sequence
  SiRNA target sequence
cgataagataaaagaactttt

SEQ ID NO: 1622 - DNA, 21 bp, Artificial sequence
  SiRNA target sequence
gataagataaaagaacttttg

SEQ ID NO: 1623 - DNA, 21 bp, Artificial sequence
  SiRNA target sequence
ataagataaaagaacttttga

SEQ ID NO: 1624 - DNA, 21 bp, Artificial sequence
  SiRNA target sequence
taagataaaagaacttttgac

SEQ ID NO: 1625 - DNA, 21 bp, Artificial sequence
  SiRNA target sequence
aagataaaagaacttttgact

SEQ ID NO: 1626 - DNA, 21 bp, Artificial sequence
  SiRNA target sequence
agataaaagaacttttgactt

SEQ ID NO: 1627 - DNA, 21 bp, Artificial sequence
  SiRNA target sequence
gataaaagaacttttgacttt

SEQ ID NO: 1628 - DNA, 21 bp, Artificial sequence
  SiRNA target sequence
ataaaagaacttttgactttt

SEQ ID NO: 1629 - DNA, 21 bp, Artificial sequence
  SiRNA target sequence
taaaagaacttttgacttttg

SEQ ID NO: 1630 - DNA, 21 bp, Artificial sequence
  SiRNA target sequence
aaaagaacttttgacttttgg

SEQ ID NO: 1631 - DNA, 21 bp, Artificial sequence
  SiRNA target sequence
aaagaacttttgacttttggt

SEQ ID NO: 1632 - DNA, 21 bp, Artificial sequence
  SiRNA target sequence
aagaacttttgacttttggta

SEQ ID NO: 1633 - DNA, 21 bp, Artificial sequence
  SiRNA target sequence
agaacttttgacttttggtaa

SEQ ID NO: 1634 - DNA, 21 bp, Artificial sequence
  SiRNA target sequence
gaacttttgacttttggtaaa

SEQ ID NO: 1635 - DNA, 21 bp, Artificial sequence
  SiRNA target sequence
aacttttgacttttggtaaac

SEQ ID NO: 1636 - DNA, 21 bp, Artificial sequence
  SiRNA target sequence
acttttgacttttggtaaaca

SEQ ID NO: 1637 - DNA, 21 bp, Artificial sequence
  SiRNA target sequence
cttttgacttttggtaaacaa

SEQ ID NO: 1638 - DNA, 21 bp, Artificial sequence
  SiRNA target sequence
ttttgacttttggtaaacaag

SEQ ID NO: 1639 - DNA, 21 bp, Artificial sequence
  SiRNA target sequence
tttgacttttggtaaacaagc

SEQ ID NO: 1640 - DNA, 21 bp, Artificial sequence
  SiRNA target sequence
ttgacttttggtaaacaagct

SEQ ID NO: 1641 - DNA, 21 bp, Artificial sequence
  SiRNA target sequence
tgacttttggtaaacaagctt

SEQ ID NO: 1642 - DNA, 21 bp, Artificial sequence
  SiRNA target sequence
gacttttggtaaacaagcttt

SEQ ID NO: 1643 - DNA, 21 bp, Artificial sequence
  SiRNA target sequence
acttttggtaaacaagctttg

SEQ ID NO: 1644 - DNA, 21 bp, Artificial sequence
  SiRNA target sequence
cttttggtaaacaagctttga

SEQ ID NO: 1645 - DNA, 21 bp, Artificial sequence
  SiRNA target sequence
ttttggtaaacaagctttgag

SEQ ID NO: 1646 - DNA, 21 bp, Artificial sequence
  SiRNA target sequence
tttggtaaacaagctttgagt

SEQ ID NO: 1647 - DNA, 21 bp, Artificial sequence
  SiRNA target sequence
ttggtaaacaagctttgagta

SEQ ID NO: 1648 - DNA, 21 bp, Artificial sequence
  SiRNA target sequence
tggtaaacaagctttgagtag

SEQ ID NO: 1649 - DNA, 21 bp, Artificial sequence
  SiRNA target sequence
ggtaaacaagctttgagtagt

SEQ ID NO: 1650 - DNA, 21 bp, Artificial sequence
  SiRNA target sequence
gtaaacaagctttgagtagta

SEQ ID NO: 1651 - DNA, 21 bp, Artificial sequence
  SiRNA target sequence
taaacaagctttgagtagtag

SEQ ID NO: 1652 - DNA, 21 bp, Artificial sequence
  SiRNA target sequence
aaacaagctttgagtagtagt

SEQ ID NO: 1653 - DNA, 21 bp, Artificial sequence
  SiRNA target sequence
aacaagctttgagtagtagta

SEQ ID NO: 1654 - DNA, 21 bp, Artificial sequence
  SiRNA target sequence
acaagctttgagtagtagtaa

SEQ ID NO: 1655 - DNA, 21 bp, Artificial sequence
  SiRNA target sequence
caagctttgagtagtagtaac

SEQ ID NO: 1656 - DNA, 21 bp, Artificial sequence
  SiRNA target sequence
aagctttgagtagtagtaacc

SEQ ID NO: 1657 - DNA, 21 bp, Artificial sequence
  SiRNA target sequence
agctttgagtagtagtaaccc

SEQ ID NO: 1658 - DNA, 21 bp, Artificial sequence
  SiRNA target sequence
gctttgagtagtagtaaccct

SEQ ID NO: 1659 - DNA, 21 bp, Artificial sequence
  SiRNA target sequence
ctttgagtagtagtaacccta

SEQ ID NO: 1660 - DNA, 21 bp, Artificial sequence
  SiRNA target sequence
tttgagtagtagtaaccctat

SEQ ID NO: 1661 - DNA, 21 bp, Artificial sequence
  SiRNA target sequence
ttgagtagtagtaaccctatt

SEQ ID NO: 1662 - DNA, 21 bp, Artificial sequence
  SiRNA target sequence
tgagtagtagtaaccctatta

SEQ ID NO: 1663 - DNA, 21 bp, Artificial sequence
  SiRNA target sequence
gagtagtagtaaccctattat

SEQ ID NO: 1664 - DNA, 21 bp, Artificial sequence
  SiRNA target sequence
agtagtagtaaccctattatt

SEQ ID NO: 1665 - DNA, 21 bp, Artificial sequence
  SiRNA target sequence
gtagtagtaaccctattattc

SEQ ID NO: 1666 - DNA, 21 bp, Artificial sequence
  SiRNA target sequence
tagtagtaaccctattattca

SEQ ID NO: 1667 - DNA, 21 bp, Artificial sequence
  SiRNA target sequence
agtagtaaccctattattcag

SEQ ID NO: 1668 - DNA, 21 bp, Artificial sequence
  SiRNA target sequence
gtagtaaccctattattcagg

SEQ ID NO: 1669 - DNA, 21 bp, Artificial sequence
  SiRNA target sequence
tagtaaccctattattcaggt

SEQ ID NO: 1670 - DNA, 21 bp, Artificial sequence
  SiRNA target sequence
agtaaccctattattcaggtt

SEQ ID NO: 1671 - DNA, 21 bp, Artificial sequence
  SiRNA target sequence
gtaaccctattattcaggttt

SEQ ID NO: 1672 - DNA, 21 bp, Artificial sequence
  SiRNA target sequence
taaccctattattcaggtttc

SEQ ID NO: 1673 - DNA, 21 bp, Artificial sequence
  SiRNA target sequence
aaccctattattcaggtttcc

SEQ ID NO: 1674 - DNA, 21 bp, Artificial sequence
  SiRNA target sequence
accctattattcaggtttcca

SEQ ID NO: 1675 - DNA, 21 bp, Artificial sequence
  SiRNA target sequence
ccctattattcaggtttccat

SEQ ID NO: 1676 - DNA, 21 bp, Artificial sequence
  SiRNA target sequence
cctattattcaggtttccatg

SEQ ID NO: 1677 - DNA, 21 bp, Artificial sequence
  SiRNA target sequence
ctattattcaggtttccatgc

SEQ ID NO: 1678 - DNA, 21 bp, Artificial sequence
  SiRNA target sequence
tattattcaggtttccatgca

SEQ ID NO: 1679 - DNA, 21 bp, Artificial sequence
  SiRNA target sequence
attattcaggtttccatgcaa

SEQ ID NO: 1680 - DNA, 21 bp, Artificial sequence
  SiRNA target sequence
ttattcaggtttccatgcaaa

SEQ ID NO: 1681 - DNA, 21 bp, Artificial sequence
  SiRNA target sequence
tattcaggtttccatgcaaat

SEQ ID NO: 1682 - DNA, 21 bp, Artificial sequence
  SiRNA target sequence
attcaggtttccatgcaaatg

SEQ ID NO: 1683 - DNA, 21 bp, Artificial sequence
  SiRNA target sequence
ttcaggtttccatgcaaatgg

SEQ ID NO: 1684 - DNA, 21 bp, Artificial sequence
  SiRNA target sequence
tcaggtttccatgcaaatgga

SEQ ID NO: 1685 - DNA, 21 bp, Artificial sequence
  SiRNA target sequence
caggtttccatgcaaatggat

SEQ ID NO: 1686 - DNA, 21 bp, Artificial sequence
  SiRNA target sequence
aggtttccatgcaaatggata

SEQ ID NO: 1687 - DNA, 21 bp, Artificial sequence
  SiRNA target sequence
ggtttccatgcaaatggatat

SEQ ID NO: 1688 - DNA, 21 bp, Artificial sequence
  SiRNA target sequence
gtttccatgcaaatggatatg

SEQ ID NO: 1689 - DNA, 21 bp, Artificial sequence
  SiRNA target sequence
tttccatgcaaatggatatgc

SEQ ID NO: 1690 - DNA, 21 bp, Artificial sequence
  SiRNA target sequence
ttccatgcaaatggatatgcc

SEQ ID NO: 1691 - DNA, 21 bp, Artificial sequence
  SiRNA target sequence
tccatgcaaatggatatgcca

SEQ ID NO: 1692 - DNA, 21 bp, Artificial sequence
  SiRNA target sequence
ccatgcaaatggatatgccag

SEQ ID NO: 1693 - DNA, 21 bp, Artificial sequence
  SiRNA target sequence
catgcaaatggatatgccaga

SEQ ID NO: 1694 - DNA, 21 bp, Artificial sequence
  SiRNA target sequence
atgcaaatggatatgccagaa

SEQ ID NO: 1695 - DNA, 21 bp, Artificial sequence
  SiRNA target sequence
tgcaaatggatatgccagaag

SEQ ID NO: 1696 - DNA, 21 bp, Artificial sequence
  SiRNA target sequence
gcaaatggatatgccagaagt

SEQ ID NO: 1697 - DNA, 21 bp, Artificial sequence
  SiRNA target sequence
caaatggatatgccagaagtt

SEQ ID NO: 1698 - DNA, 21 bp, Artificial sequence
  SiRNA target sequence
aaatggatatgccagaagttg

SEQ ID NO: 1699 - DNA, 21 bp, Artificial sequence
  SiRNA target sequence
aatggatatgccagaagttga

SEQ ID NO: 1700 - DNA, 21 bp, Artificial sequence
  SiRNA target sequence
atggatatgccagaagttgat

SEQ ID NO: 1701 - DNA, 21 bp, Artificial sequence
  SiRNA target sequence
tggatatgccagaagttgatc

SEQ ID NO: 1702 - DNA, 21 bp, Artificial sequence
  SiRNA target sequence
ggatatgccagaagttgatcc

SEQ ID NO: 1703 - DNA, 21 bp, Artificial sequence
  SiRNA target sequence
gatatgccagaagttgatcct

SEQ ID NO: 1704 - DNA, 21 bp, Artificial sequence
  SiRNA target sequence
atatgccagaagttgatcctt

SEQ ID NO: 1705 - DNA, 21 bp, Artificial sequence
  SiRNA target sequence
tatgccagaagttgatccttc

SEQ ID NO: 1706 - DNA, 21 bp, Artificial sequence
  SiRNA target sequence
atgccagaagttgatccttca

SEQ ID NO: 1707 - DNA, 21 bp, Artificial sequence
  SiRNA target sequence
tgccagaagttgatccttcaa

SEQ ID NO: 1708 - DNA, 21 bp, Artificial sequence
  SiRNA target sequence
gccagaagttgatccttcaat

SEQ ID NO: 1709 - DNA, 21 bp, Artificial sequence
  SiRNA target sequence
ccagaagttgatccttcaatt

SEQ ID NO: 1710 - DNA, 21 bp, Artificial sequence
  SiRNA target sequence
cagaagttgatccttcaattt

SEQ ID NO: 1711 - DNA, 21 bp, Artificial sequence
  SiRNA target sequence
agaagttgatccttcaatttt

SEQ ID NO: 1712 - DNA, 21 bp, Artificial sequence
  SiRNA target sequence
gaagttgatccttcaatttta

SEQ ID NO: 1713 - DNA, 21 bp, Artificial sequence
  SiRNA target sequence
aagttgatccttcaattttat

SEQ ID NO: 1714 - DNA, 21 bp, Artificial sequence
  SiRNA target sequence
agttgatccttcaattttatt

SEQ ID NO: 1715 - DNA, 21 bp, Artificial sequence
  SiRNA target sequence
gttgatccttcaattttatta

SEQ ID NO: 1716 - DNA, 21 bp, Artificial sequence
  SiRNA target sequence
ttgatccttcaattttattac

SEQ ID NO: 1717 - DNA, 21 bp, Artificial sequence
  SiRNA target sequence
tgatccttcaattttattaca

SEQ ID NO: 1718 - DNA, 21 bp, Artificial sequence
  SiRNA target sequence
gatccttcaattttattacaa

SEQ ID NO: 1719 - DNA, 21 bp, Artificial sequence
  SiRNA target sequence
atccttcaattttattacaac

SEQ ID NO: 1720 - DNA, 21 bp, Artificial sequence
  SiRNA target sequence
tccttcaattttattacaacc

SEQ ID NO: 1721 - DNA, 21 bp, Artificial sequence
  SiRNA target sequence
ccttcaattttattacaacct

SEQ ID NO: 1722 - DNA, 21 bp, Artificial sequence
  SiRNA target sequence
cttcaattttattacaacctg

SEQ ID NO: 1723 - DNA, 21 bp, Artificial sequence
  SiRNA target sequence
ttcaattttattacaacctgg

SEQ ID NO: 1724 - DNA, 21 bp, Artificial sequence
  SiRNA target sequence
tcaattttattacaacctggt

SEQ ID NO: 1725 - DNA, 21 bp, Artificial sequence
  SiRNA target sequence
caattttattacaacctggtg

SEQ ID NO: 1726 - DNA, 21 bp, Artificial sequence
  SiRNA target sequence
aattttattacaacctggtgt

SEQ ID NO: 1727 - DNA, 21 bp, Artificial sequence
  SiRNA target sequence
attttattacaacctggtgtt

SEQ ID NO: 1728 - DNA, 21 bp, Artificial sequence
  SiRNA target sequence
ttttattacaacctggtgtta

SEQ ID NO: 1729 - DNA, 21 bp, Artificial sequence
  SiRNA target sequence
tttattacaacctggtgttat

SEQ ID NO: 1730 - DNA, 21 bp, Artificial sequence
  SiRNA target sequence
ttattacaacctggtgttata

SEQ ID NO: 1731 - DNA, 21 bp, Artificial sequence
  SiRNA target sequence
tattacaacctggtgttatag

SEQ ID NO: 1732 - DNA, 21 bp, Artificial sequence
  SiRNA target sequence
attacaacctggtgttatagt

SEQ ID NO: 1733 - DNA, 21 bp, Artificial sequence
  SiRNA target sequence
ttacaacctggtgttatagta

SEQ ID NO: 1734 - DNA, 21 bp, Artificial sequence
  SiRNA target sequence
tacaacctggtgttatagtaa

SEQ ID NO: 1735 - DNA, 21 bp, Artificial sequence
  SiRNA target sequence
acaacctggtgttatagtaag

SEQ ID NO: 1736 - DNA, 21 bp, Artificial sequence
  SiRNA target sequence
caacctggtgttatagtaagt

SEQ ID NO: 1737 - DNA, 21 bp, Artificial sequence
  SiRNA target sequence
aacctggtgttatagtaagtg

SEQ ID NO: 1738 - DNA, 21 bp, Artificial sequence
  SiRNA target sequence
acctggtgttatagtaagtgc

SEQ ID NO: 1739 - DNA, 21 bp, Artificial sequence
  SiRNA target sequence
cctggtgttatagtaagtgca

SEQ ID NO: 1740 - DNA, 21 bp, Artificial sequence
  SiRNA target sequence
ctggtgttatagtaagtgcaa

SEQ ID NO: 1741 - DNA, 21 bp, Artificial sequence
  SiRNA target sequence
tggtgttatagtaagtgcaat

SEQ ID NO: 1742 - DNA, 21 bp, Artificial sequence
  SiRNA target sequence
ggtgttatagtaagtgcaatc

SEQ ID NO: 1743 - DNA, 21 bp, Artificial sequence
  SiRNA target sequence
gtgttatagtaagtgcaatct

SEQ ID NO: 1744 - DNA, 21 bp, Artificial sequence
  SiRNA target sequence
tgttatagtaagtgcaatctt

SEQ ID NO: 1745 - DNA, 21 bp, Artificial sequence
  SiRNA target sequence
gttatagtaagtgcaatcttt

SEQ ID NO: 1746 - DNA, 21 bp, Artificial sequence
  SiRNA target sequence
ttatagtaagtgcaatctttt

SEQ ID NO: 1747 - DNA, 21 bp, Artificial sequence
  SiRNA target sequence
tatagtaagtgcaatcttttt

SEQ ID NO: 1748 - DNA, 21 bp, Artificial sequence
  SiRNA target sequence
atagtaagtgcaatcttttta

SEQ ID NO: 1749 - DNA, 21 bp, Artificial sequence
  SiRNA target sequence
tagtaagtgcaatctttttag

SEQ ID NO: 1750 - DNA, 21 bp, Artificial sequence
  SiRNA target sequence
agtaagtgcaatctttttagt

SEQ ID NO: 1751 - DNA, 21 bp, Artificial sequence
  SiRNA target sequence
gtaagtgcaatctttttagtt

SEQ ID NO: 1752 - DNA, 21 bp, Artificial sequence
  SiRNA target sequence
taagtgcaatctttttagttt

SEQ ID NO: 1753 - DNA, 21 bp, Artificial sequence
  SiRNA target sequence
aagtgcaatctttttagtttt

SEQ ID NO: 1754 - DNA, 21 bp, Artificial sequence
  SiRNA target sequence
agtgcaatctttttagtttta

SEQ ID NO: 1755 - DNA, 21 bp, Artificial sequence
  SiRNA target sequence
gtgcaatctttttagttttaa

SEQ ID NO: 1756 - DNA, 21 bp, Artificial sequence
  SiRNA target sequence
tgcaatctttttagttttaag

SEQ ID NO: 1757 - DNA, 21 bp, Artificial sequence
  SiRNA target sequence
gcaatctttttagttttaagt

SEQ ID NO: 1758 - DNA, 21 bp, Artificial sequence
  SiRNA target sequence
caatctttttagttttaagtg

SEQ ID NO: 1759 - DNA, 21 bp, Artificial sequence
  SiRNA target sequence
aatctttttagttttaagtgt

SEQ ID NO: 1760 - DNA, 21 bp, Artificial sequence
  SiRNA target sequence
atctttttagttttaagtgta

SEQ ID NO: 1761 - DNA, 21 bp, Artificial sequence
  SiRNA target sequence
tctttttagttttaagtgtag

SEQ ID NO: 1762 - DNA, 21 bp, Artificial sequence
  SiRNA target sequence
ctttttagttttaagtgtagt

SEQ ID NO: 1763 - DNA, 21 bp, Artificial sequence
  SiRNA target sequence
tttttagttttaagtgtagtt

SEQ ID NO: 1764 - DNA, 21 bp, Artificial sequence
  SiRNA target sequence
ttttagttttaagtgtagttt

SEQ ID NO: 1765 - DNA, 21 bp, Artificial sequence
  SiRNA target sequence
tttagttttaagtgtagtttt

SEQ ID NO: 1766 - DNA, 21 bp, Artificial sequence
  SiRNA target sequence
ttagttttaagtgtagttttt

SEQ ID NO: 1767 - DNA, 21 bp, Artificial sequence
  SiRNA target sequence
tagttttaagtgtagttttta

SEQ ID NO: 1768 - DNA, 21 bp, Artificial sequence
  SiRNA target sequence
agttttaagtgtagtttttac

SEQ ID NO: 1769 - DNA, 21 bp, Artificial sequence
  SiRNA target sequence
gttttaagtgtagtttttact

SEQ ID NO: 1770 - DNA, 21 bp, Artificial sequence
  SiRNA target sequence
ttttaagtgtagtttttacta

SEQ ID NO: 1771 - DNA, 21 bp, Artificial sequence
  SiRNA target sequence
tttaagtgtagtttttactaa

SEQ ID NO: 1772 - DNA, 21 bp, Artificial sequence
  SiRNA target sequence
ttaagtgtagtttttactaag

SEQ ID NO: 1773 - DNA, 21 bp, Artificial sequence
  SiRNA target sequence
taagtgtagtttttactaaga

SEQ ID NO: 1774 - DNA, 21 bp, Artificial sequence
  SiRNA target sequence
aagtgtagtttttactaagac

SEQ ID NO: 1775 - DNA, 21 bp, Artificial sequence
  SiRNA target sequence
agtgtagtttttactaagacc

SEQ ID NO: 1776 - DNA, 21 bp, Artificial sequence
  SiRNA target sequence
gtgtagtttttactaagaccc

SEQ ID NO: 1777 - DNA, 21 bp, Artificial sequence
  SiRNA target sequence
tgtagtttttactaagaccct

SEQ ID NO: 1778 - DNA, 21 bp, Artificial sequence
  SiRNA target sequence
gtagtttttactaagaccctc

SEQ ID NO: 1779 - DNA, 21 bp, Artificial sequence
  SiRNA target sequence
tagtttttactaagaccctcc

SEQ ID NO: 1780 - DNA, 21 bp, Artificial sequence
  SiRNA target sequence
agtttttactaagaccctccc

SEQ ID NO: 1781 - DNA, 21 bp, Artificial sequence
  SiRNA target sequence
gtttttactaagaccctccca

SEQ ID NO: 1782 - DNA, 21 bp, Artificial sequence
  SiRNA target sequence
tttttactaagaccctcccaa

SEQ ID NO: 1783 - DNA, 21 bp, Artificial sequence
  SiRNA target sequence
ttttactaagaccctcccaag

SEQ ID NO: 1784 - DNA, 21 bp, Artificial sequence
  SiRNA target sequence
tttactaagaccctcccaagt

SEQ ID NO: 1785 - DNA, 21 bp, Artificial sequence
  SiRNA target sequence
ttactaagaccctcccaagta

SEQ ID NO: 1786 - DNA, 21 bp, Artificial sequence
  SiRNA target sequence
tactaagaccctcccaagtaa

SEQ ID NO: 1787 - DNA, 21 bp, Artificial sequence
  SiRNA target sequence
actaagaccctcccaagtaag

SEQ ID NO: 1788 - DNA, 21 bp, Artificial sequence
  SiRNA target sequence
ctaagaccctcccaagtaaga

SEQ ID NO: 1789 - DNA, 21 bp, Artificial sequence
  SiRNA target sequence
taagaccctcccaagtaagac

SEQ ID NO: 1790 - DNA, 21 bp, Artificial sequence
  SiRNA target sequence
aagaccctcccaagtaagact

SEQ ID NO: 1791 - DNA, 21 bp, Artificial sequence
  SiRNA target sequence
agaccctcccaagtaagactg

SEQ ID NO: 1792 - DNA, 21 bp, Artificial sequence
  SiRNA target sequence
gaccctcccaagtaagactgg

SEQ ID NO: 1793 - DNA, 21 bp, Artificial sequence
  SiRNA target sequence
accctcccaagtaagactggt

SEQ ID NO: 1794 - DNA, 21 bp, Artificial sequence
  SiRNA target sequence
ccctcccaagtaagactggtg

SEQ ID NO: 1795 - DNA, 21 bp, Artificial sequence
  SiRNA target sequence
cctcccaagtaagactggtgt

SEQ ID NO: 1796 - DNA, 21 bp, Artificial sequence
  SiRNA target sequence
ctcccaagtaagactggtgtt

SEQ ID NO: 1797 - DNA, 21 bp, Artificial sequence
  SiRNA target sequence
tcccaagtaagactggtgttg

SEQ ID NO: 1798 - DNA, 21 bp, Artificial sequence
  SiRNA target sequence
cccaagtaagactggtgttga

SEQ ID NO: 1799 - DNA, 21 bp, Artificial sequence
  SiRNA target sequence
ccaagtaagactggtgttgag

SEQ ID NO: 1800 - DNA, 21 bp, Artificial sequence
  SiRNA target sequence
caagtaagactggtgttgagg

SEQ ID NO: 1801 - DNA, 21 bp, Artificial sequence
  SiRNA target sequence
aagtaagactggtgttgaggc

SEQ ID NO: 1802 - DNA, 21 bp, Artificial sequence
  SiRNA target sequence
agtaagactggtgttgaggcg

SEQ ID NO: 1803 - DNA, 21 bp, Artificial sequence
  SiRNA target sequence
gtaagactggtgttgaggcga

SEQ ID NO: 1804 - DNA, 21 bp, Artificial sequence
  SiRNA target sequence
taagactggtgttgaggcgat

SEQ ID NO: 1805 - DNA, 21 bp, Artificial sequence
  SiRNA target sequence
aagactggtgttgaggcgatg

SEQ ID NO: 1806 - DNA, 21 bp, Artificial sequence
  SiRNA target sequence
agactggtgttgaggcgatgt

SEQ ID NO: 1807 - DNA, 21 bp, Artificial sequence
  SiRNA target sequence
gactggtgttgaggcgatgtt

SEQ ID NO: 1808 - DNA, 21 bp, Artificial sequence
  SiRNA target sequence
actggtgttgaggcgatgtta

SEQ ID NO: 1809 - DNA, 21 bp, Artificial sequence
  SiRNA target sequence
ctggtgttgaggcgatgttaa

SEQ ID NO: 1810 - DNA, 21 bp, Artificial sequence
  SiRNA target sequence
tggtgttgaggcgatgttaaa

SEQ ID NO: 1811 - DNA, 21 bp, Artificial sequence
  SiRNA target sequence
ggtgttgaggcgatgttaaag

SEQ ID NO: 1812 - DNA, 21 bp, Artificial sequence
  SiRNA target sequence
gtgttgaggcgatgttaaaga

SEQ ID NO: 1813 - DNA, 21 bp, Artificial sequence
  SiRNA target sequence
tgttgaggcgatgttaaagag

SEQ ID NO: 1814 - DNA, 21 bp, Artificial sequence
  SiRNA target sequence
gttgaggcgatgttaaagagg

SEQ ID NO: 1815 - DNA, 21 bp, Artificial sequence
  SiRNA target sequence
ttgaggcgatgttaaagagga

SEQ ID NO: 1816 - DNA, 21 bp, Artificial sequence
  SiRNA target sequence
tgaggcgatgttaaagaggac

SEQ ID NO: 1817 - DNA, 21 bp, Artificial sequence
  SiRNA target sequence
gaggcgatgttaaagaggact

SEQ ID NO: 1818 - DNA, 21 bp, Artificial sequence
  SiRNA target sequence
aggcgatgttaaagaggactg

SEQ ID NO: 1819 - DNA, 21 bp, Artificial sequence
  SiRNA target sequence
ggcgatgttaaagaggactgg

SEQ ID NO: 1820 - DNA, 21 bp, Artificial sequence
  SiRNA target sequence
gcgatgttaaagaggactgga

SEQ ID NO: 1821 - DNA, 21 bp, Artificial sequence
  SiRNA target sequence
cgatgttaaagaggactggag

SEQ ID NO: 1822 - DNA, 21 bp, Artificial sequence
  SiRNA target sequence
gatgttaaagaggactggaga

SEQ ID NO: 1823 - DNA, 21 bp, Artificial sequence
  SiRNA target sequence
atgttaaagaggactggagaa

SEQ ID NO: 1824 - DNA, 21 bp, Artificial sequence
  SiRNA target sequence
tgttaaagaggactggagaac

SEQ ID NO: 1825 - DNA, 21 bp, Artificial sequence
  SiRNA target sequence
gttaaagaggactggagaact

SEQ ID NO: 1826 - DNA, 21 bp, Artificial sequence
  SiRNA target sequence
ttaaagaggactggagaacta

SEQ ID NO: 1827 - DNA, 21 bp, Artificial sequence
  SiRNA target sequence
taaagaggactggagaactag

SEQ ID NO: 1828 - DNA, 21 bp, Artificial sequence
  SiRNA target sequence
aaagaggactggagaactagg

SEQ ID NO: 1829 - DNA, 21 bp, Artificial sequence
  SiRNA target sequence
aagaggactggagaactagga

SEQ ID NO: 1830 - DNA, 21 bp, Artificial sequence
  SiRNA target sequence
agaggactggagaactaggac

SEQ ID NO: 1831 - DNA, 21 bp, Artificial sequence
  SiRNA target sequence
gaggactggagaactaggacg

SEQ ID NO: 1832 - DNA, 21 bp, Artificial sequence
  SiRNA target sequence
aggactggagaactaggacgc

SEQ ID NO: 1833 - DNA, 21 bp, Artificial sequence
  SiRNA target sequence
ggactggagaactaggacgct

SEQ ID NO: 1834 - DNA, 21 bp, Artificial sequence
  SiRNA target sequence
gactggagaactaggacgctc

SEQ ID NO: 1835 - DNA, 21 bp, Artificial sequence
  SiRNA target sequence
actggagaactaggacgctct

SEQ ID NO: 1836 - DNA, 21 bp, Artificial sequence
  SiRNA target sequence
ctggagaactaggacgctctg

SEQ ID NO: 1837 - DNA, 21 bp, Artificial sequence
  SiRNA target sequence
tggagaactaggacgctctgc

SEQ ID NO: 1838 - DNA, 21 bp, Artificial sequence
  SiRNA target sequence
ggagaactaggacgctctgca

SEQ ID NO: 1839 - DNA, 21 bp, Artificial sequence
  SiRNA target sequence
gagaactaggacgctctgcaa

SEQ ID NO: 1840 - DNA, 21 bp, Artificial sequence
  SiRNA target sequence
agaactaggacgctctgcaaa

SEQ ID NO: 1841 - DNA, 21 bp, Artificial sequence
  SiRNA target sequence
gaactaggacgctctgcaaag

SEQ ID NO: 1842 - DNA, 21 bp, Artificial sequence
  SiRNA target sequence
aactaggacgctctgcaaagg

SEQ ID NO: 1843 - DNA, 21 bp, Artificial sequence
  SiRNA target sequence
actaggacgctctgcaaaggg

SEQ ID NO: 1844 - DNA, 21 bp, Artificial sequence
  SiRNA target sequence
ctaggacgctctgcaaagggc

SEQ ID NO: 1845 - DNA, 21 bp, Artificial sequence
  SiRNA target sequence
taggacgctctgcaaagggca

SEQ ID NO: 1846 - DNA, 21 bp, Artificial sequence
  SiRNA target sequence
aggacgctctgcaaagggcat

SEQ ID NO: 1847 - DNA, 21 bp, Artificial sequence
  SiRNA target sequence
ggacgctctgcaaagggcatc

SEQ ID NO: 1848 - DNA, 21 bp, Artificial sequence
  SiRNA target sequence
gacgctctgcaaagggcatca

SEQ ID NO: 1849 - DNA, 21 bp, Artificial sequence
  SiRNA target sequence
acgctctgcaaagggcatcat

SEQ ID NO: 1850 - DNA, 21 bp, Artificial sequence
  SiRNA target sequence
cgctctgcaaagggcatcatg

SEQ ID NO: 1851 - DNA, 21 bp, Artificial sequence
  SiRNA target sequence
gctctgcaaagggcatcatgg

SEQ ID NO: 1852 - DNA, 21 bp, Artificial sequence
  SiRNA target sequence
ctctgcaaagggcatcatgga

SEQ ID NO: 1853 - DNA, 21 bp, Artificial sequence
  SiRNA target sequence
tctgcaaagggcatcatggat

SEQ ID NO: 1854 - DNA, 21 bp, Artificial sequence
  SiRNA target sequence
ctgcaaagggcatcatggatc

SEQ ID NO: 1855 - DNA, 21 bp, Artificial sequence
  SiRNA target sequence
tgcaaagggcatcatggatct

SEQ ID NO: 1856 - DNA, 21 bp, Artificial sequence
  SiRNA target sequence
gcaaagggcatcatggatctc

SEQ ID NO: 1857 - DNA, 21 bp, Artificial sequence
  SiRNA target sequence
caaagggcatcatggatctca

SEQ ID NO: 1858 - DNA, 21 bp, Artificial sequence
  SiRNA target sequence
aaagggcatcatggatctcaa

SEQ ID NO: 1859 - DNA, 21 bp, Artificial sequence
  SiRNA target sequence
aagggcatcatggatctcaat

SEQ ID NO: 1860 - DNA, 21 bp, Artificial sequence
  SiRNA target sequence
agggcatcatggatctcaata

SEQ ID NO: 1861 - DNA, 21 bp, Artificial sequence
  SiRNA target sequence
gggcatcatggatctcaatac

SEQ ID NO: 1862 - DNA, 21 bp, Artificial sequence
  SiRNA target sequence
ggcatcatggatctcaataca

SEQ ID NO: 1863 - DNA, 21 bp, Artificial sequence
  SiRNA target sequence
gcatcatggatctcaatacag

SEQ ID NO: 1864 - DNA, 21 bp, Artificial sequence
  SiRNA target sequence
catcatggatctcaatacagt

SEQ ID NO: 1865 - DNA, 21 bp, Artificial sequence
  SiRNA target sequence
atcatggatctcaatacagtt

SEQ ID NO: 1866 - DNA, 21 bp, Artificial sequence
  SiRNA target sequence
tcatggatctcaatacagttc

SEQ ID NO: 1867 - DNA, 21 bp, Artificial sequence
  SiRNA target sequence
catggatctcaatacagttct

SEQ ID NO: 1868 - DNA, 21 bp, Artificial sequence
  SiRNA target sequence
atggatctcaatacagttctt

SEQ ID NO: 1869 - DNA, 21 bp, Artificial sequence
  SiRNA target sequence
tggatctcaatacagttctta

SEQ ID NO: 1870 - DNA, 21 bp, Artificial sequence
  SiRNA target sequence
ggatctcaatacagttcttaa

SEQ ID NO: 1871 - DNA, 21 bp, Artificial sequence
  SiRNA target sequence
gatctcaatacagttcttaat

SEQ ID NO: 1872 - DNA, 21 bp, Artificial sequence
  SiRNA target sequence
atctcaatacagttcttaata

SEQ ID NO: 1873 - DNA, 21 bp, Artificial sequence
  SiRNA target sequence
tctcaatacagttcttaatac

SEQ ID NO: 1874 - DNA, 21 bp, Artificial sequence
  SiRNA target sequence
ctcaatacagttcttaataca

SEQ ID NO: 1875 - DNA, 21 bp, Artificial sequence
  SiRNA target sequence
tcaatacagttcttaatacat

SEQ ID NO: 1876 - DNA, 21 bp, Artificial sequence
  SiRNA target sequence
caatacagttcttaatacatc

SEQ ID NO: 1877 - DNA, 21 bp, Artificial sequence
  SiRNA target sequence
aatacagttcttaatacatca

SEQ ID NO: 1878 - DNA, 21 bp, Artificial sequence
  SiRNA target sequence
atacagttcttaatacatcag

SEQ ID NO: 1879 - DNA, 21 bp, Artificial sequence
  SiRNA target sequence
tacagttcttaatacatcagt

SEQ ID NO: 1880 - DNA, 21 bp, Artificial sequence
  SiRNA target sequence
acagttcttaatacatcagta

SEQ ID NO: 1881 - DNA, 21 bp, Artificial sequence
  SiRNA target sequence
cagttcttaatacatcagtaa

SEQ ID NO: 1882 - DNA, 21 bp, Artificial sequence
  SiRNA target sequence
agttcttaatacatcagtaac

SEQ ID NO: 1883 - DNA, 21 bp, Artificial sequence
  SiRNA target sequence
gttcttaatacatcagtaacc

SEQ ID NO: 1884 - DNA, 21 bp, Artificial sequence
  SiRNA target sequence
ttcttaatacatcagtaacct

SEQ ID NO: 1885 - DNA, 21 bp, Artificial sequence
  SiRNA target sequence
tcttaatacatcagtaacctc

SEQ ID NO: 1886 - DNA, 21 bp, Artificial sequence
  SiRNA target sequence
cttaatacatcagtaacctca

SEQ ID NO: 1887 - DNA, 21 bp, Artificial sequence
  SiRNA target sequence
ttaatacatcagtaacctcaa

SEQ ID NO: 1888 - DNA, 21 bp, Artificial sequence
  SiRNA target sequence
taatacatcagtaacctcaat

SEQ ID NO: 1889 - DNA, 21 bp, Artificial sequence
  SiRNA target sequence
aatacatcagtaacctcaatg

SEQ ID NO: 1890 - DNA, 21 bp, Artificial sequence
  SiRNA target sequence
atacatcagtaacctcaatgc

SEQ ID NO: 1891 - DNA, 21 bp, Artificial sequence
  SiRNA target sequence
tacatcagtaacctcaatgct

SEQ ID NO: 1892 - DNA, 21 bp, Artificial sequence
  SiRNA target sequence
acatcagtaacctcaatgctt

SEQ ID NO: 1893 - DNA, 21 bp, Artificial sequence
  SiRNA target sequence
catcagtaacctcaatgcttg

SEQ ID NO: 1894 - DNA, 21 bp, Artificial sequence
  SiRNA target sequence
atcagtaacctcaatgcttga

SEQ ID NO: 1895 - DNA, 21 bp, Artificial sequence
  SiRNA target sequence
tcagtaacctcaatgcttgaa

SEQ ID NO: 1896 - DNA, 21 bp, Artificial sequence
  SiRNA target sequence
cagtaacctcaatgcttgaat

SEQ ID NO: 1897 - DNA, 21 bp, Artificial sequence
  SiRNA target sequence
agtaacctcaatgcttgaata

SEQ ID NO: 1898 - DNA, 21 bp, Artificial sequence
  SiRNA target sequence
gtaacctcaatgcttgaatac

SEQ ID NO: 1899 - DNA, 21 bp, Artificial sequence
  SiRNA target sequence
taacctcaatgcttgaatact

SEQ ID NO: 1900 - DNA, 21 bp, Artificial sequence
  SiRNA target sequence
aacctcaatgcttgaatactt

SEQ ID NO: 1901 - DNA, 21 bp, Artificial sequence
  SiRNA target sequence
acctcaatgcttgaatacttt

SEQ ID NO: 1902 - DNA, 21 bp, Artificial sequence
  SiRNA target sequence
cctcaatgcttgaatactttg

SEQ ID NO: 1903 - DNA, 21 bp, Artificial sequence
  SiRNA target sequence
ctcaatgcttgaatactttgg

SEQ ID NO: 1904 - DNA, 21 bp, Artificial sequence
  SiRNA target sequence
tcaatgcttgaatactttgga

SEQ ID NO: 1905 - DNA, 21 bp, Artificial sequence
  SiRNA target sequence
caatgcttgaatactttggag

SEQ ID NO: 1906 - DNA, 21 bp, Artificial sequence
  SiRNA target sequence
aatgcttgaatactttggagt

SEQ ID NO: 1907 - DNA, 21 bp, Artificial sequence
  SiRNA target sequence
atgcttgaatactttggagta

SEQ ID NO: 1908 - DNA, 21 bp, Artificial sequence
  SiRNA target sequence
tgcttgaatactttggagtac

SEQ ID NO: 1909 - DNA, 21 bp, Artificial sequence
  SiRNA target sequence
gcttgaatactttggagtaca

SEQ ID NO: 1910 - DNA, 21 bp, Artificial sequence
  SiRNA target sequence
cttgaatactttggagtacat

SEQ ID NO: 1911 - DNA, 21 bp, Artificial sequence
  SiRNA target sequence
ttgaatactttggagtacata

SEQ ID NO: 1912 - DNA, 21 bp, Artificial sequence
  SiRNA target sequence
tgaatactttggagtacatac

SEQ ID NO: 1913 - DNA, 21 bp, Artificial sequence
  SiRNA target sequence
gaatactttggagtacatact

SEQ ID NO: 1914 - DNA, 21 bp, Artificial sequence
  SiRNA target sequence
aatactttggagtacatactt

SEQ ID NO: 1915 - DNA, 21 bp, Artificial sequence
  SiRNA target sequence
atactttggagtacatacttt

SEQ ID NO: 1916 - DNA, 21 bp, Artificial sequence
  SiRNA target sequence
tactttggagtacatacttta

SEQ ID NO: 1917 - DNA, 21 bp, Artificial sequence
  SiRNA target sequence
actttggagtacatactttag

SEQ ID NO: 1918 - DNA, 21 bp, Artificial sequence
  SiRNA target sequence
ctttggagtacatactttagg

SEQ ID NO: 1919 - DNA, 21 bp, Artificial sequence
  SiRNA target sequence
tttggagtacatactttagga

SEQ ID NO: 1920 - DNA, 21 bp, Artificial sequence
  SiRNA target sequence
ttggagtacatactttaggat

SEQ ID NO: 1921 - DNA, 21 bp, Artificial sequence
  SiRNA target sequence
tggagtacatactttaggatt

SEQ ID NO: 1922 - DNA, 21 bp, Artificial sequence
  SiRNA target sequence
ggagtacatactttaggatta

SEQ ID NO: 1923 - DNA, 21 bp, Artificial sequence
  SiRNA target sequence
gagtacatactttaggattaa

SEQ ID NO: 1924 - DNA, 21 bp, Artificial sequence
  SiRNA target sequence
agtacatactttaggattaag

SEQ ID NO: 1925 - DNA, 21 bp, Artificial sequence
  SiRNA target sequence
gtacatactttaggattaaga

SEQ ID NO: 1926 - DNA, 21 bp, Artificial sequence
  SiRNA target sequence
tacatactttaggattaagac

SEQ ID NO: 1927 - DNA, 21 bp, Artificial sequence
  SiRNA target sequence
acatactttaggattaagaca

SEQ ID NO: 1928 - DNA, 21 bp, Artificial sequence
  SiRNA target sequence
catactttaggattaagacaa

SEQ ID NO: 1929 - DNA, 21 bp, Artificial sequence
  SiRNA target sequence
atactttaggattaagacaag

SEQ ID NO: 1930 - DNA, 21 bp, Artificial sequence
  SiRNA target sequence
tactttaggattaagacaaga

SEQ ID NO: 1931 - DNA, 21 bp, Artificial sequence
  SiRNA target sequence
actttaggattaagacaagaa

SEQ ID NO: 1932 - DNA, 21 bp, Artificial sequence
  SiRNA target sequence
ctttaggattaagacaagaag

SEQ ID NO: 1933 - DNA, 21 bp, Artificial sequence
  SiRNA target sequence
tttaggattaagacaagaagc

SEQ ID NO: 1934 - DNA, 21 bp, Artificial sequence
  SiRNA target sequence
ttaggattaagacaagaagct

SEQ ID NO: 1935 - DNA, 21 bp, Artificial sequence
  SiRNA target sequence
taggattaagacaagaagctg

SEQ ID NO: 1936 - DNA, 21 bp, Artificial sequence
  SiRNA target sequence
aggattaagacaagaagctga

SEQ ID NO: 1937 - DNA, 21 bp, Artificial sequence
  SiRNA target sequence
ggattaagacaagaagctgaa

SEQ ID NO: 1938 - DNA, 21 bp, Artificial sequence
  SiRNA target sequence
gattaagacaagaagctgaac

SEQ ID NO: 1939 - DNA, 21 bp, Artificial sequence
  SiRNA target sequence
attaagacaagaagctgaact

SEQ ID NO: 1940 - DNA, 21 bp, Artificial sequence
  SiRNA target sequence
ttaagacaagaagctgaactt

SEQ ID NO: 1941 - DNA, 21 bp, Artificial sequence
  SiRNA target sequence
taagacaagaagctgaacttc

SEQ ID NO: 1942 - DNA, 21 bp, Artificial sequence
  SiRNA target sequence
aagacaagaagctgaacttca

SEQ ID NO: 1943 - DNA, 21 bp, Artificial sequence
  SiRNA target sequence
agacaagaagctgaacttcaa

SEQ ID NO: 1944 - DNA, 21 bp, Artificial sequence
  SiRNA target sequence
gacaagaagctgaacttcaag

SEQ ID NO: 1945 - DNA, 21 bp, Artificial sequence
  SiRNA target sequence
acaagaagctgaacttcaagt

SEQ ID NO: 1946 - DNA, 21 bp, Artificial sequence
  SiRNA target sequence
caagaagctgaacttcaagtt

SEQ ID NO: 1947 - DNA, 21 bp, Artificial sequence
  SiRNA target sequence
aagaagctgaacttcaagttc

SEQ ID NO: 1948 - DNA, 21 bp, Artificial sequence
  SiRNA target sequence
agaagctgaacttcaagttct

SEQ ID NO: 1949 - DNA, 21 bp, Artificial sequence
  SiRNA target sequence
gaagctgaacttcaagttctc

SEQ ID NO: 1950 - DNA, 21 bp, Artificial sequence
  SiRNA target sequence
aagctgaacttcaagttctcg

SEQ ID NO: 1951 - DNA, 21 bp, Artificial sequence
  SiRNA target sequence
agctgaacttcaagttctcgt

SEQ ID NO: 1952 - DNA, 21 bp, Artificial sequence
  SiRNA target sequence
gctgaacttcaagttctcgta

SEQ ID NO: 1953 - DNA, 21 bp, Artificial sequence
  SiRNA target sequence
ctgaacttcaagttctcgtag

SEQ ID NO: 1954 - DNA, 21 bp, Artificial sequence
  SiRNA target sequence
tgaacttcaagttctcgtaga

SEQ ID NO: 1955 - DNA, 21 bp, Artificial sequence
  SiRNA target sequence
gaacttcaagttctcgtagaa

SEQ ID NO: 1956 - DNA, 21 bp, Artificial sequence
  SiRNA target sequence
aacttcaagttctcgtagaag

SEQ ID NO: 1957 - DNA, 21 bp, Artificial sequence
  SiRNA target sequence
acttcaagttctcgtagaagg

SEQ ID NO: 1958 - DNA, 21 bp, Artificial sequence
  SiRNA target sequence
cttcaagttctcgtagaaggt

SEQ ID NO: 1959 - DNA, 21 bp, Artificial sequence
  SiRNA target sequence
ttcaagttctcgtagaaggtt

SEQ ID NO: 1960 - DNA, 21 bp, Artificial sequence
  SiRNA target sequence
tcaagttctcgtagaaggtta

SEQ ID NO: 1961 - DNA, 21 bp, Artificial sequence
  SiRNA target sequence
caagttctcgtagaaggttat

SEQ ID NO: 1962 - DNA, 21 bp, Artificial sequence
  SiRNA target sequence
aagttctcgtagaaggttata

SEQ ID NO: 1963 - DNA, 21 bp, Artificial sequence
  SiRNA target sequence
agttctcgtagaaggttataa

SEQ ID NO: 1964 - DNA, 21 bp, Artificial sequence
  SiRNA target sequence
gttctcgtagaaggttataaa

SEQ ID NO: 1965 - DNA, 21 bp, Artificial sequence
  SiRNA target sequence
ttctcgtagaaggttataaaa

SEQ ID NO: 1966 - DNA, 21 bp, Artificial sequence
  SiRNA target sequence
tctcgtagaaggttataaaac

SEQ ID NO: 1967 - DNA, 21 bp, Artificial sequence
  SiRNA target sequence
ctcgtagaaggttataaaact

SEQ ID NO: 1968 - DNA, 21 bp, Artificial sequence
  SiRNA target sequence
tcgtagaaggttataaaactt

SEQ ID NO: 1969 - DNA, 21 bp, Artificial sequence
  SiRNA target sequence
cgtagaaggttataaaacttg

SEQ ID NO: 1970 - DNA, 21 bp, Artificial sequence
  SiRNA target sequence
gtagaaggttataaaacttgg

SEQ ID NO: 1971 - DNA, 21 bp, Artificial sequence
  SiRNA target sequence
tagaaggttataaaacttggt

SEQ ID NO: 1972 - DNA, 21 bp, Artificial sequence
  SiRNA target sequence
agaaggttataaaacttggtg

SEQ ID NO: 1973 - DNA, 21 bp, Artificial sequence
  SiRNA target sequence
gaaggttataaaacttggtgt

SEQ ID NO: 1974 - DNA, 21 bp, Artificial sequence
  SiRNA target sequence
aaggttataaaacttggtgtg

SEQ ID NO: 1975 - DNA, 21 bp, Artificial sequence
  SiRNA target sequence
aggttataaaacttggtgtga

SEQ ID NO: 1976 - DNA, 21 bp, Artificial sequence
  SiRNA target sequence
ggttataaaacttggtgtgat

SEQ ID NO: 1977 - DNA, 21 bp, Artificial sequence
  SiRNA target sequence
gttataaaacttggtgtgatg

SEQ ID NO: 1978 - DNA, 21 bp, Artificial sequence
  SiRNA target sequence
ttataaaacttggtgtgatga

SEQ ID NO: 1979 - DNA, 21 bp, Artificial sequence
  SiRNA target sequence
tataaaacttggtgtgatgaa

SEQ ID NO: 1980 - DNA, 21 bp, Artificial sequence
  SiRNA target sequence
ataaaacttggtgtgatgaag

SEQ ID NO: 1981 - DNA, 21 bp, Artificial sequence
  SiRNA target sequence
taaaacttggtgtgatgaagt

SEQ ID NO: 1982 - DNA, 21 bp, Artificial sequence
  SiRNA target sequence
aaaacttggtgtgatgaagtt

SEQ ID NO: 1983 - DNA, 21 bp, Artificial sequence
  SiRNA target sequence
aaacttggtgtgatgaagttg

SEQ ID NO: 1984 - DNA, 21 bp, Artificial sequence
  SiRNA target sequence
aacttggtgtgatgaagttgc

SEQ ID NO: 1985 - DNA, 21 bp, Artificial sequence
  SiRNA target sequence
acttggtgtgatgaagttgcg

SEQ ID NO: 1986 - DNA, 21 bp, Artificial sequence
  SiRNA target sequence
cttggtgtgatgaagttgcgg

SEQ ID NO: 1987 - DNA, 21 bp, Artificial sequence
  SiRNA target sequence
ttggtgtgatgaagttgcggc

SEQ ID NO: 1988 - DNA, 21 bp, Artificial sequence
  SiRNA target sequence
tggtgtgatgaagttgcggct

SEQ ID NO: 1989 - DNA, 21 bp, Artificial sequence
  SiRNA target sequence
ggtgtgatgaagttgcggctt

SEQ ID NO: 1990 - DNA, 21 bp, Artificial sequence
  SiRNA target sequence
gtgtgatgaagttgcggcttt

SEQ ID NO: 1991 - DNA, 21 bp, Artificial sequence
  SiRNA target sequence
tgtgatgaagttgcggcttta

SEQ ID NO: 1992 - DNA, 21 bp, Artificial sequence
  SiRNA target sequence
gtgatgaagttgcggctttag

SEQ ID NO: 1993 - DNA, 21 bp, Artificial sequence
  SiRNA target sequence
tgatgaagttgcggctttagt

SEQ ID NO: 1994 - DNA, 21 bp, Artificial sequence
  SiRNA target sequence
gatgaagttgcggctttagta

SEQ ID NO: 1995 - DNA, 21 bp, Artificial sequence
  SiRNA target sequence
atgaagttgcggctttagtag

SEQ ID NO: 1996 - DNA, 21 bp, Artificial sequence
  SiRNA target sequence
tgaagttgcggctttagtagg

SEQ ID NO: 1997 - DNA, 21 bp, Artificial sequence
  SiRNA target sequence
gaagttgcggctttagtagga

SEQ ID NO: 1998 - DNA, 21 bp, Artificial sequence
  SiRNA target sequence
aagttgcggctttagtaggac

SEQ ID NO: 1999 - DNA, 21 bp, Artificial sequence
  SiRNA target sequence
agttgcggctttagtaggaca

SEQ ID NO: 2000 - DNA, 21 bp, Artificial sequence
  SiRNA target sequence
gttgcggctttagtaggacat

SEQ ID NO: 2001 - DNA, 21 bp, Artificial sequence
  SiRNA target sequence
ttgcggctttagtaggacata

SEQ ID NO: 2002 - DNA, 21 bp, Artificial sequence
  SiRNA target sequence
tgcggctttagtaggacataa

SEQ ID NO: 2003 - DNA, 21 bp, Artificial sequence
  SiRNA target sequence
gcggctttagtaggacataag

SEQ ID NO: 2004 - DNA, 21 bp, Artificial sequence
  SiRNA target sequence
cggctttagtaggacataaga

SEQ ID NO: 2005 - DNA, 21 bp, Artificial sequence
  SiRNA target sequence
ggctttagtaggacataagat

SEQ ID NO: 2006 - DNA, 21 bp, Artificial sequence
  SiRNA target sequence
gctttagtaggacataagatt

SEQ ID NO: 2007 - DNA, 21 bp, Artificial sequence
  SiRNA target sequence
ctttagtaggacataagatta

SEQ ID NO: 2008 - DNA, 21 bp, Artificial sequence
  SiRNA target sequence
tttagtaggacataagattaa

SEQ ID NO: 2009 - DNA, 21 bp, Artificial sequence
  SiRNA target sequence
ttagtaggacataagattaac

SEQ ID NO: 2010 - DNA, 21 bp, Artificial sequence
  SiRNA target sequence
tagtaggacataagattaaca

SEQ ID NO: 2011 - DNA, 21 bp, Artificial sequence
  SiRNA target sequence
agtaggacataagattaacat

SEQ ID NO: 2012 - DNA, 21 bp, Artificial sequence
  SiRNA target sequence
gtaggacataagattaacatg

SEQ ID NO: 2013 - DNA, 21 bp, Artificial sequence
  SiRNA target sequence
taggacataagattaacatgg

SEQ ID NO: 2014 - DNA, 21 bp, Artificial sequence
  SiRNA target sequence
aggacataagattaacatgga

SEQ ID NO: 2015 - DNA, 21 bp, Artificial sequence
  SiRNA target sequence
ggacataagattaacatggat

SEQ ID NO: 2016 - DNA, 21 bp, Artificial sequence
  SiRNA target sequence
gacataagattaacatggatg

SEQ ID NO: 2017 - DNA, 21 bp, Artificial sequence
  SiRNA target sequence
acataagattaacatggatgg

SEQ ID NO: 2018 - DNA, 21 bp, Artificial sequence
  SiRNA target sequence
cataagattaacatggatggt

SEQ ID NO: 2019 - DNA, 21 bp, Artificial sequence
  SiRNA target sequence
ataagattaacatggatggta

SEQ ID NO: 2020 - DNA, 21 bp, Artificial sequence
  SiRNA target sequence
taagattaacatggatggtac

SEQ ID NO: 2021 - DNA, 21 bp, Artificial sequence
  SiRNA target sequence
aagattaacatggatggtact

SEQ ID NO: 2022 - DNA, 21 bp, Artificial sequence
  SiRNA target sequence
agattaacatggatggtactt

SEQ ID NO: 2023 - DNA, 21 bp, Artificial sequence
  SiRNA target sequence
gattaacatggatggtacttt

SEQ ID NO: 2024 - DNA, 21 bp, Artificial sequence
  SiRNA target sequence
attaacatggatggtacttta

SEQ ID NO: 2025 - DNA, 21 bp, Artificial sequence
  SiRNA target sequence
ttaacatggatggtactttag

SEQ ID NO: 2026 - DNA, 21 bp, Artificial sequence
  SiRNA target sequence
taacatggatggtactttaga

SEQ ID NO: 2027 - DNA, 21 bp, Artificial sequence
  SiRNA target sequence
aacatggatggtactttagat

SEQ ID NO: 2028 - DNA, 21 bp, Artificial sequence
  SiRNA target sequence
acatggatggtactttagatg

SEQ ID NO: 2029 - DNA, 21 bp, Artificial sequence
  SiRNA target sequence
catggatggtactttagatgg

SEQ ID NO: 2030 - DNA, 21 bp, Artificial sequence
  SiRNA target sequence
atggatggtactttagatgga

SEQ ID NO: 2031 - DNA, 21 bp, Artificial sequence
  SiRNA target sequence
tggatggtactttagatggaa

SEQ ID NO: 2032 - DNA, 21 bp, Artificial sequence
  SiRNA target sequence
ggatggtactttagatggaag

SEQ ID NO: 2033 - DNA, 21 bp, Artificial sequence
  SiRNA target sequence
gatggtactttagatggaaga

SEQ ID NO: 2034 - DNA, 21 bp, Artificial sequence
  SiRNA target sequence
atggtactttagatggaagaa

SEQ ID NO: 2035 - DNA, 21 bp, Artificial sequence
  SiRNA target sequence
tggtactttagatggaagaag

SEQ ID NO: 2036 - DNA, 21 bp, Artificial sequence
  SiRNA target sequence
ggtactttagatggaagaagt

SEQ ID NO: 2037 - DNA, 21 bp, Artificial sequence
  SiRNA target sequence
gtactttagatggaagaagta

SEQ ID NO: 2038 - DNA, 21 bp, Artificial sequence
  SiRNA target sequence
tactttagatggaagaagtat

SEQ ID NO: 2039 - DNA, 21 bp, Artificial sequence
  SiRNA target sequence
actttagatggaagaagtatt

SEQ ID NO: 2040 - DNA, 21 bp, Artificial sequence
  SiRNA target sequence
ctttagatggaagaagtattg

SEQ ID NO: 2041 - DNA, 21 bp, Artificial sequence
  SiRNA target sequence
tttagatggaagaagtattgt

SEQ ID NO: 2042 - DNA, 21 bp, Artificial sequence
  SiRNA target sequence
ttagatggaagaagtattgtt

SEQ ID NO: 2043 - DNA, 21 bp, Artificial sequence
  SiRNA target sequence
tagatggaagaagtattgttg

SEQ ID NO: 2044 - DNA, 21 bp, Artificial sequence
  SiRNA target sequence
agatggaagaagtattgttga

SEQ ID NO: 2045 - DNA, 21 bp, Artificial sequence
  SiRNA target sequence
gatggaagaagtattgttgaa

SEQ ID NO: 2046 - DNA, 21 bp, Artificial sequence
  SiRNA target sequence
atggaagaagtattgttgaag

SEQ ID NO: 2047 - DNA, 21 bp, Artificial sequence
  SiRNA target sequence
tggaagaagtattgttgaaga

SEQ ID NO: 2048 - DNA, 21 bp, Artificial sequence
  SiRNA target sequence
ggaagaagtattgttgaagat

SEQ ID NO: 2049 - DNA, 21 bp, Artificial sequence
  SiRNA target sequence
gaagaagtattgttgaagata

SEQ ID NO: 2050 - DNA, 21 bp, Artificial sequence
  SiRNA target sequence
aagaagtattgttgaagatat

SEQ ID NO: 2051 - DNA, 21 bp, Artificial sequence
  SiRNA target sequence
agaagtattgttgaagatatt

SEQ ID NO: 2052 - DNA, 21 bp, Artificial sequence
  SiRNA target sequence
gaagtattgttgaagatatta

SEQ ID NO: 2053 - DNA, 21 bp, Artificial sequence
  SiRNA target sequence
aagtattgttgaagatattat

SEQ ID NO: 2054 - DNA, 21 bp, Artificial sequence
  SiRNA target sequence
agtattgttgaagatattatg

SEQ ID NO: 2055 - DNA, 21 bp, Artificial sequence
  SiRNA target sequence
gtattgttgaagatattatga

SEQ ID NO: 2056 - DNA, 21 bp, Artificial sequence
  SiRNA target sequence
tattgttgaagatattatgag

SEQ ID NO: 2057 - DNA, 21 bp, Artificial sequence
  SiRNA target sequence
attgttgaagatattatgaga

SEQ ID NO: 2058 - DNA, 21 bp, Artificial sequence
  SiRNA target sequence
ttgttgaagatattatgagag

SEQ ID NO: 2059 - DNA, 21 bp, Artificial sequence
  SiRNA target sequence
tgttgaagatattatgagaga

SEQ ID NO: 2060 - DNA, 21 bp, Artificial sequence
  SiRNA target sequence
gttgaagatattatgagagat

SEQ ID NO: 2061 - DNA, 21 bp, Artificial sequence
  SiRNA target sequence
ttgaagatattatgagagata

SEQ ID NO: 2062 - DNA, 21 bp, Artificial sequence
  SiRNA target sequence
tgaagatattatgagagatac

SEQ ID NO: 2063 - DNA, 21 bp, Artificial sequence
  SiRNA target sequence
gaagatattatgagagataca

SEQ ID NO: 2064 - DNA, 21 bp, Artificial sequence
  SiRNA target sequence
aagatattatgagagatacaa

SEQ ID NO: 2065 - DNA, 21 bp, Artificial sequence
  SiRNA target sequence
agatattatgagagatacaaa

SEQ ID NO: 2066 - DNA, 21 bp, Artificial sequence
  SiRNA target sequence
gatattatgagagatacaaaa

SEQ ID NO: 2067 - DNA, 21 bp, Artificial sequence
  SiRNA target sequence
atattatgagagatacaaaag

SEQ ID NO: 2068 - DNA, 21 bp, Artificial sequence
  SiRNA target sequence
tattatgagagatacaaaaga

SEQ ID NO: 2069 - DNA, 21 bp, Artificial sequence
  SiRNA target sequence
attatgagagatacaaaagaa

SEQ ID NO: 2070 - DNA, 21 bp, Artificial sequence
  SiRNA target sequence
ttatgagagatacaaaagaaa

SEQ ID NO: 2071 - DNA, 21 bp, Artificial sequence
  SiRNA target sequence
tatgagagatacaaaagaaat

SEQ ID NO: 2072 - DNA, 21 bp, Artificial sequence
  SiRNA target sequence
atgagagatacaaaagaaatc

SEQ ID NO: 2073 - DNA, 21 bp, Artificial sequence
  SiRNA target sequence
tgagagatacaaaagaaatcc

SEQ ID NO: 2074 - DNA, 21 bp, Artificial sequence
  SiRNA target sequence
gagagatacaaaagaaatcca

SEQ ID NO: 2075 - DNA, 21 bp, Artificial sequence
  SiRNA target sequence
agagatacaaaagaaatccaa

SEQ ID NO: 2076 - DNA, 21 bp, Artificial sequence
  SiRNA target sequence
gagatacaaaagaaatccaac

SEQ ID NO: 2077 - DNA, 21 bp, Artificial sequence
  SiRNA target sequence
agatacaaaagaaatccaacg

SEQ ID NO: 2078 - DNA, 21 bp, Artificial sequence
  SiRNA target sequence
gatacaaaagaaatccaacgt

SEQ ID NO: 2079 - DNA, 21 bp, Artificial sequence
  SiRNA target sequence
atacaaaagaaatccaacgtg

SEQ ID NO: 2080 - DNA, 21 bp, Artificial sequence
  SiRNA target sequence
tacaaaagaaatccaacgtgt

SEQ ID NO: 2081 - DNA, 21 bp, Artificial sequence
  SiRNA target sequence
acaaaagaaatccaacgtgta

SEQ ID NO: 2082 - DNA, 21 bp, Artificial sequence
  SiRNA target sequence
caaaagaaatccaacgtgtag

SEQ ID NO: 2083 - DNA, 21 bp, Artificial sequence
  SiRNA target sequence
aaaagaaatccaacgtgtaga

SEQ ID NO: 2084 - DNA, 21 bp, Artificial sequence
  SiRNA target sequence
aaagaaatccaacgtgtagaa

SEQ ID NO: 2085 - DNA, 21 bp, Artificial sequence
  SiRNA target sequence
aagaaatccaacgtgtagaaa

SEQ ID NO: 2086 - DNA, 21 bp, Artificial sequence
  SiRNA target sequence
agaaatccaacgtgtagaaaa

SEQ ID NO: 2087 - DNA, 21 bp, Artificial sequence
  SiRNA target sequence
gaaatccaacgtgtagaaaat

SEQ ID NO: 2088 - DNA, 21 bp, Artificial sequence
  SiRNA target sequence
aaatccaacgtgtagaaaatc

SEQ ID NO: 2089 - DNA, 21 bp, Artificial sequence
  SiRNA target sequence
aatccaacgtgtagaaaatct

SEQ ID NO: 2090 - DNA, 21 bp, Artificial sequence
  SiRNA target sequence
atccaacgtgtagaaaatctc

SEQ ID NO: 2091 - DNA, 21 bp, Artificial sequence
  SiRNA target sequence
tccaacgtgtagaaaatctct

SEQ ID NO: 2092 - DNA, 21 bp, Artificial sequence
  SiRNA target sequence
ccaacgtgtagaaaatctcta

SEQ ID NO: 2093 - DNA, 21 bp, Artificial sequence
  SiRNA target sequence
caacgtgtagaaaatctctac

SEQ ID NO: 2094 - DNA, 21 bp, Artificial sequence
  SiRNA target sequence
aacgtgtagaaaatctctaca

SEQ ID NO: 2095 - DNA, 21 bp, Artificial sequence
  SiRNA target sequence
acgtgtagaaaatctctacaa

SEQ ID NO: 2096 - DNA, 21 bp, Artificial sequence
  SiRNA target sequence
cgtgtagaaaatctctacaaa

SEQ ID NO: 2097 - DNA, 21 bp, Artificial sequence
  SiRNA target sequence
gtgtagaaaatctctacaaac

SEQ ID NO: 2098 - DNA, 21 bp, Artificial sequence
  SiRNA target sequence
tgtagaaaatctctacaaacg

SEQ ID NO: 2099 - DNA, 21 bp, Artificial sequence
  SiRNA target sequence
gtagaaaatctctacaaacgt

SEQ ID NO: 2100 - DNA, 21 bp, Artificial sequence
  SiRNA target sequence
tagaaaatctctacaaacgtg

SEQ ID NO: 2101 - DNA, 21 bp, Artificial sequence
  SiRNA target sequence
agaaaatctctacaaacgtgg

SEQ ID NO: 2102 - DNA, 21 bp, Artificial sequence
  SiRNA target sequence
gaaaatctctacaaacgtgga

SEQ ID NO: 2103 - DNA, 21 bp, Artificial sequence
  SiRNA target sequence
aaaatctctacaaacgtggat

SEQ ID NO: 2104 - DNA, 21 bp, Artificial sequence
  SiRNA target sequence
aaatctctacaaacgtggatt

SEQ ID NO: 2105 - DNA, 21 bp, Artificial sequence
  SiRNA target sequence
aatctctacaaacgtggattg

SEQ ID NO: 2106 - DNA, 21 bp, Artificial sequence
  SiRNA target sequence
atctctacaaacgtggattgg

SEQ ID NO: 2107 - DNA, 21 bp, Artificial sequence
  SiRNA target sequence
tctctacaaacgtggattgga

SEQ ID NO: 2108 - DNA, 21 bp, Artificial sequence
  SiRNA target sequence
ctctacaaacgtggattggaa

SEQ ID NO: 2109 - DNA, 21 bp, Artificial sequence
  SiRNA target sequence
tctacaaacgtggattggaaa

SEQ ID NO: 2110 - DNA, 21 bp, Artificial sequence
  SiRNA target sequence
ctacaaacgtggattggaaat

SEQ ID NO: 2111 - DNA, 21 bp, Artificial sequence
  SiRNA target sequence
tacaaacgtggattggaaatt

SEQ ID NO: 2112 - DNA, 21 bp, Artificial sequence
  SiRNA target sequence
acaaacgtggattggaaattt

SEQ ID NO: 2113 - DNA, 21 bp, Artificial sequence
  SiRNA target sequence
caaacgtggattggaaatttc

SEQ ID NO: 2114 - DNA, 21 bp, Artificial sequence
  SiRNA target sequence
aaacgtggattggaaatttct

SEQ ID NO: 2115 - DNA, 21 bp, Artificial sequence
  SiRNA target sequence
aacgtggattggaaatttctc

SEQ ID NO: 2116 - DNA, 21 bp, Artificial sequence
  SiRNA target sequence
acgtggattggaaatttctcg

SEQ ID NO: 2117 - DNA, 21 bp, Artificial sequence
  SiRNA target sequence
cgtggattggaaatttctcgt

SEQ ID NO: 2118 - DNA, 21 bp, Artificial sequence
  SiRNA target sequence
gtggattggaaatttctcgta

SEQ ID NO: 2119 - DNA, 21 bp, Artificial sequence
  SiRNA target sequence
tggattggaaatttctcgtaa

SEQ ID NO: 2120 - DNA, 21 bp, Artificial sequence
  SiRNA target sequence
ggattggaaatttctcgtaat

SEQ ID NO: 2121 - DNA, 21 bp, Artificial sequence
  SiRNA target sequence
gattggaaatttctcgtaata

SEQ ID NO: 2122 - DNA, 21 bp, Artificial sequence
  SiRNA target sequence
attggaaatttctcgtaatat

SEQ ID NO: 2123 - DNA, 21 bp, Artificial sequence
  SiRNA target sequence
ttggaaatttctcgtaatatt

SEQ ID NO: 2124 - DNA, 21 bp, Artificial sequence
  SiRNA target sequence
tggaaatttctcgtaatattg

SEQ ID NO: 2125 - DNA, 21 bp, Artificial sequence
  SiRNA target sequence
ggaaatttctcgtaatattgc

SEQ ID NO: 2126 - DNA, 21 bp, Artificial sequence
  SiRNA target sequence
gaaatttctcgtaatattgca

SEQ ID NO: 2127 - DNA, 21 bp, Artificial sequence
  SiRNA target sequence
aaatttctcgtaatattgcag

SEQ ID NO: 2128 - DNA, 21 bp, Artificial sequence
  SiRNA target sequence
aatttctcgtaatattgcaga

SEQ ID NO: 2129 - DNA, 21 bp, Artificial sequence
  SiRNA target sequence
atttctcgtaatattgcagac

SEQ ID NO: 2130 - DNA, 21 bp, Artificial sequence
  SiRNA target sequence
tttctcgtaatattgcagaca

SEQ ID NO: 2131 - DNA, 21 bp, Artificial sequence
  SiRNA target sequence
ttctcgtaatattgcagacat

SEQ ID NO: 2132 - DNA, 21 bp, Artificial sequence
  SiRNA target sequence
tctcgtaatattgcagacatg

SEQ ID NO: 2133 - DNA, 21 bp, Artificial sequence
  SiRNA target sequence
ctcgtaatattgcagacatga

SEQ ID NO: 2134 - DNA, 21 bp, Artificial sequence
  SiRNA target sequence
tcgtaatattgcagacatgaa

SEQ ID NO: 2135 - DNA, 21 bp, Artificial sequence
  SiRNA target sequence
cgtaatattgcagacatgaaa

SEQ ID NO: 2136 - DNA, 21 bp, Artificial sequence
  SiRNA target sequence
gtaatattgcagacatgaaac

SEQ ID NO: 2137 - DNA, 21 bp, Artificial sequence
  SiRNA target sequence
taatattgcagacatgaaact

SEQ ID NO: 2138 - DNA, 21 bp, Artificial sequence
  SiRNA target sequence
aatattgcagacatgaaactt

SEQ ID NO: 2139 - DNA, 21 bp, Artificial sequence
  SiRNA target sequence
atattgcagacatgaaacttc

SEQ ID NO: 2140 - DNA, 21 bp, Artificial sequence
  SiRNA target sequence
tattgcagacatgaaacttcc

SEQ ID NO: 2141 - DNA, 21 bp, Artificial sequence
  SiRNA target sequence
attgcagacatgaaacttcca

SEQ ID NO: 2142 - DNA, 21 bp, Artificial sequence
  SiRNA target sequence
ttgcagacatgaaacttccaa

SEQ ID NO: 2143 - DNA, 21 bp, Artificial sequence
  SiRNA target sequence
tgcagacatgaaacttccaac

SEQ ID NO: 2144 - DNA, 21 bp, Artificial sequence
  SiRNA target sequence
gcagacatgaaacttccaaca

SEQ ID NO: 2145 - DNA, 21 bp, Artificial sequence
  SiRNA target sequence
cagacatgaaacttccaacaa

SEQ ID NO: 2146 - DNA, 21 bp, Artificial sequence
  SiRNA target sequence
agacatgaaacttccaacaaa

SEQ ID NO: 2147 - DNA, 21 bp, Artificial sequence
  SiRNA target sequence
gacatgaaacttccaacaaaa

SEQ ID NO: 2148 - DNA, 21 bp, Artificial sequence
  SiRNA target sequence
acatgaaacttccaacaaaat

SEQ ID NO: 2149 - DNA, 21 bp, Artificial sequence
  SiRNA target sequence
catgaaacttccaacaaaatt

SEQ ID NO: 2150 - DNA, 21 bp, Artificial sequence
  SiRNA target sequence
atgaaacttccaacaaaatta

SEQ ID NO: 2151 - DNA, 21 bp, Artificial sequence
  SiRNA target sequence
tgaaacttccaacaaaattaa

SEQ ID NO: 2152 - DNA, 21 bp, Artificial sequence
  SiRNA target sequence
gaaacttccaacaaaattaac

SEQ ID NO: 2153 - DNA, 21 bp, Artificial sequence
  SiRNA target sequence
aaacttccaacaaaattaacc

SEQ ID NO: 2154 - DNA, 21 bp, Artificial sequence
  SiRNA target sequence
aacttccaacaaaattaacca

SEQ ID NO: 2155 - DNA, 21 bp, Artificial sequence
  SiRNA target sequence
acttccaacaaaattaaccat

SEQ ID NO: 2156 - DNA, 21 bp, Artificial sequence
  SiRNA target sequence
cttccaacaaaattaaccatt

SEQ ID NO: 2157 - DNA, 21 bp, Artificial sequence
  SiRNA target sequence
ttccaacaaaattaaccatta

SEQ ID NO: 2158 - DNA, 21 bp, Artificial sequence
  SiRNA target sequence
tccaacaaaattaaccattag

SEQ ID NO: 2159 - DNA, 21 bp, Artificial sequence
  SiRNA target sequence
ccaacaaaattaaccattagt

SEQ ID NO: 2160 - DNA, 21 bp, Artificial sequence
  SiRNA target sequence
caacaaaattaaccattagtt

SEQ ID NO: 2161 - DNA, 21 bp, Artificial sequence
  SiRNA target sequence
aacaaaattaaccattagttt

SEQ ID NO: 2162 - DNA, 21 bp, Artificial sequence
  SiRNA target sequence
acaaaattaaccattagtttt

SEQ ID NO: 2163 - DNA, 21 bp, Artificial sequence
  SiRNA target sequence
caaaattaaccattagtttta

SEQ ID NO: 2164 - DNA, 21 bp, Artificial sequence
  SiRNA target sequence
aaaattaaccattagttttaa

SEQ ID NO: 2165 - DNA, 21 bp, Artificial sequence
  SiRNA target sequence
aaattaaccattagttttaat

SEQ ID NO: 2166 - DNA, 21 bp, Artificial sequence
  SiRNA target sequence
aattaaccattagttttaata

SEQ ID NO: 2167 - DNA, 21 bp, Artificial sequence
  SiRNA target sequence
attaaccattagttttaatac

SEQ ID NO: 2168 - DNA, 21 bp, Artificial sequence
  SiRNA target sequence
ttaaccattagttttaataca

SEQ ID NO: 2169 - DNA, 21 bp, Artificial sequence
  SiRNA target sequence
taaccattagttttaatacac

SEQ ID NO: 2170 - DNA, 21 bp, Artificial sequence
  SiRNA target sequence
aaccattagttttaatacaca

SEQ ID NO: 2171 - DNA, 21 bp, Artificial sequence
  SiRNA target sequence
accattagttttaatacacac

SEQ ID NO: 2172 - DNA, 21 bp, Artificial sequence
  SiRNA target sequence
ccattagttttaatacacaca

SEQ ID NO: 2173 - DNA, 21 bp, Artificial sequence
  SiRNA target sequence
cattagttttaatacacacat

SEQ ID NO: 2174 - DNA, 21 bp, Artificial sequence
  SiRNA target sequence
attagttttaatacacacatg

SEQ ID NO: 2175 - DNA, 21 bp, Artificial sequence
  SiRNA target sequence
ttagttttaatacacacatga

SEQ ID NO: 2176 - DNA, 21 bp, Artificial sequence
  SiRNA target sequence
tagttttaatacacacatgag

SEQ ID NO: 2177 - DNA, 21 bp, Artificial sequence
  SiRNA target sequence
agttttaatacacacatgaga

SEQ ID NO: 2178 - DNA, 21 bp, Artificial sequence
  SiRNA target sequence
gttttaatacacacatgagat

SEQ ID NO: 2179 - DNA, 21 bp, Artificial sequence
  SiRNA target sequence
ttttaatacacacatgagata

SEQ ID NO: 2180 - DNA, 21 bp, Artificial sequence
  SiRNA target sequence
tttaatacacacatgagatac

SEQ ID NO: 2181 - DNA, 21 bp, Artificial sequence
  SiRNA target sequence
ttaatacacacatgagatact

SEQ ID NO: 2182 - DNA, 21 bp, Artificial sequence
  SiRNA target sequence
taatacacacatgagatactt

SEQ ID NO: 2183 - DNA, 21 bp, Artificial sequence
  SiRNA target sequence
aatacacacatgagatacttg

SEQ ID NO: 2184 - DNA, 21 bp, Artificial sequence
  SiRNA target sequence
atacacacatgagatacttga

SEQ ID NO: 2185 - DNA, 21 bp, Artificial sequence
  SiRNA target sequence
tacacacatgagatacttgac

SEQ ID NO: 2186 - DNA, 21 bp, Artificial sequence
  SiRNA target sequence
acacacatgagatacttgact

SEQ ID NO: 2187 - DNA, 21 bp, Artificial sequence
  SiRNA target sequence
cacacatgagatacttgactg

SEQ ID NO: 2188 - DNA, 21 bp, Artificial sequence
  SiRNA target sequence
acacatgagatacttgactga

SEQ ID NO: 2189 - DNA, 21 bp, Artificial sequence
  SiRNA target sequence
cacatgagatacttgactgaa

SEQ ID NO: 2190 - DNA, 21 bp, Artificial sequence
  SiRNA target sequence
acatgagatacttgactgaag

SEQ ID NO: 2191 - DNA, 21 bp, Artificial sequence
  SiRNA target sequence
catgagatacttgactgaagt

SEQ ID NO: 2192 - DNA, 21 bp, Artificial sequence
  SiRNA target sequence
atgagatacttgactgaagtt

SEQ ID NO: 2193 - DNA, 21 bp, Artificial sequence
  SiRNA target sequence
tgagatacttgactgaagttt

SEQ ID NO: 2194 - DNA, 21 bp, Artificial sequence
  SiRNA target sequence
gagatacttgactgaagtttt

SEQ ID NO: 2195 - DNA, 21 bp, Artificial sequence
  SiRNA target sequence
agatacttgactgaagttttc

SEQ ID NO: 2196 - DNA, 21 bp, Artificial sequence
  SiRNA target sequence
gatacttgactgaagttttca

SEQ ID NO: 2197 - DNA, 21 bp, Artificial sequence
  SiRNA target sequence
atacttgactgaagttttcaa

SEQ ID NO: 2198 - DNA, 21 bp, Artificial sequence
  SiRNA target sequence
tacttgactgaagttttcaaa

SEQ ID NO: 2199 - DNA, 21 bp, Artificial sequence
  SiRNA target sequence
acttgactgaagttttcaaag

SEQ ID NO: 2200 - DNA, 21 bp, Artificial sequence
  SiRNA target sequence
cttgactgaagttttcaaagc

SEQ ID NO: 2201 - DNA, 21 bp, Artificial sequence
  SiRNA target sequence
ttgactgaagttttcaaagca

SEQ ID NO: 2202 - DNA, 21 bp, Artificial sequence
  SiRNA target sequence
tgactgaagttttcaaagcag

SEQ ID NO: 2203 - DNA, 21 bp, Artificial sequence
  SiRNA target sequence
gactgaagttttcaaagcagt

SEQ ID NO: 2204 - DNA, 21 bp, Artificial sequence
  SiRNA target sequence
actgaagttttcaaagcagta

SEQ ID NO: 2205 - DNA, 21 bp, Artificial sequence
  SiRNA target sequence
ctgaagttttcaaagcagtag

SEQ ID NO: 2206 - DNA, 21 bp, Artificial sequence
  SiRNA target sequence
tgaagttttcaaagcagtaga

SEQ ID NO: 2207 - DNA, 21 bp, Artificial sequence
  SiRNA target sequence
gaagttttcaaagcagtagat

SEQ ID NO: 2208 - DNA, 21 bp, Artificial sequence
  SiRNA target sequence
aagttttcaaagcagtagata

SEQ ID NO: 2209 - DNA, 21 bp, Artificial sequence
  SiRNA target sequence
agttttcaaagcagtagatac

SEQ ID NO: 2210 - DNA, 21 bp, Artificial sequence
  SiRNA target sequence
gttttcaaagcagtagatacg

SEQ ID NO: 2211 - DNA, 21 bp, Artificial sequence
  SiRNA target sequence
ttttcaaagcagtagatacgt

SEQ ID NO: 2212 - DNA, 21 bp, Artificial sequence
  SiRNA target sequence
tttcaaagcagtagatacgtc

SEQ ID NO: 2213 - DNA, 21 bp, Artificial sequence
  SiRNA target sequence
ttcaaagcagtagatacgtct

SEQ ID NO: 2214 - DNA, 21 bp, Artificial sequence
  SiRNA target sequence
tcaaagcagtagatacgtctg

SEQ ID NO: 2215 - DNA, 21 bp, Artificial sequence
  SiRNA target sequence
caaagcagtagatacgtctgg

SEQ ID NO: 2216 - DNA, 21 bp, Artificial sequence
  SiRNA target sequence
aaagcagtagatacgtctggt

SEQ ID NO: 2217 - DNA, 21 bp, Artificial sequence
  SiRNA target sequence
aagcagtagatacgtctggtg

SEQ ID NO: 2218 - DNA, 21 bp, Artificial sequence
  SiRNA target sequence
agcagtagatacgtctggtgc

SEQ ID NO: 2219 - DNA, 21 bp, Artificial sequence
  SiRNA target sequence
gcagtagatacgtctggtgct

SEQ ID NO: 2220 - DNA, 21 bp, Artificial sequence
  SiRNA target sequence
cagtagatacgtctggtgctt

SEQ ID NO: 2221 - DNA, 21 bp, Artificial sequence
  SiRNA target sequence
agtagatacgtctggtgcttt

SEQ ID NO: 2222 - DNA, 21 bp, Artificial sequence
  SiRNA target sequence
gtagatacgtctggtgctttt

SEQ ID NO: 2223 - DNA, 21 bp, Artificial sequence
  SiRNA target sequence
tagatacgtctggtgcttttg

SEQ ID NO: 2224 - DNA, 21 bp, Artificial sequence
  SiRNA target sequence
agatacgtctggtgcttttgg

SEQ ID NO: 2225 - DNA, 21 bp, Artificial sequence
  SiRNA target sequence
gatacgtctggtgcttttgga

SEQ ID NO: 2226 - DNA, 21 bp, Artificial sequence
  SiRNA target sequence
atacgtctggtgcttttggaa

SEQ ID NO: 2227 - DNA, 21 bp, Artificial sequence
  SiRNA target sequence
tacgtctggtgcttttggaaa

SEQ ID NO: 2228 - DNA, 21 bp, Artificial sequence
  SiRNA target sequence
acgtctggtgcttttggaaat

SEQ ID NO: 2229 - DNA, 21 bp, Artificial sequence
  SiRNA target sequence
cgtctggtgcttttggaaata

SEQ ID NO: 2230 - DNA, 21 bp, Artificial sequence
  SiRNA target sequence
gtctggtgcttttggaaataa

SEQ ID NO: 2231 - DNA, 21 bp, Artificial sequence
  SiRNA target sequence
tctggtgcttttggaaataaa

SEQ ID NO: 2232 - DNA, 21 bp, Artificial sequence
  SiRNA target sequence
ctggtgcttttggaaataaac

SEQ ID NO: 2233 - DNA, 21 bp, Artificial sequence
  SiRNA target sequence
tggtgcttttggaaataaacc

SEQ ID NO: 2234 - DNA, 21 bp, Artificial sequence
  SiRNA target sequence
ggtgcttttggaaataaaccc

SEQ ID NO: 2235 - DNA, 21 bp, Artificial sequence
  SiRNA target sequence
gtgcttttggaaataaacccc

SEQ ID NO: 2236 - DNA, 21 bp, Artificial sequence
  SiRNA target sequence
tgcttttggaaataaaccccg

SEQ ID NO: 2237 - DNA, 21 bp, Artificial sequence
  SiRNA target sequence
gcttttggaaataaaccccga

SEQ ID NO: 2238 - DNA, 21 bp, Artificial sequence
  SiRNA target sequence
cttttggaaataaaccccgaa

SEQ ID NO: 2239 - DNA, 21 bp, Artificial sequence
  SiRNA target sequence
ttttggaaataaaccccgaac

SEQ ID NO: 2240 - DNA, 21 bp, Artificial sequence
  SiRNA target sequence
tttggaaataaaccccgaact

SEQ ID NO: 2241 - DNA, 21 bp, Artificial sequence
  SiRNA target sequence
ttggaaataaaccccgaactc

SEQ ID NO: 2242 - DNA, 21 bp, Artificial sequence
  SiRNA target sequence
tggaaataaaccccgaactca

SEQ ID NO: 2243 - DNA, 21 bp, Artificial sequence
  SiRNA target sequence
ggaaataaaccccgaactcaa

SEQ ID NO: 2244 - DNA, 21 bp, Artificial sequence
  SiRNA target sequence
gaaataaaccccgaactcaac

SEQ ID NO: 2245 - DNA, 21 bp, Artificial sequence
  SiRNA target sequence
aaataaaccccgaactcaacc

SEQ ID NO: 2246 - DNA, 21 bp, Artificial sequence
  SiRNA target sequence
aataaaccccgaactcaacct

SEQ ID NO: 2247 - DNA, 21 bp, Artificial sequence
  SiRNA target sequence
ataaaccccgaactcaacctg

SEQ ID NO: 2248 - DNA, 21 bp, Artificial sequence
  SiRNA target sequence
taaaccccgaactcaacctgt

SEQ ID NO: 2249 - DNA, 21 bp, Artificial sequence
  SiRNA target sequence
aaaccccgaactcaacctgta

SEQ ID NO: 2250 - DNA, 21 bp, Artificial sequence
  SiRNA target sequence
aaccccgaactcaacctgtag

SEQ ID NO: 2251 - DNA, 21 bp, Artificial sequence
  SiRNA target sequence
accccgaactcaacctgtagt

SEQ ID NO: 2252 - DNA, 21 bp, Artificial sequence
  SiRNA target sequence
ccccgaactcaacctgtagtt

SEQ ID NO: 2253 - DNA, 21 bp, Artificial sequence
  SiRNA target sequence
cccgaactcaacctgtagtta

SEQ ID NO: 2254 - DNA, 21 bp, Artificial sequence
  SiRNA target sequence
ccgaactcaacctgtagttat

SEQ ID NO: 2255 - DNA, 21 bp, Artificial sequence
  SiRNA target sequence
cgaactcaacctgtagttatt

SEQ ID NO: 2256 - DNA, 21 bp, Artificial sequence
  SiRNA target sequence
gaactcaacctgtagttattt

SEQ ID NO: 2257 - DNA, 21 bp, Artificial sequence
  SiRNA target sequence
aactcaacctgtagttatttg

SEQ ID NO: 2258 - DNA, 21 bp, Artificial sequence
  SiRNA target sequence
actcaacctgtagttatttgg

SEQ ID NO: 2259 - DNA, 21 bp, Artificial sequence
  SiRNA target sequence
ctcaacctgtagttatttggc

SEQ ID NO: 2260 - DNA, 21 bp, Artificial sequence
  SiRNA target sequence
tcaacctgtagttatttggct

SEQ ID NO: 2261 - DNA, 21 bp, Artificial sequence
  SiRNA target sequence
caacctgtagttatttggcta

SEQ ID NO: 2262 - DNA, 21 bp, Artificial sequence
  SiRNA target sequence
aacctgtagttatttggctat

SEQ ID NO: 2263 - DNA, 21 bp, Artificial sequence
  SiRNA target sequence
acctgtagttatttggctata

SEQ ID NO: 2264 - DNA, 21 bp, Artificial sequence
  SiRNA target sequence
cctgtagttatttggctatat

SEQ ID NO: 2265 - DNA, 21 bp, Artificial sequence
  SiRNA target sequence
ctgtagttatttggctatatg

SEQ ID NO: 2266 - DNA, 21 bp, Artificial sequence
  SiRNA target sequence
tgtagttatttggctatatgg

SEQ ID NO: 2267 - DNA, 21 bp, Artificial sequence
  SiRNA target sequence
gtagttatttggctatatggt

SEQ ID NO: 2268 - DNA, 21 bp, Artificial sequence
  SiRNA target sequence
tagttatttggctatatggtg

SEQ ID NO: 2269 - DNA, 21 bp, Artificial sequence
  SiRNA target sequence
agttatttggctatatggtga

SEQ ID NO: 2270 - DNA, 21 bp, Artificial sequence
  SiRNA target sequence
gttatttggctatatggtgag

SEQ ID NO: 2271 - DNA, 21 bp, Artificial sequence
  SiRNA target sequence
ttatttggctatatggtgagt

SEQ ID NO: 2272 - DNA, 21 bp, Artificial sequence
  SiRNA target sequence
tatttggctatatggtgagtc

SEQ ID NO: 2273 - DNA, 21 bp, Artificial sequence
  SiRNA target sequence
atttggctatatggtgagtct

SEQ ID NO: 2274 - DNA, 21 bp, Artificial sequence
  SiRNA target sequence
tttggctatatggtgagtctg

SEQ ID NO: 2275 - DNA, 21 bp, Artificial sequence
  SiRNA target sequence
ttggctatatggtgagtctgg

SEQ ID NO: 2276 - DNA, 21 bp, Artificial sequence
  SiRNA target sequence
tggctatatggtgagtctgga

SEQ ID NO: 2277 - DNA, 21 bp, Artificial sequence
  SiRNA target sequence
ggctatatggtgagtctggag

SEQ ID NO: 2278 - DNA, 21 bp, Artificial sequence
  SiRNA target sequence
gctatatggtgagtctggagt

SEQ ID NO: 2279 - DNA, 21 bp, Artificial sequence
  SiRNA target sequence
ctatatggtgagtctggagtt

SEQ ID NO: 2280 - DNA, 21 bp, Artificial sequence
  SiRNA target sequence
tatatggtgagtctggagttg

SEQ ID NO: 2281 - DNA, 21 bp, Artificial sequence
  SiRNA target sequence
atatggtgagtctggagttgg

SEQ ID NO: 2282 - DNA, 21 bp, Artificial sequence
  SiRNA target sequence
tatggtgagtctggagttggt

SEQ ID NO: 2283 - DNA, 21 bp, Artificial sequence
  SiRNA target sequence
atggtgagtctggagttggta

SEQ ID NO: 2284 - DNA, 21 bp, Artificial sequence
  SiRNA target sequence
tggtgagtctggagttggtaa

SEQ ID NO: 2285 - DNA, 21 bp, Artificial sequence
  SiRNA target sequence
ggtgagtctggagttggtaag

SEQ ID NO: 2286 - DNA, 21 bp, Artificial sequence
  SiRNA target sequence
gtgagtctggagttggtaagt

SEQ ID NO: 2287 - DNA, 21 bp, Artificial sequence
  SiRNA target sequence
tgagtctggagttggtaagtc

SEQ ID NO: 2288 - DNA, 21 bp, Artificial sequence
  SiRNA target sequence
gagtctggagttggtaagtca

SEQ ID NO: 2289 - DNA, 21 bp, Artificial sequence
  SiRNA target sequence
agtctggagttggtaagtcag

SEQ ID NO: 2290 - DNA, 21 bp, Artificial sequence
  SiRNA target sequence
gtctggagttggtaagtcagg

SEQ ID NO: 2291 - DNA, 21 bp, Artificial sequence
  SiRNA target sequence
tctggagttggtaagtcaggt

SEQ ID NO: 2292 - DNA, 21 bp, Artificial sequence
  SiRNA target sequence
ctggagttggtaagtcaggta

SEQ ID NO: 2293 - DNA, 21 bp, Artificial sequence
  SiRNA target sequence
tggagttggtaagtcaggtat

SEQ ID NO: 2294 - DNA, 21 bp, Artificial sequence
  SiRNA target sequence
ggagttggtaagtcaggtatg

SEQ ID NO: 2295 - DNA, 21 bp, Artificial sequence
  SiRNA target sequence
gagttggtaagtcaggtatga

SEQ ID NO: 2296 - DNA, 21 bp, Artificial sequence
  SiRNA target sequence
agttggtaagtcaggtatgac

SEQ ID NO: 2297 - DNA, 21 bp, Artificial sequence
  SiRNA target sequence
gttggtaagtcaggtatgaca

SEQ ID NO: 2298 - DNA, 21 bp, Artificial sequence
  SiRNA target sequence
ttggtaagtcaggtatgacat

SEQ ID NO: 2299 - DNA, 21 bp, Artificial sequence
  SiRNA target sequence
tggtaagtcaggtatgacatg

SEQ ID NO: 2300 - DNA, 21 bp, Artificial sequence
  SiRNA target sequence
ggtaagtcaggtatgacatgg

SEQ ID NO: 2301 - DNA, 21 bp, Artificial sequence
  SiRNA target sequence
gtaagtcaggtatgacatggc

SEQ ID NO: 2302 - DNA, 21 bp, Artificial sequence
  SiRNA target sequence
taagtcaggtatgacatggcc

SEQ ID NO: 2303 - DNA, 21 bp, Artificial sequence
  SiRNA target sequence
aagtcaggtatgacatggccc

SEQ ID NO: 2304 - DNA, 21 bp, Artificial sequence
  SiRNA target sequence
agtcaggtatgacatggcccc

SEQ ID NO: 2305 - DNA, 21 bp, Artificial sequence
  SiRNA target sequence
gtcaggtatgacatggcccct

SEQ ID NO: 2306 - DNA, 21 bp, Artificial sequence
  SiRNA target sequence
tcaggtatgacatggccccta

SEQ ID NO: 2307 - DNA, 21 bp, Artificial sequence
  SiRNA target sequence
caggtatgacatggcccctag

SEQ ID NO: 2308 - DNA, 21 bp, Artificial sequence
  SiRNA target sequence
aggtatgacatggcccctagc

SEQ ID NO: 2309 - DNA, 21 bp, Artificial sequence
  SiRNA target sequence
ggtatgacatggcccctagct

SEQ ID NO: 2310 - DNA, 21 bp, Artificial sequence
  SiRNA target sequence
gtatgacatggcccctagctg

SEQ ID NO: 2311 - DNA, 21 bp, Artificial sequence
  SiRNA target sequence
tatgacatggcccctagctgt

SEQ ID NO: 2312 - DNA, 21 bp, Artificial sequence
  SiRNA target sequence
atgacatggcccctagctgta

SEQ ID NO: 2313 - DNA, 21 bp, Artificial sequence
  SiRNA target sequence
tgacatggcccctagctgtag

SEQ ID NO: 2314 - DNA, 21 bp, Artificial sequence
  SiRNA target sequence
gacatggcccctagctgtaga

SEQ ID NO: 2315 - DNA, 21 bp, Artificial sequence
  SiRNA target sequence
acatggcccctagctgtagat

SEQ ID NO: 2316 - DNA, 21 bp, Artificial sequence
  SiRNA target sequence
catggcccctagctgtagatc

SEQ ID NO: 2317 - DNA, 21 bp, Artificial sequence
  SiRNA target sequence
atggcccctagctgtagatct

SEQ ID NO: 2318 - DNA, 21 bp, Artificial sequence
  SiRNA target sequence
tggcccctagctgtagatctt

SEQ ID NO: 2319 - DNA, 21 bp, Artificial sequence
  SiRNA target sequence
ggcccctagctgtagatctta

SEQ ID NO: 2320 - DNA, 21 bp, Artificial sequence
  SiRNA target sequence
gcccctagctgtagatcttaa

SEQ ID NO: 2321 - DNA, 21 bp, Artificial sequence
  SiRNA target sequence
cccctagctgtagatcttaat

SEQ ID NO: 2322 - DNA, 21 bp, Artificial sequence
  SiRNA target sequence
ccctagctgtagatcttaata

SEQ ID NO: 2323 - DNA, 21 bp, Artificial sequence
  SiRNA target sequence
cctagctgtagatcttaataa

SEQ ID NO: 2324 - DNA, 21 bp, Artificial sequence
  SiRNA target sequence
ctagctgtagatcttaataat

SEQ ID NO: 2325 - DNA, 21 bp, Artificial sequence
  SiRNA target sequence
tagctgtagatcttaataata

SEQ ID NO: 2326 - DNA, 21 bp, Artificial sequence
  SiRNA target sequence
agctgtagatcttaataatag

SEQ ID NO: 2327 - DNA, 21 bp, Artificial sequence
  SiRNA target sequence
gctgtagatcttaataatagt

SEQ ID NO: 2328 - DNA, 21 bp, Artificial sequence
  SiRNA target sequence
ctgtagatcttaataatagtt

SEQ ID NO: 2329 - DNA, 21 bp, Artificial sequence
  SiRNA target sequence
tgtagatcttaataatagttt

SEQ ID NO: 2330 - DNA, 21 bp, Artificial sequence
  SiRNA target sequence
gtagatcttaataatagttta

SEQ ID NO: 2331 - DNA, 21 bp, Artificial sequence
  SiRNA target sequence
tagatcttaataatagtttag

SEQ ID NO: 2332 - DNA, 21 bp, Artificial sequence
  SiRNA target sequence
agatcttaataatagtttagt

SEQ ID NO: 2333 - DNA, 21 bp, Artificial sequence
  SiRNA target sequence
gatcttaataatagtttagta

SEQ ID NO: 2334 - DNA, 21 bp, Artificial sequence
  SiRNA target sequence
atcttaataatagtttagtag

SEQ ID NO: 2335 - DNA, 21 bp, Artificial sequence
  SiRNA target sequence
tcttaataatagtttagtaga

SEQ ID NO: 2336 - DNA, 21 bp, Artificial sequence
  SiRNA target sequence
cttaataatagtttagtagat

SEQ ID NO: 2337 - DNA, 21 bp, Artificial sequence
  SiRNA target sequence
ttaataatagtttagtagata

SEQ ID NO: 2338 - DNA, 21 bp, Artificial sequence
  SiRNA target sequence
taataatagtttagtagataa

SEQ ID NO: 2339 - DNA, 21 bp, Artificial sequence
  SiRNA target sequence
aataatagtttagtagataat

SEQ ID NO: 2340 - DNA, 21 bp, Artificial sequence
  SiRNA target sequence
ataatagtttagtagataatg

SEQ ID NO: 2341 - DNA, 21 bp, Artificial sequence
  SiRNA target sequence
taatagtttagtagataatgt

SEQ ID NO: 2342 - DNA, 21 bp, Artificial sequence
  SiRNA target sequence
aatagtttagtagataatgta

SEQ ID NO: 2343 - DNA, 21 bp, Artificial sequence
  SiRNA target sequence
atagtttagtagataatgtag

SEQ ID NO: 2344 - DNA, 21 bp, Artificial sequence
  SiRNA target sequence
tagtttagtagataatgtaga

SEQ ID NO: 2345 - DNA, 21 bp, Artificial sequence
  SiRNA target sequence
agtttagtagataatgtagag

SEQ ID NO: 2346 - DNA, 21 bp, Artificial sequence
  SiRNA target sequence
gtttagtagataatgtagagg

SEQ ID NO: 2347 - DNA, 21 bp, Artificial sequence
  SiRNA target sequence
tttagtagataatgtagagga

SEQ ID NO: 2348 - DNA, 21 bp, Artificial sequence
  SiRNA target sequence
ttagtagataatgtagaggag

SEQ ID NO: 2349 - DNA, 21 bp, Artificial sequence
  SiRNA target sequence
tagtagataatgtagaggaga

SEQ ID NO: 2350 - DNA, 21 bp, Artificial sequence
  SiRNA target sequence
agtagataatgtagaggagat

SEQ ID NO: 2351 - DNA, 21 bp, Artificial sequence
  SiRNA target sequence
gtagataatgtagaggagatg

SEQ ID NO: 2352 - DNA, 21 bp, Artificial sequence
  SiRNA target sequence
tagataatgtagaggagatgc

SEQ ID NO: 2353 - DNA, 21 bp, Artificial sequence
  SiRNA target sequence
agataatgtagaggagatgcg

SEQ ID NO: 2354 - DNA, 21 bp, Artificial sequence
  SiRNA target sequence
gataatgtagaggagatgcgt

SEQ ID NO: 2355 - DNA, 21 bp, Artificial sequence
  SiRNA target sequence
ataatgtagaggagatgcgta

SEQ ID NO: 2356 - DNA, 21 bp, Artificial sequence
  SiRNA target sequence
taatgtagaggagatgcgtaa

SEQ ID NO: 2357 - DNA, 21 bp, Artificial sequence
  SiRNA target sequence
aatgtagaggagatgcgtaat

SEQ ID NO: 2358 - DNA, 21 bp, Artificial sequence
  SiRNA target sequence
atgtagaggagatgcgtaatt

SEQ ID NO: 2359 - DNA, 21 bp, Artificial sequence
  SiRNA target sequence
tgtagaggagatgcgtaattt

SEQ ID NO: 2360 - DNA, 21 bp, Artificial sequence
  SiRNA target sequence
gtagaggagatgcgtaatttt

SEQ ID NO: 2361 - DNA, 21 bp, Artificial sequence
  SiRNA target sequence
tagaggagatgcgtaattttt

SEQ ID NO: 2362 - DNA, 21 bp, Artificial sequence
  SiRNA target sequence
agaggagatgcgtaatttttc

SEQ ID NO: 2363 - DNA, 21 bp, Artificial sequence
  SiRNA target sequence
gaggagatgcgtaatttttcc

SEQ ID NO: 2364 - DNA, 21 bp, Artificial sequence
  SiRNA target sequence
aggagatgcgtaatttttcca

SEQ ID NO: 2365 - DNA, 21 bp, Artificial sequence
  SiRNA target sequence
ggagatgcgtaatttttccaa

SEQ ID NO: 2366 - DNA, 21 bp, Artificial sequence
  SiRNA target sequence
gagatgcgtaatttttccaag

SEQ ID NO: 2367 - DNA, 21 bp, Artificial sequence
  SiRNA target sequence
agatgcgtaatttttccaaga

SEQ ID NO: 2368 - DNA, 21 bp, Artificial sequence
  SiRNA target sequence
gatgcgtaatttttccaagaa

SEQ ID NO: 2369 - DNA, 21 bp, Artificial sequence
  SiRNA target sequence
atgcgtaatttttccaagaat

SEQ ID NO: 2370 - DNA, 21 bp, Artificial sequence
  SiRNA target sequence
tgcgtaatttttccaagaata

SEQ ID NO: 2371 - DNA, 21 bp, Artificial sequence
  SiRNA target sequence
gcgtaatttttccaagaatat

SEQ ID NO: 2372 - DNA, 21 bp, Artificial sequence
  SiRNA target sequence
cgtaatttttccaagaatatt

SEQ ID NO: 2373 - DNA, 21 bp, Artificial sequence
  SiRNA target sequence
gtaatttttccaagaatattt

SEQ ID NO: 2374 - DNA, 21 bp, Artificial sequence
  SiRNA target sequence
taatttttccaagaatattta

SEQ ID NO: 2375 - DNA, 21 bp, Artificial sequence
  SiRNA target sequence
aatttttccaagaatatttac

SEQ ID NO: 2376 - DNA, 21 bp, Artificial sequence
  SiRNA target sequence
atttttccaagaatatttaca

SEQ ID NO: 2377 - DNA, 21 bp, Artificial sequence
  SiRNA target sequence
tttttccaagaatatttacat

SEQ ID NO: 2378 - DNA, 21 bp, Artificial sequence
  SiRNA target sequence
ttttccaagaatatttacatg

SEQ ID NO: 2379 - DNA, 21 bp, Artificial sequence
  SiRNA target sequence
tttccaagaatatttacatga

SEQ ID NO: 2380 - DNA, 21 bp, Artificial sequence
  SiRNA target sequence
ttccaagaatatttacatgag

SEQ ID NO: 2381 - DNA, 21 bp, Artificial sequence
  SiRNA target sequence
tccaagaatatttacatgaga

SEQ ID NO: 2382 - DNA, 21 bp, Artificial sequence
  SiRNA target sequence
ccaagaatatttacatgagaa

SEQ ID NO: 2383 - DNA, 21 bp, Artificial sequence
  SiRNA target sequence
caagaatatttacatgagaaa

SEQ ID NO: 2384 - DNA, 21 bp, Artificial sequence
  SiRNA target sequence
aagaatatttacatgagaaat

SEQ ID NO: 2385 - DNA, 21 bp, Artificial sequence
  SiRNA target sequence
agaatatttacatgagaaatg

SEQ ID NO: 2386 - DNA, 21 bp, Artificial sequence
  SiRNA target sequence
gaatatttacatgagaaatgt

SEQ ID NO: 2387 - DNA, 21 bp, Artificial sequence
  SiRNA target sequence
aatatttacatgagaaatgta

SEQ ID NO: 2388 - DNA, 21 bp, Artificial sequence
  SiRNA target sequence
atatttacatgagaaatgtag

SEQ ID NO: 2389 - DNA, 21 bp, Artificial sequence
  SiRNA target sequence
tatttacatgagaaatgtaga

SEQ ID NO: 2390 - DNA, 21 bp, Artificial sequence
  SiRNA target sequence
atttacatgagaaatgtagaa

SEQ ID NO: 2391 - DNA, 21 bp, Artificial sequence
  SiRNA target sequence
tttacatgagaaatgtagaac

SEQ ID NO: 2392 - DNA, 21 bp, Artificial sequence
  SiRNA target sequence
ttacatgagaaatgtagaaca

SEQ ID NO: 2393 - DNA, 21 bp, Artificial sequence
  SiRNA target sequence
tacatgagaaatgtagaacag

SEQ ID NO: 2394 - DNA, 21 bp, Artificial sequence
  SiRNA target sequence
acatgagaaatgtagaacagg

SEQ ID NO: 2395 - DNA, 21 bp, Artificial sequence
  SiRNA target sequence
catgagaaatgtagaacagga

SEQ ID NO: 2396 - DNA, 21 bp, Artificial sequence
  SiRNA target sequence
atgagaaatgtagaacaggaa

SEQ ID NO: 2397 - DNA, 21 bp, Artificial sequence
  SiRNA target sequence
tgagaaatgtagaacaggaat

SEQ ID NO: 2398 - DNA, 21 bp, Artificial sequence
  SiRNA target sequence
gagaaatgtagaacaggaatt

SEQ ID NO: 2399 - DNA, 21 bp, Artificial sequence
  SiRNA target sequence
agaaatgtagaacaggaattt

SEQ ID NO: 2400 - DNA, 21 bp, Artificial sequence
  SiRNA target sequence
gaaatgtagaacaggaatttt

SEQ ID NO: 2401 - DNA, 21 bp, Artificial sequence
  SiRNA target sequence
aaatgtagaacaggaattttg

SEQ ID NO: 2402 - DNA, 21 bp, Artificial sequence
  SiRNA target sequence
aatgtagaacaggaattttgg

SEQ ID NO: 2403 - DNA, 21 bp, Artificial sequence
  SiRNA target sequence
atgtagaacaggaattttggg

SEQ ID NO: 2404 - DNA, 21 bp, Artificial sequence
  SiRNA target sequence
tgtagaacaggaattttggga

SEQ ID NO: 2405 - DNA, 21 bp, Artificial sequence
  SiRNA target sequence
gtagaacaggaattttgggat

SEQ ID NO: 2406 - DNA, 21 bp, Artificial sequence
  SiRNA target sequence
tagaacaggaattttgggata

SEQ ID NO: 2407 - DNA, 21 bp, Artificial sequence
  SiRNA target sequence
agaacaggaattttgggataa

SEQ ID NO: 2408 - DNA, 21 bp, Artificial sequence
  SiRNA target sequence
gaacaggaattttgggataat

SEQ ID NO: 2409 - DNA, 21 bp, Artificial sequence
  SiRNA target sequence
aacaggaattttgggataatt

SEQ ID NO: 2410 - DNA, 21 bp, Artificial sequence
  SiRNA target sequence
acaggaattttgggataatta

SEQ ID NO: 2411 - DNA, 21 bp, Artificial sequence
  SiRNA target sequence
caggaattttgggataattat

SEQ ID NO: 2412 - DNA, 21 bp, Artificial sequence
  SiRNA target sequence
aggaattttgggataattatc

SEQ ID NO: 2413 - DNA, 21 bp, Artificial sequence
  SiRNA target sequence
ggaattttgggataattatca

SEQ ID NO: 2414 - DNA, 21 bp, Artificial sequence
  SiRNA target sequence
gaattttgggataattatcaa

SEQ ID NO: 2415 - DNA, 21 bp, Artificial sequence
  SiRNA target sequence
aattttgggataattatcaag

SEQ ID NO: 2416 - DNA, 21 bp, Artificial sequence
  SiRNA target sequence
attttgggataattatcaagg

SEQ ID NO: 2417 - DNA, 21 bp, Artificial sequence
  SiRNA target sequence
ttttgggataattatcaagga

SEQ ID NO: 2418 - DNA, 21 bp, Artificial sequence
  SiRNA target sequence
tttgggataattatcaaggac

SEQ ID NO: 2419 - DNA, 21 bp, Artificial sequence
  SiRNA target sequence
ttgggataattatcaaggaca

SEQ ID NO: 2420 - DNA, 21 bp, Artificial sequence
  SiRNA target sequence
tgggataattatcaaggacaa

SEQ ID NO: 2421 - DNA, 21 bp, Artificial sequence
  SiRNA target sequence
gggataattatcaaggacaaa

SEQ ID NO: 2422 - DNA, 21 bp, Artificial sequence
  SiRNA target sequence
ggataattatcaaggacaaaa

SEQ ID NO: 2423 - DNA, 21 bp, Artificial sequence
  SiRNA target sequence
gataattatcaaggacaaaac

SEQ ID NO: 2424 - DNA, 21 bp, Artificial sequence
  SiRNA target sequence
ataattatcaaggacaaaacg

SEQ ID NO: 2425 - DNA, 21 bp, Artificial sequence
  SiRNA target sequence
taattatcaaggacaaaacgt

SEQ ID NO: 2426 - DNA, 21 bp, Artificial sequence
  SiRNA target sequence
aattatcaaggacaaaacgtt

SEQ ID NO: 2427 - DNA, 21 bp, Artificial sequence
  SiRNA target sequence
attatcaaggacaaaacgttg

SEQ ID NO: 2428 - DNA, 21 bp, Artificial sequence
  SiRNA target sequence
ttatcaaggacaaaacgttgt

SEQ ID NO: 2429 - DNA, 21 bp, Artificial sequence
  SiRNA target sequence
tatcaaggacaaaacgttgta

SEQ ID NO: 2430 - DNA, 21 bp, Artificial sequence
  SiRNA target sequence
atcaaggacaaaacgttgtag

SEQ ID NO: 2431 - DNA, 21 bp, Artificial sequence
  SiRNA target sequence
tcaaggacaaaacgttgtagt

SEQ ID NO: 2432 - DNA, 21 bp, Artificial sequence
  SiRNA target sequence
caaggacaaaacgttgtagtt

SEQ ID NO: 2433 - DNA, 21 bp, Artificial sequence
  SiRNA target sequence
aaggacaaaacgttgtagttt

SEQ ID NO: 2434 - DNA, 21 bp, Artificial sequence
  SiRNA target sequence
aggacaaaacgttgtagttta

SEQ ID NO: 2435 - DNA, 21 bp, Artificial sequence
  SiRNA target sequence
ggacaaaacgttgtagtttat

SEQ ID NO: 2436 - DNA, 21 bp, Artificial sequence
  SiRNA target sequence
gacaaaacgttgtagtttatg

SEQ ID NO: 2437 - DNA, 21 bp, Artificial sequence
  SiRNA target sequence
acaaaacgttgtagtttatga

SEQ ID NO: 2438 - DNA, 21 bp, Artificial sequence
  SiRNA target sequence
caaaacgttgtagtttatgat

SEQ ID NO: 2439 - DNA, 21 bp, Artificial sequence
  SiRNA target sequence
aaaacgttgtagtttatgatg

SEQ ID NO: 2440 - DNA, 21 bp, Artificial sequence
  SiRNA target sequence
aaacgttgtagtttatgatga

SEQ ID NO: 2441 - DNA, 21 bp, Artificial sequence
  SiRNA target sequence
aacgttgtagtttatgatgat

SEQ ID NO: 2442 - DNA, 21 bp, Artificial sequence
  SiRNA target sequence
acgttgtagtttatgatgatt

SEQ ID NO: 2443 - DNA, 21 bp, Artificial sequence
  SiRNA target sequence
cgttgtagtttatgatgattt

SEQ ID NO: 2444 - DNA, 21 bp, Artificial sequence
  SiRNA target sequence
gttgtagtttatgatgatttt

SEQ ID NO: 2445 - DNA, 21 bp, Artificial sequence
  SiRNA target sequence
ttgtagtttatgatgattttg

SEQ ID NO: 2446 - DNA, 21 bp, Artificial sequence
  SiRNA target sequence
tgtagtttatgatgattttgg

SEQ ID NO: 2447 - DNA, 21 bp, Artificial sequence
  SiRNA target sequence
gtagtttatgatgattttgga

SEQ ID NO: 2448 - DNA, 21 bp, Artificial sequence
  SiRNA target sequence
tagtttatgatgattttggac

SEQ ID NO: 2449 - DNA, 21 bp, Artificial sequence
  SiRNA target sequence
agtttatgatgattttggaca

SEQ ID NO: 2450 - DNA, 21 bp, Artificial sequence
  SiRNA target sequence
gtttatgatgattttggacag

SEQ ID NO: 2451 - DNA, 21 bp, Artificial sequence
  SiRNA target sequence
tttatgatgattttggacaga

SEQ ID NO: 2452 - DNA, 21 bp, Artificial sequence
  SiRNA target sequence
ttatgatgattttggacagat

SEQ ID NO: 2453 - DNA, 21 bp, Artificial sequence
  SiRNA target sequence
tatgatgattttggacagatg

SEQ ID NO: 2454 - DNA, 21 bp, Artificial sequence
  SiRNA target sequence
atgatgattttggacagatga

SEQ ID NO: 2455 - DNA, 21 bp, Artificial sequence
  SiRNA target sequence
tgatgattttggacagatgag

SEQ ID NO: 2456 - DNA, 21 bp, Artificial sequence
  SiRNA target sequence
gatgattttggacagatgagg

SEQ ID NO: 2457 - DNA, 21 bp, Artificial sequence
  SiRNA target sequence
atgattttggacagatgaggg

SEQ ID NO: 2458 - DNA, 21 bp, Artificial sequence
  SiRNA target sequence
tgattttggacagatgaggga

SEQ ID NO: 2459 - DNA, 21 bp, Artificial sequence
  SiRNA target sequence
gattttggacagatgagggat

SEQ ID NO: 2460 - DNA, 21 bp, Artificial sequence
  SiRNA target sequence
attttggacagatgagggatt

SEQ ID NO: 2461 - DNA, 21 bp, Artificial sequence
  SiRNA target sequence
ttttggacagatgagggattc

SEQ ID NO: 2462 - DNA, 21 bp, Artificial sequence
  SiRNA target sequence
tttggacagatgagggattca

SEQ ID NO: 2463 - DNA, 21 bp, Artificial sequence
  SiRNA target sequence
ttggacagatgagggattcaa

SEQ ID NO: 2464 - DNA, 21 bp, Artificial sequence
  SiRNA target sequence
tggacagatgagggattcaac

SEQ ID NO: 2465 - DNA, 21 bp, Artificial sequence
  SiRNA target sequence
ggacagatgagggattcaaca

SEQ ID NO: 2466 - DNA, 21 bp, Artificial sequence
  SiRNA target sequence
gacagatgagggattcaacat

SEQ ID NO: 2467 - DNA, 21 bp, Artificial sequence
  SiRNA target sequence
acagatgagggattcaacatc

SEQ ID NO: 2468 - DNA, 21 bp, Artificial sequence
  SiRNA target sequence
cagatgagggattcaacatct

SEQ ID NO: 2469 - DNA, 21 bp, Artificial sequence
  SiRNA target sequence
agatgagggattcaacatcta

SEQ ID NO: 2470 - DNA, 21 bp, Artificial sequence
  SiRNA target sequence
gatgagggattcaacatctaa

SEQ ID NO: 2471 - DNA, 21 bp, Artificial sequence
  SiRNA target sequence
atgagggattcaacatctaat

SEQ ID NO: 2472 - DNA, 21 bp, Artificial sequence
  SiRNA target sequence
tgagggattcaacatctaatc

SEQ ID NO: 2473 - DNA, 21 bp, Artificial sequence
  SiRNA target sequence
gagggattcaacatctaatcc

SEQ ID NO: 2474 - DNA, 21 bp, Artificial sequence
  SiRNA target sequence
agggattcaacatctaatcct

SEQ ID NO: 2475 - DNA, 21 bp, Artificial sequence
  SiRNA target sequence
gggattcaacatctaatccta

SEQ ID NO: 2476 - DNA, 21 bp, Artificial sequence
  SiRNA target sequence
ggattcaacatctaatcctaa

SEQ ID NO: 2477 - DNA, 21 bp, Artificial sequence
  SiRNA target sequence
gattcaacatctaatcctaat

SEQ ID NO: 2478 - DNA, 21 bp, Artificial sequence
  SiRNA target sequence
attcaacatctaatcctaatc

SEQ ID NO: 2479 - DNA, 21 bp, Artificial sequence
  SiRNA target sequence
ttcaacatctaatcctaatcc

SEQ ID NO: 2480 - DNA, 21 bp, Artificial sequence
  SiRNA target sequence
tcaacatctaatcctaatcct

SEQ ID NO: 2481 - DNA, 21 bp, Artificial sequence
  SiRNA target sequence
caacatctaatcctaatcctg

SEQ ID NO: 2482 - DNA, 21 bp, Artificial sequence
  SiRNA target sequence
aacatctaatcctaatcctga

SEQ ID NO: 2483 - DNA, 21 bp, Artificial sequence
  SiRNA target sequence
acatctaatcctaatcctgaa

SEQ ID NO: 2484 - DNA, 21 bp, Artificial sequence
  SiRNA target sequence
catctaatcctaatcctgaat

SEQ ID NO: 2485 - DNA, 21 bp, Artificial sequence
  SiRNA target sequence
atctaatcctaatcctgaatt

SEQ ID NO: 2486 - DNA, 21 bp, Artificial sequence
  SiRNA target sequence
tctaatcctaatcctgaattc

SEQ ID NO: 2487 - DNA, 21 bp, Artificial sequence
  SiRNA target sequence
ctaatcctaatcctgaattca

SEQ ID NO: 2488 - DNA, 21 bp, Artificial sequence
  SiRNA target sequence
taatcctaatcctgaattcat

SEQ ID NO: 2489 - DNA, 21 bp, Artificial sequence
  SiRNA target sequence
aatcctaatcctgaattcatg

SEQ ID NO: 2490 - DNA, 21 bp, Artificial sequence
  SiRNA target sequence
atcctaatcctgaattcatgg

SEQ ID NO: 2491 - DNA, 21 bp, Artificial sequence
  SiRNA target sequence
tcctaatcctgaattcatgga

SEQ ID NO: 2492 - DNA, 21 bp, Artificial sequence
  SiRNA target sequence
cctaatcctgaattcatggaa

SEQ ID NO: 2493 - DNA, 21 bp, Artificial sequence
  SiRNA target sequence
ctaatcctgaattcatggaat

SEQ ID NO: 2494 - DNA, 21 bp, Artificial sequence
  SiRNA target sequence
taatcctgaattcatggaatt

SEQ ID NO: 2495 - DNA, 21 bp, Artificial sequence
  SiRNA target sequence
aatcctgaattcatggaatta

SEQ ID NO: 2496 - DNA, 21 bp, Artificial sequence
  SiRNA target sequence
atcctgaattcatggaattaa

SEQ ID NO: 2497 - DNA, 21 bp, Artificial sequence
  SiRNA target sequence
tcctgaattcatggaattaat

SEQ ID NO: 2498 - DNA, 21 bp, Artificial sequence
  SiRNA target sequence
cctgaattcatggaattaata

SEQ ID NO: 2499 - DNA, 21 bp, Artificial sequence
  SiRNA target sequence
ctgaattcatggaattaatac

SEQ ID NO: 2500 - DNA, 21 bp, Artificial sequence
  SiRNA target sequence
tgaattcatggaattaatacg

SEQ ID NO: 2501 - DNA, 21 bp, Artificial sequence
  SiRNA target sequence
gaattcatggaattaatacgc

SEQ ID NO: 2502 - DNA, 21 bp, Artificial sequence
  SiRNA target sequence
aattcatggaattaatacgca

SEQ ID NO: 2503 - DNA, 21 bp, Artificial sequence
  SiRNA target sequence
attcatggaattaatacgcac

SEQ ID NO: 2504 - DNA, 21 bp, Artificial sequence
  SiRNA target sequence
ttcatggaattaatacgcaca

SEQ ID NO: 2505 - DNA, 21 bp, Artificial sequence
  SiRNA target sequence
tcatggaattaatacgcacag

SEQ ID NO: 2506 - DNA, 21 bp, Artificial sequence
  SiRNA target sequence
catggaattaatacgcacagc

SEQ ID NO: 2507 - DNA, 21 bp, Artificial sequence
  SiRNA target sequence
atggaattaatacgcacagct

SEQ ID NO: 2508 - DNA, 21 bp, Artificial sequence
  SiRNA target sequence
tggaattaatacgcacagcta

SEQ ID NO: 2509 - DNA, 21 bp, Artificial sequence
  SiRNA target sequence
ggaattaatacgcacagctaa

SEQ ID NO: 2510 - DNA, 21 bp, Artificial sequence
  SiRNA target sequence
gaattaatacgcacagctaac

SEQ ID NO: 2511 - DNA, 21 bp, Artificial sequence
  SiRNA target sequence
aattaatacgcacagctaaca

SEQ ID NO: 2512 - DNA, 21 bp, Artificial sequence
  SiRNA target sequence
attaatacgcacagctaacat

SEQ ID NO: 2513 - DNA, 21 bp, Artificial sequence
  SiRNA target sequence
ttaatacgcacagctaacata

SEQ ID NO: 2514 - DNA, 21 bp, Artificial sequence
  SiRNA target sequence
taatacgcacagctaacatag

SEQ ID NO: 2515 - DNA, 21 bp, Artificial sequence
  SiRNA target sequence
aatacgcacagctaacatagc

SEQ ID NO: 2516 - DNA, 21 bp, Artificial sequence
  SiRNA target sequence
atacgcacagctaacatagcc

SEQ ID NO: 2517 - DNA, 21 bp, Artificial sequence
  SiRNA target sequence
tacgcacagctaacatagccc

SEQ ID NO: 2518 - DNA, 21 bp, Artificial sequence
  SiRNA target sequence
acgcacagctaacatagcccc

SEQ ID NO: 2519 - DNA, 21 bp, Artificial sequence
  SiRNA target sequence
cgcacagctaacatagcccct

SEQ ID NO: 2520 - DNA, 21 bp, Artificial sequence
  SiRNA target sequence
gcacagctaacatagcccctt

SEQ ID NO: 2521 - DNA, 21 bp, Artificial sequence
  SiRNA target sequence
cacagctaacatagcccctta

SEQ ID NO: 2522 - DNA, 21 bp, Artificial sequence
  SiRNA target sequence
acagctaacatagccccttat

SEQ ID NO: 2523 - DNA, 21 bp, Artificial sequence
  SiRNA target sequence
cagctaacatagccccttatc

SEQ ID NO: 2524 - DNA, 21 bp, Artificial sequence
  SiRNA target sequence
agctaacatagccccttatcc

SEQ ID NO: 2525 - DNA, 21 bp, Artificial sequence
  SiRNA target sequence
gctaacatagccccttatcct

SEQ ID NO: 2526 - DNA, 21 bp, Artificial sequence
  SiRNA target sequence
ctaacatagccccttatcctt

SEQ ID NO: 2527 - DNA, 21 bp, Artificial sequence
  SiRNA target sequence
taacatagccccttatccttt

SEQ ID NO: 2528 - DNA, 21 bp, Artificial sequence
  SiRNA target sequence
aacatagccccttatccttta

SEQ ID NO: 2529 - DNA, 21 bp, Artificial sequence
  SiRNA target sequence
acatagccccttatcctttac

SEQ ID NO: 2530 - DNA, 21 bp, Artificial sequence
  SiRNA target sequence
catagccccttatcctttaca

SEQ ID NO: 2531 - DNA, 21 bp, Artificial sequence
  SiRNA target sequence
atagccccttatcctttacat

SEQ ID NO: 2532 - DNA, 21 bp, Artificial sequence
  SiRNA target sequence
tagccccttatcctttacata

SEQ ID NO: 2533 - DNA, 21 bp, Artificial sequence
  SiRNA target sequence
agccccttatcctttacatat

SEQ ID NO: 2534 - DNA, 21 bp, Artificial sequence
  SiRNA target sequence
gccccttatcctttacatatg

SEQ ID NO: 2535 - DNA, 21 bp, Artificial sequence
  SiRNA target sequence
ccccttatcctttacatatgg

SEQ ID NO: 2536 - DNA, 21 bp, Artificial sequence
  SiRNA target sequence
cccttatcctttacatatggc

SEQ ID NO: 2537 - DNA, 21 bp, Artificial sequence
  SiRNA target sequence
ccttatcctttacatatggct

SEQ ID NO: 2538 - DNA, 21 bp, Artificial sequence
  SiRNA target sequence
cttatcctttacatatggctc

SEQ ID NO: 2539 - DNA, 21 bp, Artificial sequence
  SiRNA target sequence
ttatcctttacatatggctca

SEQ ID NO: 2540 - DNA, 21 bp, Artificial sequence
  SiRNA target sequence
tatcctttacatatggctcat

SEQ ID NO: 2541 - DNA, 21 bp, Artificial sequence
  SiRNA target sequence
atcctttacatatggctcatt

SEQ ID NO: 2542 - DNA, 21 bp, Artificial sequence
  SiRNA target sequence
tcctttacatatggctcattt

SEQ ID NO: 2543 - DNA, 21 bp, Artificial sequence
  SiRNA target sequence
cctttacatatggctcattta

SEQ ID NO: 2544 - DNA, 21 bp, Artificial sequence
  SiRNA target sequence
ctttacatatggctcatttag

SEQ ID NO: 2545 - DNA, 21 bp, Artificial sequence
  SiRNA target sequence
tttacatatggctcatttaga

SEQ ID NO: 2546 - DNA, 21 bp, Artificial sequence
  SiRNA target sequence
ttacatatggctcatttagaa

SEQ ID NO: 2547 - DNA, 21 bp, Artificial sequence
  SiRNA target sequence
tacatatggctcatttagaag

SEQ ID NO: 2548 - DNA, 21 bp, Artificial sequence
  SiRNA target sequence
acatatggctcatttagaaga

SEQ ID NO: 2549 - DNA, 21 bp, Artificial sequence
  SiRNA target sequence
catatggctcatttagaagat

SEQ ID NO: 2550 - DNA, 21 bp, Artificial sequence
  SiRNA target sequence
atatggctcatttagaagata

SEQ ID NO: 2551 - DNA, 21 bp, Artificial sequence
  SiRNA target sequence
tatggctcatttagaagataa

SEQ ID NO: 2552 - DNA, 21 bp, Artificial sequence
  SiRNA target sequence
atggctcatttagaagataag

SEQ ID NO: 2553 - DNA, 21 bp, Artificial sequence
  SiRNA target sequence
tggctcatttagaagataagc

SEQ ID NO: 2554 - DNA, 21 bp, Artificial sequence
  SiRNA target sequence
ggctcatttagaagataagcg

SEQ ID NO: 2555 - DNA, 21 bp, Artificial sequence
  SiRNA target sequence
gctcatttagaagataagcgt

SEQ ID NO: 2556 - DNA, 21 bp, Artificial sequence
  SiRNA target sequence
ctcatttagaagataagcgta

SEQ ID NO: 2557 - DNA, 21 bp, Artificial sequence
  SiRNA target sequence
tcatttagaagataagcgtaa

SEQ ID NO: 2558 - DNA, 21 bp, Artificial sequence
  SiRNA target sequence
catttagaagataagcgtaaa

SEQ ID NO: 2559 - DNA, 21 bp, Artificial sequence
  SiRNA target sequence
atttagaagataagcgtaaaa

SEQ ID NO: 2560 - DNA, 21 bp, Artificial sequence
  SiRNA target sequence
tttagaagataagcgtaaaac

SEQ ID NO: 2561 - DNA, 21 bp, Artificial sequence
  SiRNA target sequence
ttagaagataagcgtaaaact

SEQ ID NO: 2562 - DNA, 21 bp, Artificial sequence
  SiRNA target sequence
tagaagataagcgtaaaacta

SEQ ID NO: 2563 - DNA, 21 bp, Artificial sequence
  SiRNA target sequence
agaagataagcgtaaaactaa

SEQ ID NO: 2564 - DNA, 21 bp, Artificial sequence
  SiRNA target sequence
gaagataagcgtaaaactaaa

SEQ ID NO: 2565 - DNA, 21 bp, Artificial sequence
  SiRNA target sequence
aagataagcgtaaaactaaat

SEQ ID NO: 2566 - DNA, 21 bp, Artificial sequence
  SiRNA target sequence
agataagcgtaaaactaaatt

SEQ ID NO: 2567 - DNA, 21 bp, Artificial sequence
  SiRNA target sequence
gataagcgtaaaactaaattt

SEQ ID NO: 2568 - DNA, 21 bp, Artificial sequence
  SiRNA target sequence
ataagcgtaaaactaaattta

SEQ ID NO: 2569 - DNA, 21 bp, Artificial sequence
  SiRNA target sequence
taagcgtaaaactaaatttac

SEQ ID NO: 2570 - DNA, 21 bp, Artificial sequence
  SiRNA target sequence
aagcgtaaaactaaatttaca

SEQ ID NO: 2571 - DNA, 21 bp, Artificial sequence
  SiRNA target sequence
agcgtaaaactaaatttacat

SEQ ID NO: 2572 - DNA, 21 bp, Artificial sequence
  SiRNA target sequence
gcgtaaaactaaatttacatc

SEQ ID NO: 2573 - DNA, 21 bp, Artificial sequence
  SiRNA target sequence
cgtaaaactaaatttacatct

SEQ ID NO: 2574 - DNA, 21 bp, Artificial sequence
  SiRNA target sequence
gtaaaactaaatttacatcta

SEQ ID NO: 2575 - DNA, 21 bp, Artificial sequence
  SiRNA target sequence
taaaactaaatttacatctaa

SEQ ID NO: 2576 - DNA, 21 bp, Artificial sequence
  SiRNA target sequence
aaaactaaatttacatctaaa

SEQ ID NO: 2577 - DNA, 21 bp, Artificial sequence
  SiRNA target sequence
aaactaaatttacatctaaag

SEQ ID NO: 2578 - DNA, 21 bp, Artificial sequence
  SiRNA target sequence
aactaaatttacatctaaagt

SEQ ID NO: 2579 - DNA, 21 bp, Artificial sequence
  SiRNA target sequence
actaaatttacatctaaagta

SEQ ID NO: 2580 - DNA, 21 bp, Artificial sequence
  SiRNA target sequence
ctaaatttacatctaaagtaa

SEQ ID NO: 2581 - DNA, 21 bp, Artificial sequence
  SiRNA target sequence
taaatttacatctaaagtaat

SEQ ID NO: 2582 - DNA, 21 bp, Artificial sequence
  SiRNA target sequence
aaatttacatctaaagtaatt

SEQ ID NO: 2583 - DNA, 21 bp, Artificial sequence
  SiRNA target sequence
aatttacatctaaagtaatta

SEQ ID NO: 2584 - DNA, 21 bp, Artificial sequence
  SiRNA target sequence
atttacatctaaagtaattat

SEQ ID NO: 2585 - DNA, 21 bp, Artificial sequence
  SiRNA target sequence
tttacatctaaagtaattatc

SEQ ID NO: 2586 - DNA, 21 bp, Artificial sequence
  SiRNA target sequence
ttacatctaaagtaattatca

SEQ ID NO: 2587 - DNA, 21 bp, Artificial sequence
  SiRNA target sequence
tacatctaaagtaattatcat

SEQ ID NO: 2588 - DNA, 21 bp, Artificial sequence
  SiRNA target sequence
acatctaaagtaattatcatg

SEQ ID NO: 2589 - DNA, 21 bp, Artificial sequence
  SiRNA target sequence
catctaaagtaattatcatga

SEQ ID NO: 2590 - DNA, 21 bp, Artificial sequence
  SiRNA target sequence
atctaaagtaattatcatgac

SEQ ID NO: 2591 - DNA, 21 bp, Artificial sequence
  SiRNA target sequence
tctaaagtaattatcatgaca

SEQ ID NO: 2592 - DNA, 21 bp, Artificial sequence
  SiRNA target sequence
ctaaagtaattatcatgacat

SEQ ID NO: 2593 - DNA, 21 bp, Artificial sequence
  SiRNA target sequence
taaagtaattatcatgacatc

SEQ ID NO: 2594 - DNA, 21 bp, Artificial sequence
  SiRNA target sequence
aaagtaattatcatgacatct

SEQ ID NO: 2595 - DNA, 21 bp, Artificial sequence
  SiRNA target sequence
aagtaattatcatgacatcta

SEQ ID NO: 2596 - DNA, 21 bp, Artificial sequence
  SiRNA target sequence
agtaattatcatgacatctaa

SEQ ID NO: 2597 - DNA, 21 bp, Artificial sequence
  SiRNA target sequence
gtaattatcatgacatctaat

SEQ ID NO: 2598 - DNA, 21 bp, Artificial sequence
  SiRNA target sequence
taattatcatgacatctaatg

SEQ ID NO: 2599 - DNA, 21 bp, Artificial sequence
  SiRNA target sequence
aattatcatgacatctaatgt

SEQ ID NO: 2600 - DNA, 21 bp, Artificial sequence
  SiRNA target sequence
attatcatgacatctaatgtt

SEQ ID NO: 2601 - DNA, 21 bp, Artificial sequence
  SiRNA target sequence
ttatcatgacatctaatgttt

SEQ ID NO: 2602 - DNA, 21 bp, Artificial sequence
  SiRNA target sequence
tatcatgacatctaatgtttt

SEQ ID NO: 2603 - DNA, 21 bp, Artificial sequence
  SiRNA target sequence
atcatgacatctaatgttttt

SEQ ID NO: 2604 - DNA, 21 bp, Artificial sequence
  SiRNA target sequence
tcatgacatctaatgtttttg

SEQ ID NO: 2605 - DNA, 21 bp, Artificial sequence
  SiRNA target sequence
catgacatctaatgtttttga

SEQ ID NO: 2606 - DNA, 21 bp, Artificial sequence
  SiRNA target sequence
atgacatctaatgtttttgaa

SEQ ID NO: 2607 - DNA, 21 bp, Artificial sequence
  SiRNA target sequence
tgacatctaatgtttttgaac

SEQ ID NO: 2608 - DNA, 21 bp, Artificial sequence
  SiRNA target sequence
gacatctaatgtttttgaaca

SEQ ID NO: 2609 - DNA, 21 bp, Artificial sequence
  SiRNA target sequence
acatctaatgtttttgaacag

SEQ ID NO: 2610 - DNA, 21 bp, Artificial sequence
  SiRNA target sequence
catctaatgtttttgaacagt

SEQ ID NO: 2611 - DNA, 21 bp, Artificial sequence
  SiRNA target sequence
atctaatgtttttgaacagtc

SEQ ID NO: 2612 - DNA, 21 bp, Artificial sequence
  SiRNA target sequence
tctaatgtttttgaacagtca

SEQ ID NO: 2613 - DNA, 21 bp, Artificial sequence
  SiRNA target sequence
ctaatgtttttgaacagtcag

SEQ ID NO: 2614 - DNA, 21 bp, Artificial sequence
  SiRNA target sequence
taatgtttttgaacagtcagt

SEQ ID NO: 2615 - DNA, 21 bp, Artificial sequence
  SiRNA target sequence
aatgtttttgaacagtcagtt

SEQ ID NO: 2616 - DNA, 21 bp, Artificial sequence
  SiRNA target sequence
atgtttttgaacagtcagtta

SEQ ID NO: 2617 - DNA, 21 bp, Artificial sequence
  SiRNA target sequence
tgtttttgaacagtcagttaa

SEQ ID NO: 2618 - DNA, 21 bp, Artificial sequence
  SiRNA target sequence
gtttttgaacagtcagttaat

SEQ ID NO: 2619 - DNA, 21 bp, Artificial sequence
  SiRNA target sequence
tttttgaacagtcagttaatt

SEQ ID NO: 2620 - DNA, 21 bp, Artificial sequence
  SiRNA target sequence
ttttgaacagtcagttaattc

SEQ ID NO: 2621 - DNA, 21 bp, Artificial sequence
  SiRNA target sequence
tttgaacagtcagttaattcg

SEQ ID NO: 2622 - DNA, 21 bp, Artificial sequence
  SiRNA target sequence
ttgaacagtcagttaattcgt

SEQ ID NO: 2623 - DNA, 21 bp, Artificial sequence
  SiRNA target sequence
tgaacagtcagttaattcgtt

SEQ ID NO: 2624 - DNA, 21 bp, Artificial sequence
  SiRNA target sequence
gaacagtcagttaattcgtta

SEQ ID NO: 2625 - DNA, 21 bp, Artificial sequence
  SiRNA target sequence
aacagtcagttaattcgttaa

SEQ ID NO: 2626 - DNA, 21 bp, Artificial sequence
  SiRNA target sequence
acagtcagttaattcgttaac

SEQ ID NO: 2627 - DNA, 21 bp, Artificial sequence
  SiRNA target sequence
cagtcagttaattcgttaact

SEQ ID NO: 2628 - DNA, 21 bp, Artificial sequence
  SiRNA target sequence
agtcagttaattcgttaactt

SEQ ID NO: 2629 - DNA, 21 bp, Artificial sequence
  SiRNA target sequence
gtcagttaattcgttaacttt

SEQ ID NO: 2630 - DNA, 21 bp, Artificial sequence
  SiRNA target sequence
tcagttaattcgttaactttt

SEQ ID NO: 2631 - DNA, 21 bp, Artificial sequence
  SiRNA target sequence
cagttaattcgttaacttttc

SEQ ID NO: 2632 - DNA, 21 bp, Artificial sequence
  SiRNA target sequence
agttaattcgttaacttttcc

SEQ ID NO: 2633 - DNA, 21 bp, Artificial sequence
  SiRNA target sequence
gttaattcgttaacttttcct

SEQ ID NO: 2634 - DNA, 21 bp, Artificial sequence
  SiRNA target sequence
ttaattcgttaacttttcctg

SEQ ID NO: 2635 - DNA, 21 bp, Artificial sequence
  SiRNA target sequence
taattcgttaacttttcctga

SEQ ID NO: 2636 - DNA, 21 bp, Artificial sequence
  SiRNA target sequence
aattcgttaacttttcctgat

SEQ ID NO: 2637 - DNA, 21 bp, Artificial sequence
  SiRNA target sequence
attcgttaacttttcctgatg

SEQ ID NO: 2638 - DNA, 21 bp, Artificial sequence
  SiRNA target sequence
ttcgttaacttttcctgatgc

SEQ ID NO: 2639 - DNA, 21 bp, Artificial sequence
  SiRNA target sequence
tcgttaacttttcctgatgct

SEQ ID NO: 2640 - DNA, 21 bp, Artificial sequence
  SiRNA target sequence
cgttaacttttcctgatgctt

SEQ ID NO: 2641 - DNA, 21 bp, Artificial sequence
  SiRNA target sequence
gttaacttttcctgatgcttt

SEQ ID NO: 2642 - DNA, 21 bp, Artificial sequence
  SiRNA target sequence
ttaacttttcctgatgctttt

SEQ ID NO: 2643 - DNA, 21 bp, Artificial sequence
  SiRNA target sequence
taacttttcctgatgctttta

SEQ ID NO: 2644 - DNA, 21 bp, Artificial sequence
  SiRNA target sequence
aacttttcctgatgcttttag

SEQ ID NO: 2645 - DNA, 21 bp, Artificial sequence
  SiRNA target sequence
acttttcctgatgcttttaga

SEQ ID NO: 2646 - DNA, 21 bp, Artificial sequence
  SiRNA target sequence
cttttcctgatgcttttagac

SEQ ID NO: 2647 - DNA, 21 bp, Artificial sequence
  SiRNA target sequence
ttttcctgatgcttttagacg

SEQ ID NO: 2648 - DNA, 21 bp, Artificial sequence
  SiRNA target sequence
tttcctgatgcttttagacgc

SEQ ID NO: 2649 - DNA, 21 bp, Artificial sequence
  SiRNA target sequence
ttcctgatgcttttagacgca

SEQ ID NO: 2650 - DNA, 21 bp, Artificial sequence
  SiRNA target sequence
tcctgatgcttttagacgcag

SEQ ID NO: 2651 - DNA, 21 bp, Artificial sequence
  SiRNA target sequence
cctgatgcttttagacgcaga

SEQ ID NO: 2652 - DNA, 21 bp, Artificial sequence
  SiRNA target sequence
ctgatgcttttagacgcagag

SEQ ID NO: 2653 - DNA, 21 bp, Artificial sequence
  SiRNA target sequence
tgatgcttttagacgcagagt

SEQ ID NO: 2654 - DNA, 21 bp, Artificial sequence
  SiRNA target sequence
gatgcttttagacgcagagtt

SEQ ID NO: 2655 - DNA, 21 bp, Artificial sequence
  SiRNA target sequence
atgcttttagacgcagagttg

SEQ ID NO: 2656 - DNA, 21 bp, Artificial sequence
  SiRNA target sequence
tgcttttagacgcagagttga

SEQ ID NO: 2657 - DNA, 21 bp, Artificial sequence
  SiRNA target sequence
gcttttagacgcagagttgat

SEQ ID NO: 2658 - DNA, 21 bp, Artificial sequence
  SiRNA target sequence
cttttagacgcagagttgatc

SEQ ID NO: 2659 - DNA, 21 bp, Artificial sequence
  SiRNA target sequence
ttttagacgcagagttgatct

SEQ ID NO: 2660 - DNA, 21 bp, Artificial sequence
  SiRNA target sequence
tttagacgcagagttgatctg

SEQ ID NO: 2661 - DNA, 21 bp, Artificial sequence
  SiRNA target sequence
ttagacgcagagttgatctgt

SEQ ID NO: 2662 - DNA, 21 bp, Artificial sequence
  SiRNA target sequence
tagacgcagagttgatctgtg

SEQ ID NO: 2663 - DNA, 21 bp, Artificial sequence
  SiRNA target sequence
agacgcagagttgatctgtgt

SEQ ID NO: 2664 - DNA, 21 bp, Artificial sequence
  SiRNA target sequence
gacgcagagttgatctgtgtg

SEQ ID NO: 2665 - DNA, 21 bp, Artificial sequence
  SiRNA target sequence
acgcagagttgatctgtgtgc

SEQ ID NO: 2666 - DNA, 21 bp, Artificial sequence
  SiRNA target sequence
cgcagagttgatctgtgtgct

SEQ ID NO: 2667 - DNA, 21 bp, Artificial sequence
  SiRNA target sequence
gcagagttgatctgtgtgctg

SEQ ID NO: 2668 - DNA, 21 bp, Artificial sequence
  SiRNA target sequence
cagagttgatctgtgtgctga

SEQ ID NO: 2669 - DNA, 21 bp, Artificial sequence
  SiRNA target sequence
agagttgatctgtgtgctgaa

SEQ ID NO: 2670 - DNA, 21 bp, Artificial sequence
  SiRNA target sequence
gagttgatctgtgtgctgaag

SEQ ID NO: 2671 - DNA, 21 bp, Artificial sequence
  SiRNA target sequence
agttgatctgtgtgctgaagt

SEQ ID NO: 2672 - DNA, 21 bp, Artificial sequence
  SiRNA target sequence
gttgatctgtgtgctgaagta

SEQ ID NO: 2673 - DNA, 21 bp, Artificial sequence
  SiRNA target sequence
ttgatctgtgtgctgaagtac

SEQ ID NO: 2674 - DNA, 21 bp, Artificial sequence
  SiRNA target sequence
tgatctgtgtgctgaagtacg

SEQ ID NO: 2675 - DNA, 21 bp, Artificial sequence
  SiRNA target sequence
gatctgtgtgctgaagtacgt

SEQ ID NO: 2676 - DNA, 21 bp, Artificial sequence
  SiRNA target sequence
atctgtgtgctgaagtacgta

SEQ ID NO: 2677 - DNA, 21 bp, Artificial sequence
  SiRNA target sequence
tctgtgtgctgaagtacgtaa

SEQ ID NO: 2678 - DNA, 21 bp, Artificial sequence
  SiRNA target sequence
ctgtgtgctgaagtacgtaat

SEQ ID NO: 2679 - DNA, 21 bp, Artificial sequence
  SiRNA target sequence
tgtgtgctgaagtacgtaata

SEQ ID NO: 2680 - DNA, 21 bp, Artificial sequence
  SiRNA target sequence
gtgtgctgaagtacgtaataa

SEQ ID NO: 2681 - DNA, 21 bp, Artificial sequence
  SiRNA target sequence
tgtgctgaagtacgtaataag

SEQ ID NO: 2682 - DNA, 21 bp, Artificial sequence
  SiRNA target sequence
gtgctgaagtacgtaataagg

SEQ ID NO: 2683 - DNA, 21 bp, Artificial sequence
  SiRNA target sequence
tgctgaagtacgtaataaggt

SEQ ID NO: 2684 - DNA, 21 bp, Artificial sequence
  SiRNA target sequence
gctgaagtacgtaataaggtt

SEQ ID NO: 2685 - DNA, 21 bp, Artificial sequence
  SiRNA target sequence
ctgaagtacgtaataaggttg

SEQ ID NO: 2686 - DNA, 21 bp, Artificial sequence
  SiRNA target sequence
tgaagtacgtaataaggttga

SEQ ID NO: 2687 - DNA, 21 bp, Artificial sequence
  SiRNA target sequence
gaagtacgtaataaggttgag

SEQ ID NO: 2688 - DNA, 21 bp, Artificial sequence
  SiRNA target sequence
aagtacgtaataaggttgagt

SEQ ID NO: 2689 - DNA, 21 bp, Artificial sequence
  SiRNA target sequence
agtacgtaataaggttgagtt

SEQ ID NO: 2690 - DNA, 21 bp, Artificial sequence
  SiRNA target sequence
gtacgtaataaggttgagttt

SEQ ID NO: 2691 - DNA, 21 bp, Artificial sequence
  SiRNA target sequence
tacgtaataaggttgagttta

SEQ ID NO: 2692 - DNA, 21 bp, Artificial sequence
  SiRNA target sequence
acgtaataaggttgagtttac

SEQ ID NO: 2693 - DNA, 21 bp, Artificial sequence
  SiRNA target sequence
cgtaataaggttgagtttacg

SEQ ID NO: 2694 - DNA, 21 bp, Artificial sequence
  SiRNA target sequence
gtaataaggttgagtttacga

SEQ ID NO: 2695 - DNA, 21 bp, Artificial sequence
  SiRNA target sequence
taataaggttgagtttacgaa

SEQ ID NO: 2696 - DNA, 21 bp, Artificial sequence
  SiRNA target sequence
aataaggttgagtttacgaag

SEQ ID NO: 2697 - DNA, 21 bp, Artificial sequence
  SiRNA target sequence
ataaggttgagtttacgaagg

SEQ ID NO: 2698 - DNA, 21 bp, Artificial sequence
  SiRNA target sequence
taaggttgagtttacgaagga

SEQ ID NO: 2699 - DNA, 21 bp, Artificial sequence
  SiRNA target sequence
aaggttgagtttacgaaggaa

SEQ ID NO: 2700 - DNA, 21 bp, Artificial sequence
  SiRNA target sequence
aggttgagtttacgaaggaag

SEQ ID NO: 2701 - DNA, 21 bp, Artificial sequence
  SiRNA target sequence
ggttgagtttacgaaggaagg

SEQ ID NO: 2702 - DNA, 21 bp, Artificial sequence
  SiRNA target sequence
gttgagtttacgaaggaagga

SEQ ID NO: 2703 - DNA, 21 bp, Artificial sequence
  SiRNA target sequence
ttgagtttacgaaggaaggat

SEQ ID NO: 2704 - DNA, 21 bp, Artificial sequence
  SiRNA target sequence
tgagtttacgaaggaaggata

SEQ ID NO: 2705 - DNA, 21 bp, Artificial sequence
  SiRNA target sequence
gagtttacgaaggaaggatat

SEQ ID NO: 2706 - DNA, 21 bp, Artificial sequence
  SiRNA target sequence
agtttacgaaggaaggatatt

SEQ ID NO: 2707 - DNA, 21 bp, Artificial sequence
  SiRNA target sequence
gtttacgaaggaaggatattc

SEQ ID NO: 2708 - DNA, 21 bp, Artificial sequence
  SiRNA target sequence
tttacgaaggaaggatattca

SEQ ID NO: 2709 - DNA, 21 bp, Artificial sequence
  SiRNA target sequence
ttacgaaggaaggatattcaa

SEQ ID NO: 2710 - DNA, 21 bp, Artificial sequence
  SiRNA target sequence
tacgaaggaaggatattcaaa

SEQ ID NO: 2711 - DNA, 21 bp, Artificial sequence
  SiRNA target sequence
acgaaggaaggatattcaaag

SEQ ID NO: 2712 - DNA, 21 bp, Artificial sequence
  SiRNA target sequence
cgaaggaaggatattcaaaga

SEQ ID NO: 2713 - DNA, 21 bp, Artificial sequence
  SiRNA target sequence
gaaggaaggatattcaaagac

SEQ ID NO: 2714 - DNA, 21 bp, Artificial sequence
  SiRNA target sequence
aaggaaggatattcaaagact

SEQ ID NO: 2715 - DNA, 21 bp, Artificial sequence
  SiRNA target sequence
aggaaggatattcaaagacta

SEQ ID NO: 2716 - DNA, 21 bp, Artificial sequence
  SiRNA target sequence
ggaaggatattcaaagactaa

SEQ ID NO: 2717 - DNA, 21 bp, Artificial sequence
  SiRNA target sequence
gaaggatattcaaagactaaa

SEQ ID NO: 2718 - DNA, 21 bp, Artificial sequence
  SiRNA target sequence
aaggatattcaaagactaaag

SEQ ID NO: 2719 - DNA, 21 bp, Artificial sequence
  SiRNA target sequence
aggatattcaaagactaaagg

SEQ ID NO: 2720 - DNA, 21 bp, Artificial sequence
  SiRNA target sequence
ggatattcaaagactaaagga

SEQ ID NO: 2721 - DNA, 21 bp, Artificial sequence
  SiRNA target sequence
gatattcaaagactaaaggat

SEQ ID NO: 2722 - DNA, 21 bp, Artificial sequence
  SiRNA target sequence
atattcaaagactaaaggatg

SEQ ID NO: 2723 - DNA, 21 bp, Artificial sequence
  SiRNA target sequence
tattcaaagactaaaggatgc

SEQ ID NO: 2724 - DNA, 21 bp, Artificial sequence
  SiRNA target sequence
attcaaagactaaaggatgca

SEQ ID NO: 2725 - DNA, 21 bp, Artificial sequence
  SiRNA target sequence
ttcaaagactaaaggatgcat

SEQ ID NO: 2726 - DNA, 21 bp, Artificial sequence
  SiRNA target sequence
tcaaagactaaaggatgcatg

SEQ ID NO: 2727 - DNA, 21 bp, Artificial sequence
  SiRNA target sequence
caaagactaaaggatgcatgg

SEQ ID NO: 2728 - DNA, 21 bp, Artificial sequence
  SiRNA target sequence
aaagactaaaggatgcatggt

SEQ ID NO: 2729 - DNA, 21 bp, Artificial sequence
  SiRNA target sequence
aagactaaaggatgcatggta

SEQ ID NO: 2730 - DNA, 21 bp, Artificial sequence
  SiRNA target sequence
agactaaaggatgcatggtaa

SEQ ID NO: 2731 - DNA, 21 bp, Artificial sequence
  SiRNA target sequence
gactaaaggatgcatggtaag

SEQ ID NO: 2732 - DNA, 21 bp, Artificial sequence
  SiRNA target sequence
actaaaggatgcatggtaaga

SEQ ID NO: 2733 - DNA, 21 bp, Artificial sequence
  SiRNA target sequence
ctaaaggatgcatggtaagac

SEQ ID NO: 2734 - DNA, 21 bp, Artificial sequence
  SiRNA target sequence
taaaggatgcatggtaagacg

SEQ ID NO: 2735 - DNA, 21 bp, Artificial sequence
  SiRNA target sequence
aaaggatgcatggtaagacgc

SEQ ID NO: 2736 - DNA, 21 bp, Artificial sequence
  SiRNA target sequence
aaggatgcatggtaagacgct

SEQ ID NO: 2737 - DNA, 21 bp, Artificial sequence
  SiRNA target sequence
aggatgcatggtaagacgctt

SEQ ID NO: 2738 - DNA, 21 bp, Artificial sequence
  SiRNA target sequence
ggatgcatggtaagacgcttg

SEQ ID NO: 2739 - DNA, 21 bp, Artificial sequence
  SiRNA target sequence
gatgcatggtaagacgcttgg

SEQ ID NO: 2740 - DNA, 21 bp, Artificial sequence
  SiRNA target sequence
atgcatggtaagacgcttgga

SEQ ID NO: 2741 - DNA, 21 bp, Artificial sequence
  SiRNA target sequence
tgcatggtaagacgcttggat

SEQ ID NO: 2742 - DNA, 21 bp, Artificial sequence
  SiRNA target sequence
gcatggtaagacgcttggata

SEQ ID NO: 2743 - DNA, 21 bp, Artificial sequence
  SiRNA target sequence
catggtaagacgcttggataa

SEQ ID NO: 2744 - DNA, 21 bp, Artificial sequence
  SiRNA target sequence
atggtaagacgcttggataag

SEQ ID NO: 2745 - DNA, 21 bp, Artificial sequence
  SiRNA target sequence
tggtaagacgcttggataagg

SEQ ID NO: 2746 - DNA, 21 bp, Artificial sequence
  SiRNA target sequence
ggtaagacgcttggataagga

SEQ ID NO: 2747 - DNA, 21 bp, Artificial sequence
  SiRNA target sequence
gtaagacgcttggataaggat

SEQ ID NO: 2748 - DNA, 21 bp, Artificial sequence
  SiRNA target sequence
taagacgcttggataaggatt

SEQ ID NO: 2749 - DNA, 21 bp, Artificial sequence
  SiRNA target sequence
aagacgcttggataaggattt

SEQ ID NO: 2750 - DNA, 21 bp, Artificial sequence
  SiRNA target sequence
agacgcttggataaggattta

SEQ ID NO: 2751 - DNA, 21 bp, Artificial sequence
  SiRNA target sequence
gacgcttggataaggatttag

SEQ ID NO: 2752 - DNA, 21 bp, Artificial sequence
  SiRNA target sequence
acgcttggataaggatttagt

SEQ ID NO: 2753 - DNA, 21 bp, Artificial sequence
  SiRNA target sequence
cgcttggataaggatttagtt

SEQ ID NO: 2754 - DNA, 21 bp, Artificial sequence
  SiRNA target sequence
gcttggataaggatttagtta

SEQ ID NO: 2755 - DNA, 21 bp, Artificial sequence
  SiRNA target sequence
cttggataaggatttagttaa

SEQ ID NO: 2756 - DNA, 21 bp, Artificial sequence
  SiRNA target sequence
ttggataaggatttagttaag

SEQ ID NO: 2757 - DNA, 21 bp, Artificial sequence
  SiRNA target sequence
tggataaggatttagttaaga

SEQ ID NO: 2758 - DNA, 21 bp, Artificial sequence
  SiRNA target sequence
ggataaggatttagttaagaa

SEQ ID NO: 2759 - DNA, 21 bp, Artificial sequence
  SiRNA target sequence
gataaggatttagttaagaag

SEQ ID NO: 2760 - DNA, 21 bp, Artificial sequence
  SiRNA target sequence
ataaggatttagttaagaaga

SEQ ID NO: 2761 - DNA, 21 bp, Artificial sequence
  SiRNA target sequence
taaggatttagttaagaagaa

SEQ ID NO: 2762 - DNA, 21 bp, Artificial sequence
  SiRNA target sequence
aaggatttagttaagaagaag

SEQ ID NO: 2763 - DNA, 21 bp, Artificial sequence
  SiRNA target sequence
aggatttagttaagaagaaga

SEQ ID NO: 2764 - DNA, 21 bp, Artificial sequence
  SiRNA target sequence
ggatttagttaagaagaagac

SEQ ID NO: 2765 - DNA, 21 bp, Artificial sequence
  SiRNA target sequence
gatttagttaagaagaagact

SEQ ID NO: 2766 - DNA, 21 bp, Artificial sequence
  SiRNA target sequence
atttagttaagaagaagactg

SEQ ID NO: 2767 - DNA, 21 bp, Artificial sequence
  SiRNA target sequence
tttagttaagaagaagactgg

SEQ ID NO: 2768 - DNA, 21 bp, Artificial sequence
  SiRNA target sequence
ttagttaagaagaagactgga

SEQ ID NO: 2769 - DNA, 21 bp, Artificial sequence
  SiRNA target sequence
tagttaagaagaagactggag

SEQ ID NO: 2770 - DNA, 21 bp, Artificial sequence
  SiRNA target sequence
agttaagaagaagactggaga

SEQ ID NO: 2771 - DNA, 21 bp, Artificial sequence
  SiRNA target sequence
gttaagaagaagactggagac

SEQ ID NO: 2772 - DNA, 21 bp, Artificial sequence
  SiRNA target sequence
ttaagaagaagactggagaca

SEQ ID NO: 2773 - DNA, 21 bp, Artificial sequence
  SiRNA target sequence
taagaagaagactggagacat

SEQ ID NO: 2774 - DNA, 21 bp, Artificial sequence
  SiRNA target sequence
aagaagaagactggagacata

SEQ ID NO: 2775 - DNA, 21 bp, Artificial sequence
  SiRNA target sequence
agaagaagactggagacatat

SEQ ID NO: 2776 - DNA, 21 bp, Artificial sequence
  SiRNA target sequence
gaagaagactggagacatatg

SEQ ID NO: 2777 - DNA, 21 bp, Artificial sequence
  SiRNA target sequence
aagaagactggagacatatgt

SEQ ID NO: 2778 - DNA, 21 bp, Artificial sequence
  SiRNA target sequence
agaagactggagacatatgtt

SEQ ID NO: 2779 - DNA, 21 bp, Artificial sequence
  SiRNA target sequence
gaagactggagacatatgttc

SEQ ID NO: 2780 - DNA, 21 bp, Artificial sequence
  SiRNA target sequence
aagactggagacatatgttca

SEQ ID NO: 2781 - DNA, 21 bp, Artificial sequence
  SiRNA target sequence
agactggagacatatgttcaa

SEQ ID NO: 2782 - DNA, 21 bp, Artificial sequence
  SiRNA target sequence
gactggagacatatgttcaac

SEQ ID NO: 2783 - DNA, 21 bp, Artificial sequence
  SiRNA target sequence
actggagacatatgttcaaca

SEQ ID NO: 2784 - DNA, 21 bp, Artificial sequence
  SiRNA target sequence
ctggagacatatgttcaacag

SEQ ID NO: 2785 - DNA, 21 bp, Artificial sequence
  SiRNA target sequence
tggagacatatgttcaacaga

SEQ ID NO: 2786 - DNA, 21 bp, Artificial sequence
  SiRNA target sequence
ggagacatatgttcaacagaa

SEQ ID NO: 2787 - DNA, 21 bp, Artificial sequence
  SiRNA target sequence
gagacatatgttcaacagaat

SEQ ID NO: 2788 - DNA, 21 bp, Artificial sequence
  SiRNA target sequence
agacatatgttcaacagaatg

SEQ ID NO: 2789 - DNA, 21 bp, Artificial sequence
  SiRNA target sequence
gacatatgttcaacagaatgt

SEQ ID NO: 2790 - DNA, 21 bp, Artificial sequence
  SiRNA target sequence
acatatgttcaacagaatgtt

SEQ ID NO: 2791 - DNA, 21 bp, Artificial sequence
  SiRNA target sequence
catatgttcaacagaatgtta

SEQ ID NO: 2792 - DNA, 21 bp, Artificial sequence
  SiRNA target sequence
atatgttcaacagaatgttat

SEQ ID NO: 2793 - DNA, 21 bp, Artificial sequence
  SiRNA target sequence
tatgttcaacagaatgttatt

SEQ ID NO: 2794 - DNA, 21 bp, Artificial sequence
  SiRNA target sequence
atgttcaacagaatgttattt

SEQ ID NO: 2795 - DNA, 21 bp, Artificial sequence
  SiRNA target sequence
tgttcaacagaatgttattta

SEQ ID NO: 2796 - DNA, 21 bp, Artificial sequence
  SiRNA target sequence
gttcaacagaatgttatttag

SEQ ID NO: 2797 - DNA, 21 bp, Artificial sequence
  SiRNA target sequence
ttcaacagaatgttatttagt

SEQ ID NO: 2798 - DNA, 21 bp, Artificial sequence
  SiRNA target sequence
tcaacagaatgttatttagta

SEQ ID NO: 2799 - DNA, 21 bp, Artificial sequence
  SiRNA target sequence
caacagaatgttatttagtag

SEQ ID NO: 2800 - DNA, 21 bp, Artificial sequence
  SiRNA target sequence
aacagaatgttatttagtaga

SEQ ID NO: 2801 - DNA, 21 bp, Artificial sequence
  SiRNA target sequence
acagaatgttatttagtagac

SEQ ID NO: 2802 - DNA, 21 bp, Artificial sequence
  SiRNA target sequence
cagaatgttatttagtagact

SEQ ID NO: 2803 - DNA, 21 bp, Artificial sequence
  SiRNA target sequence
agaatgttatttagtagactt

SEQ ID NO: 2804 - DNA, 21 bp, Artificial sequence
  SiRNA target sequence
gaatgttatttagtagacttg

SEQ ID NO: 2805 - DNA, 21 bp, Artificial sequence
  SiRNA target sequence
aatgttatttagtagacttgg

SEQ ID NO: 2806 - DNA, 21 bp, Artificial sequence
  SiRNA target sequence
atgttatttagtagacttggt

SEQ ID NO: 2807 - DNA, 21 bp, Artificial sequence
  SiRNA target sequence
tgttatttagtagacttggtt

SEQ ID NO: 2808 - DNA, 21 bp, Artificial sequence
  SiRNA target sequence
gttatttagtagacttggtta

SEQ ID NO: 2809 - DNA, 21 bp, Artificial sequence
  SiRNA target sequence
ttatttagtagacttggttaa

SEQ ID NO: 2810 - DNA, 21 bp, Artificial sequence
  SiRNA target sequence
tatttagtagacttggttaat

SEQ ID NO: 2811 - DNA, 21 bp, Artificial sequence
  SiRNA target sequence
atttagtagacttggttaatc

SEQ ID NO: 2812 - DNA, 21 bp, Artificial sequence
  SiRNA target sequence
tttagtagacttggttaatcc

SEQ ID NO: 2813 - DNA, 21 bp, Artificial sequence
  SiRNA target sequence
ttagtagacttggttaatccc

SEQ ID NO: 2814 - DNA, 21 bp, Artificial sequence
  SiRNA target sequence
tagtagacttggttaatcccg

SEQ ID NO: 2815 - DNA, 21 bp, Artificial sequence
  SiRNA target sequence
agtagacttggttaatcccga

SEQ ID NO: 2816 - DNA, 21 bp, Artificial sequence
  SiRNA target sequence
gtagacttggttaatcccgag

SEQ ID NO: 2817 - DNA, 21 bp, Artificial sequence
  SiRNA target sequence
tagacttggttaatcccgaga

SEQ ID NO: 2818 - DNA, 21 bp, Artificial sequence
  SiRNA target sequence
agacttggttaatcccgagac

SEQ ID NO: 2819 - DNA, 21 bp, Artificial sequence
  SiRNA target sequence
gacttggttaatcccgagact

SEQ ID NO: 2820 - DNA, 21 bp, Artificial sequence
  SiRNA target sequence
acttggttaatcccgagactg

SEQ ID NO: 2821 - DNA, 21 bp, Artificial sequence
  SiRNA target sequence
cttggttaatcccgagactgg

SEQ ID NO: 2822 - DNA, 21 bp, Artificial sequence
  SiRNA target sequence
ttggttaatcccgagactgga

SEQ ID NO: 2823 - DNA, 21 bp, Artificial sequence
  SiRNA target sequence
tggttaatcccgagactggag

SEQ ID NO: 2824 - DNA, 21 bp, Artificial sequence
  SiRNA target sequence
ggttaatcccgagactggaga

SEQ ID NO: 2825 - DNA, 21 bp, Artificial sequence
  SiRNA target sequence
gttaatcccgagactggagag

SEQ ID NO: 2826 - DNA, 21 bp, Artificial sequence
  SiRNA target sequence
ttaatcccgagactggagaga

SEQ ID NO: 2827 - DNA, 21 bp, Artificial sequence
  SiRNA target sequence
taatcccgagactggagagaa

SEQ ID NO: 2828 - DNA, 21 bp, Artificial sequence
  SiRNA target sequence
aatcccgagactggagagaaa

SEQ ID NO: 2829 - DNA, 21 bp, Artificial sequence
  SiRNA target sequence
atcccgagactggagagaaat

SEQ ID NO: 2830 - DNA, 21 bp, Artificial sequence
  SiRNA target sequence
tcccgagactggagagaaata

SEQ ID NO: 2831 - DNA, 21 bp, Artificial sequence
  SiRNA target sequence
cccgagactggagagaaatac

SEQ ID NO: 2832 - DNA, 21 bp, Artificial sequence
  SiRNA target sequence
ccgagactggagagaaatacc

SEQ ID NO: 2833 - DNA, 21 bp, Artificial sequence
  SiRNA target sequence
cgagactggagagaaatacca

SEQ ID NO: 2834 - DNA, 21 bp, Artificial sequence
  SiRNA target sequence
gagactggagagaaataccaa

SEQ ID NO: 2835 - DNA, 21 bp, Artificial sequence
  SiRNA target sequence
agactggagagaaataccaaa

SEQ ID NO: 2836 - DNA, 21 bp, Artificial sequence
  SiRNA target sequence
gactggagagaaataccaaac

SEQ ID NO: 2837 - DNA, 21 bp, Artificial sequence
  SiRNA target sequence
actggagagaaataccaaact

SEQ ID NO: 2838 - DNA, 21 bp, Artificial sequence
  SiRNA target sequence
ctggagagaaataccaaactg

SEQ ID NO: 2839 - DNA, 21 bp, Artificial sequence
  SiRNA target sequence
tggagagaaataccaaactga

SEQ ID NO: 2840 - DNA, 21 bp, Artificial sequence
  SiRNA target sequence
ggagagaaataccaaactgat

SEQ ID NO: 2841 - DNA, 21 bp, Artificial sequence
  SiRNA target sequence
gagagaaataccaaactgatt

SEQ ID NO: 2842 - DNA, 21 bp, Artificial sequence
  SiRNA target sequence
agagaaataccaaactgattt

SEQ ID NO: 2843 - DNA, 21 bp, Artificial sequence
  SiRNA target sequence
gagaaataccaaactgattta

SEQ ID NO: 2844 - DNA, 21 bp, Artificial sequence
  SiRNA target sequence
agaaataccaaactgatttag

SEQ ID NO: 2845 - DNA, 21 bp, Artificial sequence
  SiRNA target sequence
gaaataccaaactgatttaga

SEQ ID NO: 2846 - DNA, 21 bp, Artificial sequence
  SiRNA target sequence
aaataccaaactgatttagaa

SEQ ID NO: 2847 - DNA, 21 bp, Artificial sequence
  SiRNA target sequence
aataccaaactgatttagaat

SEQ ID NO: 2848 - DNA, 21 bp, Artificial sequence
  SiRNA target sequence
ataccaaactgatttagaata

SEQ ID NO: 2849 - DNA, 21 bp, Artificial sequence
  SiRNA target sequence
taccaaactgatttagaatat

SEQ ID NO: 2850 - DNA, 21 bp, Artificial sequence
  SiRNA target sequence
accaaactgatttagaatatg

SEQ ID NO: 2851 - DNA, 21 bp, Artificial sequence
  SiRNA target sequence
ccaaactgatttagaatatga

SEQ ID NO: 2852 - DNA, 21 bp, Artificial sequence
  SiRNA target sequence
caaactgatttagaatatgaa

SEQ ID NO: 2853 - DNA, 21 bp, Artificial sequence
  SiRNA target sequence
aaactgatttagaatatgaag

SEQ ID NO: 2854 - DNA, 21 bp, Artificial sequence
  SiRNA target sequence
aactgatttagaatatgaaga

SEQ ID NO: 2855 - DNA, 21 bp, Artificial sequence
  SiRNA target sequence
actgatttagaatatgaagat

SEQ ID NO: 2856 - DNA, 21 bp, Artificial sequence
  SiRNA target sequence
ctgatttagaatatgaagatt

SEQ ID NO: 2857 - DNA, 21 bp, Artificial sequence
  SiRNA target sequence
tgatttagaatatgaagattt

SEQ ID NO: 2858 - DNA, 21 bp, Artificial sequence
  SiRNA target sequence
gatttagaatatgaagatttt

SEQ ID NO: 2859 - DNA, 21 bp, Artificial sequence
  SiRNA target sequence
atttagaatatgaagattttt

SEQ ID NO: 2860 - DNA, 21 bp, Artificial sequence
  SiRNA target sequence
tttagaatatgaagatttttt

SEQ ID NO: 2861 - DNA, 21 bp, Artificial sequence
  SiRNA target sequence
ttagaatatgaagatttttta

SEQ ID NO: 2862 - DNA, 21 bp, Artificial sequence
  SiRNA target sequence
tagaatatgaagattttttag

SEQ ID NO: 2863 - DNA, 21 bp, Artificial sequence
  SiRNA target sequence
agaatatgaagattttttaga

SEQ ID NO: 2864 - DNA, 21 bp, Artificial sequence
  SiRNA target sequence
gaatatgaagattttttagat

SEQ ID NO: 2865 - DNA, 21 bp, Artificial sequence
  SiRNA target sequence
aatatgaagattttttagata

SEQ ID NO: 2866 - DNA, 21 bp, Artificial sequence
  SiRNA target sequence
atatgaagattttttagatat

SEQ ID NO: 2867 - DNA, 21 bp, Artificial sequence
  SiRNA target sequence
tatgaagattttttagatatg

SEQ ID NO: 2868 - DNA, 21 bp, Artificial sequence
  SiRNA target sequence
atgaagattttttagatatgt

SEQ ID NO: 2869 - DNA, 21 bp, Artificial sequence
  SiRNA target sequence
tgaagattttttagatatgtg

SEQ ID NO: 2870 - DNA, 21 bp, Artificial sequence
  SiRNA target sequence
gaagattttttagatatgtgt

SEQ ID NO: 2871 - DNA, 21 bp, Artificial sequence
  SiRNA target sequence
aagattttttagatatgtgtt

SEQ ID NO: 2872 - DNA, 21 bp, Artificial sequence
  SiRNA target sequence
agattttttagatatgtgttt

SEQ ID NO: 2873 - DNA, 21 bp, Artificial sequence
  SiRNA target sequence
gattttttagatatgtgtttg

SEQ ID NO: 2874 - DNA, 21 bp, Artificial sequence
  SiRNA target sequence
attttttagatatgtgtttgg

SEQ ID NO: 2875 - DNA, 21 bp, Artificial sequence
  SiRNA target sequence
ttttttagatatgtgtttgga

SEQ ID NO: 2876 - DNA, 21 bp, Artificial sequence
  SiRNA target sequence
tttttagatatgtgtttggag

SEQ ID NO: 2877 - DNA, 21 bp, Artificial sequence
  SiRNA target sequence
ttttagatatgtgtttggaga

SEQ ID NO: 2878 - DNA, 21 bp, Artificial sequence
  SiRNA target sequence
tttagatatgtgtttggagaa

SEQ ID NO: 2879 - DNA, 21 bp, Artificial sequence
  SiRNA target sequence
ttagatatgtgtttggagaaa

SEQ ID NO: 2880 - DNA, 21 bp, Artificial sequence
  SiRNA target sequence
tagatatgtgtttggagaaaa

SEQ ID NO: 2881 - DNA, 21 bp, Artificial sequence
  SiRNA target sequence
agatatgtgtttggagaaaac

SEQ ID NO: 2882 - DNA, 21 bp, Artificial sequence
  SiRNA target sequence
gatatgtgtttggagaaaact

SEQ ID NO: 2883 - DNA, 21 bp, Artificial sequence
  SiRNA target sequence
atatgtgtttggagaaaactc

SEQ ID NO: 2884 - DNA, 21 bp, Artificial sequence
  SiRNA target sequence
tatgtgtttggagaaaactca

SEQ ID NO: 2885 - DNA, 21 bp, Artificial sequence
  SiRNA target sequence
atgtgtttggagaaaactcag

SEQ ID NO: 2886 - DNA, 21 bp, Artificial sequence
  SiRNA target sequence
tgtgtttggagaaaactcagg

SEQ ID NO: 2887 - DNA, 21 bp, Artificial sequence
  SiRNA target sequence
gtgtttggagaaaactcagga

SEQ ID NO: 2888 - DNA, 21 bp, Artificial sequence
  SiRNA target sequence
tgtttggagaaaactcaggag

SEQ ID NO: 2889 - DNA, 21 bp, Artificial sequence
  SiRNA target sequence
gtttggagaaaactcaggagt

SEQ ID NO: 2890 - DNA, 21 bp, Artificial sequence
  SiRNA target sequence
tttggagaaaactcaggagtg

SEQ ID NO: 2891 - DNA, 21 bp, Artificial sequence
  SiRNA target sequence
ttggagaaaactcaggagtgt

SEQ ID NO: 2892 - DNA, 21 bp, Artificial sequence
  SiRNA target sequence
tggagaaaactcaggagtgta

SEQ ID NO: 2893 - DNA, 21 bp, Artificial sequence
  SiRNA target sequence
ggagaaaactcaggagtgtag

SEQ ID NO: 2894 - DNA, 21 bp, Artificial sequence
  SiRNA target sequence
gagaaaactcaggagtgtaga

SEQ ID NO: 2895 - DNA, 21 bp, Artificial sequence
  SiRNA target sequence
agaaaactcaggagtgtagag

SEQ ID NO: 2896 - DNA, 21 bp, Artificial sequence
  SiRNA target sequence
gaaaactcaggagtgtagaga

SEQ ID NO: 2897 - DNA, 21 bp, Artificial sequence
  SiRNA target sequence
aaaactcaggagtgtagagat

SEQ ID NO: 2898 - DNA, 21 bp, Artificial sequence
  SiRNA target sequence
aaactcaggagtgtagagata

SEQ ID NO: 2899 - DNA, 21 bp, Artificial sequence
  SiRNA target sequence
aactcaggagtgtagagataa

SEQ ID NO: 2900 - DNA, 21 bp, Artificial sequence
  SiRNA target sequence
actcaggagtgtagagataat

SEQ ID NO: 2901 - DNA, 21 bp, Artificial sequence
  SiRNA target sequence
ctcaggagtgtagagataatt

SEQ ID NO: 2902 - DNA, 21 bp, Artificial sequence
  SiRNA target sequence
tcaggagtgtagagataattc

SEQ ID NO: 2903 - DNA, 21 bp, Artificial sequence
  SiRNA target sequence
caggagtgtagagataattct

SEQ ID NO: 2904 - DNA, 21 bp, Artificial sequence
  SiRNA target sequence
aggagtgtagagataattctg

SEQ ID NO: 2905 - DNA, 21 bp, Artificial sequence
  SiRNA target sequence
ggagtgtagagataattctgc

SEQ ID NO: 2906 - DNA, 21 bp, Artificial sequence
  SiRNA target sequence
gagtgtagagataattctgct

SEQ ID NO: 2907 - DNA, 21 bp, Artificial sequence
  SiRNA target sequence
agtgtagagataattctgcta

SEQ ID NO: 2908 - DNA, 21 bp, Artificial sequence
  SiRNA target sequence
gtgtagagataattctgctaa

SEQ ID NO: 2909 - DNA, 21 bp, Artificial sequence
  SiRNA target sequence
tgtagagataattctgctaag

SEQ ID NO: 2910 - DNA, 21 bp, Artificial sequence
  SiRNA target sequence
gtagagataattctgctaagt

SEQ ID NO: 2911 - DNA, 21 bp, Artificial sequence
  SiRNA target sequence
tagagataattctgctaagtt

SEQ ID NO: 2912 - DNA, 21 bp, Artificial sequence
  SiRNA target sequence
agagataattctgctaagttg

SEQ ID NO: 2913 - DNA, 21 bp, Artificial sequence
  SiRNA target sequence
gagataattctgctaagttga

SEQ ID NO: 2914 - DNA, 21 bp, Artificial sequence
  SiRNA target sequence
agataattctgctaagttgaa

SEQ ID NO: 2915 - DNA, 21 bp, Artificial sequence
  SiRNA target sequence
gataattctgctaagttgaac

SEQ ID NO: 2916 - DNA, 21 bp, Artificial sequence
  SiRNA target sequence
ataattctgctaagttgaacg

SEQ ID NO: 2917 - DNA, 21 bp, Artificial sequence
  SiRNA target sequence
taattctgctaagttgaacga

SEQ ID NO: 2918 - DNA, 21 bp, Artificial sequence
  SiRNA target sequence
aattctgctaagttgaacgaa

SEQ ID NO: 2919 - DNA, 21 bp, Artificial sequence
  SiRNA target sequence
attctgctaagttgaacgaat

SEQ ID NO: 2920 - DNA, 21 bp, Artificial sequence
  SiRNA target sequence
ttctgctaagttgaacgaatt

SEQ ID NO: 2921 - DNA, 21 bp, Artificial sequence
  SiRNA target sequence
tctgctaagttgaacgaattt

SEQ ID NO: 2922 - DNA, 21 bp, Artificial sequence
  SiRNA target sequence
ctgctaagttgaacgaatttc

SEQ ID NO: 2923 - DNA, 21 bp, Artificial sequence
  SiRNA target sequence
tgctaagttgaacgaatttct

SEQ ID NO: 2924 - DNA, 21 bp, Artificial sequence
  SiRNA target sequence
gctaagttgaacgaatttctg

SEQ ID NO: 2925 - DNA, 21 bp, Artificial sequence
  SiRNA target sequence
ctaagttgaacgaatttctga

SEQ ID NO: 2926 - DNA, 21 bp, Artificial sequence
  SiRNA target sequence
taagttgaacgaatttctgat

SEQ ID NO: 2927 - DNA, 21 bp, Artificial sequence
  SiRNA target sequence
aagttgaacgaatttctgatg

SEQ ID NO: 2928 - DNA, 21 bp, Artificial sequence
  SiRNA target sequence
agttgaacgaatttctgatga

SEQ ID NO: 2929 - DNA, 21 bp, Artificial sequence
  SiRNA target sequence
gttgaacgaatttctgatgaa

SEQ ID NO: 2930 - DNA, 21 bp, Artificial sequence
  SiRNA target sequence
ttgaacgaatttctgatgaac

SEQ ID NO: 2931 - DNA, 21 bp, Artificial sequence
  SiRNA target sequence
tgaacgaatttctgatgaact

SEQ ID NO: 2932 - DNA, 21 bp, Artificial sequence
  SiRNA target sequence
gaacgaatttctgatgaacta

SEQ ID NO: 2933 - DNA, 21 bp, Artificial sequence
  SiRNA target sequence
aacgaatttctgatgaactat

SEQ ID NO: 2934 - DNA, 21 bp, Artificial sequence
  SiRNA target sequence
acgaatttctgatgaactatg

SEQ ID NO: 2935 - DNA, 21 bp, Artificial sequence
  SiRNA target sequence
cgaatttctgatgaactatgc

SEQ ID NO: 2936 - DNA, 21 bp, Artificial sequence
  SiRNA target sequence
gaatttctgatgaactatgct

SEQ ID NO: 2937 - DNA, 21 bp, Artificial sequence
  SiRNA target sequence
aatttctgatgaactatgctg

SEQ ID NO: 2938 - DNA, 21 bp, Artificial sequence
  SiRNA target sequence
atttctgatgaactatgctga

SEQ ID NO: 2939 - DNA, 21 bp, Artificial sequence
  SiRNA target sequence
tttctgatgaactatgctgaa

SEQ ID NO: 2940 - DNA, 21 bp, Artificial sequence
  SiRNA target sequence
ttctgatgaactatgctgaaa

SEQ ID NO: 2941 - DNA, 21 bp, Artificial sequence
  SiRNA target sequence
tctgatgaactatgctgaaag

SEQ ID NO: 2942 - DNA, 21 bp, Artificial sequence
  SiRNA target sequence
ctgatgaactatgctgaaagt

SEQ ID NO: 2943 - DNA, 21 bp, Artificial sequence
  SiRNA target sequence
tgatgaactatgctgaaagtc

SEQ ID NO: 2944 - DNA, 21 bp, Artificial sequence
  SiRNA target sequence
gatgaactatgctgaaagtcg

SEQ ID NO: 2945 - DNA, 21 bp, Artificial sequence
  SiRNA target sequence
atgaactatgctgaaagtcga

SEQ ID NO: 2946 - DNA, 21 bp, Artificial sequence
  SiRNA target sequence
tgaactatgctgaaagtcgat

SEQ ID NO: 2947 - DNA, 21 bp, Artificial sequence
  SiRNA target sequence
gaactatgctgaaagtcgatc

SEQ ID NO: 2948 - DNA, 21 bp, Artificial sequence
  SiRNA target sequence
aactatgctgaaagtcgatca

SEQ ID NO: 2949 - DNA, 21 bp, Artificial sequence
  SiRNA target sequence
actatgctgaaagtcgatcaa

SEQ ID NO: 2950 - DNA, 21 bp, Artificial sequence
  SiRNA target sequence
ctatgctgaaagtcgatcaaa

SEQ ID NO: 2951 - DNA, 21 bp, Artificial sequence
  SiRNA target sequence
tatgctgaaagtcgatcaaaa

SEQ ID NO: 2952 - DNA, 21 bp, Artificial sequence
  SiRNA target sequence
atgctgaaagtcgatcaaaac

SEQ ID NO: 2953 - DNA, 21 bp, Artificial sequence
  SiRNA target sequence
tgctgaaagtcgatcaaaacg

SEQ ID NO: 2954 - DNA, 21 bp, Artificial sequence
  SiRNA target sequence
gctgaaagtcgatcaaaacga

SEQ ID NO: 2955 - DNA, 21 bp, Artificial sequence
  SiRNA target sequence
ctgaaagtcgatcaaaacgac

SEQ ID NO: 2956 - DNA, 21 bp, Artificial sequence
  SiRNA target sequence
tgaaagtcgatcaaaacgacc

SEQ ID NO: 2957 - DNA, 21 bp, Artificial sequence
  SiRNA target sequence
gaaagtcgatcaaaacgaccc

SEQ ID NO: 2958 - DNA, 21 bp, Artificial sequence
  SiRNA target sequence
aaagtcgatcaaaacgacccg

SEQ ID NO: 2959 - DNA, 21 bp, Artificial sequence
  SiRNA target sequence
aagtcgatcaaaacgacccga

SEQ ID NO: 2960 - DNA, 21 bp, Artificial sequence
  SiRNA target sequence
agtcgatcaaaacgacccgaa

SEQ ID NO: 2961 - DNA, 21 bp, Artificial sequence
  SiRNA target sequence
gtcgatcaaaacgacccgaac

SEQ ID NO: 2962 - DNA, 21 bp, Artificial sequence
  SiRNA target sequence
tcgatcaaaacgacccgaaca

SEQ ID NO: 2963 - DNA, 21 bp, Artificial sequence
  SiRNA target sequence
cgatcaaaacgacccgaacaa

SEQ ID NO: 2964 - DNA, 21 bp, Artificial sequence
  SiRNA target sequence
gatcaaaacgacccgaacaaa

SEQ ID NO: 2965 - DNA, 21 bp, Artificial sequence
  SiRNA target sequence
atcaaaacgacccgaacaaaa

SEQ ID NO: 2966 - DNA, 21 bp, Artificial sequence
  SiRNA target sequence
tcaaaacgacccgaacaaaaa

SEQ ID NO: 2967 - DNA, 21 bp, Artificial sequence
  SiRNA target sequence
caaaacgacccgaacaaaaac

SEQ ID NO: 2968 - DNA, 21 bp, Artificial sequence
  SiRNA target sequence
aaaacgacccgaacaaaaaca

SEQ ID NO: 2969 - DNA, 21 bp, Artificial sequence
  SiRNA target sequence
aaacgacccgaacaaaaacac

SEQ ID NO: 2970 - DNA, 21 bp, Artificial sequence
  SiRNA target sequence
aacgacccgaacaaaaacacg

SEQ ID NO: 2971 - DNA, 21 bp, Artificial sequence
  SiRNA target sequence
acgacccgaacaaaaacacga

SEQ ID NO: 2972 - DNA, 21 bp, Artificial sequence
  SiRNA target sequence
cgacccgaacaaaaacacgat

SEQ ID NO: 2973 - DNA, 21 bp, Artificial sequence
  SiRNA target sequence
gacccgaacaaaaacacgata

SEQ ID NO: 2974 - DNA, 21 bp, Artificial sequence
  SiRNA target sequence
acccgaacaaaaacacgataa

SEQ ID NO: 2975 - DNA, 21 bp, Artificial sequence
  SiRNA target sequence
cccgaacaaaaacacgataag

SEQ ID NO: 2976 - DNA, 21 bp, Artificial sequence
  SiRNA target sequence
ccgaacaaaaacacgataagt

SEQ ID NO: 2977 - DNA, 21 bp, Artificial sequence
  SiRNA target sequence
cgaacaaaaacacgataagtg

SEQ ID NO: 2978 - DNA, 21 bp, Artificial sequence
  SiRNA target sequence
gaacaaaaacacgataagtgc

SEQ ID NO: 2979 - DNA, 21 bp, Artificial sequence
  SiRNA target sequence
aacaaaaacacgataagtgcc

SEQ ID NO: 2980 - DNA, 21 bp, Artificial sequence
  SiRNA target sequence
acaaaaacacgataagtgccc

SEQ ID NO: 2981 - DNA, 21 bp, Artificial sequence
  SiRNA target sequence
caaaaacacgataagtgccct

SEQ ID NO: 2982 - DNA, 21 bp, Artificial sequence
  SiRNA target sequence
aaaaacacgataagtgccctg

SEQ ID NO: 2983 - DNA, 21 bp, Artificial sequence
  SiRNA target sequence
aaaacacgataagtgccctga

SEQ ID NO: 2984 - DNA, 21 bp, Artificial sequence
  SiRNA target sequence
aaacacgataagtgccctgaa

SEQ ID NO: 2985 - DNA, 21 bp, Artificial sequence
  SiRNA target sequence
aacacgataagtgccctgaat

SEQ ID NO: 2986 - DNA, 21 bp, Artificial sequence
  SiRNA target sequence
acacgataagtgccctgaatt

SEQ ID NO: 2987 - DNA, 21 bp, Artificial sequence
  SiRNA target sequence
cacgataagtgccctgaattg

SEQ ID NO: 2988 - DNA, 21 bp, Artificial sequence
  SiRNA target sequence
acgataagtgccctgaattgg

SEQ ID NO: 2989 - DNA, 21 bp, Artificial sequence
  SiRNA target sequence
cgataagtgccctgaattgga

SEQ ID NO: 2990 - DNA, 21 bp, Artificial sequence
  SiRNA target sequence
gataagtgccctgaattggaa

SEQ ID NO: 2991 - DNA, 21 bp, Artificial sequence
  SiRNA target sequence
ataagtgccctgaattggaat

SEQ ID NO: 2992 - DNA, 21 bp, Artificial sequence
  SiRNA target sequence
taagtgccctgaattggaatt

SEQ ID NO: 2993 - DNA, 21 bp, Artificial sequence
  SiRNA target sequence
aagtgccctgaattggaattt

SEQ ID NO: 2994 - DNA, 21 bp, Artificial sequence
  SiRNA target sequence
agtgccctgaattggaatttg

SEQ ID NO: 2995 - DNA, 21 bp, Artificial sequence
  SiRNA target sequence
gtgccctgaattggaatttga

SEQ ID NO: 2996 - DNA, 21 bp, Artificial sequence
  SiRNA target sequence
tgccctgaattggaatttgaa

SEQ ID NO: 2997 - DNA, 21 bp, Artificial sequence
  SiRNA target sequence
gccctgaattggaatttgaag

SEQ ID NO: 2998 - DNA, 21 bp, Artificial sequence
  SiRNA target sequence
ccctgaattggaatttgaaga

SEQ ID NO: 2999 - DNA, 21 bp, Artificial sequence
  SiRNA target sequence
cctgaattggaatttgaagat

SEQ ID NO: 3000 - DNA, 21 bp, Artificial sequence
  SiRNA target sequence
ctgaattggaatttgaagatg

SEQ ID NO: 3001 - DNA, 21 bp, Artificial sequence
  SiRNA target sequence
tgaattggaatttgaagatgc

SEQ ID NO: 3002 - DNA, 21 bp, Artificial sequence
  SiRNA target sequence
gaattggaatttgaagatgca

SEQ ID NO: 3003 - DNA, 21 bp, Artificial sequence
  SiRNA target sequence
aattggaatttgaagatgcaa

SEQ ID NO: 3004 - DNA, 21 bp, Artificial sequence
  SiRNA target sequence
attggaatttgaagatgcaat

SEQ ID NO: 3005 - DNA, 21 bp, Artificial sequence
  SiRNA target sequence
ttggaatttgaagatgcaatt

SEQ ID NO: 3006 - DNA, 21 bp, Artificial sequence
  SiRNA target sequence
tggaatttgaagatgcaattg

SEQ ID NO: 3007 - DNA, 21 bp, Artificial sequence
  SiRNA target sequence
ggaatttgaagatgcaattga

SEQ ID NO: 3008 - DNA, 21 bp, Artificial sequence
  SiRNA target sequence
gaatttgaagatgcaattgaa

SEQ ID NO: 3009 - DNA, 21 bp, Artificial sequence
  SiRNA target sequence
aatttgaagatgcaattgaag

SEQ ID NO: 3010 - DNA, 21 bp, Artificial sequence
  SiRNA target sequence
atttgaagatgcaattgaagt

SEQ ID NO: 3011 - DNA, 21 bp, Artificial sequence
  SiRNA target sequence
tttgaagatgcaattgaagtg

SEQ ID NO: 3012 - DNA, 21 bp, Artificial sequence
  SiRNA target sequence
ttgaagatgcaattgaagtgt

SEQ ID NO: 3013 - DNA, 21 bp, Artificial sequence
  SiRNA target sequence
tgaagatgcaattgaagtgtc

SEQ ID NO: 3014 - DNA, 21 bp, Artificial sequence
  SiRNA target sequence
gaagatgcaattgaagtgtct

SEQ ID NO: 3015 - DNA, 21 bp, Artificial sequence
  SiRNA target sequence
aagatgcaattgaagtgtcta

SEQ ID NO: 3016 - DNA, 21 bp, Artificial sequence
  SiRNA target sequence
agatgcaattgaagtgtctat

SEQ ID NO: 3017 - DNA, 21 bp, Artificial sequence
  SiRNA target sequence
gatgcaattgaagtgtctatg

SEQ ID NO: 3018 - DNA, 21 bp, Artificial sequence
  SiRNA target sequence
atgcaattgaagtgtctatgc

SEQ ID NO: 3019 - DNA, 21 bp, Artificial sequence
  SiRNA target sequence
tgcaattgaagtgtctatgca

SEQ ID NO: 3020 - DNA, 21 bp, Artificial sequence
  SiRNA target sequence
gcaattgaagtgtctatgcaa

SEQ ID NO: 3021 - DNA, 21 bp, Artificial sequence
  SiRNA target sequence
caattgaagtgtctatgcaag

SEQ ID NO: 3022 - DNA, 21 bp, Artificial sequence
  SiRNA target sequence
aattgaagtgtctatgcaagt

SEQ ID NO: 3023 - DNA, 21 bp, Artificial sequence
  SiRNA target sequence
attgaagtgtctatgcaagta

SEQ ID NO: 3024 - DNA, 21 bp, Artificial sequence
  SiRNA target sequence
ttgaagtgtctatgcaagtag

SEQ ID NO: 3025 - DNA, 21 bp, Artificial sequence
  SiRNA target sequence
tgaagtgtctatgcaagtaga

SEQ ID NO: 3026 - DNA, 21 bp, Artificial sequence
  SiRNA target sequence
gaagtgtctatgcaagtagac

SEQ ID NO: 3027 - DNA, 21 bp, Artificial sequence
  SiRNA target sequence
aagtgtctatgcaagtagacg

SEQ ID NO: 3028 - DNA, 21 bp, Artificial sequence
  SiRNA target sequence
agtgtctatgcaagtagacgc

SEQ ID NO: 3029 - DNA, 21 bp, Artificial sequence
  SiRNA target sequence
gtgtctatgcaagtagacgct

SEQ ID NO: 3030 - DNA, 21 bp, Artificial sequence
  SiRNA target sequence
tgtctatgcaagtagacgctg

SEQ ID NO: 3031 - DNA, 21 bp, Artificial sequence
  SiRNA target sequence
gtctatgcaagtagacgctga

SEQ ID NO: 3032 - DNA, 21 bp, Artificial sequence
  SiRNA target sequence
tctatgcaagtagacgctgac

SEQ ID NO: 3033 - DNA, 21 bp, Artificial sequence
  SiRNA target sequence
ctatgcaagtagacgctgact

SEQ ID NO: 3034 - DNA, 21 bp, Artificial sequence
  SiRNA target sequence
tatgcaagtagacgctgactc

SEQ ID NO: 3035 - DNA, 21 bp, Artificial sequence
  SiRNA target sequence
atgcaagtagacgctgactcg

SEQ ID NO: 3036 - DNA, 21 bp, Artificial sequence
  SiRNA target sequence
tgcaagtagacgctgactcgt

SEQ ID NO: 3037 - DNA, 21 bp, Artificial sequence
  SiRNA target sequence
gcaagtagacgctgactcgtc

SEQ ID NO: 3038 - DNA, 21 bp, Artificial sequence
  SiRNA target sequence
caagtagacgctgactcgtct

SEQ ID NO: 3039 - DNA, 21 bp, Artificial sequence
  SiRNA target sequence
aagtagacgctgactcgtctt

SEQ ID NO: 3040 - DNA, 21 bp, Artificial sequence
  SiRNA target sequence
agtagacgctgactcgtcttt

SEQ ID NO: 3041 - DNA, 21 bp, Artificial sequence
  SiRNA target sequence
gtagacgctgactcgtcttta

SEQ ID NO: 3042 - DNA, 21 bp, Artificial sequence
  SiRNA target sequence
tagacgctgactcgtctttag

SEQ ID NO: 3043 - DNA, 21 bp, Artificial sequence
  SiRNA target sequence
agacgctgactcgtctttagt

SEQ ID NO: 3044 - DNA, 21 bp, Artificial sequence
  SiRNA target sequence
gacgctgactcgtctttagtt

SEQ ID NO: 3045 - DNA, 21 bp, Artificial sequence
  SiRNA target sequence
acgctgactcgtctttagttc

SEQ ID NO: 3046 - DNA, 21 bp, Artificial sequence
  SiRNA target sequence
cgctgactcgtctttagttcc

SEQ ID NO: 3047 - DNA, 21 bp, Artificial sequence
  SiRNA target sequence
gctgactcgtctttagttcca

SEQ ID NO: 3048 - DNA, 21 bp, Artificial sequence
  SiRNA target sequence
ctgactcgtctttagttccaa

SEQ ID NO: 3049 - DNA, 21 bp, Artificial sequence
  SiRNA target sequence
tgactcgtctttagttccaat

SEQ ID NO: 3050 - DNA, 21 bp, Artificial sequence
  SiRNA target sequence
gactcgtctttagttccaatt

SEQ ID NO: 3051 - DNA, 21 bp, Artificial sequence
  SiRNA target sequence
actcgtctttagttccaattg

SEQ ID NO: 3052 - DNA, 21 bp, Artificial sequence
  SiRNA target sequence
ctcgtctttagttccaattga

SEQ ID NO: 3053 - DNA, 21 bp, Artificial sequence
  SiRNA target sequence
tcgtctttagttccaattgag

SEQ ID NO: 3054 - DNA, 21 bp, Artificial sequence
  SiRNA target sequence
cgtctttagttccaattgaga

SEQ ID NO: 3055 - DNA, 21 bp, Artificial sequence
  SiRNA target sequence
gtctttagttccaattgagaa

SEQ ID NO: 3056 - DNA, 21 bp, Artificial sequence
  SiRNA target sequence
tctttagttccaattgagaag

SEQ ID NO: 3057 - DNA, 21 bp, Artificial sequence
  SiRNA target sequence
ctttagttccaattgagaagt

SEQ ID NO: 3058 - DNA, 21 bp, Artificial sequence
  SiRNA target sequence
tttagttccaattgagaagtc

SEQ ID NO: 3059 - DNA, 21 bp, Artificial sequence
  SiRNA target sequence
ttagttccaattgagaagtct

SEQ ID NO: 3060 - DNA, 21 bp, Artificial sequence
  SiRNA target sequence
tagttccaattgagaagtctc

SEQ ID NO: 3061 - DNA, 21 bp, Artificial sequence
  SiRNA target sequence
agttccaattgagaagtctcg

SEQ ID NO: 3062 - DNA, 21 bp, Artificial sequence
  SiRNA target sequence
gttccaattgagaagtctcgt

SEQ ID NO: 3063 - DNA, 21 bp, Artificial sequence
  SiRNA target sequence
ttccaattgagaagtctcgtc

SEQ ID NO: 3064 - DNA, 21 bp, Artificial sequence
  SiRNA target sequence
tccaattgagaagtctcgtct

SEQ ID NO: 3065 - DNA, 21 bp, Artificial sequence
  SiRNA target sequence
ccaattgagaagtctcgtctt

SEQ ID NO: 3066 - DNA, 21 bp, Artificial sequence
  SiRNA target sequence
caattgagaagtctcgtcttc

SEQ ID NO: 3067 - DNA, 21 bp, Artificial sequence
  SiRNA target sequence
aattgagaagtctcgtcttca

SEQ ID NO: 3068 - DNA, 21 bp, Artificial sequence
  SiRNA target sequence
attgagaagtctcgtcttcaa

SEQ ID NO: 3069 - DNA, 21 bp, Artificial sequence
  SiRNA target sequence
ttgagaagtctcgtcttcaag

SEQ ID NO: 3070 - DNA, 21 bp, Artificial sequence
  SiRNA target sequence
tgagaagtctcgtcttcaaga

SEQ ID NO: 3071 - DNA, 21 bp, Artificial sequence
  SiRNA target sequence
gagaagtctcgtcttcaagag

SEQ ID NO: 3072 - DNA, 21 bp, Artificial sequence
  SiRNA target sequence
agaagtctcgtcttcaagaga

SEQ ID NO: 3073 - DNA, 21 bp, Artificial sequence
  SiRNA target sequence
gaagtctcgtcttcaagagat

SEQ ID NO: 3074 - DNA, 21 bp, Artificial sequence
  SiRNA target sequence
aagtctcgtcttcaagagatg

SEQ ID NO: 3075 - DNA, 21 bp, Artificial sequence
  SiRNA target sequence
agtctcgtcttcaagagatga

SEQ ID NO: 3076 - DNA, 21 bp, Artificial sequence
  SiRNA target sequence
gtctcgtcttcaagagatgat

SEQ ID NO: 3077 - DNA, 21 bp, Artificial sequence
  SiRNA target sequence
tctcgtcttcaagagatgatt

SEQ ID NO: 3078 - DNA, 21 bp, Artificial sequence
  SiRNA target sequence
ctcgtcttcaagagatgattg

SEQ ID NO: 3079 - DNA, 21 bp, Artificial sequence
  SiRNA target sequence
tcgtcttcaagagatgattga

SEQ ID NO: 3080 - DNA, 21 bp, Artificial sequence
  SiRNA target sequence
cgtcttcaagagatgattgag

SEQ ID NO: 3081 - DNA, 21 bp, Artificial sequence
  SiRNA target sequence
gtcttcaagagatgattgaga

SEQ ID NO: 3082 - DNA, 21 bp, Artificial sequence
  SiRNA target sequence
tcttcaagagatgattgagag

SEQ ID NO: 3083 - DNA, 21 bp, Artificial sequence
  SiRNA target sequence
cttcaagagatgattgagagt

SEQ ID NO: 3084 - DNA, 21 bp, Artificial sequence
  SiRNA target sequence
ttcaagagatgattgagagtt

SEQ ID NO: 3085 - DNA, 21 bp, Artificial sequence
  SiRNA target sequence
tcaagagatgattgagagttg

SEQ ID NO: 3086 - DNA, 21 bp, Artificial sequence
  SiRNA target sequence
caagagatgattgagagttgc

SEQ ID NO: 3087 - DNA, 21 bp, Artificial sequence
  SiRNA target sequence
aagagatgattgagagttgcc

SEQ ID NO: 3088 - DNA, 21 bp, Artificial sequence
  SiRNA target sequence
agagatgattgagagttgcca

SEQ ID NO: 3089 - DNA, 21 bp, Artificial sequence
  SiRNA target sequence
gagatgattgagagttgccaa

SEQ ID NO: 3090 - DNA, 21 bp, Artificial sequence
  SiRNA target sequence
agatgattgagagttgccaag

SEQ ID NO: 3091 - DNA, 21 bp, Artificial sequence
  SiRNA target sequence
gatgattgagagttgccaagg

SEQ ID NO: 3092 - DNA, 21 bp, Artificial sequence
  SiRNA target sequence
atgattgagagttgccaagga

SEQ ID NO: 3093 - DNA, 21 bp, Artificial sequence
  SiRNA target sequence
tgattgagagttgccaaggag

SEQ ID NO: 3094 - DNA, 21 bp, Artificial sequence
  SiRNA target sequence
gattgagagttgccaaggagt

SEQ ID NO: 3095 - DNA, 21 bp, Artificial sequence
  SiRNA target sequence
attgagagttgccaaggagtt

SEQ ID NO: 3096 - DNA, 21 bp, Artificial sequence
  SiRNA target sequence
ttgagagttgccaaggagttg

SEQ ID NO: 3097 - DNA, 21 bp, Artificial sequence
  SiRNA target sequence
tgagagttgccaaggagttgt

SEQ ID NO: 3098 - DNA, 21 bp, Artificial sequence
  SiRNA target sequence
gagagttgccaaggagttgtg

SEQ ID NO: 3099 - DNA, 21 bp, Artificial sequence
  SiRNA target sequence
agagttgccaaggagttgtgt

SEQ ID NO: 3100 - DNA, 21 bp, Artificial sequence
  SiRNA target sequence
gagttgccaaggagttgtgta

SEQ ID NO: 3101 - DNA, 21 bp, Artificial sequence
  SiRNA target sequence
agttgccaaggagttgtgtat

SEQ ID NO: 3102 - DNA, 21 bp, Artificial sequence
  SiRNA target sequence
gttgccaaggagttgtgtatg

SEQ ID NO: 3103 - DNA, 21 bp, Artificial sequence
  SiRNA target sequence
ttgccaaggagttgtgtatga

SEQ ID NO: 3104 - DNA, 21 bp, Artificial sequence
  SiRNA target sequence
tgccaaggagttgtgtatgat

SEQ ID NO: 3105 - DNA, 21 bp, Artificial sequence
  SiRNA target sequence
gccaaggagttgtgtatgatg

SEQ ID NO: 3106 - DNA, 21 bp, Artificial sequence
  SiRNA target sequence
ccaaggagttgtgtatgatgc

SEQ ID NO: 3107 - DNA, 21 bp, Artificial sequence
  SiRNA target sequence
caaggagttgtgtatgatgcc

SEQ ID NO: 3108 - DNA, 21 bp, Artificial sequence
  SiRNA target sequence
aaggagttgtgtatgatgcct

SEQ ID NO: 3109 - DNA, 21 bp, Artificial sequence
  SiRNA target sequence
aggagttgtgtatgatgcctg

SEQ ID NO: 3110 - DNA, 21 bp, Artificial sequence
  SiRNA target sequence
ggagttgtgtatgatgcctgc

SEQ ID NO: 3111 - DNA, 21 bp, Artificial sequence
  SiRNA target sequence
gagttgtgtatgatgcctgcg

SEQ ID NO: 3112 - DNA, 21 bp, Artificial sequence
  SiRNA target sequence
agttgtgtatgatgcctgcgg

SEQ ID NO: 3113 - DNA, 21 bp, Artificial sequence
  SiRNA target sequence
gttgtgtatgatgcctgcggc

SEQ ID NO: 3114 - DNA, 21 bp, Artificial sequence
  SiRNA target sequence
ttgtgtatgatgcctgcggca

SEQ ID NO: 3115 - DNA, 21 bp, Artificial sequence
  SiRNA target sequence
tgtgtatgatgcctgcggcaa

SEQ ID NO: 3116 - DNA, 21 bp, Artificial sequence
  SiRNA target sequence
gtgtatgatgcctgcggcaag

SEQ ID NO: 3117 - DNA, 21 bp, Artificial sequence
  SiRNA target sequence
tgtatgatgcctgcggcaaga

SEQ ID NO: 3118 - DNA, 21 bp, Artificial sequence
  SiRNA target sequence
gtatgatgcctgcggcaagac

SEQ ID NO: 3119 - DNA, 21 bp, Artificial sequence
  SiRNA target sequence
tatgatgcctgcggcaagacc

SEQ ID NO: 3120 - DNA, 21 bp, Artificial sequence
  SiRNA target sequence
atgatgcctgcggcaagaccg

SEQ ID NO: 3121 - DNA, 21 bp, Artificial sequence
  SiRNA target sequence
tgatgcctgcggcaagaccgt

SEQ ID NO: 3122 - DNA, 21 bp, Artificial sequence
  SiRNA target sequence
gatgcctgcggcaagaccgta

SEQ ID NO: 3123 - DNA, 21 bp, Artificial sequence
  SiRNA target sequence
atgcctgcggcaagaccgtat

SEQ ID NO: 3124 - DNA, 21 bp, Artificial sequence
  SiRNA target sequence
tgcctgcggcaagaccgtata

SEQ ID NO: 3125 - DNA, 21 bp, Artificial sequence
  SiRNA target sequence
gcctgcggcaagaccgtatac

SEQ ID NO: 3126 - DNA, 21 bp, Artificial sequence
  SiRNA target sequence
cctgcggcaagaccgtataca

SEQ ID NO: 3127 - DNA, 21 bp, Artificial sequence
  SiRNA target sequence
ctgcggcaagaccgtatacat

SEQ ID NO: 3128 - DNA, 21 bp, Artificial sequence
  SiRNA target sequence
tgcggcaagaccgtatacatt

SEQ ID NO: 3129 - DNA, 21 bp, Artificial sequence
  SiRNA target sequence
gcggcaagaccgtatacattt

SEQ ID NO: 3130 - DNA, 21 bp, Artificial sequence
  SiRNA target sequence
cggcaagaccgtatacatttc

SEQ ID NO: 3131 - DNA, 21 bp, Artificial sequence
  SiRNA target sequence
ggcaagaccgtatacatttct

SEQ ID NO: 3132 - DNA, 21 bp, Artificial sequence
  SiRNA target sequence
gcaagaccgtatacatttcta

SEQ ID NO: 3133 - DNA, 21 bp, Artificial sequence
  SiRNA target sequence
caagaccgtatacatttctaa

SEQ ID NO: 3134 - DNA, 21 bp, Artificial sequence
  SiRNA target sequence
aagaccgtatacatttctaag

SEQ ID NO: 3135 - DNA, 21 bp, Artificial sequence
  SiRNA target sequence
agaccgtatacatttctaagt

SEQ ID NO: 3136 - DNA, 21 bp, Artificial sequence
  SiRNA target sequence
gaccgtatacatttctaagtt

SEQ ID NO: 3137 - DNA, 21 bp, Artificial sequence
  SiRNA target sequence
accgtatacatttctaagtta

SEQ ID NO: 3138 - DNA, 21 bp, Artificial sequence
  SiRNA target sequence
ccgtatacatttctaagttag

SEQ ID NO: 3139 - DNA, 21 bp, Artificial sequence
  SiRNA target sequence
cgtatacatttctaagttagc

SEQ ID NO: 3140 - DNA, 21 bp, Artificial sequence
  SiRNA target sequence
gtatacatttctaagttagct

SEQ ID NO: 3141 - DNA, 21 bp, Artificial sequence
  SiRNA target sequence
tatacatttctaagttagctt

SEQ ID NO: 3142 - DNA, 21 bp, Artificial sequence
  SiRNA target sequence
atacatttctaagttagcttt

SEQ ID NO: 3143 - DNA, 21 bp, Artificial sequence
  SiRNA target sequence
tacatttctaagttagctttt

SEQ ID NO: 3144 - DNA, 21 bp, Artificial sequence
  SiRNA target sequence
acatttctaagttagcttttg

SEQ ID NO: 3145 - DNA, 21 bp, Artificial sequence
  SiRNA target sequence
catttctaagttagcttttga

SEQ ID NO: 3146 - DNA, 21 bp, Artificial sequence
  SiRNA target sequence
atttctaagttagcttttgaa

SEQ ID NO: 3147 - DNA, 21 bp, Artificial sequence
  SiRNA target sequence
tttctaagttagcttttgaac

SEQ ID NO: 3148 - DNA, 21 bp, Artificial sequence
  SiRNA target sequence
ttctaagttagcttttgaact

SEQ ID NO: 3149 - DNA, 21 bp, Artificial sequence
  SiRNA target sequence
tctaagttagcttttgaacta

SEQ ID NO: 3150 - DNA, 21 bp, Artificial sequence
  SiRNA target sequence
ctaagttagcttttgaactag

SEQ ID NO: 3151 - DNA, 21 bp, Artificial sequence
  SiRNA target sequence
taagttagcttttgaactagc

SEQ ID NO: 3152 - DNA, 21 bp, Artificial sequence
  SiRNA target sequence
aagttagcttttgaactagcc

SEQ ID NO: 3153 - DNA, 21 bp, Artificial sequence
  SiRNA target sequence
agttagcttttgaactagccc

SEQ ID NO: 3154 - DNA, 21 bp, Artificial sequence
  SiRNA target sequence
gttagcttttgaactagcccc

SEQ ID NO: 3155 - DNA, 21 bp, Artificial sequence
  SiRNA target sequence
ttagcttttgaactagcccct

SEQ ID NO: 3156 - DNA, 21 bp, Artificial sequence
  SiRNA target sequence
tagcttttgaactagcccctc

SEQ ID NO: 3157 - DNA, 21 bp, Artificial sequence
  SiRNA target sequence
agcttttgaactagcccctct

SEQ ID NO: 3158 - DNA, 21 bp, Artificial sequence
  SiRNA target sequence
gcttttgaactagcccctctt

SEQ ID NO: 3159 - DNA, 21 bp, Artificial sequence
  SiRNA target sequence
cttttgaactagcccctcttg

SEQ ID NO: 3160 - DNA, 21 bp, Artificial sequence
  SiRNA target sequence
ttttgaactagcccctcttga

SEQ ID NO: 3161 - DNA, 21 bp, Artificial sequence
  SiRNA target sequence
tttgaactagcccctcttgag

SEQ ID NO: 3162 - DNA, 21 bp, Artificial sequence
  SiRNA target sequence
ttgaactagcccctcttgagt

SEQ ID NO: 3163 - DNA, 21 bp, Artificial sequence
  SiRNA target sequence
tgaactagcccctcttgagta

SEQ ID NO: 3164 - DNA, 21 bp, Artificial sequence
  SiRNA target sequence
gaactagcccctcttgagtat

SEQ ID NO: 3165 - DNA, 21 bp, Artificial sequence
  SiRNA target sequence
aactagcccctcttgagtatg

SEQ ID NO: 3166 - DNA, 21 bp, Artificial sequence
  SiRNA target sequence
actagcccctcttgagtatga

SEQ ID NO: 3167 - DNA, 21 bp, Artificial sequence
  SiRNA target sequence
ctagcccctcttgagtatgag

SEQ ID NO: 3168 - DNA, 21 bp, Artificial sequence
  SiRNA target sequence
tagcccctcttgagtatgaga

SEQ ID NO: 3169 - DNA, 21 bp, Artificial sequence
  SiRNA target sequence
agcccctcttgagtatgagaa

SEQ ID NO: 3170 - DNA, 21 bp, Artificial sequence
  SiRNA target sequence
gcccctcttgagtatgagaaa

SEQ ID NO: 3171 - DNA, 21 bp, Artificial sequence
  SiRNA target sequence
cccctcttgagtatgagaaac

SEQ ID NO: 3172 - DNA, 21 bp, Artificial sequence
  SiRNA target sequence
ccctcttgagtatgagaaaca

SEQ ID NO: 3173 - DNA, 21 bp, Artificial sequence
  SiRNA target sequence
cctcttgagtatgagaaacaa

SEQ ID NO: 3174 - DNA, 21 bp, Artificial sequence
  SiRNA target sequence
ctcttgagtatgagaaacaaa

SEQ ID NO: 3175 - DNA, 21 bp, Artificial sequence
  SiRNA target sequence
tcttgagtatgagaaacaaat

SEQ ID NO: 3176 - DNA, 21 bp, Artificial sequence
  SiRNA target sequence
cttgagtatgagaaacaaatg

SEQ ID NO: 3177 - DNA, 21 bp, Artificial sequence
  SiRNA target sequence
ttgagtatgagaaacaaatgg

SEQ ID NO: 3178 - DNA, 21 bp, Artificial sequence
  SiRNA target sequence
tgagtatgagaaacaaatgga

SEQ ID NO: 3179 - DNA, 21 bp, Artificial sequence
  SiRNA target sequence
gagtatgagaaacaaatggaa

SEQ ID NO: 3180 - DNA, 21 bp, Artificial sequence
  SiRNA target sequence
agtatgagaaacaaatggaaa

SEQ ID NO: 3181 - DNA, 21 bp, Artificial sequence
  SiRNA target sequence
gtatgagaaacaaatggaaag

SEQ ID NO: 3182 - DNA, 21 bp, Artificial sequence
  SiRNA target sequence
tatgagaaacaaatggaaaga

SEQ ID NO: 3183 - DNA, 21 bp, Artificial sequence
  SiRNA target sequence
atgagaaacaaatggaaagaa

SEQ ID NO: 3184 - DNA, 21 bp, Artificial sequence
  SiRNA target sequence
tgagaaacaaatggaaagaat

SEQ ID NO: 3185 - DNA, 21 bp, Artificial sequence
  SiRNA target sequence
gagaaacaaatggaaagaatt

SEQ ID NO: 3186 - DNA, 21 bp, Artificial sequence
  SiRNA target sequence
agaaacaaatggaaagaattt

SEQ ID NO: 3187 - DNA, 21 bp, Artificial sequence
  SiRNA target sequence
gaaacaaatggaaagaatttc

SEQ ID NO: 3188 - DNA, 21 bp, Artificial sequence
  SiRNA target sequence
aaacaaatggaaagaatttca

SEQ ID NO: 3189 - DNA, 21 bp, Artificial sequence
  SiRNA target sequence
aacaaatggaaagaatttcag

SEQ ID NO: 3190 - DNA, 21 bp, Artificial sequence
  SiRNA target sequence
acaaatggaaagaatttcagg

SEQ ID NO: 3191 - DNA, 21 bp, Artificial sequence
  SiRNA target sequence
caaatggaaagaatttcaggg

SEQ ID NO: 3192 - DNA, 21 bp, Artificial sequence
  SiRNA target sequence
aaatggaaagaatttcaggga

SEQ ID NO: 3193 - DNA, 21 bp, Artificial sequence
  SiRNA target sequence
aatggaaagaatttcagggat

SEQ ID NO: 3194 - DNA, 21 bp, Artificial sequence
  SiRNA target sequence
atggaaagaatttcagggatg

SEQ ID NO: 3195 - DNA, 21 bp, Artificial sequence
  SiRNA target sequence
tggaaagaatttcagggatga

SEQ ID NO: 3196 - DNA, 21 bp, Artificial sequence
  SiRNA target sequence
ggaaagaatttcagggatgaa

SEQ ID NO: 3197 - DNA, 21 bp, Artificial sequence
  SiRNA target sequence
gaaagaatttcagggatgaaa

SEQ ID NO: 3198 - DNA, 21 bp, Artificial sequence
  SiRNA target sequence
aaagaatttcagggatgaaat

SEQ ID NO: 3199 - DNA, 21 bp, Artificial sequence
  SiRNA target sequence
aagaatttcagggatgaaatt

SEQ ID NO: 3200 - DNA, 21 bp, Artificial sequence
  SiRNA target sequence
agaatttcagggatgaaattt

SEQ ID NO: 3201 - DNA, 21 bp, Artificial sequence
  SiRNA target sequence
gaatttcagggatgaaatttt

SEQ ID NO: 3202 - DNA, 21 bp, Artificial sequence
  SiRNA target sequence
aatttcagggatgaaatttta

SEQ ID NO: 3203 - DNA, 21 bp, Artificial sequence
  SiRNA target sequence
atttcagggatgaaattttat

SEQ ID NO: 3204 - DNA, 21 bp, Artificial sequence
  SiRNA target sequence
tttcagggatgaaattttatc

SEQ ID NO: 3205 - DNA, 21 bp, Artificial sequence
  SiRNA target sequence
ttcagggatgaaattttatca

SEQ ID NO: 3206 - DNA, 21 bp, Artificial sequence
  SiRNA target sequence
tcagggatgaaattttatcag

SEQ ID NO: 3207 - DNA, 21 bp, Artificial sequence
  SiRNA target sequence
cagggatgaaattttatcaga

SEQ ID NO: 3208 - DNA, 21 bp, Artificial sequence
  SiRNA target sequence
agggatgaaattttatcagaa

SEQ ID NO: 3209 - DNA, 21 bp, Artificial sequence
  SiRNA target sequence
gggatgaaattttatcagaaa

SEQ ID NO: 3210 - DNA, 21 bp, Artificial sequence
  SiRNA target sequence
ggatgaaattttatcagaaaa

SEQ ID NO: 3211 - DNA, 21 bp, Artificial sequence
  SiRNA target sequence
gatgaaattttatcagaaaat

SEQ ID NO: 3212 - DNA, 21 bp, Artificial sequence
  SiRNA target sequence
atgaaattttatcagaaaatg

SEQ ID NO: 3213 - DNA, 21 bp, Artificial sequence
  SiRNA target sequence
tgaaattttatcagaaaatgg

SEQ ID NO: 3214 - DNA, 21 bp, Artificial sequence
  SiRNA target sequence
gaaattttatcagaaaatggc

SEQ ID NO: 3215 - DNA, 21 bp, Artificial sequence
  SiRNA target sequence
aaattttatcagaaaatggca

SEQ ID NO: 3216 - DNA, 21 bp, Artificial sequence
  SiRNA target sequence
aattttatcagaaaatggcaa

SEQ ID NO: 3217 - DNA, 21 bp, Artificial sequence
  SiRNA target sequence
attttatcagaaaatggcaag

SEQ ID NO: 3218 - DNA, 21 bp, Artificial sequence
  SiRNA target sequence
ttttatcagaaaatggcaagt

SEQ ID NO: 3219 - DNA, 21 bp, Artificial sequence
  SiRNA target sequence
tttatcagaaaatggcaagtg

SEQ ID NO: 3220 - DNA, 21 bp, Artificial sequence
  SiRNA target sequence
ttatcagaaaatggcaagtgg

SEQ ID NO: 3221 - DNA, 21 bp, Artificial sequence
  SiRNA target sequence
tatcagaaaatggcaagtggt

SEQ ID NO: 3222 - DNA, 21 bp, Artificial sequence
  SiRNA target sequence
atcagaaaatggcaagtggtg

SEQ ID NO: 3223 - DNA, 21 bp, Artificial sequence
  SiRNA target sequence
tcagaaaatggcaagtggtgt

SEQ ID NO: 3224 - DNA, 21 bp, Artificial sequence
  SiRNA target sequence
cagaaaatggcaagtggtgtt

SEQ ID NO: 3225 - DNA, 21 bp, Artificial sequence
  SiRNA target sequence
agaaaatggcaagtggtgttg

SEQ ID NO: 3226 - DNA, 21 bp, Artificial sequence
  SiRNA target sequence
gaaaatggcaagtggtgttgt

SEQ ID NO: 3227 - DNA, 21 bp, Artificial sequence
  SiRNA target sequence
aaaatggcaagtggtgttgta

SEQ ID NO: 3228 - DNA, 21 bp, Artificial sequence
  SiRNA target sequence
aaatggcaagtggtgttgtat

SEQ ID NO: 3229 - DNA, 21 bp, Artificial sequence
  SiRNA target sequence
aatggcaagtggtgttgtata

SEQ ID NO: 3230 - DNA, 21 bp, Artificial sequence
  SiRNA target sequence
atggcaagtggtgttgtatac

SEQ ID NO: 3231 - DNA, 21 bp, Artificial sequence
  SiRNA target sequence
tggcaagtggtgttgtatacc

SEQ ID NO: 3232 - DNA, 21 bp, Artificial sequence
  SiRNA target sequence
ggcaagtggtgttgtatacct

SEQ ID NO: 3233 - DNA, 21 bp, Artificial sequence
  SiRNA target sequence
gcaagtggtgttgtatacctt

SEQ ID NO: 3234 - DNA, 21 bp, Artificial sequence
  SiRNA target sequence
caagtggtgttgtataccttc

SEQ ID NO: 3235 - DNA, 21 bp, Artificial sequence
  SiRNA target sequence
aagtggtgttgtataccttcg

SEQ ID NO: 3236 - DNA, 21 bp, Artificial sequence
  SiRNA target sequence
agtggtgttgtataccttcgt

SEQ ID NO: 3237 - DNA, 21 bp, Artificial sequence
  SiRNA target sequence
gtggtgttgtataccttcgtc

SEQ ID NO: 3238 - DNA, 21 bp, Artificial sequence
  SiRNA target sequence
tggtgttgtataccttcgtca

SEQ ID NO: 3239 - DNA, 21 bp, Artificial sequence
  SiRNA target sequence
ggtgttgtataccttcgtcaa

SEQ ID NO: 3240 - DNA, 21 bp, Artificial sequence
  SiRNA target sequence
gtgttgtataccttcgtcaag

SEQ ID NO: 3241 - DNA, 21 bp, Artificial sequence
  SiRNA target sequence
tgttgtataccttcgtcaagt

SEQ ID NO: 3242 - DNA, 21 bp, Artificial sequence
  SiRNA target sequence
gttgtataccttcgtcaagtt

SEQ ID NO: 3243 - DNA, 21 bp, Artificial sequence
  SiRNA target sequence
ttgtataccttcgtcaagttc

SEQ ID NO: 3244 - DNA, 21 bp, Artificial sequence
  SiRNA target sequence
tgtataccttcgtcaagttcg

SEQ ID NO: 3245 - DNA, 21 bp, Artificial sequence
  SiRNA target sequence
gtataccttcgtcaagttcgt

SEQ ID NO: 3246 - DNA, 21 bp, Artificial sequence
  SiRNA target sequence
tataccttcgtcaagttcgtg

SEQ ID NO: 3247 - DNA, 21 bp, Artificial sequence
  SiRNA target sequence
ataccttcgtcaagttcgtga

SEQ ID NO: 3248 - DNA, 21 bp, Artificial sequence
  SiRNA target sequence
taccttcgtcaagttcgtgac

SEQ ID NO: 3249 - DNA, 21 bp, Artificial sequence
  SiRNA target sequence
accttcgtcaagttcgtgaca

SEQ ID NO: 3250 - DNA, 21 bp, Artificial sequence
  SiRNA target sequence
ccttcgtcaagttcgtgacac

SEQ ID NO: 3251 - DNA, 21 bp, Artificial sequence
  SiRNA target sequence
cttcgtcaagttcgtgacacg

SEQ ID NO: 3252 - DNA, 21 bp, Artificial sequence
  SiRNA target sequence
ttcgtcaagttcgtgacacga

SEQ ID NO: 3253 - DNA, 21 bp, Artificial sequence
  SiRNA target sequence
tcgtcaagttcgtgacacgag

SEQ ID NO: 3254 - DNA, 21 bp, Artificial sequence
  SiRNA target sequence
cgtcaagttcgtgacacgagt

SEQ ID NO: 3255 - DNA, 21 bp, Artificial sequence
  SiRNA target sequence
gtcaagttcgtgacacgagta

SEQ ID NO: 3256 - DNA, 21 bp, Artificial sequence
  SiRNA target sequence
tcaagttcgtgacacgagtat

SEQ ID NO: 3257 - DNA, 21 bp, Artificial sequence
  SiRNA target sequence
caagttcgtgacacgagtatg

SEQ ID NO: 3258 - DNA, 21 bp, Artificial sequence
  SiRNA target sequence
aagttcgtgacacgagtatga

SEQ ID NO: 3259 - DNA, 21 bp, Artificial sequence
  SiRNA target sequence
agttcgtgacacgagtatgaa

SEQ ID NO: 3260 - DNA, 21 bp, Artificial sequence
  SiRNA target sequence
gttcgtgacacgagtatgaaa

SEQ ID NO: 3261 - DNA, 21 bp, Artificial sequence
  SiRNA target sequence
ttcgtgacacgagtatgaaaa

SEQ ID NO: 3262 - DNA, 21 bp, Artificial sequence
  SiRNA target sequence
tcgtgacacgagtatgaaaat

SEQ ID NO: 3263 - DNA, 21 bp, Artificial sequence
  SiRNA target sequence
cgtgacacgagtatgaaaatg

SEQ ID NO: 3264 - DNA, 21 bp, Artificial sequence
  SiRNA target sequence
gtgacacgagtatgaaaatgc

SEQ ID NO: 3265 - DNA, 21 bp, Artificial sequence
  SiRNA target sequence
tgacacgagtatgaaaatgct

SEQ ID NO: 3266 - DNA, 21 bp, Artificial sequence
  SiRNA target sequence
gacacgagtatgaaaatgctt

SEQ ID NO: 3267 - DNA, 21 bp, Artificial sequence
  SiRNA target sequence
acacgagtatgaaaatgctta

SEQ ID NO: 3268 - DNA, 21 bp, Artificial sequence
  SiRNA target sequence
cacgagtatgaaaatgcttaa

SEQ ID NO: 3269 - DNA, 21 bp, Artificial sequence
  SiRNA target sequence
acgagtatgaaaatgcttaat

SEQ ID NO: 3270 - DNA, 21 bp, Artificial sequence
  SiRNA target sequence
cgagtatgaaaatgcttaatt

SEQ ID NO: 3271 - DNA, 21 bp, Artificial sequence
  SiRNA target sequence
gagtatgaaaatgcttaattc

SEQ ID NO: 3272 - DNA, 21 bp, Artificial sequence
  SiRNA target sequence
agtatgaaaatgcttaattca

SEQ ID NO: 3273 - DNA, 21 bp, Artificial sequence
  SiRNA target sequence
gtatgaaaatgcttaattcat

SEQ ID NO: 3274 - DNA, 21 bp, Artificial sequence
  SiRNA target sequence
tatgaaaatgcttaattcatg

SEQ ID NO: 3275 - DNA, 21 bp, Artificial sequence
  SiRNA target sequence
atgaaaatgcttaattcatgg

SEQ ID NO: 3276 - DNA, 21 bp, Artificial sequence
  SiRNA target sequence
tgaaaatgcttaattcatgga

SEQ ID NO: 3277 - DNA, 21 bp, Artificial sequence
  SiRNA target sequence
gaaaatgcttaattcatggat

SEQ ID NO: 3278 - DNA, 21 bp, Artificial sequence
  SiRNA target sequence
aaaatgcttaattcatggatg

SEQ ID NO: 3279 - DNA, 21 bp, Artificial sequence
  SiRNA target sequence
aaatgcttaattcatggatgg

SEQ ID NO: 3280 - DNA, 21 bp, Artificial sequence
  SiRNA target sequence
aatgcttaattcatggatgga

SEQ ID NO: 3281 - DNA, 21 bp, Artificial sequence
  SiRNA target sequence
atgcttaattcatggatggaa

SEQ ID NO: 3282 - DNA, 21 bp, Artificial sequence
  SiRNA target sequence
tgcttaattcatggatggaag

SEQ ID NO: 3283 - DNA, 21 bp, Artificial sequence
  SiRNA target sequence
gcttaattcatggatggaaga

SEQ ID NO: 3284 - DNA, 21 bp, Artificial sequence
  SiRNA target sequence
cttaattcatggatggaagaa

SEQ ID NO: 3285 - DNA, 21 bp, Artificial sequence
  SiRNA target sequence
ttaattcatggatggaagaat

SEQ ID NO: 3286 - DNA, 21 bp, Artificial sequence
  SiRNA target sequence
taattcatggatggaagaatg

SEQ ID NO: 3287 - DNA, 21 bp, Artificial sequence
  SiRNA target sequence
aattcatggatggaagaatgt

SEQ ID NO: 3288 - DNA, 21 bp, Artificial sequence
  SiRNA target sequence
attcatggatggaagaatgta

SEQ ID NO: 3289 - DNA, 21 bp, Artificial sequence
  SiRNA target sequence
ttcatggatggaagaatgtat

SEQ ID NO: 3290 - DNA, 21 bp, Artificial sequence
  SiRNA target sequence
tcatggatggaagaatgtata

SEQ ID NO: 3291 - DNA, 21 bp, Artificial sequence
  SiRNA target sequence
catggatggaagaatgtatac

SEQ ID NO: 3292 - DNA, 21 bp, Artificial sequence
  SiRNA target sequence
atggatggaagaatgtataca

SEQ ID NO: 3293 - DNA, 21 bp, Artificial sequence
  SiRNA target sequence
tggatggaagaatgtatacaa

SEQ ID NO: 3294 - DNA, 21 bp, Artificial sequence
  SiRNA target sequence
ggatggaagaatgtatacaat

SEQ ID NO: 3295 - DNA, 21 bp, Artificial sequence
  SiRNA target sequence
gatggaagaatgtatacaata

SEQ ID NO: 3296 - DNA, 21 bp, Artificial sequence
  SiRNA target sequence
atggaagaatgtatacaatat

SEQ ID NO: 3297 - DNA, 21 bp, Artificial sequence
  SiRNA target sequence
tggaagaatgtatacaatatg

SEQ ID NO: 3298 - DNA, 21 bp, Artificial sequence
  SiRNA target sequence
ggaagaatgtatacaatatgc

SEQ ID NO: 3299 - DNA, 21 bp, Artificial sequence
  SiRNA target sequence
gaagaatgtatacaatatgca

SEQ ID NO: 3300 - DNA, 21 bp, Artificial sequence
  SiRNA target sequence
aagaatgtatacaatatgcaa

SEQ ID NO: 3301 - DNA, 21 bp, Artificial sequence
  SiRNA target sequence
agaatgtatacaatatgcaaa

SEQ ID NO: 3302 - DNA, 21 bp, Artificial sequence
  SiRNA target sequence
gaatgtatacaatatgcaaag

SEQ ID NO: 3303 - DNA, 21 bp, Artificial sequence
  SiRNA target sequence
aatgtatacaatatgcaaagg

SEQ ID NO: 3304 - DNA, 21 bp, Artificial sequence
  SiRNA target sequence
atgtatacaatatgcaaagga

SEQ ID NO: 3305 - DNA, 21 bp, Artificial sequence
  SiRNA target sequence
tgtatacaatatgcaaaggat

SEQ ID NO: 3306 - DNA, 21 bp, Artificial sequence
  SiRNA target sequence
gtatacaatatgcaaaggatc

SEQ ID NO: 3307 - DNA, 21 bp, Artificial sequence
  SiRNA target sequence
tatacaatatgcaaaggatca

SEQ ID NO: 3308 - DNA, 21 bp, Artificial sequence
  SiRNA target sequence
atacaatatgcaaaggatcac

SEQ ID NO: 3309 - DNA, 21 bp, Artificial sequence
  SiRNA target sequence
tacaatatgcaaaggatcacc

SEQ ID NO: 3310 - DNA, 21 bp, Artificial sequence
  SiRNA target sequence
acaatatgcaaaggatcaccc

SEQ ID NO: 3311 - DNA, 21 bp, Artificial sequence
  SiRNA target sequence
caatatgcaaaggatcaccct

SEQ ID NO: 3312 - DNA, 21 bp, Artificial sequence
  SiRNA target sequence
aatatgcaaaggatcaccctt

SEQ ID NO: 3313 - DNA, 21 bp, Artificial sequence
  SiRNA target sequence
atatgcaaaggatcacccttg

SEQ ID NO: 3314 - DNA, 21 bp, Artificial sequence
  SiRNA target sequence
tatgcaaaggatcacccttgg

SEQ ID NO: 3315 - DNA, 21 bp, Artificial sequence
  SiRNA target sequence
atgcaaaggatcacccttgga

SEQ ID NO: 3316 - DNA, 21 bp, Artificial sequence
  SiRNA target sequence
tgcaaaggatcacccttggac

SEQ ID NO: 3317 - DNA, 21 bp, Artificial sequence
  SiRNA target sequence
gcaaaggatcacccttggaca

SEQ ID NO: 3318 - DNA, 21 bp, Artificial sequence
  SiRNA target sequence
caaaggatcacccttggacaa

SEQ ID NO: 3319 - DNA, 21 bp, Artificial sequence
  SiRNA target sequence
aaaggatcacccttggacaat

SEQ ID NO: 3320 - DNA, 21 bp, Artificial sequence
  SiRNA target sequence
aaggatcacccttggacaata

SEQ ID NO: 3321 - DNA, 21 bp, Artificial sequence
  SiRNA target sequence
aggatcacccttggacaatag

SEQ ID NO: 3322 - DNA, 21 bp, Artificial sequence
  SiRNA target sequence
ggatcacccttggacaatagt

SEQ ID NO: 3323 - DNA, 21 bp, Artificial sequence
  SiRNA target sequence
gatcacccttggacaatagta

SEQ ID NO: 3324 - DNA, 21 bp, Artificial sequence
  SiRNA target sequence
atcacccttggacaatagtag

SEQ ID NO: 3325 - DNA, 21 bp, Artificial sequence
  SiRNA target sequence
tcacccttggacaatagtagc

SEQ ID NO: 3326 - DNA, 21 bp, Artificial sequence
  SiRNA target sequence
cacccttggacaatagtagct

SEQ ID NO: 3327 - DNA, 21 bp, Artificial sequence
  SiRNA target sequence
acccttggacaatagtagctg

SEQ ID NO: 3328 - DNA, 21 bp, Artificial sequence
  SiRNA target sequence
cccttggacaatagtagctgg

SEQ ID NO: 3329 - DNA, 21 bp, Artificial sequence
  SiRNA target sequence
ccttggacaatagtagctgga

SEQ ID NO: 3330 - DNA, 21 bp, Artificial sequence
  SiRNA target sequence
cttggacaatagtagctggag

SEQ ID NO: 3331 - DNA, 21 bp, Artificial sequence
  SiRNA target sequence
ttggacaatagtagctggagt

SEQ ID NO: 3332 - DNA, 21 bp, Artificial sequence
  SiRNA target sequence
tggacaatagtagctggagtt

SEQ ID NO: 3333 - DNA, 21 bp, Artificial sequence
  SiRNA target sequence
ggacaatagtagctggagttc

SEQ ID NO: 3334 - DNA, 21 bp, Artificial sequence
  SiRNA target sequence
gacaatagtagctggagttct

SEQ ID NO: 3335 - DNA, 21 bp, Artificial sequence
  SiRNA target sequence
acaatagtagctggagttcta

SEQ ID NO: 3336 - DNA, 21 bp, Artificial sequence
  SiRNA target sequence
caatagtagctggagttctag

SEQ ID NO: 3337 - DNA, 21 bp, Artificial sequence
  SiRNA target sequence
aatagtagctggagttctagg

SEQ ID NO: 3338 - DNA, 21 bp, Artificial sequence
  SiRNA target sequence
atagtagctggagttctagga

SEQ ID NO: 3339 - DNA, 21 bp, Artificial sequence
  SiRNA target sequence
tagtagctggagttctaggaa

SEQ ID NO: 3340 - DNA, 21 bp, Artificial sequence
  SiRNA target sequence
agtagctggagttctaggaac

SEQ ID NO: 3341 - DNA, 21 bp, Artificial sequence
  SiRNA target sequence
gtagctggagttctaggaacc

SEQ ID NO: 3342 - DNA, 21 bp, Artificial sequence
  SiRNA target sequence
tagctggagttctaggaacct

SEQ ID NO: 3343 - DNA, 21 bp, Artificial sequence
  SiRNA target sequence
agctggagttctaggaacctt

SEQ ID NO: 3344 - DNA, 21 bp, Artificial sequence
  SiRNA target sequence
gctggagttctaggaaccttc

SEQ ID NO: 3345 - DNA, 21 bp, Artificial sequence
  SiRNA target sequence
ctggagttctaggaaccttca

SEQ ID NO: 3346 - DNA, 21 bp, Artificial sequence
  SiRNA target sequence
tggagttctaggaaccttcat

SEQ ID NO: 3347 - DNA, 21 bp, Artificial sequence
  SiRNA target sequence
ggagttctaggaaccttcatt

SEQ ID NO: 3348 - DNA, 21 bp, Artificial sequence
  SiRNA target sequence
gagttctaggaaccttcattg

SEQ ID NO: 3349 - DNA, 21 bp, Artificial sequence
  SiRNA target sequence
agttctaggaaccttcattgg

SEQ ID NO: 3350 - DNA, 21 bp, Artificial sequence
  SiRNA target sequence
gttctaggaaccttcattggc

SEQ ID NO: 3351 - DNA, 21 bp, Artificial sequence
  SiRNA target sequence
ttctaggaaccttcattggca

SEQ ID NO: 3352 - DNA, 21 bp, Artificial sequence
  SiRNA target sequence
tctaggaaccttcattggcat

SEQ ID NO: 3353 - DNA, 21 bp, Artificial sequence
  SiRNA target sequence
ctaggaaccttcattggcatt

SEQ ID NO: 3354 - DNA, 21 bp, Artificial sequence
  SiRNA target sequence
taggaaccttcattggcattc

SEQ ID NO: 3355 - DNA, 21 bp, Artificial sequence
  SiRNA target sequence
aggaaccttcattggcattct

SEQ ID NO: 3356 - DNA, 21 bp, Artificial sequence
  SiRNA target sequence
ggaaccttcattggcattctc

SEQ ID NO: 3357 - DNA, 21 bp, Artificial sequence
  SiRNA target sequence
gaaccttcattggcattctca

SEQ ID NO: 3358 - DNA, 21 bp, Artificial sequence
  SiRNA target sequence
aaccttcattggcattctcac

SEQ ID NO: 3359 - DNA, 21 bp, Artificial sequence
  SiRNA target sequence
accttcattggcattctcacc

SEQ ID NO: 3360 - DNA, 21 bp, Artificial sequence
  SiRNA target sequence
ccttcattggcattctcacca

SEQ ID NO: 3361 - DNA, 21 bp, Artificial sequence
  SiRNA target sequence
cttcattggcattctcaccat

SEQ ID NO: 3362 - DNA, 21 bp, Artificial sequence
  SiRNA target sequence
ttcattggcattctcaccatt

SEQ ID NO: 3363 - DNA, 21 bp, Artificial sequence
  SiRNA target sequence
tcattggcattctcaccattg

SEQ ID NO: 3364 - DNA, 21 bp, Artificial sequence
  SiRNA target sequence
cattggcattctcaccattgt

SEQ ID NO: 3365 - DNA, 21 bp, Artificial sequence
  SiRNA target sequence
attggcattctcaccattgtt

SEQ ID NO: 3366 - DNA, 21 bp, Artificial sequence
  SiRNA target sequence
ttggcattctcaccattgttg

SEQ ID NO: 3367 - DNA, 21 bp, Artificial sequence
  SiRNA target sequence
tggcattctcaccattgttgg

SEQ ID NO: 3368 - DNA, 21 bp, Artificial sequence
  SiRNA target sequence
ggcattctcaccattgttggt

SEQ ID NO: 3369 - DNA, 21 bp, Artificial sequence
  SiRNA target sequence
gcattctcaccattgttggtt

SEQ ID NO: 3370 - DNA, 21 bp, Artificial sequence
  SiRNA target sequence
cattctcaccattgttggttt

SEQ ID NO: 3371 - DNA, 21 bp, Artificial sequence
  SiRNA target sequence
attctcaccattgttggtttc

SEQ ID NO: 3372 - DNA, 21 bp, Artificial sequence
  SiRNA target sequence
ttctcaccattgttggtttct

SEQ ID NO: 3373 - DNA, 21 bp, Artificial sequence
  SiRNA target sequence
tctcaccattgttggtttctg

SEQ ID NO: 3374 - DNA, 21 bp, Artificial sequence
  SiRNA target sequence
ctcaccattgttggtttctgg

SEQ ID NO: 3375 - DNA, 21 bp, Artificial sequence
  SiRNA target sequence
tcaccattgttggtttctgga

SEQ ID NO: 3376 - DNA, 21 bp, Artificial sequence
  SiRNA target sequence
caccattgttggtttctggaa

SEQ ID NO: 3377 - DNA, 21 bp, Artificial sequence
  SiRNA target sequence
accattgttggtttctggaaa

SEQ ID NO: 3378 - DNA, 21 bp, Artificial sequence
  SiRNA target sequence
ccattgttggtttctggaaat

SEQ ID NO: 3379 - DNA, 21 bp, Artificial sequence
  SiRNA target sequence
cattgttggtttctggaaatg

SEQ ID NO: 3380 - DNA, 21 bp, Artificial sequence
  SiRNA target sequence
attgttggtttctggaaatgg

SEQ ID NO: 3381 - DNA, 21 bp, Artificial sequence
  SiRNA target sequence
ttgttggtttctggaaatggc

SEQ ID NO: 3382 - DNA, 21 bp, Artificial sequence
  SiRNA target sequence
tgttggtttctggaaatggct

SEQ ID NO: 3383 - DNA, 21 bp, Artificial sequence
  SiRNA target sequence
gttggtttctggaaatggcta

SEQ ID NO: 3384 - DNA, 21 bp, Artificial sequence
  SiRNA target sequence
ttggtttctggaaatggctat

SEQ ID NO: 3385 - DNA, 21 bp, Artificial sequence
  SiRNA target sequence
tggtttctggaaatggctatg

SEQ ID NO: 3386 - DNA, 21 bp, Artificial sequence
  SiRNA target sequence
ggtttctggaaatggctatgc

SEQ ID NO: 3387 - DNA, 21 bp, Artificial sequence
  SiRNA target sequence
gtttctggaaatggctatgct

SEQ ID NO: 3388 - DNA, 21 bp, Artificial sequence
  SiRNA target sequence
tttctggaaatggctatgctc

SEQ ID NO: 3389 - DNA, 21 bp, Artificial sequence
  SiRNA target sequence
ttctggaaatggctatgctct

SEQ ID NO: 3390 - DNA, 21 bp, Artificial sequence
  SiRNA target sequence
tctggaaatggctatgctctg

SEQ ID NO: 3391 - DNA, 21 bp, Artificial sequence
  SiRNA target sequence
ctggaaatggctatgctctga

SEQ ID NO: 3392 - DNA, 21 bp, Artificial sequence
  SiRNA target sequence
tggaaatggctatgctctgat

SEQ ID NO: 3393 - DNA, 21 bp, Artificial sequence
  SiRNA target sequence
ggaaatggctatgctctgatg

SEQ ID NO: 3394 - DNA, 21 bp, Artificial sequence
  SiRNA target sequence
gaaatggctatgctctgatgg

SEQ ID NO: 3395 - DNA, 21 bp, Artificial sequence
  SiRNA target sequence
aaatggctatgctctgatgga

SEQ ID NO: 3396 - DNA, 21 bp, Artificial sequence
  SiRNA target sequence
aatggctatgctctgatggac

SEQ ID NO: 3397 - DNA, 21 bp, Artificial sequence
  SiRNA target sequence
atggctatgctctgatggaca

SEQ ID NO: 3398 - DNA, 21 bp, Artificial sequence
  SiRNA target sequence
tggctatgctctgatggacag

SEQ ID NO: 3399 - DNA, 21 bp, Artificial sequence
  SiRNA target sequence
ggctatgctctgatggacaga

SEQ ID NO: 3400 - DNA, 21 bp, Artificial sequence
  SiRNA target sequence
gctatgctctgatggacagaa

SEQ ID NO: 3401 - DNA, 21 bp, Artificial sequence
  SiRNA target sequence
ctatgctctgatggacagaag

SEQ ID NO: 3402 - DNA, 21 bp, Artificial sequence
  SiRNA target sequence
tatgctctgatggacagaaga

SEQ ID NO: 3403 - DNA, 21 bp, Artificial sequence
  SiRNA target sequence
atgctctgatggacagaagaa

SEQ ID NO: 3404 - DNA, 21 bp, Artificial sequence
  SiRNA target sequence
tgctctgatggacagaagaag

SEQ ID NO: 3405 - DNA, 21 bp, Artificial sequence
  SiRNA target sequence
gctctgatggacagaagaaga

SEQ ID NO: 3406 - DNA, 21 bp, Artificial sequence
  SiRNA target sequence
ctctgatggacagaagaagaa

SEQ ID NO: 3407 - DNA, 21 bp, Artificial sequence
  SiRNA target sequence
tctgatggacagaagaagaaa

SEQ ID NO: 3408 - DNA, 21 bp, Artificial sequence
  SiRNA target sequence
ctgatggacagaagaagaaac

SEQ ID NO: 3409 - DNA, 21 bp, Artificial sequence
  SiRNA target sequence
tgatggacagaagaagaaaca

SEQ ID NO: 3410 - DNA, 21 bp, Artificial sequence
  SiRNA target sequence
gatggacagaagaagaaacag

SEQ ID NO: 3411 - DNA, 21 bp, Artificial sequence
  SiRNA target sequence
atggacagaagaagaaacagg

SEQ ID NO: 3412 - DNA, 21 bp, Artificial sequence
  SiRNA target sequence
tggacagaagaagaaacaggc

SEQ ID NO: 3413 - DNA, 21 bp, Artificial sequence
  SiRNA target sequence
ggacagaagaagaaacaggca

SEQ ID NO: 3414 - DNA, 21 bp, Artificial sequence
  SiRNA target sequence
gacagaagaagaaacaggcaa

SEQ ID NO: 3415 - DNA, 21 bp, Artificial sequence
  SiRNA target sequence
acagaagaagaaacaggcaat

SEQ ID NO: 3416 - DNA, 21 bp, Artificial sequence
  SiRNA target sequence
cagaagaagaaacaggcaatt

SEQ ID NO: 3417 - DNA, 21 bp, Artificial sequence
  SiRNA target sequence
agaagaagaaacaggcaatta

SEQ ID NO: 3418 - DNA, 21 bp, Artificial sequence
  SiRNA target sequence
gaagaagaaacaggcaattaa

SEQ ID NO: 3419 - DNA, 21 bp, Artificial sequence
  SiRNA target sequence
aagaagaaacaggcaattaag

SEQ ID NO: 3420 - DNA, 21 bp, Artificial sequence
  SiRNA target sequence
agaagaaacaggcaattaagc

SEQ ID NO: 3421 - DNA, 21 bp, Artificial sequence
  SiRNA target sequence
gaagaaacaggcaattaagcg

SEQ ID NO: 3422 - DNA, 21 bp, Artificial sequence
  SiRNA target sequence
aagaaacaggcaattaagcgt

SEQ ID NO: 3423 - DNA, 21 bp, Artificial sequence
  SiRNA target sequence
agaaacaggcaattaagcgtc

SEQ ID NO: 3424 - DNA, 21 bp, Artificial sequence
  SiRNA target sequence
gaaacaggcaattaagcgtca

SEQ ID NO: 3425 - DNA, 21 bp, Artificial sequence
  SiRNA target sequence
aaacaggcaattaagcgtcat

SEQ ID NO: 3426 - DNA, 21 bp, Artificial sequence
  SiRNA target sequence
aacaggcaattaagcgtcatt

SEQ ID NO: 3427 - DNA, 21 bp, Artificial sequence
  SiRNA target sequence
acaggcaattaagcgtcattt

SEQ ID NO: 3428 - DNA, 21 bp, Artificial sequence
  SiRNA target sequence
caggcaattaagcgtcatttc

SEQ ID NO: 3429 - DNA, 21 bp, Artificial sequence
  SiRNA target sequence
aggcaattaagcgtcatttca

SEQ ID NO: 3430 - DNA, 21 bp, Artificial sequence
  SiRNA target sequence
ggcaattaagcgtcatttcat

SEQ ID NO: 3431 - DNA, 21 bp, Artificial sequence
  SiRNA target sequence
gcaattaagcgtcatttcatt

SEQ ID NO: 3432 - DNA, 21 bp, Artificial sequence
  SiRNA target sequence
caattaagcgtcatttcatta

SEQ ID NO: 3433 - DNA, 21 bp, Artificial sequence
  SiRNA target sequence
aattaagcgtcatttcattaa

SEQ ID NO: 3434 - DNA, 21 bp, Artificial sequence
  SiRNA target sequence
attaagcgtcatttcattaat

SEQ ID NO: 3435 - DNA, 21 bp, Artificial sequence
  SiRNA target sequence
ttaagcgtcatttcattaata

SEQ ID NO: 3436 - DNA, 21 bp, Artificial sequence
  SiRNA target sequence
taagcgtcatttcattaatac

SEQ ID NO: 3437 - DNA, 21 bp, Artificial sequence
  SiRNA target sequence
aagcgtcatttcattaatact

SEQ ID NO: 3438 - DNA, 21 bp, Artificial sequence
  SiRNA target sequence
agcgtcatttcattaatactg

SEQ ID NO: 3439 - DNA, 21 bp, Artificial sequence
  SiRNA target sequence
gcgtcatttcattaatactgg

SEQ ID NO: 3440 - DNA, 21 bp, Artificial sequence
  SiRNA target sequence
cgtcatttcattaatactgga

SEQ ID NO: 3441 - DNA, 21 bp, Artificial sequence
  SiRNA target sequence
gtcatttcattaatactggat

SEQ ID NO: 3442 - DNA, 21 bp, Artificial sequence
  SiRNA target sequence
tcatttcattaatactggata

SEQ ID NO: 3443 - DNA, 21 bp, Artificial sequence
  SiRNA target sequence
catttcattaatactggatac

SEQ ID NO: 3444 - DNA, 21 bp, Artificial sequence
  SiRNA target sequence
atttcattaatactggataca

SEQ ID NO: 3445 - DNA, 21 bp, Artificial sequence
  SiRNA target sequence
tttcattaatactggatacac

SEQ ID NO: 3446 - DNA, 21 bp, Artificial sequence
  SiRNA target sequence
ttcattaatactggatacacg

SEQ ID NO: 3447 - DNA, 21 bp, Artificial sequence
  SiRNA target sequence
tcattaatactggatacacgc

SEQ ID NO: 3448 - DNA, 21 bp, Artificial sequence
  SiRNA target sequence
cattaatactggatacacgct

SEQ ID NO: 3449 - DNA, 21 bp, Artificial sequence
  SiRNA target sequence
attaatactggatacacgctt

SEQ ID NO: 3450 - DNA, 21 bp, Artificial sequence
  SiRNA target sequence
ttaatactggatacacgctta

SEQ ID NO: 3451 - DNA, 21 bp, Artificial sequence
  SiRNA target sequence
taatactggatacacgcttat

SEQ ID NO: 3452 - DNA, 21 bp, Artificial sequence
  SiRNA target sequence
aatactggatacacgcttatt

SEQ ID NO: 3453 - DNA, 21 bp, Artificial sequence
  SiRNA target sequence
atactggatacacgcttatta

SEQ ID NO: 3454 - DNA, 21 bp, Artificial sequence
  SiRNA target sequence
tactggatacacgcttattat

SEQ ID NO: 3455 - DNA, 21 bp, Artificial sequence
  SiRNA target sequence
actggatacacgcttattata

SEQ ID NO: 3456 - DNA, 21 bp, Artificial sequence
  SiRNA target sequence
ctggatacacgcttattatac

SEQ ID NO: 3457 - DNA, 21 bp, Artificial sequence
  SiRNA target sequence
tggatacacgcttattatacc

SEQ ID NO: 3458 - DNA, 21 bp, Artificial sequence
  SiRNA target sequence
ggatacacgcttattatacct

SEQ ID NO: 3459 - DNA, 21 bp, Artificial sequence
  SiRNA target sequence
gatacacgcttattatacctg

SEQ ID NO: 3460 - DNA, 21 bp, Artificial sequence
  SiRNA target sequence
atacacgcttattatacctga

SEQ ID NO: 3461 - DNA, 21 bp, Artificial sequence
  SiRNA target sequence
tacacgcttattatacctgaa

SEQ ID NO: 3462 - DNA, 21 bp, Artificial sequence
  SiRNA target sequence
acacgcttattatacctgaac

SEQ ID NO: 3463 - DNA, 21 bp, Artificial sequence
  SiRNA target sequence
cacgcttattatacctgaacg

SEQ ID NO: 3464 - DNA, 21 bp, Artificial sequence
  SiRNA target sequence
acgcttattatacctgaacga

SEQ ID NO: 3465 - DNA, 21 bp, Artificial sequence
  SiRNA target sequence
cgcttattatacctgaacgag

SEQ ID NO: 3466 - DNA, 21 bp, Artificial sequence
  SiRNA target sequence
gcttattatacctgaacgaga

SEQ ID NO: 3467 - DNA, 21 bp, Artificial sequence
  SiRNA target sequence
cttattatacctgaacgagaa

SEQ ID NO: 3468 - DNA, 21 bp, Artificial sequence
  SiRNA target sequence
ttattatacctgaacgagaat

SEQ ID NO: 3469 - DNA, 21 bp, Artificial sequence
  SiRNA target sequence
tattatacctgaacgagaatt

SEQ ID NO: 3470 - DNA, 21 bp, Artificial sequence
  SiRNA target sequence
attatacctgaacgagaattg

SEQ ID NO: 3471 - DNA, 21 bp, Artificial sequence
  SiRNA target sequence
ttatacctgaacgagaattga

SEQ ID NO: 3472 - DNA, 21 bp, Artificial sequence
  SiRNA target sequence
tatacctgaacgagaattgaa

SEQ ID NO: 3473 - DNA, 21 bp, Artificial sequence
  SiRNA target sequence
atacctgaacgagaattgaat

SEQ ID NO: 3474 - DNA, 21 bp, Artificial sequence
  SiRNA target sequence
tacctgaacgagaattgaata

SEQ ID NO: 3475 - DNA, 21 bp, Artificial sequence
  SiRNA target sequence
acctgaacgagaattgaataa

SEQ ID NO: 3476 - DNA, 21 bp, Artificial sequence
  SiRNA target sequence
cctgaacgagaattgaataaa

SEQ ID NO: 3477 - DNA, 21 bp, Artificial sequence
  SiRNA target sequence
ctgaacgagaattgaataaat

SEQ ID NO: 3478 - DNA, 21 bp, Artificial sequence
  SiRNA target sequence
tgaacgagaattgaataaatt

SEQ ID NO: 3479 - DNA, 21 bp, Artificial sequence
  SiRNA target sequence
gaacgagaattgaataaattc

SEQ ID NO: 3480 - DNA, 21 bp, Artificial sequence
  SiRNA target sequence
aacgagaattgaataaattct

SEQ ID NO: 3481 - DNA, 21 bp, Artificial sequence
  SiRNA target sequence
acgagaattgaataaattctg

SEQ ID NO: 3482 - DNA, 21 bp, Artificial sequence
  SiRNA target sequence
cgagaattgaataaattctgg

SEQ ID NO: 3483 - DNA, 21 bp, Artificial sequence
  SiRNA target sequence
gagaattgaataaattctggg

SEQ ID NO: 3484 - DNA, 21 bp, Artificial sequence
  SiRNA target sequence
agaattgaataaattctggga

SEQ ID NO: 3485 - DNA, 21 bp, Artificial sequence
  SiRNA target sequence
gaattgaataaattctgggag

SEQ ID NO: 3486 - DNA, 21 bp, Artificial sequence
  SiRNA target sequence
aattgaataaattctgggagt

SEQ ID NO: 3487 - DNA, 21 bp, Artificial sequence
  SiRNA target sequence
attgaataaattctgggagtt

SEQ ID NO: 3488 - DNA, 21 bp, Artificial sequence
  SiRNA target sequence
ttgaataaattctgggagttg

SEQ ID NO: 3489 - DNA, 21 bp, Artificial sequence
  SiRNA target sequence
tgaataaattctgggagttgg

SEQ ID NO: 3490 - DNA, 21 bp, Artificial sequence
  SiRNA target sequence
gaataaattctgggagttgga

SEQ ID NO: 3491 - DNA, 21 bp, Artificial sequence
  SiRNA target sequence
aataaattctgggagttggat

SEQ ID NO: 3492 - DNA, 21 bp, Artificial sequence
  SiRNA target sequence
ataaattctgggagttggatg

SEQ ID NO: 3493 - DNA, 21 bp, Artificial sequence
  SiRNA target sequence
taaattctgggagttggatga

SEQ ID NO: 3494 - DNA, 21 bp, Artificial sequence
  SiRNA target sequence
aaattctgggagttggatgaa

SEQ ID NO: 3495 - DNA, 21 bp, Artificial sequence
  SiRNA target sequence
aattctgggagttggatgaaa

SEQ ID NO: 3496 - DNA, 21 bp, Artificial sequence
  SiRNA target sequence
attctgggagttggatgaaac

SEQ ID NO: 3497 - DNA, 21 bp, Artificial sequence
  SiRNA target sequence
ttctgggagttggatgaaact

SEQ ID NO: 3498 - DNA, 21 bp, Artificial sequence
  SiRNA target sequence
tctgggagttggatgaaactc

SEQ ID NO: 3499 - DNA, 21 bp, Artificial sequence
  SiRNA target sequence
ctgggagttggatgaaactct

SEQ ID NO: 3500 - DNA, 21 bp, Artificial sequence
  SiRNA target sequence
tgggagttggatgaaactctc

SEQ ID NO: 3501 - DNA, 21 bp, Artificial sequence
  SiRNA target sequence
gggagttggatgaaactctcg

SEQ ID NO: 3502 - DNA, 21 bp, Artificial sequence
  SiRNA target sequence
ggagttggatgaaactctcga

SEQ ID NO: 3503 - DNA, 21 bp, Artificial sequence
  SiRNA target sequence
gagttggatgaaactctcgat

SEQ ID NO: 3504 - DNA, 21 bp, Artificial sequence
  SiRNA target sequence
agttggatgaaactctcgatt

SEQ ID NO: 3505 - DNA, 21 bp, Artificial sequence
  SiRNA target sequence
gttggatgaaactctcgattt

SEQ ID NO: 3506 - DNA, 21 bp, Artificial sequence
  SiRNA target sequence
ttggatgaaactctcgattta

SEQ ID NO: 3507 - DNA, 21 bp, Artificial sequence
  SiRNA target sequence
tggatgaaactctcgatttac

SEQ ID NO: 3508 - DNA, 21 bp, Artificial sequence
  SiRNA target sequence
ggatgaaactctcgatttacg

SEQ ID NO: 3509 - DNA, 21 bp, Artificial sequence
  SiRNA target sequence
gatgaaactctcgatttacgt

SEQ ID NO: 3510 - DNA, 21 bp, Artificial sequence
  SiRNA target sequence
atgaaactctcgatttacgtg

SEQ ID NO: 3511 - DNA, 21 bp, Artificial sequence
  SiRNA target sequence
tgaaactctcgatttacgtgg

SEQ ID NO: 3512 - DNA, 21 bp, Artificial sequence
  SiRNA target sequence
gaaactctcgatttacgtgga

SEQ ID NO: 3513 - DNA, 21 bp, Artificial sequence
  SiRNA target sequence
aaactctcgatttacgtggaa

SEQ ID NO: 3514 - DNA, 21 bp, Artificial sequence
  SiRNA target sequence
aactctcgatttacgtggaat

SEQ ID NO: 3515 - DNA, 21 bp, Artificial sequence
  SiRNA target sequence
actctcgatttacgtggaatg

SEQ ID NO: 3516 - DNA, 21 bp, Artificial sequence
  SiRNA target sequence
ctctcgatttacgtggaatgc

SEQ ID NO: 3517 - DNA, 21 bp, Artificial sequence
  SiRNA target sequence
tctcgatttacgtggaatgcc

SEQ ID NO: 3518 - DNA, 21 bp, Artificial sequence
  SiRNA target sequence
ctcgatttacgtggaatgcct

SEQ ID NO: 3519 - DNA, 21 bp, Artificial sequence
  SiRNA target sequence
tcgatttacgtggaatgcctg

SEQ ID NO: 3520 - DNA, 21 bp, Artificial sequence
  SiRNA target sequence
cgatttacgtggaatgcctgt

SEQ ID NO: 3521 - DNA, 21 bp, Artificial sequence
  SiRNA target sequence
gatttacgtggaatgcctgta

SEQ ID NO: 3522 - DNA, 21 bp, Artificial sequence
  SiRNA target sequence
atttacgtggaatgcctgtaa

SEQ ID NO: 3523 - DNA, 21 bp, Artificial sequence
  SiRNA target sequence
tttacgtggaatgcctgtaaa

SEQ ID NO: 3524 - DNA, 21 bp, Artificial sequence
  SiRNA target sequence
ttacgtggaatgcctgtaaat

SEQ ID NO: 3525 - DNA, 21 bp, Artificial sequence
  SiRNA target sequence
tacgtggaatgcctgtaaatc

SEQ ID NO: 3526 - DNA, 21 bp, Artificial sequence
  SiRNA target sequence
acgtggaatgcctgtaaatca

SEQ ID NO: 3527 - DNA, 21 bp, Artificial sequence
  SiRNA target sequence
cgtggaatgcctgtaaatcaa

SEQ ID NO: 3528 - DNA, 21 bp, Artificial sequence
  SiRNA target sequence
gtggaatgcctgtaaatcaaa

SEQ ID NO: 3529 - DNA, 21 bp, Artificial sequence
  SiRNA target sequence
tggaatgcctgtaaatcaaat

SEQ ID NO: 3530 - DNA, 21 bp, Artificial sequence
  SiRNA target sequence
ggaatgcctgtaaatcaaata

SEQ ID NO: 3531 - DNA, 21 bp, Artificial sequence
  SiRNA target sequence
gaatgcctgtaaatcaaatag

SEQ ID NO: 3532 - DNA, 21 bp, Artificial sequence
  SiRNA target sequence
aatgcctgtaaatcaaataga

SEQ ID NO: 3533 - DNA, 21 bp, Artificial sequence
  SiRNA target sequence
atgcctgtaaatcaaatagag

SEQ ID NO: 3534 - DNA, 21 bp, Artificial sequence
  SiRNA target sequence
tgcctgtaaatcaaatagagg

SEQ ID NO: 3535 - DNA, 21 bp, Artificial sequence
  SiRNA target sequence
gcctgtaaatcaaatagagga

SEQ ID NO: 3536 - DNA, 21 bp, Artificial sequence
  SiRNA target sequence
cctgtaaatcaaatagaggaa

SEQ ID NO: 3537 - DNA, 21 bp, Artificial sequence
  SiRNA target sequence
ctgtaaatcaaatagaggaac

SEQ ID NO: 3538 - DNA, 21 bp, Artificial sequence
  SiRNA target sequence
tgtaaatcaaatagaggaaca

SEQ ID NO: 3539 - DNA, 21 bp, Artificial sequence
  SiRNA target sequence
gtaaatcaaatagaggaacat

SEQ ID NO: 3540 - DNA, 21 bp, Artificial sequence
  SiRNA target sequence
taaatcaaatagaggaacatc

SEQ ID NO: 3541 - DNA, 21 bp, Artificial sequence
  SiRNA target sequence
aaatcaaatagaggaacatct

SEQ ID NO: 3542 - DNA, 21 bp, Artificial sequence
  SiRNA target sequence
aatcaaatagaggaacatctc

SEQ ID NO: 3543 - DNA, 21 bp, Artificial sequence
  SiRNA target sequence
atcaaatagaggaacatctcg

SEQ ID NO: 3544 - DNA, 21 bp, Artificial sequence
  SiRNA target sequence
tcaaatagaggaacatctcgc

SEQ ID NO: 3545 - DNA, 21 bp, Artificial sequence
  SiRNA target sequence
caaatagaggaacatctcgct

SEQ ID NO: 3546 - DNA, 21 bp, Artificial sequence
  SiRNA target sequence
aaatagaggaacatctcgctc

SEQ ID NO: 3547 - DNA, 21 bp, Artificial sequence
  SiRNA target sequence
aatagaggaacatctcgctct

SEQ ID NO: 3548 - DNA, 21 bp, Artificial sequence
  SiRNA target sequence
atagaggaacatctcgctcta

SEQ ID NO: 3549 - DNA, 21 bp, Artificial sequence
  SiRNA target sequence
tagaggaacatctcgctctac

SEQ ID NO: 3550 - DNA, 21 bp, Artificial sequence
  SiRNA target sequence
agaggaacatctcgctctact

SEQ ID NO: 3551 - DNA, 21 bp, Artificial sequence
  SiRNA target sequence
gaggaacatctcgctctacta

SEQ ID NO: 3552 - DNA, 21 bp, Artificial sequence
  SiRNA target sequence
aggaacatctcgctctactac

SEQ ID NO: 3553 - DNA, 21 bp, Artificial sequence
  SiRNA target sequence
ggaacatctcgctctactact

SEQ ID NO: 3554 - DNA, 21 bp, Artificial sequence
  SiRNA target sequence
gaacatctcgctctactactg

SEQ ID NO: 3555 - DNA, 21 bp, Artificial sequence
  SiRNA target sequence
aacatctcgctctactactga

SEQ ID NO: 3556 - DNA, 21 bp, Artificial sequence
  SiRNA target sequence
acatctcgctctactactgaa

SEQ ID NO: 3557 - DNA, 21 bp, Artificial sequence
  SiRNA target sequence
catctcgctctactactgaag

SEQ ID NO: 3558 - DNA, 21 bp, Artificial sequence
  SiRNA target sequence
atctcgctctactactgaagc

SEQ ID NO: 3559 - DNA, 21 bp, Artificial sequence
  SiRNA target sequence
tctcgctctactactgaagcc

SEQ ID NO: 3560 - DNA, 21 bp, Artificial sequence
  SiRNA target sequence
ctcgctctactactgaagccg

SEQ ID NO: 3561 - DNA, 21 bp, Artificial sequence
  SiRNA target sequence
tcgctctactactgaagccgc

SEQ ID NO: 3562 - DNA, 21 bp, Artificial sequence
  SiRNA target sequence
cgctctactactgaagccgcg

SEQ ID NO: 3563 - DNA, 21 bp, Artificial sequence
  SiRNA target sequence
gctctactactgaagccgcgt

SEQ ID NO: 3564 - DNA, 21 bp, Artificial sequence
  SiRNA target sequence
ctctactactgaagccgcgtc

SEQ ID NO: 3565 - DNA, 21 bp, Artificial sequence
  SiRNA target sequence
tctactactgaagccgcgtca

SEQ ID NO: 3566 - DNA, 21 bp, Artificial sequence
  SiRNA target sequence
ctactactgaagccgcgtcat

SEQ ID NO: 3567 - DNA, 21 bp, Artificial sequence
  SiRNA target sequence
tactactgaagccgcgtcatc

SEQ ID NO: 3568 - DNA, 21 bp, Artificial sequence
  SiRNA target sequence
actactgaagccgcgtcatcg

SEQ ID NO: 3569 - DNA, 21 bp, Artificial sequence
  SiRNA target sequence
ctactgaagccgcgtcatcgc

SEQ ID NO: 3570 - DNA, 21 bp, Artificial sequence
  SiRNA target sequence
tactgaagccgcgtcatcgcg

SEQ ID NO: 3571 - DNA, 21 bp, Artificial sequence
  SiRNA target sequence
actgaagccgcgtcatcgcgt

SEQ ID NO: 3572 - DNA, 21 bp, Artificial sequence
  SiRNA target sequence
ctgaagccgcgtcatcgcgtg

SEQ ID NO: 3573 - DNA, 21 bp, Artificial sequence
  SiRNA target sequence
tgaagccgcgtcatcgcgtgg

SEQ ID NO: 3574 - DNA, 21 bp, Artificial sequence
  SiRNA target sequence
gaagccgcgtcatcgcgtggt

SEQ ID NO: 3575 - DNA, 21 bp, Artificial sequence
  SiRNA target sequence
aagccgcgtcatcgcgtggtt

SEQ ID NO: 3576 - DNA, 21 bp, Artificial sequence
  SiRNA target sequence
agccgcgtcatcgcgtggttt

SEQ ID NO: 3577 - DNA, 21 bp, Artificial sequence
  SiRNA target sequence
gccgcgtcatcgcgtggtttt

SEQ ID NO: 3578 - DNA, 21 bp, Artificial sequence
  SiRNA target sequence
ccgcgtcatcgcgtggtttta

SEQ ID NO: 3579 - DNA, 21 bp, Artificial sequence
  SiRNA target sequence
cgcgtcatcgcgtggttttag

SEQ ID NO: 3580 - DNA, 21 bp, Artificial sequence
  SiRNA target sequence
gcgtcatcgcgtggttttagt

SEQ ID NO: 3581 - DNA, 21 bp, Artificial sequence
  SiRNA target sequence
cgtcatcgcgtggttttagta

SEQ ID NO: 3582 - DNA, 21 bp, Artificial sequence
  SiRNA target sequence
gtcatcgcgtggttttagtac

SEQ ID NO: 3583 - DNA, 21 bp, Artificial sequence
  SiRNA target sequence
tcatcgcgtggttttagtacc

SEQ ID NO: 3584 - DNA, 21 bp, Artificial sequence
  SiRNA target sequence
catcgcgtggttttagtacct

SEQ ID NO: 3585 - DNA, 21 bp, Artificial sequence
  SiRNA target sequence
atcgcgtggttttagtaccta

SEQ ID NO: 3586 - DNA, 21 bp, Artificial sequence
  SiRNA target sequence
tcgcgtggttttagtacctaa

SEQ ID NO: 3587 - DNA, 21 bp, Artificial sequence
  SiRNA target sequence
cgcgtggttttagtacctaaa

SEQ ID NO: 3588 - DNA, 21 bp, Artificial sequence
  SiRNA target sequence
gcgtggttttagtacctaaag

SEQ ID NO: 3589 - DNA, 21 bp, Artificial sequence
  SiRNA target sequence
cgtggttttagtacctaaagc

SEQ ID NO: 3590 - DNA, 21 bp, Artificial sequence
  SiRNA target sequence
gtggttttagtacctaaagcc

SEQ ID NO: 3591 - DNA, 21 bp, Artificial sequence
  SiRNA target sequence
tggttttagtacctaaagcca

SEQ ID NO: 3592 - DNA, 21 bp, Artificial sequence
  SiRNA target sequence
ggttttagtacctaaagccac

SEQ ID NO: 3593 - DNA, 21 bp, Artificial sequence
  SiRNA target sequence
gttttagtacctaaagccact

SEQ ID NO: 3594 - DNA, 21 bp, Artificial sequence
  SiRNA target sequence
ttttagtacctaaagccacta

SEQ ID NO: 3595 - DNA, 21 bp, Artificial sequence
  SiRNA target sequence
tttagtacctaaagccactaa

SEQ ID NO: 3596 - DNA, 21 bp, Artificial sequence
  SiRNA target sequence
ttagtacctaaagccactaag

SEQ ID NO: 3597 - DNA, 21 bp, Artificial sequence
  SiRNA target sequence
tagtacctaaagccactaagt

SEQ ID NO: 3598 - DNA, 21 bp, Artificial sequence
  SiRNA target sequence
agtacctaaagccactaagta

SEQ ID NO: 3599 - DNA, 21 bp, Artificial sequence
  SiRNA target sequence
gtacctaaagccactaagtac

SEQ ID NO: 3600 - DNA, 21 bp, Artificial sequence
  SiRNA target sequence
tacctaaagccactaagtaca

SEQ ID NO: 3601 - DNA, 21 bp, Artificial sequence
  SiRNA target sequence
acctaaagccactaagtacat

SEQ ID NO: 3602 - DNA, 21 bp, Artificial sequence
  SiRNA target sequence
cctaaagccactaagtacata

SEQ ID NO: 3603 - DNA, 21 bp, Artificial sequence
  SiRNA target sequence
ctaaagccactaagtacataa

SEQ ID NO: 3604 - DNA, 21 bp, Artificial sequence
  SiRNA target sequence
taaagccactaagtacataat

SEQ ID NO: 3605 - DNA, 21 bp, Artificial sequence
  SiRNA target sequence
aaagccactaagtacataata

SEQ ID NO: 3606 - DNA, 21 bp, Artificial sequence
  SiRNA target sequence
aagccactaagtacataataa

SEQ ID NO: 3607 - DNA, 21 bp, Artificial sequence
  SiRNA target sequence
agccactaagtacataataag

SEQ ID NO: 3608 - DNA, 21 bp, Artificial sequence
  SiRNA target sequence
gccactaagtacataataagt

SEQ ID NO: 3609 - DNA, 21 bp, Artificial sequence
  SiRNA target sequence
ccactaagtacataataagtt

SEQ ID NO: 3610 - DNA, 21 bp, Artificial sequence
  SiRNA target sequence
cactaagtacataataagttt

SEQ ID NO: 3611 - DNA, 21 bp, Artificial sequence
  SiRNA target sequence
actaagtacataataagttta

SEQ ID NO: 3612 - DNA, 21 bp, Artificial sequence
  SiRNA target sequence
ctaagtacataataagtttag

SEQ ID NO: 3613 - DNA, 21 bp, Artificial sequence
  SiRNA target sequence
taagtacataataagtttagt

SEQ ID NO: 3614 - DNA, 21 bp, Artificial sequence
  SiRNA target sequence
aagtacataataagtttagtg

SEQ ID NO: 3615 - DNA, 21 bp, Artificial sequence
  SiRNA target sequence
agtacataataagtttagtgg

SEQ ID NO: 3616 - DNA, 21 bp, Artificial sequence
  SiRNA target sequence
gtacataataagtttagtgga

SEQ ID NO: 3617 - DNA, 21 bp, Artificial sequence
  SiRNA target sequence
tacataataagtttagtggat

SEQ ID NO: 3618 - DNA, 21 bp, Artificial sequence
  SiRNA target sequence
acataataagtttagtggata

SEQ ID NO: 3619 - DNA, 21 bp, Artificial sequence
  SiRNA target sequence
cataataagtttagtggataa

SEQ ID NO: 3620 - DNA, 21 bp, Artificial sequence
  SiRNA target sequence
ataataagtttagtggataat

SEQ ID NO: 3621 - DNA, 21 bp, Artificial sequence
  SiRNA target sequence
taataagtttagtggataatc

SEQ ID NO: 3622 - DNA, 21 bp, Artificial sequence
  SiRNA target sequence
aataagtttagtggataatca

SEQ ID NO: 3623 - DNA, 21 bp, Artificial sequence
  SiRNA target sequence
ataagtttagtggataatcat

SEQ ID NO: 3624 - DNA, 21 bp, Artificial sequence
  SiRNA target sequence
taagtttagtggataatcatg

SEQ ID NO: 3625 - DNA, 21 bp, Artificial sequence
  SiRNA target sequence
aagtttagtggataatcatgc

SEQ ID NO: 3626 - DNA, 21 bp, Artificial sequence
  SiRNA target sequence
agtttagtggataatcatgcc

SEQ ID NO: 3627 - DNA, 21 bp, Artificial sequence
  SiRNA target sequence
gtttagtggataatcatgcca

SEQ ID NO: 3628 - DNA, 21 bp, Artificial sequence
  SiRNA target sequence
tttagtggataatcatgccaa

SEQ ID NO: 3629 - DNA, 21 bp, Artificial sequence
  SiRNA target sequence
ttagtggataatcatgccaaa

SEQ ID NO: 3630 - DNA, 21 bp, Artificial sequence
  SiRNA target sequence
tagtggataatcatgccaaat

SEQ ID NO: 3631 - DNA, 21 bp, Artificial sequence
  SiRNA target sequence
agtggataatcatgccaaatt

SEQ ID NO: 3632 - DNA, 21 bp, Artificial sequence
  SiRNA target sequence
gtggataatcatgccaaattg

SEQ ID NO: 3633 - DNA, 21 bp, Artificial sequence
  SiRNA target sequence
tggataatcatgccaaattga

SEQ ID NO: 3634 - DNA, 21 bp, Artificial sequence
  SiRNA target sequence
ggataatcatgccaaattgac

SEQ ID NO: 3635 - DNA, 21 bp, Artificial sequence
  SiRNA target sequence
gataatcatgccaaattgaca

SEQ ID NO: 3636 - DNA, 21 bp, Artificial sequence
  SiRNA target sequence
ataatcatgccaaattgacag

SEQ ID NO: 3637 - DNA, 21 bp, Artificial sequence
  SiRNA target sequence
taatcatgccaaattgacaga

SEQ ID NO: 3638 - DNA, 21 bp, Artificial sequence
  SiRNA target sequence
aatcatgccaaattgacagat

SEQ ID NO: 3639 - DNA, 21 bp, Artificial sequence
  SiRNA target sequence
atcatgccaaattgacagata

SEQ ID NO: 3640 - DNA, 21 bp, Artificial sequence
  SiRNA target sequence
tcatgccaaattgacagataa

SEQ ID NO: 3641 - DNA, 21 bp, Artificial sequence
  SiRNA target sequence
catgccaaattgacagataag

SEQ ID NO: 3642 - DNA, 21 bp, Artificial sequence
  SiRNA target sequence
atgccaaattgacagataaga

SEQ ID NO: 3643 - DNA, 21 bp, Artificial sequence
  SiRNA target sequence
tgccaaattgacagataagat

SEQ ID NO: 3644 - DNA, 21 bp, Artificial sequence
  SiRNA target sequence
gccaaattgacagataagatt

SEQ ID NO: 3645 - DNA, 21 bp, Artificial sequence
  SiRNA target sequence
ccaaattgacagataagatta

SEQ ID NO: 3646 - DNA, 21 bp, Artificial sequence
  SiRNA target sequence
caaattgacagataagattat

SEQ ID NO: 3647 - DNA, 21 bp, Artificial sequence
  SiRNA target sequence
aaattgacagataagattatt

SEQ ID NO: 3648 - DNA, 21 bp, Artificial sequence
  SiRNA target sequence
aattgacagataagattattc

SEQ ID NO: 3649 - DNA, 21 bp, Artificial sequence
  SiRNA target sequence
attgacagataagattattct

SEQ ID NO: 3650 - DNA, 21 bp, Artificial sequence
  SiRNA target sequence
ttgacagataagattattctt

SEQ ID NO: 3651 - DNA, 21 bp, Artificial sequence
  SiRNA target sequence
tgacagataagattattctta

SEQ ID NO: 3652 - DNA, 21 bp, Artificial sequence
  SiRNA target sequence
gacagataagattattcttat

SEQ ID NO: 3653 - DNA, 21 bp, Artificial sequence
  SiRNA target sequence
acagataagattattcttata

SEQ ID NO: 3654 - DNA, 21 bp, Artificial sequence
  SiRNA target sequence
cagataagattattcttataa

SEQ ID NO: 3655 - DNA, 21 bp, Artificial sequence
  SiRNA target sequence
agataagattattcttataac

SEQ ID NO: 3656 - DNA, 21 bp, Artificial sequence
  SiRNA target sequence
gataagattattcttataact

SEQ ID NO: 3657 - DNA, 21 bp, Artificial sequence
  SiRNA target sequence
ataagattattcttataactg

SEQ ID NO: 3658 - DNA, 21 bp, Artificial sequence
  SiRNA target sequence
taagattattcttataactgc

SEQ ID NO: 3659 - DNA, 21 bp, Artificial sequence
  SiRNA target sequence
aagattattcttataactgct

SEQ ID NO: 3660 - DNA, 21 bp, Artificial sequence
  SiRNA target sequence
agattattcttataactgcta

SEQ ID NO: 3661 - DNA, 21 bp, Artificial sequence
  SiRNA target sequence
gattattcttataactgctaa

SEQ ID NO: 3662 - DNA, 21 bp, Artificial sequence
  SiRNA target sequence
attattcttataactgctaat

SEQ ID NO: 3663 - DNA, 21 bp, Artificial sequence
  SiRNA target sequence
ttattcttataactgctaata

SEQ ID NO: 3664 - DNA, 21 bp, Artificial sequence
  SiRNA target sequence
tattcttataactgctaatag

SEQ ID NO: 3665 - DNA, 21 bp, Artificial sequence
  SiRNA target sequence
attcttataactgctaatagg

SEQ ID NO: 3666 - DNA, 21 bp, Artificial sequence
  SiRNA target sequence
ttcttataactgctaataggt

SEQ ID NO: 3667 - DNA, 21 bp, Artificial sequence
  SiRNA target sequence
tcttataactgctaataggta

SEQ ID NO: 3668 - DNA, 21 bp, Artificial sequence
  SiRNA target sequence
cttataactgctaataggtat

SEQ ID NO: 3669 - DNA, 21 bp, Artificial sequence
  SiRNA target sequence
ttataactgctaataggtatg

SEQ ID NO: 3670 - DNA, 21 bp, Artificial sequence
  SiRNA target sequence
tataactgctaataggtatgt

SEQ ID NO: 3671 - DNA, 21 bp, Artificial sequence
  SiRNA target sequence
ataactgctaataggtatgtg

SEQ ID NO: 3672 - DNA, 21 bp, Artificial sequence
  SiRNA target sequence
taactgctaataggtatgtgt

SEQ ID NO: 3673 - DNA, 21 bp, Artificial sequence
  SiRNA target sequence
aactgctaataggtatgtgtt

SEQ ID NO: 3674 - DNA, 21 bp, Artificial sequence
  SiRNA target sequence
actgctaataggtatgtgttt

SEQ ID NO: 3675 - DNA, 21 bp, Artificial sequence
  SiRNA target sequence
ctgctaataggtatgtgtttt

SEQ ID NO: 3676 - DNA, 21 bp, Artificial sequence
  SiRNA target sequence
tgctaataggtatgtgtttta

SEQ ID NO: 3677 - DNA, 21 bp, Artificial sequence
  SiRNA target sequence
gctaataggtatgtgttttat

SEQ ID NO: 3678 - DNA, 21 bp, Artificial sequence
  SiRNA target sequence
ctaataggtatgtgttttata

SEQ ID NO: 3679 - DNA, 21 bp, Artificial sequence
  SiRNA target sequence
taataggtatgtgttttataa

SEQ ID NO: 3680 - DNA, 21 bp, Artificial sequence
  SiRNA target sequence
aataggtatgtgttttataaa

SEQ ID NO: 3681 - DNA, 21 bp, Artificial sequence
  SiRNA target sequence
ataggtatgtgttttataaaa

SEQ ID NO: 3682 - DNA, 21 bp, Artificial sequence
  SiRNA target sequence
taggtatgtgttttataaaaa

SEQ ID NO: 3683 - DNA, 21 bp, Artificial sequence
  SiRNA target sequence
aggtatgtgttttataaaaat

SEQ ID NO: 3684 - DNA, 21 bp, Artificial sequence
  SiRNA target sequence
ggtatgtgttttataaaaatc

SEQ ID NO: 3685 - DNA, 21 bp, Artificial sequence
  SiRNA target sequence
gtatgtgttttataaaaatca

SEQ ID NO: 3686 - DNA, 21 bp, Artificial sequence
  SiRNA target sequence
tatgtgttttataaaaatcaa

SEQ ID NO: 3687 - DNA, 21 bp, Artificial sequence
  SiRNA target sequence
atgtgttttataaaaatcaaa

SEQ ID NO: 3688 - DNA, 21 bp, Artificial sequence
  SiRNA target sequence
tgtgttttataaaaatcaaaa

SEQ ID NO: 3689 - DNA, 21 bp, Artificial sequence
  SiRNA target sequence
gtgttttataaaaatcaaaat

SEQ ID NO: 3690 - DNA, 21 bp, Artificial sequence
  SiRNA target sequence
tgttttataaaaatcaaaatt

SEQ ID NO: 3691 - DNA, 21 bp, Artificial sequence
  SiRNA target sequence
gttttataaaaatcaaaatta

SEQ ID NO: 3692 - DNA, 21 bp, Artificial sequence
  SiRNA target sequence
ttttataaaaatcaaaattat

SEQ ID NO: 3693 - DNA, 21 bp, Artificial sequence
  SiRNA target sequence
tttataaaaatcaaaattatg

SEQ ID NO: 3694 - DNA, 21 bp, Artificial sequence
  SiRNA target sequence
ttataaaaatcaaaattatga

SEQ ID NO: 3695 - DNA, 21 bp, Artificial sequence
  SiRNA target sequence
tataaaaatcaaaattatgaa

SEQ ID NO: 3696 - DNA, 21 bp, Artificial sequence
  SiRNA target sequence
ataaaaatcaaaattatgaat

SEQ ID NO: 3697 - DNA, 21 bp, Artificial sequence
  SiRNA target sequence
taaaaatcaaaattatgaatt

SEQ ID NO: 3698 - DNA, 21 bp, Artificial sequence
  SiRNA target sequence
aaaaatcaaaattatgaatta

SEQ ID NO: 3699 - DNA, 21 bp, Artificial sequence
  SiRNA target sequence
aaaatcaaaattatgaattag

SEQ ID NO: 3700 - DNA, 21 bp, Artificial sequence
  SiRNA target sequence
aaatcaaaattatgaattagt

SEQ ID NO: 3701 - DNA, 21 bp, Artificial sequence
  SiRNA target sequence
aatcaaaattatgaattagtg

SEQ ID NO: 3702 - DNA, 21 bp, Artificial sequence
  SiRNA target sequence
atcaaaattatgaattagtgt

SEQ ID NO: 3703 - DNA, 21 bp, Artificial sequence
  SiRNA target sequence
tcaaaattatgaattagtgtt

SEQ ID NO: 3704 - DNA, 21 bp, Artificial sequence
  SiRNA target sequence
caaaattatgaattagtgttt

SEQ ID NO: 3705 - DNA, 21 bp, Artificial sequence
  SiRNA target sequence
aaaattatgaattagtgtttg

SEQ ID NO: 3706 - DNA, 21 bp, Artificial sequence
  SiRNA target sequence
aaattatgaattagtgtttgg

SEQ ID NO: 3707 - DNA, 21 bp, Artificial sequence
  SiRNA target sequence
aattatgaattagtgtttgga

SEQ ID NO: 3708 - DNA, 21 bp, Artificial sequence
  SiRNA target sequence
attatgaattagtgtttggag

SEQ ID NO: 3709 - DNA, 21 bp, Artificial sequence
  SiRNA target sequence
ttatgaattagtgtttggaga

SEQ ID NO: 3710 - DNA, 21 bp, Artificial sequence
  SiRNA target sequence
tatgaattagtgtttggagaa

SEQ ID NO: 3711 - DNA, 21 bp, Artificial sequence
  SiRNA target sequence
atgaattagtgtttggagaat

SEQ ID NO: 3712 - DNA, 21 bp, Artificial sequence
  SiRNA target sequence
tgaattagtgtttggagaatt

SEQ ID NO: 3713 - DNA, 21 bp, Artificial sequence
  SiRNA target sequence
gaattagtgtttggagaatta

SEQ ID NO: 3714 - DNA, 21 bp, Artificial sequence
  SiRNA target sequence
aattagtgtttggagaattaa

SEQ ID NO: 3715 - DNA, 21 bp, Artificial sequence
  SiRNA target sequence
attagtgtttggagaattaaa

SEQ ID NO: 3716 - DNA, 21 bp, Artificial sequence
  SiRNA target sequence
ttagtgtttggagaattaaat

SEQ ID NO: 3717 - DNA, 21 bp, Artificial sequence
  SiRNA target sequence
tagtgtttggagaattaaatc

SEQ ID NO: 3718 - DNA, 21 bp, Artificial sequence
  SiRNA target sequence
agtgtttggagaattaaatca

SEQ ID NO: 3719 - DNA, 21 bp, Artificial sequence
  SiRNA target sequence
gtgtttggagaattaaatcaa

SEQ ID NO: 3720 - DNA, 21 bp, Artificial sequence
  SiRNA target sequence
tgtttggagaattaaatcaat

SEQ ID NO: 3721 - DNA, 21 bp, Artificial sequence
  SiRNA target sequence
gtttggagaattaaatcaatt

SEQ ID NO: 3722 - DNA, 21 bp, Artificial sequence
  SiRNA target sequence
tttggagaattaaatcaattt

SEQ ID NO: 3723 - DNA, 21 bp, Artificial sequence
  SiRNA target sequence
ttggagaattaaatcaatttt

SEQ ID NO: 3724 - DNA, 21 bp, Artificial sequence
  SiRNA target sequence
tggagaattaaatcaattttt

SEQ ID NO: 3725 - DNA, 21 bp, Artificial sequence
  SiRNA target sequence
ggagaattaaatcaatttttc

SEQ ID NO: 3726 - DNA, 21 bp, Artificial sequence
  SiRNA target sequence
gagaattaaatcaatttttcg

SEQ ID NO: 3727 - DNA, 21 bp, Artificial sequence
  SiRNA target sequence
agaattaaatcaatttttcga

SEQ ID NO: 3728 - DNA, 21 bp, Artificial sequence
  SiRNA target sequence
gaattaaatcaatttttcgaa

SEQ ID NO: 3729 - DNA, 21 bp, Artificial sequence
  SiRNA target sequence
aattaaatcaatttttcgaaa

SEQ ID NO: 3730 - DNA, 21 bp, Artificial sequence
  SiRNA target sequence
attaaatcaatttttcgaaaa

SEQ ID NO: 3731 - DNA, 21 bp, Artificial sequence
  SiRNA target sequence
ttaaatcaatttttcgaaaaa

SEQ ID NO: 3732 - DNA, 21 bp, Artificial sequence
  SiRNA target sequence
taaatcaatttttcgaaaaag

SEQ ID NO: 3733 - DNA, 21 bp, Artificial sequence
  SiRNA target sequence
aaatcaatttttcgaaaaaga

SEQ ID NO: 3734 - DNA, 21 bp, Artificial sequence
  SiRNA target sequence
aatcaatttttcgaaaaagac

SEQ ID NO: 3735 - DNA, 21 bp, Artificial sequence
  SiRNA target sequence
atcaatttttcgaaaaagacc

SEQ ID NO: 3736 - DNA, 21 bp, Artificial sequence
  SiRNA target sequence
tcaatttttcgaaaaagaccc

SEQ ID NO: 3737 - DNA, 21 bp, Artificial sequence
  SiRNA target sequence
caatttttcgaaaaagaccca

SEQ ID NO: 3738 - DNA, 21 bp, Artificial sequence
  SiRNA target sequence
aatttttcgaaaaagacccag

SEQ ID NO: 3739 - DNA, 21 bp, Artificial sequence
  SiRNA target sequence
atttttcgaaaaagacccaga

SEQ ID NO: 3740 - DNA, 21 bp, Artificial sequence
  SiRNA target sequence
tttttcgaaaaagacccagaa

SEQ ID NO: 3741 - DNA, 21 bp, Artificial sequence
  SiRNA target sequence
ttttcgaaaaagacccagaat

SEQ ID NO: 3742 - DNA, 21 bp, Artificial sequence
  SiRNA target sequence
tttcgaaaaagacccagaatc

SEQ ID NO: 3743 - DNA, 21 bp, Artificial sequence
  SiRNA target sequence
ttcgaaaaagacccagaatcc

SEQ ID NO: 3744 - DNA, 21 bp, Artificial sequence
  SiRNA target sequence
tcgaaaaagacccagaatccc

SEQ ID NO: 3745 - DNA, 21 bp, Artificial sequence
  SiRNA target sequence
cgaaaaagacccagaatccct

SEQ ID NO: 3746 - DNA, 21 bp, Artificial sequence
  SiRNA target sequence
gaaaaagacccagaatccctt

SEQ ID NO: 3747 - DNA, 21 bp, Artificial sequence
  SiRNA target sequence
aaaaagacccagaatcccttg

SEQ ID NO: 3748 - DNA, 21 bp, Artificial sequence
  SiRNA target sequence
aaaagacccagaatcccttgt

SEQ ID NO: 3749 - DNA, 21 bp, Artificial sequence
  SiRNA target sequence
aaagacccagaatcccttgtg

SEQ ID NO: 3750 - DNA, 21 bp, Artificial sequence
  SiRNA target sequence
aagacccagaatcccttgtga

SEQ ID NO: 3751 - DNA, 21 bp, Artificial sequence
  SiRNA target sequence
agacccagaatcccttgtgaa

SEQ ID NO: 3752 - DNA, 21 bp, Artificial sequence
  SiRNA target sequence
gacccagaatcccttgtgaat

SEQ ID NO: 3753 - DNA, 21 bp, Artificial sequence
  SiRNA target sequence
acccagaatcccttgtgaata

SEQ ID NO: 3754 - DNA, 21 bp, Artificial sequence
  SiRNA target sequence
cccagaatcccttgtgaatac

SEQ ID NO: 3755 - DNA, 21 bp, Artificial sequence
  SiRNA target sequence
ccagaatcccttgtgaatact

SEQ ID NO: 3756 - DNA, 21 bp, Artificial sequence
  SiRNA target sequence
cagaatcccttgtgaatactc

SEQ ID NO: 3757 - DNA, 21 bp, Artificial sequence
  SiRNA target sequence
agaatcccttgtgaatactcc

SEQ ID NO: 3758 - DNA, 21 bp, Artificial sequence
  SiRNA target sequence
gaatcccttgtgaatactcct

SEQ ID NO: 3759 - DNA, 21 bp, Artificial sequence
  SiRNA target sequence
aatcccttgtgaatactccta

SEQ ID NO: 3760 - DNA, 21 bp, Artificial sequence
  SiRNA target sequence
atcccttgtgaatactcctaa

SEQ ID NO: 3761 - DNA, 21 bp, Artificial sequence
  SiRNA target sequence
tcccttgtgaatactcctaag

SEQ ID NO: 3762 - DNA, 21 bp, Artificial sequence
  SiRNA target sequence
cccttgtgaatactcctaagg

SEQ ID NO: 3763 - DNA, 21 bp, Artificial sequence
  SiRNA target sequence
ccttgtgaatactcctaaggt

SEQ ID NO: 3764 - DNA, 21 bp, Artificial sequence
  SiRNA target sequence
cttgtgaatactcctaaggtt

SEQ ID NO: 3765 - DNA, 21 bp, Artificial sequence
  SiRNA target sequence
ttgtgaatactcctaaggttg

SEQ ID NO: 3766 - DNA, 21 bp, Artificial sequence
  SiRNA target sequence
tgtgaatactcctaaggttga

SEQ ID NO: 3767 - DNA, 21 bp, Artificial sequence
  SiRNA target sequence
gtgaatactcctaaggttgaa

SEQ ID NO: 3768 - DNA, 21 bp, Artificial sequence
  SiRNA target sequence
tgaatactcctaaggttgaag

SEQ ID NO: 3769 - DNA, 21 bp, Artificial sequence
  SiRNA target sequence
gaatactcctaaggttgaagc

SEQ ID NO: 3770 - DNA, 21 bp, Artificial sequence
  SiRNA target sequence
aatactcctaaggttgaagct

SEQ ID NO: 3771 - DNA, 21 bp, Artificial sequence
  SiRNA target sequence
atactcctaaggttgaagctt

SEQ ID NO: 3772 - DNA, 21 bp, Artificial sequence
  SiRNA target sequence
tactcctaaggttgaagcttt

SEQ ID NO: 3773 - DNA, 21 bp, Artificial sequence
  SiRNA target sequence
actcctaaggttgaagctttt

SEQ ID NO: 3774 - DNA, 21 bp, Artificial sequence
  SiRNA target sequence
ctcctaaggttgaagcttttg

SEQ ID NO: 3775 - DNA, 21 bp, Artificial sequence
  SiRNA target sequence
tcctaaggttgaagcttttgc

SEQ ID NO: 3776 - DNA, 21 bp, Artificial sequence
  SiRNA target sequence
cctaaggttgaagcttttgct

SEQ ID NO: 3777 - DNA, 21 bp, Artificial sequence
  SiRNA target sequence
ctaaggttgaagcttttgctt

SEQ ID NO: 3778 - DNA, 21 bp, Artificial sequence
  SiRNA target sequence
taaggttgaagcttttgcttc

SEQ ID NO: 3779 - DNA, 21 bp, Artificial sequence
  SiRNA target sequence
aaggttgaagcttttgcttcc

SEQ ID NO: 3780 - DNA, 21 bp, Artificial sequence
  SiRNA target sequence
aggttgaagcttttgcttccg

SEQ ID NO: 3781 - DNA, 21 bp, Artificial sequence
  SiRNA target sequence
ggttgaagcttttgcttccgc

SEQ ID NO: 3782 - DNA, 21 bp, Artificial sequence
  SiRNA target sequence
gttgaagcttttgcttccgcc

SEQ ID NO: 3783 - DNA, 21 bp, Artificial sequence
  SiRNA target sequence
ttgaagcttttgcttccgccg

SEQ ID NO: 3784 - DNA, 21 bp, Artificial sequence
  SiRNA target sequence
tgaagcttttgcttccgccga

SEQ ID NO: 3785 - DNA, 21 bp, Artificial sequence
  SiRNA target sequence
gaagcttttgcttccgccgat

SEQ ID NO: 3786 - DNA, 21 bp, Artificial sequence
  SiRNA target sequence
aagcttttgcttccgccgatt

SEQ ID NO: 3787 - DNA, 21 bp, Artificial sequence
  SiRNA target sequence
agcttttgcttccgccgattt

SEQ ID NO: 3788 - DNA, 21 bp, Artificial sequence
  SiRNA target sequence
gcttttgcttccgccgatttg

SEQ ID NO: 3789 - DNA, 21 bp, Artificial sequence
  SiRNA target sequence
cttttgcttccgccgatttga

SEQ ID NO: 3790 - DNA, 21 bp, Artificial sequence
  SiRNA target sequence
ttttgcttccgccgatttgag

SEQ ID NO: 3791 - DNA, 21 bp, Artificial sequence
  SiRNA target sequence
tttgcttccgccgatttgagt

SEQ ID NO: 3792 - DNA, 21 bp, Artificial sequence
  SiRNA target sequence
ttgcttccgccgatttgagta

SEQ ID NO: 3793 - DNA, 21 bp, Artificial sequence
  SiRNA target sequence
tgcttccgccgatttgagtac

SEQ ID NO: 3794 - DNA, 21 bp, Artificial sequence
  SiRNA target sequence
gcttccgccgatttgagtact

SEQ ID NO: 3795 - DNA, 21 bp, Artificial sequence
  SiRNA target sequence
cttccgccgatttgagtactt

SEQ ID NO: 3796 - DNA, 21 bp, Artificial sequence
  SiRNA target sequence
ttccgccgatttgagtactta

SEQ ID NO: 3797 - DNA, 21 bp, Artificial sequence
  SiRNA target sequence
tccgccgatttgagtacttac

SEQ ID NO: 3798 - DNA, 21 bp, Artificial sequence
  SiRNA target sequence
ccgccgatttgagtacttaca

SEQ ID NO: 3799 - DNA, 21 bp, Artificial sequence
  SiRNA target sequence
cgccgatttgagtacttacaa

SEQ ID NO: 3800 - DNA, 21 bp, Artificial sequence
  SiRNA target sequence
gccgatttgagtacttacaaa

SEQ ID NO: 3801 - DNA, 21 bp, Artificial sequence
  SiRNA target sequence
ccgatttgagtacttacaaaa

SEQ ID NO: 3802 - DNA, 21 bp, Artificial sequence
  SiRNA target sequence
cgatttgagtacttacaaaaa

SEQ ID NO: 3803 - DNA, 21 bp, Artificial sequence
  SiRNA target sequence
gatttgagtacttacaaaaat

SEQ ID NO: 3804 - DNA, 21 bp, Artificial sequence
  SiRNA target sequence
atttgagtacttacaaaaata

SEQ ID NO: 3805 - DNA, 21 bp, Artificial sequence
  SiRNA target sequence
tttgagtacttacaaaaatag

SEQ ID NO: 3806 - DNA, 21 bp, Artificial sequence
  SiRNA target sequence
ttgagtacttacaaaaatagg

SEQ ID NO: 3807 - DNA, 21 bp, Artificial sequence
  SiRNA target sequence
tgagtacttacaaaaatagga

SEQ ID NO: 3808 - DNA, 21 bp, Artificial sequence
  SiRNA target sequence
gagtacttacaaaaataggac

SEQ ID NO: 3809 - DNA, 21 bp, Artificial sequence
  SiRNA target sequence
agtacttacaaaaataggacc

SEQ ID NO: 3810 - DNA, 21 bp, Artificial sequence
  SiRNA target sequence
gtacttacaaaaataggaccc

SEQ ID NO: 3811 - DNA, 21 bp, Artificial sequence
  SiRNA target sequence
tacttacaaaaataggacccc

SEQ ID NO: 3812 - DNA, 21 bp, Artificial sequence
  SiRNA target sequence
acttacaaaaataggaccccg

SEQ ID NO: 3813 - DNA, 21 bp, Artificial sequence
  SiRNA target sequence
cttacaaaaataggaccccga

SEQ ID NO: 3814 - DNA, 21 bp, Artificial sequence
  SiRNA target sequence
ttacaaaaataggaccccgat

SEQ ID NO: 3815 - DNA, 21 bp, Artificial sequence
  SiRNA target sequence
tacaaaaataggaccccgatt

SEQ ID NO: 3816 - DNA, 21 bp, Artificial sequence
  SiRNA target sequence
acaaaaataggaccccgattg

SEQ ID NO: 3817 - DNA, 21 bp, Artificial sequence
  SiRNA target sequence
caaaaataggaccccgattgt

SEQ ID NO: 3818 - DNA, 21 bp, Artificial sequence
  SiRNA target sequence
aaaaataggaccccgattgtg

SEQ ID NO: 3819 - DNA, 21 bp, Artificial sequence
  SiRNA target sequence
aaaataggaccccgattgtga

SEQ ID NO: 3820 - DNA, 21 bp, Artificial sequence
  SiRNA target sequence
aaataggaccccgattgtgat

SEQ ID NO: 3821 - DNA, 21 bp, Artificial sequence
  SiRNA target sequence
aataggaccccgattgtgatc

SEQ ID NO: 3822 - DNA, 21 bp, Artificial sequence
  SiRNA target sequence
ataggaccccgattgtgatcg

SEQ ID NO: 3823 - DNA, 21 bp, Artificial sequence
  SiRNA target sequence
taggaccccgattgtgatcga

SEQ ID NO: 3824 - DNA, 21 bp, Artificial sequence
  SiRNA target sequence
aggaccccgattgtgatcgaa

SEQ ID NO: 3825 - DNA, 21 bp, Artificial sequence
  SiRNA target sequence
ggaccccgattgtgatcgaag

SEQ ID NO: 3826 - DNA, 21 bp, Artificial sequence
  SiRNA target sequence
gaccccgattgtgatcgaagc

SEQ ID NO: 3827 - DNA, 21 bp, Artificial sequence
  SiRNA target sequence
accccgattgtgatcgaagca

SEQ ID NO: 3828 - DNA, 21 bp, Artificial sequence
  SiRNA target sequence
ccccgattgtgatcgaagcac

SEQ ID NO: 3829 - DNA, 21 bp, Artificial sequence
  SiRNA target sequence
cccgattgtgatcgaagcaca

SEQ ID NO: 3830 - DNA, 21 bp, Artificial sequence
  SiRNA target sequence
ccgattgtgatcgaagcacag

SEQ ID NO: 3831 - DNA, 21 bp, Artificial sequence
  SiRNA target sequence
cgattgtgatcgaagcacaga

SEQ ID NO: 3832 - DNA, 21 bp, Artificial sequence
  SiRNA target sequence
gattgtgatcgaagcacagac

SEQ ID NO: 3833 - DNA, 21 bp, Artificial sequence
  SiRNA target sequence
attgtgatcgaagcacagaca

SEQ ID NO: 3834 - DNA, 21 bp, Artificial sequence
  SiRNA target sequence
ttgtgatcgaagcacagacat

SEQ ID NO: 3835 - DNA, 21 bp, Artificial sequence
  SiRNA target sequence
tgtgatcgaagcacagacatc

SEQ ID NO: 3836 - DNA, 21 bp, Artificial sequence
  SiRNA target sequence
gtgatcgaagcacagacatct

SEQ ID NO: 3837 - DNA, 21 bp, Artificial sequence
  SiRNA target sequence
tgatcgaagcacagacatctg

SEQ ID NO: 3838 - DNA, 21 bp, Artificial sequence
  SiRNA target sequence
gatcgaagcacagacatctgg

SEQ ID NO: 3839 - DNA, 21 bp, Artificial sequence
  SiRNA target sequence
atcgaagcacagacatctgga

SEQ ID NO: 3840 - DNA, 21 bp, Artificial sequence
  SiRNA target sequence
tcgaagcacagacatctggag

SEQ ID NO: 3841 - DNA, 21 bp, Artificial sequence
  SiRNA target sequence
cgaagcacagacatctggaga

SEQ ID NO: 3842 - DNA, 21 bp, Artificial sequence
  SiRNA target sequence
gaagcacagacatctggagat

SEQ ID NO: 3843 - DNA, 21 bp, Artificial sequence
  SiRNA target sequence
aagcacagacatctggagata

SEQ ID NO: 3844 - DNA, 21 bp, Artificial sequence
  SiRNA target sequence
agcacagacatctggagataa

SEQ ID NO: 3845 - DNA, 21 bp, Artificial sequence
  SiRNA target sequence
gcacagacatctggagataat

SEQ ID NO: 3846 - DNA, 21 bp, Artificial sequence
  SiRNA target sequence
cacagacatctggagataatg

SEQ ID NO: 3847 - DNA, 21 bp, Artificial sequence
  SiRNA target sequence
acagacatctggagataatgt

SEQ ID NO: 3848 - DNA, 21 bp, Artificial sequence
  SiRNA target sequence
cagacatctggagataatgtg

SEQ ID NO: 3849 - DNA, 21 bp, Artificial sequence
  SiRNA target sequence
agacatctggagataatgtga

SEQ ID NO: 3850 - DNA, 21 bp, Artificial sequence
  SiRNA target sequence
gacatctggagataatgtgac

SEQ ID NO: 3851 - DNA, 21 bp, Artificial sequence
  SiRNA target sequence
acatctggagataatgtgact

SEQ ID NO: 3852 - DNA, 21 bp, Artificial sequence
  SiRNA target sequence
catctggagataatgtgactc

SEQ ID NO: 3853 - DNA, 21 bp, Artificial sequence
  SiRNA target sequence
atctggagataatgtgactct

SEQ ID NO: 3854 - DNA, 21 bp, Artificial sequence
  SiRNA target sequence
tctggagataatgtgactctt

SEQ ID NO: 3855 - DNA, 21 bp, Artificial sequence
  SiRNA target sequence
ctggagataatgtgactctta

SEQ ID NO: 3856 - DNA, 21 bp, Artificial sequence
  SiRNA target sequence
tggagataatgtgactcttaa

SEQ ID NO: 3857 - DNA, 21 bp, Artificial sequence
  SiRNA target sequence
ggagataatgtgactcttaaa

SEQ ID NO: 3858 - DNA, 21 bp, Artificial sequence
  SiRNA target sequence
gagataatgtgactcttaaac

SEQ ID NO: 3859 - DNA, 21 bp, Artificial sequence
  SiRNA target sequence
agataatgtgactcttaaaca

SEQ ID NO: 3860 - DNA, 21 bp, Artificial sequence
  SiRNA target sequence
gataatgtgactcttaaacaa

SEQ ID NO: 3861 - DNA, 21 bp, Artificial sequence
  SiRNA target sequence
ataatgtgactcttaaacaac

SEQ ID NO: 3862 - DNA, 21 bp, Artificial sequence
  SiRNA target sequence
taatgtgactcttaaacaaca

SEQ ID NO: 3863 - DNA, 21 bp, Artificial sequence
  SiRNA target sequence
aatgtgactcttaaacaacaa

SEQ ID NO: 3864 - DNA, 21 bp, Artificial sequence
  SiRNA target sequence
atgtgactcttaaacaacaaa

SEQ ID NO: 3865 - DNA, 21 bp, Artificial sequence
  SiRNA target sequence
tgtgactcttaaacaacaaaa

SEQ ID NO: 3866 - DNA, 21 bp, Artificial sequence
  SiRNA target sequence
gtgactcttaaacaacaaaag

SEQ ID NO: 3867 - DNA, 21 bp, Artificial sequence
  SiRNA target sequence
tgactcttaaacaacaaaagg

SEQ ID NO: 3868 - DNA, 21 bp, Artificial sequence
  SiRNA target sequence
gactcttaaacaacaaaaggt

SEQ ID NO: 3869 - DNA, 21 bp, Artificial sequence
  SiRNA target sequence
actcttaaacaacaaaaggtt

SEQ ID NO: 3870 - DNA, 21 bp, Artificial sequence
  SiRNA target sequence
ctcttaaacaacaaaaggtta

SEQ ID NO: 3871 - DNA, 21 bp, Artificial sequence
  SiRNA target sequence
tcttaaacaacaaaaggttaa

SEQ ID NO: 3872 - DNA, 21 bp, Artificial sequence
  SiRNA target sequence
cttaaacaacaaaaggttaaa

SEQ ID NO: 3873 - DNA, 21 bp, Artificial sequence
  SiRNA target sequence
ttaaacaacaaaaggttaaag

SEQ ID NO: 3874 - DNA, 21 bp, Artificial sequence
  SiRNA target sequence
taaacaacaaaaggttaaagt

SEQ ID NO: 3875 - DNA, 21 bp, Artificial sequence
  SiRNA target sequence
aaacaacaaaaggttaaagta

SEQ ID NO: 3876 - DNA, 21 bp, Artificial sequence
  SiRNA target sequence
aacaacaaaaggttaaagtaa

SEQ ID NO: 3877 - DNA, 21 bp, Artificial sequence
  SiRNA target sequence
acaacaaaaggttaaagtaat

SEQ ID NO: 3878 - DNA, 21 bp, Artificial sequence
  SiRNA target sequence
caacaaaaggttaaagtaatt

SEQ ID NO: 3879 - DNA, 21 bp, Artificial sequence
  SiRNA target sequence
aacaaaaggttaaagtaattg

SEQ ID NO: 3880 - DNA, 21 bp, Artificial sequence
  SiRNA target sequence
acaaaaggttaaagtaattga

SEQ ID NO: 3881 - DNA, 21 bp, Artificial sequence
  SiRNA target sequence
caaaaggttaaagtaattgaa

SEQ ID NO: 3882 - DNA, 21 bp, Artificial sequence
  SiRNA target sequence
aaaaggttaaagtaattgaag

SEQ ID NO: 3883 - DNA, 21 bp, Artificial sequence
  SiRNA target sequence
aaaggttaaagtaattgaagc

SEQ ID NO: 3884 - DNA, 21 bp, Artificial sequence
  SiRNA target sequence
aaggttaaagtaattgaagca

SEQ ID NO: 3885 - DNA, 21 bp, Artificial sequence
  SiRNA target sequence
aggttaaagtaattgaagcaa

SEQ ID NO: 3886 - DNA, 21 bp, Artificial sequence
  SiRNA target sequence
ggttaaagtaattgaagcaaa

SEQ ID NO: 3887 - DNA, 21 bp, Artificial sequence
  SiRNA target sequence
gttaaagtaattgaagcaaaa

SEQ ID NO: 3888 - DNA, 21 bp, Artificial sequence
  SiRNA target sequence
ttaaagtaattgaagcaaaaa

SEQ ID NO: 3889 - DNA, 21 bp, Artificial sequence
  SiRNA target sequence
taaagtaattgaagcaaaaac

SEQ ID NO: 3890 - DNA, 21 bp, Artificial sequence
  SiRNA target sequence
aaagtaattgaagcaaaaaca

SEQ ID NO: 3891 - DNA, 21 bp, Artificial sequence
  SiRNA target sequence
aagtaattgaagcaaaaacat

SEQ ID NO: 3892 - DNA, 21 bp, Artificial sequence
  SiRNA target sequence
agtaattgaagcaaaaacatc

SEQ ID NO: 3893 - DNA, 21 bp, Artificial sequence
  SiRNA target sequence
gtaattgaagcaaaaacatct

SEQ ID NO: 3894 - DNA, 21 bp, Artificial sequence
  SiRNA target sequence
taattgaagcaaaaacatcta

SEQ ID NO: 3895 - DNA, 21 bp, Artificial sequence
  SiRNA target sequence
aattgaagcaaaaacatctac

SEQ ID NO: 3896 - DNA, 21 bp, Artificial sequence
  SiRNA target sequence
attgaagcaaaaacatctact

SEQ ID NO: 3897 - DNA, 21 bp, Artificial sequence
  SiRNA target sequence
ttgaagcaaaaacatctactg

SEQ ID NO: 3898 - DNA, 21 bp, Artificial sequence
  SiRNA target sequence
tgaagcaaaaacatctactga

SEQ ID NO: 3899 - DNA, 21 bp, Artificial sequence
  SiRNA target sequence
gaagcaaaaacatctactgat

SEQ ID NO: 3900 - DNA, 21 bp, Artificial sequence
  SiRNA target sequence
aagcaaaaacatctactgatg

SEQ ID NO: 3901 - DNA, 21 bp, Artificial sequence
  SiRNA target sequence
agcaaaaacatctactgatga

SEQ ID NO: 3902 - DNA, 21 bp, Artificial sequence
  SiRNA target sequence
gcaaaaacatctactgatgaa

SEQ ID NO: 3903 - DNA, 21 bp, Artificial sequence
  SiRNA target sequence
caaaaacatctactgatgaag

SEQ ID NO: 3904 - DNA, 21 bp, Artificial sequence
  SiRNA target sequence
aaaaacatctactgatgaagt

SEQ ID NO: 3905 - DNA, 21 bp, Artificial sequence
  SiRNA target sequence
aaaacatctactgatgaagtt

SEQ ID NO: 3906 - DNA, 21 bp, Artificial sequence
  SiRNA target sequence
aaacatctactgatgaagtta

SEQ ID NO: 3907 - DNA, 21 bp, Artificial sequence
  SiRNA target sequence
aacatctactgatgaagttac

SEQ ID NO: 3908 - DNA, 21 bp, Artificial sequence
  SiRNA target sequence
acatctactgatgaagttact

SEQ ID NO: 3909 - DNA, 21 bp, Artificial sequence
  SiRNA target sequence
catctactgatgaagttactt

SEQ ID NO: 3910 - DNA, 21 bp, Artificial sequence
  SiRNA target sequence
atctactgatgaagttacttt

SEQ ID NO: 3911 - DNA, 21 bp, Artificial sequence
  SiRNA target sequence
tctactgatgaagttactttg

SEQ ID NO: 3912 - DNA, 21 bp, Artificial sequence
  SiRNA target sequence
ctactgatgaagttactttga

SEQ ID NO: 3913 - DNA, 21 bp, Artificial sequence
  SiRNA target sequence
tactgatgaagttactttgaa

SEQ ID NO: 3914 - DNA, 21 bp, Artificial sequence
  SiRNA target sequence
actgatgaagttactttgaaa

SEQ ID NO: 3915 - DNA, 21 bp, Artificial sequence
  SiRNA target sequence
ctgatgaagttactttgaaac

SEQ ID NO: 3916 - DNA, 21 bp, Artificial sequence
  SiRNA target sequence
tgatgaagttactttgaaaca

SEQ ID NO: 3917 - DNA, 21 bp, Artificial sequence
  SiRNA target sequence
gatgaagttactttgaaacaa

SEQ ID NO: 3918 - DNA, 21 bp, Artificial sequence
  SiRNA target sequence
atgaagttactttgaaacaac

SEQ ID NO: 3919 - DNA, 21 bp, Artificial sequence
  SiRNA target sequence
tgaagttactttgaaacaaca

SEQ ID NO: 3920 - DNA, 21 bp, Artificial sequence
  SiRNA target sequence
gaagttactttgaaacaacaa

SEQ ID NO: 3921 - DNA, 21 bp, Artificial sequence
  SiRNA target sequence
aagttactttgaaacaacaaa

SEQ ID NO: 3922 - DNA, 21 bp, Artificial sequence
  SiRNA target sequence
agttactttgaaacaacaaaa

SEQ ID NO: 3923 - DNA, 21 bp, Artificial sequence
  SiRNA target sequence
gttactttgaaacaacaaaaa

SEQ ID NO: 3924 - DNA, 21 bp, Artificial sequence
  SiRNA target sequence
ttactttgaaacaacaaaaac

SEQ ID NO: 3925 - DNA, 21 bp, Artificial sequence
  SiRNA target sequence
tactttgaaacaacaaaaacc

SEQ ID NO: 3926 - DNA, 21 bp, Artificial sequence
  SiRNA target sequence
actttgaaacaacaaaaacct

SEQ ID NO: 3927 - DNA, 21 bp, Artificial sequence
  SiRNA target sequence
ctttgaaacaacaaaaaccta

SEQ ID NO: 3928 - DNA, 21 bp, Artificial sequence
  SiRNA target sequence
tttgaaacaacaaaaacctat

SEQ ID NO: 3929 - DNA, 21 bp, Artificial sequence
  SiRNA target sequence
ttgaaacaacaaaaacctatt

SEQ ID NO: 3930 - DNA, 21 bp, Artificial sequence
  SiRNA target sequence
tgaaacaacaaaaacctattg

SEQ ID NO: 3931 - DNA, 21 bp, Artificial sequence
  SiRNA target sequence
gaaacaacaaaaacctattgt

SEQ ID NO: 3932 - DNA, 21 bp, Artificial sequence
  SiRNA target sequence
aaacaacaaaaacctattgtt

SEQ ID NO: 3933 - DNA, 21 bp, Artificial sequence
  SiRNA target sequence
aacaacaaaaacctattgtta

SEQ ID NO: 3934 - DNA, 21 bp, Artificial sequence
  SiRNA target sequence
acaacaaaaacctattgttat

SEQ ID NO: 3935 - DNA, 21 bp, Artificial sequence
  SiRNA target sequence
caacaaaaacctattgttata

SEQ ID NO: 3936 - DNA, 21 bp, Artificial sequence
  SiRNA target sequence
aacaaaaacctattgttatag

SEQ ID NO: 3937 - DNA, 21 bp, Artificial sequence
  SiRNA target sequence
acaaaaacctattgttataga

SEQ ID NO: 3938 - DNA, 21 bp, Artificial sequence
  SiRNA target sequence
caaaaacctattgttatagag

SEQ ID NO: 3939 - DNA, 21 bp, Artificial sequence
  SiRNA target sequence
aaaaacctattgttatagagg

SEQ ID NO: 3940 - DNA, 21 bp, Artificial sequence
  SiRNA target sequence
aaaacctattgttatagaggc

SEQ ID NO: 3941 - DNA, 21 bp, Artificial sequence
  SiRNA target sequence
aaacctattgttatagaggca

SEQ ID NO: 3942 - DNA, 21 bp, Artificial sequence
  SiRNA target sequence
aacctattgttatagaggcac

SEQ ID NO: 3943 - DNA, 21 bp, Artificial sequence
  SiRNA target sequence
acctattgttatagaggcaca

SEQ ID NO: 3944 - DNA, 21 bp, Artificial sequence
  SiRNA target sequence
cctattgttatagaggcacag

SEQ ID NO: 3945 - DNA, 21 bp, Artificial sequence
  SiRNA target sequence
ctattgttatagaggcacagt

SEQ ID NO: 3946 - DNA, 21 bp, Artificial sequence
  SiRNA target sequence
tattgttatagaggcacagtc

SEQ ID NO: 3947 - DNA, 21 bp, Artificial sequence
  SiRNA target sequence
attgttatagaggcacagtct

SEQ ID NO: 3948 - DNA, 21 bp, Artificial sequence
  SiRNA target sequence
ttgttatagaggcacagtctt

SEQ ID NO: 3949 - DNA, 21 bp, Artificial sequence
  SiRNA target sequence
tgttatagaggcacagtcttc

SEQ ID NO: 3950 - DNA, 21 bp, Artificial sequence
  SiRNA target sequence
gttatagaggcacagtcttct

SEQ ID NO: 3951 - DNA, 21 bp, Artificial sequence
  SiRNA target sequence
ttatagaggcacagtcttctg

SEQ ID NO: 3952 - DNA, 21 bp, Artificial sequence
  SiRNA target sequence
tatagaggcacagtcttctgg

SEQ ID NO: 3953 - DNA, 21 bp, Artificial sequence
  SiRNA target sequence
atagaggcacagtcttctggt

SEQ ID NO: 3954 - DNA, 21 bp, Artificial sequence
  SiRNA target sequence
tagaggcacagtcttctggtg

SEQ ID NO: 3955 - DNA, 21 bp, Artificial sequence
  SiRNA target sequence
agaggcacagtcttctggtga

SEQ ID NO: 3956 - DNA, 21 bp, Artificial sequence
  SiRNA target sequence
gaggcacagtcttctggtgat

SEQ ID NO: 3957 - DNA, 21 bp, Artificial sequence
  SiRNA target sequence
aggcacagtcttctggtgatt

SEQ ID NO: 3958 - DNA, 21 bp, Artificial sequence
  SiRNA target sequence
ggcacagtcttctggtgattg

SEQ ID NO: 3959 - DNA, 21 bp, Artificial sequence
  SiRNA target sequence
gcacagtcttctggtgattgt

SEQ ID NO: 3960 - DNA, 21 bp, Artificial sequence
  SiRNA target sequence
cacagtcttctggtgattgtg

SEQ ID NO: 3961 - DNA, 21 bp, Artificial sequence
  SiRNA target sequence
acagtcttctggtgattgtgt

SEQ ID NO: 3962 - DNA, 21 bp, Artificial sequence
  SiRNA target sequence
cagtcttctggtgattgtgtg

SEQ ID NO: 3963 - DNA, 21 bp, Artificial sequence
  SiRNA target sequence
agtcttctggtgattgtgtga

SEQ ID NO: 3964 - DNA, 21 bp, Artificial sequence
  SiRNA target sequence
gtcttctggtgattgtgtgac

SEQ ID NO: 3965 - DNA, 21 bp, Artificial sequence
  SiRNA target sequence
tcttctggtgattgtgtgacc

SEQ ID NO: 3966 - DNA, 21 bp, Artificial sequence
  SiRNA target sequence
cttctggtgattgtgtgaccc

SEQ ID NO: 3967 - DNA, 21 bp, Artificial sequence
  SiRNA target sequence
ttctggtgattgtgtgacccg

SEQ ID NO: 3968 - DNA, 21 bp, Artificial sequence
  SiRNA target sequence
tctggtgattgtgtgacccga

SEQ ID NO: 3969 - DNA, 21 bp, Artificial sequence
  SiRNA target sequence
ctggtgattgtgtgacccgaa

SEQ ID NO: 3970 - DNA, 21 bp, Artificial sequence
  SiRNA target sequence
tggtgattgtgtgacccgaaa

SEQ ID NO: 3971 - DNA, 21 bp, Artificial sequence
  SiRNA target sequence
ggtgattgtgtgacccgaaaa

SEQ ID NO: 3972 - DNA, 21 bp, Artificial sequence
  SiRNA target sequence
gtgattgtgtgacccgaaaac

SEQ ID NO: 3973 - DNA, 21 bp, Artificial sequence
  SiRNA target sequence
tgattgtgtgacccgaaaaca

SEQ ID NO: 3974 - DNA, 21 bp, Artificial sequence
  SiRNA target sequence
gattgtgtgacccgaaaacaa

SEQ ID NO: 3975 - DNA, 21 bp, Artificial sequence
  SiRNA target sequence
attgtgtgacccgaaaacaac

SEQ ID NO: 3976 - DNA, 21 bp, Artificial sequence
  SiRNA target sequence
ttgtgtgacccgaaaacaacg

SEQ ID NO: 3977 - DNA, 21 bp, Artificial sequence
  SiRNA target sequence
tgtgtgacccgaaaacaacga

SEQ ID NO: 3978 - DNA, 21 bp, Artificial sequence
  SiRNA target sequence
gtgtgacccgaaaacaacgag

SEQ ID NO: 3979 - DNA, 21 bp, Artificial sequence
  SiRNA target sequence
tgtgacccgaaaacaacgagt

SEQ ID NO: 3980 - DNA, 21 bp, Artificial sequence
  SiRNA target sequence
gtgacccgaaaacaacgagta

SEQ ID NO: 3981 - DNA, 21 bp, Artificial sequence
  SiRNA target sequence
tgacccgaaaacaacgagtac

SEQ ID NO: 3982 - DNA, 21 bp, Artificial sequence
  SiRNA target sequence
gacccgaaaacaacgagtaca

SEQ ID NO: 3983 - DNA, 21 bp, Artificial sequence
  SiRNA target sequence
acccgaaaacaacgagtacaa

SEQ ID NO: 3984 - DNA, 21 bp, Artificial sequence
  SiRNA target sequence
cccgaaaacaacgagtacaac

SEQ ID NO: 3985 - DNA, 21 bp, Artificial sequence
  SiRNA target sequence
ccgaaaacaacgagtacaacg

SEQ ID NO: 3986 - DNA, 21 bp, Artificial sequence
  SiRNA target sequence
cgaaaacaacgagtacaacga

SEQ ID NO: 3987 - DNA, 21 bp, Artificial sequence
  SiRNA target sequence
gaaaacaacgagtacaacgag

SEQ ID NO: 3988 - DNA, 21 bp, Artificial sequence
  SiRNA target sequence
aaaacaacgagtacaacgagt

SEQ ID NO: 3989 - DNA, 21 bp, Artificial sequence
  SiRNA target sequence
aaacaacgagtacaacgagtg

SEQ ID NO: 3990 - DNA, 21 bp, Artificial sequence
  SiRNA target sequence
aacaacgagtacaacgagtga

SEQ ID NO: 3991 - DNA, 21 bp, Artificial sequence
  SiRNA target sequence
acaacgagtacaacgagtgat

SEQ ID NO: 3992 - DNA, 21 bp, Artificial sequence
  SiRNA target sequence
caacgagtacaacgagtgatt

SEQ ID NO: 3993 - DNA, 21 bp, Artificial sequence
  SiRNA target sequence
aacgagtacaacgagtgattg

SEQ ID NO: 3994 - DNA, 21 bp, Artificial sequence
  SiRNA target sequence
acgagtacaacgagtgattga

SEQ ID NO: 3995 - DNA, 21 bp, Artificial sequence
  SiRNA target sequence
cgagtacaacgagtgattgaa

SEQ ID NO: 3996 - DNA, 21 bp, Artificial sequence
  SiRNA target sequence
gagtacaacgagtgattgaag

SEQ ID NO: 3997 - DNA, 21 bp, Artificial sequence
  SiRNA target sequence
agtacaacgagtgattgaagc

SEQ ID NO: 3998 - DNA, 21 bp, Artificial sequence
  SiRNA target sequence
gtacaacgagtgattgaagca

SEQ ID NO: 3999 - DNA, 21 bp, Artificial sequence
  SiRNA target sequence
tacaacgagtgattgaagcat

SEQ ID NO: 4000 - DNA, 21 bp, Artificial sequence
  SiRNA target sequence
acaacgagtgattgaagcatt

SEQ ID NO: 4001 - DNA, 21 bp, Artificial sequence
  SiRNA target sequence
caacgagtgattgaagcattt

SEQ ID NO: 4002 - DNA, 21 bp, Artificial sequence
  SiRNA target sequence
aacgagtgattgaagcatttg

SEQ ID NO: 4003 - DNA, 21 bp, Artificial sequence
  SiRNA target sequence
acgagtgattgaagcatttgc

SEQ ID NO: 4004 - DNA, 21 bp, Artificial sequence
  SiRNA target sequence
cgagtgattgaagcatttgca

SEQ ID NO: 4005 - DNA, 21 bp, Artificial sequence
  SiRNA target sequence
gagtgattgaagcatttgcaa

SEQ ID NO: 4006 - DNA, 21 bp, Artificial sequence
  SiRNA target sequence
agtgattgaagcatttgcaag

SEQ ID NO: 4007 - DNA, 21 bp, Artificial sequence
  SiRNA target sequence
gtgattgaagcatttgcaagt

SEQ ID NO: 4008 - DNA, 21 bp, Artificial sequence
  SiRNA target sequence
tgattgaagcatttgcaagta

SEQ ID NO: 4009 - DNA, 21 bp, Artificial sequence
  SiRNA target sequence
gattgaagcatttgcaagtag

SEQ ID NO: 4010 - DNA, 21 bp, Artificial sequence
  SiRNA target sequence
attgaagcatttgcaagtagt

SEQ ID NO: 4011 - DNA, 21 bp, Artificial sequence
  SiRNA target sequence
ttgaagcatttgcaagtagtg

SEQ ID NO: 4012 - DNA, 21 bp, Artificial sequence
  SiRNA target sequence
tgaagcatttgcaagtagtga

SEQ ID NO: 4013 - DNA, 21 bp, Artificial sequence
  SiRNA target sequence
gaagcatttgcaagtagtgat

SEQ ID NO: 4014 - DNA, 21 bp, Artificial sequence
  SiRNA target sequence
aagcatttgcaagtagtgatg

SEQ ID NO: 4015 - DNA, 21 bp, Artificial sequence
  SiRNA target sequence
agcatttgcaagtagtgatgc

SEQ ID NO: 4016 - DNA, 21 bp, Artificial sequence
  SiRNA target sequence
gcatttgcaagtagtgatgct

SEQ ID NO: 4017 - DNA, 21 bp, Artificial sequence
  SiRNA target sequence
catttgcaagtagtgatgctg

SEQ ID NO: 4018 - DNA, 21 bp, Artificial sequence
  SiRNA target sequence
atttgcaagtagtgatgctgt

SEQ ID NO: 4019 - DNA, 21 bp, Artificial sequence
  SiRNA target sequence
tttgcaagtagtgatgctgtg

SEQ ID NO: 4020 - DNA, 21 bp, Artificial sequence
  SiRNA target sequence
ttgcaagtagtgatgctgtga

SEQ ID NO: 4021 - DNA, 21 bp, Artificial sequence
  SiRNA target sequence
tgcaagtagtgatgctgtgac

SEQ ID NO: 4022 - DNA, 21 bp, Artificial sequence
  SiRNA target sequence
gcaagtagtgatgctgtgaca

SEQ ID NO: 4023 - DNA, 21 bp, Artificial sequence
  SiRNA target sequence
caagtagtgatgctgtgacat

SEQ ID NO: 4024 - DNA, 21 bp, Artificial sequence
  SiRNA target sequence
aagtagtgatgctgtgacatt

SEQ ID NO: 4025 - DNA, 21 bp, Artificial sequence
  SiRNA target sequence
agtagtgatgctgtgacattg

SEQ ID NO: 4026 - DNA, 21 bp, Artificial sequence
  SiRNA target sequence
gtagtgatgctgtgacattga

SEQ ID NO: 4027 - DNA, 21 bp, Artificial sequence
  SiRNA target sequence
tagtgatgctgtgacattgaa

SEQ ID NO: 4028 - DNA, 21 bp, Artificial sequence
  SiRNA target sequence
agtgatgctgtgacattgaag

SEQ ID NO: 4029 - DNA, 21 bp, Artificial sequence
  SiRNA target sequence
gtgatgctgtgacattgaaga

SEQ ID NO: 4030 - DNA, 21 bp, Artificial sequence
  SiRNA target sequence
tgatgctgtgacattgaagaa

SEQ ID NO: 4031 - DNA, 21 bp, Artificial sequence
  SiRNA target sequence
gatgctgtgacattgaagaaa

SEQ ID NO: 4032 - DNA, 21 bp, Artificial sequence
  SiRNA target sequence
atgctgtgacattgaagaaat

SEQ ID NO: 4033 - DNA, 21 bp, Artificial sequence
  SiRNA target sequence
tgctgtgacattgaagaaatc

SEQ ID NO: 4034 - DNA, 21 bp, Artificial sequence
  SiRNA target sequence
gctgtgacattgaagaaatct

SEQ ID NO: 4035 - DNA, 21 bp, Artificial sequence
  SiRNA target sequence
ctgtgacattgaagaaatcta

SEQ ID NO: 4036 - DNA, 21 bp, Artificial sequence
  SiRNA target sequence
tgtgacattgaagaaatctac

SEQ ID NO: 4037 - DNA, 21 bp, Artificial sequence
  SiRNA target sequence
gtgacattgaagaaatctact

SEQ ID NO: 4038 - DNA, 21 bp, Artificial sequence
  SiRNA target sequence
tgacattgaagaaatctactg

SEQ ID NO: 4039 - DNA, 21 bp, Artificial sequence
  SiRNA target sequence
gacattgaagaaatctactgc

SEQ ID NO: 4040 - DNA, 21 bp, Artificial sequence
  SiRNA target sequence
acattgaagaaatctactgcg

SEQ ID NO: 4041 - DNA, 21 bp, Artificial sequence
  SiRNA target sequence
cattgaagaaatctactgcga

SEQ ID NO: 4042 - DNA, 21 bp, Artificial sequence
  SiRNA target sequence
attgaagaaatctactgcgaa

SEQ ID NO: 4043 - DNA, 21 bp, Artificial sequence
  SiRNA target sequence
ttgaagaaatctactgcgaaa

SEQ ID NO: 4044 - DNA, 21 bp, Artificial sequence
  SiRNA target sequence
tgaagaaatctactgcgaaat

SEQ ID NO: 4045 - DNA, 21 bp, Artificial sequence
  SiRNA target sequence
gaagaaatctactgcgaaatt

SEQ ID NO: 4046 - DNA, 21 bp, Artificial sequence
  SiRNA target sequence
aagaaatctactgcgaaattc

SEQ ID NO: 4047 - DNA, 21 bp, Artificial sequence
  SiRNA target sequence
agaaatctactgcgaaattcg

SEQ ID NO: 4048 - DNA, 21 bp, Artificial sequence
  SiRNA target sequence
gaaatctactgcgaaattcgt

SEQ ID NO: 4049 - DNA, 21 bp, Artificial sequence
  SiRNA target sequence
aaatctactgcgaaattcgta

SEQ ID NO: 4050 - DNA, 21 bp, Artificial sequence
  SiRNA target sequence
aatctactgcgaaattcgtag

SEQ ID NO: 4051 - DNA, 21 bp, Artificial sequence
  SiRNA target sequence
atctactgcgaaattcgtaga

SEQ ID NO: 4052 - DNA, 21 bp, Artificial sequence
  SiRNA target sequence
tctactgcgaaattcgtagaa

SEQ ID NO: 4053 - DNA, 21 bp, Artificial sequence
  SiRNA target sequence
ctactgcgaaattcgtagaaa

SEQ ID NO: 4054 - DNA, 21 bp, Artificial sequence
  SiRNA target sequence
tactgcgaaattcgtagaaag

SEQ ID NO: 4055 - DNA, 21 bp, Artificial sequence
  SiRNA target sequence
actgcgaaattcgtagaaagt

SEQ ID NO: 4056 - DNA, 21 bp, Artificial sequence
  SiRNA target sequence
ctgcgaaattcgtagaaagtg

SEQ ID NO: 4057 - DNA, 21 bp, Artificial sequence
  SiRNA target sequence
tgcgaaattcgtagaaagtga

SEQ ID NO: 4058 - DNA, 21 bp, Artificial sequence
  SiRNA target sequence
gcgaaattcgtagaaagtgac

SEQ ID NO: 4059 - DNA, 21 bp, Artificial sequence
  SiRNA target sequence
cgaaattcgtagaaagtgacc

SEQ ID NO: 4060 - DNA, 21 bp, Artificial sequence
  SiRNA target sequence
gaaattcgtagaaagtgaccc

SEQ ID NO: 4061 - DNA, 21 bp, Artificial sequence
  SiRNA target sequence
aaattcgtagaaagtgaccca

SEQ ID NO: 4062 - DNA, 21 bp, Artificial sequence
  SiRNA target sequence
aattcgtagaaagtgacccaa

SEQ ID NO: 4063 - DNA, 21 bp, Artificial sequence
  SiRNA target sequence
attcgtagaaagtgacccaaa

SEQ ID NO: 4064 - DNA, 21 bp, Artificial sequence
  SiRNA target sequence
ttcgtagaaagtgacccaaat

SEQ ID NO: 4065 - DNA, 21 bp, Artificial sequence
  SiRNA target sequence
tcgtagaaagtgacccaaatg

SEQ ID NO: 4066 - DNA, 21 bp, Artificial sequence
  SiRNA target sequence
cgtagaaagtgacccaaatga

SEQ ID NO: 4067 - DNA, 21 bp, Artificial sequence
  SiRNA target sequence
gtagaaagtgacccaaatgac

SEQ ID NO: 4068 - DNA, 21 bp, Artificial sequence
  SiRNA target sequence
tagaaagtgacccaaatgaca

SEQ ID NO: 4069 - DNA, 21 bp, Artificial sequence
  SiRNA target sequence
agaaagtgacccaaatgacat

SEQ ID NO: 4070 - DNA, 21 bp, Artificial sequence
  SiRNA target sequence
gaaagtgacccaaatgacata

SEQ ID NO: 4071 - DNA, 21 bp, Artificial sequence
  SiRNA target sequence
aaagtgacccaaatgacatag

SEQ ID NO: 4072 - DNA, 21 bp, Artificial sequence
  SiRNA target sequence
aagtgacccaaatgacatagt

SEQ ID NO: 4073 - DNA, 21 bp, Artificial sequence
  SiRNA target sequence
agtgacccaaatgacatagtt

SEQ ID NO: 4074 - DNA, 21 bp, Artificial sequence
  SiRNA target sequence
gtgacccaaatgacatagttg

SEQ ID NO: 4075 - DNA, 21 bp, Artificial sequence
  SiRNA target sequence
tgacccaaatgacatagttga

SEQ ID NO: 4076 - DNA, 21 bp, Artificial sequence
  SiRNA target sequence
gacccaaatgacatagttgat

SEQ ID NO: 4077 - DNA, 21 bp, Artificial sequence
  SiRNA target sequence
acccaaatgacatagttgatg

SEQ ID NO: 4078 - DNA, 21 bp, Artificial sequence
  SiRNA target sequence
cccaaatgacatagttgatgt

SEQ ID NO: 4079 - DNA, 21 bp, Artificial sequence
  SiRNA target sequence
ccaaatgacatagttgatgtt

SEQ ID NO: 4080 - DNA, 21 bp, Artificial sequence
  SiRNA target sequence
caaatgacatagttgatgtta

SEQ ID NO: 4081 - DNA, 21 bp, Artificial sequence
  SiRNA target sequence
aaatgacatagttgatgttac

SEQ ID NO: 4082 - DNA, 21 bp, Artificial sequence
  SiRNA target sequence
aatgacatagttgatgttaca

SEQ ID NO: 4083 - DNA, 21 bp, Artificial sequence
  SiRNA target sequence
atgacatagttgatgttacaa

SEQ ID NO: 4084 - DNA, 21 bp, Artificial sequence
  SiRNA target sequence
tgacatagttgatgttacaat

SEQ ID NO: 4085 - DNA, 21 bp, Artificial sequence
  SiRNA target sequence
gacatagttgatgttacaatg

SEQ ID NO: 4086 - DNA, 21 bp, Artificial sequence
  SiRNA target sequence
acatagttgatgttacaatgc

SEQ ID NO: 4087 - DNA, 21 bp, Artificial sequence
  SiRNA target sequence
catagttgatgttacaatgca

SEQ ID NO: 4088 - DNA, 21 bp, Artificial sequence
  SiRNA target sequence
atagttgatgttacaatgcaa

SEQ ID NO: 4089 - DNA, 21 bp, Artificial sequence
  SiRNA target sequence
tagttgatgttacaatgcaaa

SEQ ID NO: 4090 - DNA, 21 bp, Artificial sequence
  SiRNA target sequence
agttgatgttacaatgcaaat

SEQ ID NO: 4091 - DNA, 21 bp, Artificial sequence
  SiRNA target sequence
gttgatgttacaatgcaaatg

SEQ ID NO: 4092 - DNA, 21 bp, Artificial sequence
  SiRNA target sequence
ttgatgttacaatgcaaatgt

SEQ ID NO: 4093 - DNA, 21 bp, Artificial sequence
  SiRNA target sequence
tgatgttacaatgcaaatgtg

SEQ ID NO: 4094 - DNA, 21 bp, Artificial sequence
  SiRNA target sequence
gatgttacaatgcaaatgtgg

SEQ ID NO: 4095 - DNA, 21 bp, Artificial sequence
  SiRNA target sequence
atgttacaatgcaaatgtgga

SEQ ID NO: 4096 - DNA, 21 bp, Artificial sequence
  SiRNA target sequence
tgttacaatgcaaatgtggaa

SEQ ID NO: 4097 - DNA, 21 bp, Artificial sequence
  SiRNA target sequence
gttacaatgcaaatgtggaaa

SEQ ID NO: 4098 - DNA, 21 bp, Artificial sequence
  SiRNA target sequence
ttacaatgcaaatgtggaaag

SEQ ID NO: 4099 - DNA, 21 bp, Artificial sequence
  SiRNA target sequence
tacaatgcaaatgtggaaaga

SEQ ID NO: 4100 - DNA, 21 bp, Artificial sequence
  SiRNA target sequence
acaatgcaaatgtggaaagat

SEQ ID NO: 4101 - DNA, 21 bp, Artificial sequence
  SiRNA target sequence
caatgcaaatgtggaaagatc

SEQ ID NO: 4102 - DNA, 21 bp, Artificial sequence
  SiRNA target sequence
aatgcaaatgtggaaagatca

SEQ ID NO: 4103 - DNA, 21 bp, Artificial sequence
  SiRNA target sequence
atgcaaatgtggaaagatcaa

SEQ ID NO: 4104 - DNA, 21 bp, Artificial sequence
  SiRNA target sequence
tgcaaatgtggaaagatcaag

SEQ ID NO: 4105 - DNA, 21 bp, Artificial sequence
  SiRNA target sequence
gcaaatgtggaaagatcaagt

SEQ ID NO: 4106 - DNA, 21 bp, Artificial sequence
  SiRNA target sequence
caaatgtggaaagatcaagtt

SEQ ID NO: 4107 - DNA, 21 bp, Artificial sequence
  SiRNA target sequence
aaatgtggaaagatcaagttg

SEQ ID NO: 4108 - DNA, 21 bp, Artificial sequence
  SiRNA target sequence
aatgtggaaagatcaagttgc

SEQ ID NO: 4109 - DNA, 21 bp, Artificial sequence
  SiRNA target sequence
atgtggaaagatcaagttgcc

SEQ ID NO: 4110 - DNA, 21 bp, Artificial sequence
  SiRNA target sequence
tgtggaaagatcaagttgccc

SEQ ID NO: 4111 - DNA, 21 bp, Artificial sequence
  SiRNA target sequence
gtggaaagatcaagttgccca

SEQ ID NO: 4112 - DNA, 21 bp, Artificial sequence
  SiRNA target sequence
tggaaagatcaagttgcccaa

SEQ ID NO: 4113 - DNA, 21 bp, Artificial sequence
  SiRNA target sequence
ggaaagatcaagttgcccaac

SEQ ID NO: 4114 - DNA, 21 bp, Artificial sequence
  SiRNA target sequence
gaaagatcaagttgcccaacg

SEQ ID NO: 4115 - DNA, 21 bp, Artificial sequence
  SiRNA target sequence
aaagatcaagttgcccaacga

SEQ ID NO: 4116 - DNA, 21 bp, Artificial sequence
  SiRNA target sequence
aagatcaagttgcccaacgat

SEQ ID NO: 4117 - DNA, 21 bp, Artificial sequence
  SiRNA target sequence
agatcaagttgcccaacgatt

SEQ ID NO: 4118 - DNA, 21 bp, Artificial sequence
  SiRNA target sequence
gatcaagttgcccaacgattg

SEQ ID NO: 4119 - DNA, 21 bp, Artificial sequence
  SiRNA target sequence
atcaagttgcccaacgattga

SEQ ID NO: 4120 - DNA, 21 bp, Artificial sequence
  SiRNA target sequence
tcaagttgcccaacgattgat

SEQ ID NO: 4121 - DNA, 21 bp, Artificial sequence
  SiRNA target sequence
caagttgcccaacgattgata

SEQ ID NO: 4122 - DNA, 21 bp, Artificial sequence
  SiRNA target sequence
aagttgcccaacgattgataa

SEQ ID NO: 4123 - DNA, 21 bp, Artificial sequence
  SiRNA target sequence
agttgcccaacgattgataac

SEQ ID NO: 4124 - DNA, 21 bp, Artificial sequence
  SiRNA target sequence
gttgcccaacgattgataacc

SEQ ID NO: 4125 - DNA, 21 bp, Artificial sequence
  SiRNA target sequence
ttgcccaacgattgataacca

SEQ ID NO: 4126 - DNA, 21 bp, Artificial sequence
  SiRNA target sequence
tgcccaacgattgataaccaa

SEQ ID NO: 4127 - DNA, 21 bp, Artificial sequence
  SiRNA target sequence
gcccaacgattgataaccaac

SEQ ID NO: 4128 - DNA, 21 bp, Artificial sequence
  SiRNA target sequence
cccaacgattgataaccaacc

SEQ ID NO: 4129 - DNA, 21 bp, Artificial sequence
  SiRNA target sequence
ccaacgattgataaccaaccg

SEQ ID NO: 4130 - DNA, 21 bp, Artificial sequence
  SiRNA target sequence
caacgattgataaccaaccgt

SEQ ID NO: 4131 - DNA, 21 bp, Artificial sequence
  SiRNA target sequence
aacgattgataaccaaccgtg

SEQ ID NO: 4132 - DNA, 21 bp, Artificial sequence
  SiRNA target sequence
acgattgataaccaaccgtgt

SEQ ID NO: 4133 - DNA, 21 bp, Artificial sequence
  SiRNA target sequence
cgattgataaccaaccgtgta

SEQ ID NO: 4134 - DNA, 21 bp, Artificial sequence
  SiRNA target sequence
gattgataaccaaccgtgtat

SEQ ID NO: 4135 - DNA, 21 bp, Artificial sequence
  SiRNA target sequence
attgataaccaaccgtgtatt

SEQ ID NO: 4136 - DNA, 21 bp, Artificial sequence
  SiRNA target sequence
ttgataaccaaccgtgtattg

SEQ ID NO: 4137 - DNA, 21 bp, Artificial sequence
  SiRNA target sequence
tgataaccaaccgtgtattga

SEQ ID NO: 4138 - DNA, 21 bp, Artificial sequence
  SiRNA target sequence
gataaccaaccgtgtattgac

SEQ ID NO: 4139 - DNA, 21 bp, Artificial sequence
  SiRNA target sequence
ataaccaaccgtgtattgaca

SEQ ID NO: 4140 - DNA, 21 bp, Artificial sequence
  SiRNA target sequence
taaccaaccgtgtattgacaa

SEQ ID NO: 4141 - DNA, 21 bp, Artificial sequence
  SiRNA target sequence
aaccaaccgtgtattgacaaa

SEQ ID NO: 4142 - DNA, 21 bp, Artificial sequence
  SiRNA target sequence
accaaccgtgtattgacaaat

SEQ ID NO: 4143 - DNA, 21 bp, Artificial sequence
  SiRNA target sequence
ccaaccgtgtattgacaaatt

SEQ ID NO: 4144 - DNA, 21 bp, Artificial sequence
  SiRNA target sequence
caaccgtgtattgacaaattt

SEQ ID NO: 4145 - DNA, 21 bp, Artificial sequence
  SiRNA target sequence
aaccgtgtattgacaaatttg

SEQ ID NO: 4146 - DNA, 21 bp, Artificial sequence
  SiRNA target sequence
accgtgtattgacaaatttgt

SEQ ID NO: 4147 - DNA, 21 bp, Artificial sequence
  SiRNA target sequence
ccgtgtattgacaaatttgta

SEQ ID NO: 4148 - DNA, 21 bp, Artificial sequence
  SiRNA target sequence
cgtgtattgacaaatttgtat

SEQ ID NO: 4149 - DNA, 21 bp, Artificial sequence
  SiRNA target sequence
gtgtattgacaaatttgtata

SEQ ID NO: 4150 - DNA, 21 bp, Artificial sequence
  SiRNA target sequence
tgtattgacaaatttgtataa

SEQ ID NO: 4151 - DNA, 21 bp, Artificial sequence
  SiRNA target sequence
gtattgacaaatttgtataaa

SEQ ID NO: 4152 - DNA, 21 bp, Artificial sequence
  SiRNA target sequence
tattgacaaatttgtataaag

SEQ ID NO: 4153 - DNA, 21 bp, Artificial sequence
  SiRNA target sequence
attgacaaatttgtataaagt

SEQ ID NO: 4154 - DNA, 21 bp, Artificial sequence
  SiRNA target sequence
ttgacaaatttgtataaagtt

SEQ ID NO: 4155 - DNA, 21 bp, Artificial sequence
  SiRNA target sequence
tgacaaatttgtataaagttt

SEQ ID NO: 4156 - DNA, 21 bp, Artificial sequence
  SiRNA target sequence
gacaaatttgtataaagtttg

SEQ ID NO: 4157 - DNA, 21 bp, Artificial sequence
  SiRNA target sequence
acaaatttgtataaagtttgt

SEQ ID NO: 4158 - DNA, 21 bp, Artificial sequence
  SiRNA target sequence
caaatttgtataaagtttgtt

SEQ ID NO: 4159 - DNA, 21 bp, Artificial sequence
  SiRNA target sequence
aaatttgtataaagtttgttt

SEQ ID NO: 4160 - DNA, 21 bp, Artificial sequence
  SiRNA target sequence
aatttgtataaagtttgtttg

SEQ ID NO: 4161 - DNA, 21 bp, Artificial sequence
  SiRNA target sequence
atttgtataaagtttgtttgg

SEQ ID NO: 4162 - DNA, 21 bp, Artificial sequence
  SiRNA target sequence
tttgtataaagtttgtttggt

SEQ ID NO: 4163 - DNA, 21 bp, Artificial sequence
  SiRNA target sequence
ttgtataaagtttgtttggta

SEQ ID NO: 4164 - DNA, 21 bp, Artificial sequence
  SiRNA target sequence
tgtataaagtttgtttggtac

SEQ ID NO: 4165 - DNA, 21 bp, Artificial sequence
  SiRNA target sequence
gtataaagtttgtttggtaca

SEQ ID NO: 4166 - DNA, 21 bp, Artificial sequence
  SiRNA target sequence
tataaagtttgtttggtacac

SEQ ID NO: 4167 - DNA, 21 bp, Artificial sequence
  SiRNA target sequence
ataaagtttgtttggtacaca

SEQ ID NO: 4168 - DNA, 21 bp, Artificial sequence
  SiRNA target sequence
taaagtttgtttggtacacaa

SEQ ID NO: 4169 - DNA, 21 bp, Artificial sequence
  SiRNA target sequence
aaagtttgtttggtacacaat

SEQ ID NO: 4170 - DNA, 21 bp, Artificial sequence
  SiRNA target sequence
aagtttgtttggtacacaatg

SEQ ID NO: 4171 - DNA, 21 bp, Artificial sequence
  SiRNA target sequence
agtttgtttggtacacaatga

SEQ ID NO: 4172 - DNA, 21 bp, Artificial sequence
  SiRNA target sequence
gtttgtttggtacacaatgac

SEQ ID NO: 4173 - DNA, 21 bp, Artificial sequence
  SiRNA target sequence
tttgtttggtacacaatgacg

SEQ ID NO: 4174 - DNA, 21 bp, Artificial sequence
  SiRNA target sequence
ttgtttggtacacaatgacga

SEQ ID NO: 4175 - DNA, 21 bp, Artificial sequence
  SiRNA target sequence
tgtttggtacacaatgacgat

SEQ ID NO: 4176 - DNA, 21 bp, Artificial sequence
  SiRNA target sequence
gtttggtacacaatgacgatc

SEQ ID NO: 4177 - DNA, 21 bp, Artificial sequence
  SiRNA target sequence
tttggtacacaatgacgatcg

SEQ ID NO: 4178 - DNA, 21 bp, Artificial sequence
  SiRNA target sequence
ttggtacacaatgacgatcga

SEQ ID NO: 4179 - DNA, 21 bp, Artificial sequence
  SiRNA target sequence
tggtacacaatgacgatcgaa

SEQ ID NO: 4180 - DNA, 21 bp, Artificial sequence
  SiRNA target sequence
ggtacacaatgacgatcgaat

SEQ ID NO: 4181 - DNA, 21 bp, Artificial sequence
  SiRNA target sequence
gtacacaatgacgatcgaata

SEQ ID NO: 4182 - DNA, 21 bp, Artificial sequence
  SiRNA target sequence
tacacaatgacgatcgaataa

SEQ ID NO: 4183 - DNA, 21 bp, Artificial sequence
  SiRNA target sequence
acacaatgacgatcgaataac

SEQ ID NO: 4184 - DNA, 21 bp, Artificial sequence
  SiRNA target sequence
cacaatgacgatcgaataaca

SEQ ID NO: 4185 - DNA, 21 bp, Artificial sequence
  SiRNA target sequence
acaatgacgatcgaataacac

SEQ ID NO: 4186 - DNA, 21 bp, Artificial sequence
  SiRNA target sequence
caatgacgatcgaataacacc

SEQ ID NO: 4187 - DNA, 21 bp, Artificial sequence
  SiRNA target sequence
aatgacgatcgaataacacct

SEQ ID NO: 4188 - DNA, 21 bp, Artificial sequence
  SiRNA target sequence
atgacgatcgaataacacctc

SEQ ID NO: 4189 - DNA, 21 bp, Artificial sequence
  SiRNA target sequence
tgacgatcgaataacacctct

SEQ ID NO: 4190 - DNA, 21 bp, Artificial sequence
  SiRNA target sequence
gacgatcgaataacacctctt

SEQ ID NO: 4191 - DNA, 21 bp, Artificial sequence
  SiRNA target sequence
acgatcgaataacacctcttt

SEQ ID NO: 4192 - DNA, 21 bp, Artificial sequence
  SiRNA target sequence
cgatcgaataacacctctttt

SEQ ID NO: 4193 - DNA, 21 bp, Artificial sequence
  SiRNA target sequence
gatcgaataacacctcttttg

SEQ ID NO: 4194 - DNA, 21 bp, Artificial sequence
  SiRNA target sequence
atcgaataacacctcttttga

SEQ ID NO: 4195 - DNA, 21 bp, Artificial sequence
  SiRNA target sequence
tcgaataacacctcttttgaa

SEQ ID NO: 4196 - DNA, 21 bp, Artificial sequence
  SiRNA target sequence
cgaataacacctcttttgaat

SEQ ID NO: 4197 - DNA, 21 bp, Artificial sequence
  SiRNA target sequence
gaataacacctcttttgaatg

SEQ ID NO: 4198 - DNA, 21 bp, Artificial sequence
  SiRNA target sequence
aataacacctcttttgaatgg

SEQ ID NO: 4199 - DNA, 21 bp, Artificial sequence
  SiRNA target sequence
ataacacctcttttgaatgga

SEQ ID NO: 4200 - DNA, 21 bp, Artificial sequence
  SiRNA target sequence
taacacctcttttgaatggac

SEQ ID NO: 4201 - DNA, 21 bp, Artificial sequence
  SiRNA target sequence
aacacctcttttgaatggact

SEQ ID NO: 4202 - DNA, 21 bp, Artificial sequence
  SiRNA target sequence
acacctcttttgaatggactt

SEQ ID NO: 4203 - DNA, 21 bp, Artificial sequence
  SiRNA target sequence
cacctcttttgaatggacttt

SEQ ID NO: 4204 - DNA, 21 bp, Artificial sequence
  SiRNA target sequence
acctcttttgaatggactttt

SEQ ID NO: 4205 - DNA, 21 bp, Artificial sequence
  SiRNA target sequence
cctcttttgaatggacttttt

SEQ ID NO: 4206 - DNA, 21 bp, Artificial sequence
  SiRNA target sequence
ctcttttgaatggactttttg

SEQ ID NO: 4207 - DNA, 21 bp, Artificial sequence
  SiRNA target sequence
tcttttgaatggactttttgt

SEQ ID NO: 4208 - DNA, 21 bp, Artificial sequence
  SiRNA target sequence
cttttgaatggactttttgtt

SEQ ID NO: 4209 - DNA, 21 bp, Artificial sequence
  SiRNA target sequence
ttttgaatggactttttgttc

SEQ ID NO: 4210 - DNA, 21 bp, Artificial sequence
  SiRNA target sequence
tttgaatggactttttgttcg

SEQ ID NO: 4211 - DNA, 21 bp, Artificial sequence
  SiRNA target sequence
ttgaatggactttttgttcgt

SEQ ID NO: 4212 - DNA, 21 bp, Artificial sequence
  SiRNA target sequence
tgaatggactttttgttcgtt

SEQ ID NO: 4213 - DNA, 21 bp, Artificial sequence
  SiRNA target sequence
gaatggactttttgttcgttc

SEQ ID NO: 4214 - DNA, 21 bp, Artificial sequence
  SiRNA target sequence
aatggactttttgttcgttca

SEQ ID NO: 4215 - DNA, 21 bp, Artificial sequence
  SiRNA target sequence
atggactttttgttcgttcaa

SEQ ID NO: 4216 - DNA, 21 bp, Artificial sequence
  SiRNA target sequence
tggactttttgttcgttcaaa

SEQ ID NO: 4217 - DNA, 21 bp, Artificial sequence
  SiRNA target sequence
ggactttttgttcgttcaaat

SEQ ID NO: 4218 - DNA, 21 bp, Artificial sequence
  SiRNA target sequence
gactttttgttcgttcaaatt

SEQ ID NO: 4219 - DNA, 21 bp, Artificial sequence
  SiRNA target sequence
actttttgttcgttcaaattt

SEQ ID NO: 4220 - DNA, 21 bp, Artificial sequence
  SiRNA target sequence
ctttttgttcgttcaaatttg

SEQ ID NO: 4221 - DNA, 21 bp, Artificial sequence
  SiRNA target sequence
tttttgttcgttcaaatttga

SEQ ID NO: 4222 - DNA, 21 bp, Artificial sequence
  SiRNA target sequence
ttttgttcgttcaaatttgat

SEQ ID NO: 4223 - DNA, 21 bp, Artificial sequence
  SiRNA target sequence
tttgttcgttcaaatttgatg

SEQ ID NO: 4224 - DNA, 21 bp, Artificial sequence
  SiRNA target sequence
ttgttcgttcaaatttgatgt

SEQ ID NO: 4225 - DNA, 21 bp, Artificial sequence
  SiRNA target sequence
tgttcgttcaaatttgatgtt

SEQ ID NO: 4226 - DNA, 21 bp, Artificial sequence
  SiRNA target sequence
gttcgttcaaatttgatgtta

SEQ ID NO: 4227 - DNA, 21 bp, Artificial sequence
  SiRNA target sequence
ttcgttcaaatttgatgttag

SEQ ID NO: 4228 - DNA, 21 bp, Artificial sequence
  SiRNA target sequence
tcgttcaaatttgatgttagt

SEQ ID NO: 4229 - DNA, 21 bp, Artificial sequence
  SiRNA target sequence
cgttcaaatttgatgttagta

SEQ ID NO: 4230 - DNA, 21 bp, Artificial sequence
  SiRNA target sequence
gttcaaatttgatgttagtac

SEQ ID NO: 4231 - DNA, 21 bp, Artificial sequence
  SiRNA target sequence
ttcaaatttgatgttagtacc

SEQ ID NO: 4232 - DNA, 21 bp, Artificial sequence
  SiRNA target sequence
tcaaatttgatgttagtacct

SEQ ID NO: 4233 - DNA, 21 bp, Artificial sequence
  SiRNA target sequence
caaatttgatgttagtacctg

SEQ ID NO: 4234 - DNA, 21 bp, Artificial sequence
  SiRNA target sequence
aaatttgatgttagtacctgg

SEQ ID NO: 4235 - DNA, 21 bp, Artificial sequence
  SiRNA target sequence
aatttgatgttagtacctgga

SEQ ID NO: 4236 - DNA, 21 bp, Artificial sequence
  SiRNA target sequence
atttgatgttagtacctggac

SEQ ID NO: 4237 - DNA, 21 bp, Artificial sequence
  SiRNA target sequence
tttgatgttagtacctggaca

SEQ ID NO: 4238 - DNA, 21 bp, Artificial sequence
  SiRNA target sequence
ttgatgttagtacctggacat

SEQ ID NO: 4239 - DNA, 21 bp, Artificial sequence
  SiRNA target sequence
tgatgttagtacctggacatc

SEQ ID NO: 4240 - DNA, 21 bp, Artificial sequence
  SiRNA target sequence
gatgttagtacctggacatct

SEQ ID NO: 4241 - DNA, 21 bp, Artificial sequence
  SiRNA target sequence
atgttagtacctggacatctt

SEQ ID NO: 4242 - DNA, 21 bp, Artificial sequence
  SiRNA target sequence
tgttagtacctggacatcttc

SEQ ID NO: 4243 - DNA, 21 bp, Artificial sequence
  SiRNA target sequence
gttagtacctggacatcttct

SEQ ID NO: 4244 - DNA, 21 bp, Artificial sequence
  SiRNA target sequence
ttagtacctggacatcttctt

SEQ ID NO: 4245 - DNA, 21 bp, Artificial sequence
  SiRNA target sequence
tagtacctggacatcttcttg

SEQ ID NO: 4246 - DNA, 21 bp, Artificial sequence
  SiRNA target sequence
agtacctggacatcttcttgg

SEQ ID NO: 4247 - DNA, 21 bp, Artificial sequence
  SiRNA target sequence
gtacctggacatcttcttgga

SEQ ID NO: 4248 - DNA, 21 bp, Artificial sequence
  SiRNA target sequence
tacctggacatcttcttggat

SEQ ID NO: 4249 - DNA, 21 bp, Artificial sequence
  SiRNA target sequence
acctggacatcttcttggatt

SEQ ID NO: 4250 - DNA, 21 bp, Artificial sequence
  SiRNA target sequence
cctggacatcttcttggattc

SEQ ID NO: 4251 - DNA, 21 bp, Artificial sequence
  SiRNA target sequence
ctggacatcttcttggattca

SEQ ID NO: 4252 - DNA, 21 bp, Artificial sequence
  SiRNA target sequence
tggacatcttcttggattcat

SEQ ID NO: 4253 - DNA, 21 bp, Artificial sequence
  SiRNA target sequence
ggacatcttcttggattcatt

SEQ ID NO: 4254 - DNA, 21 bp, Artificial sequence
  SiRNA target sequence
gacatcttcttggattcattg

SEQ ID NO: 4255 - DNA, 21 bp, Artificial sequence
  SiRNA target sequence
acatcttcttggattcattgc

SEQ ID NO: 4256 - DNA, 21 bp, Artificial sequence
  SiRNA target sequence
catcttcttggattcattgct

SEQ ID NO: 4257 - DNA, 21 bp, Artificial sequence
  SiRNA target sequence
atcttcttggattcattgctg

SEQ ID NO: 4258 - DNA, 21 bp, Artificial sequence
  SiRNA target sequence
tcttcttggattcattgctga

SEQ ID NO: 4259 - DNA, 21 bp, Artificial sequence
  SiRNA target sequence
cttcttggattcattgctgag

SEQ ID NO: 4260 - DNA, 21 bp, Artificial sequence
  SiRNA target sequence
ttcttggattcattgctgagt

SEQ ID NO: 4261 - DNA, 21 bp, Artificial sequence
  SiRNA target sequence
tcttggattcattgctgagta

SEQ ID NO: 4262 - DNA, 21 bp, Artificial sequence
  SiRNA target sequence
cttggattcattgctgagtat

SEQ ID NO: 4263 - DNA, 21 bp, Artificial sequence
  SiRNA target sequence
ttggattcattgctgagtatg

SEQ ID NO: 4264 - DNA, 21 bp, Artificial sequence
  SiRNA target sequence
tggattcattgctgagtatga

SEQ ID NO: 4265 - DNA, 21 bp, Artificial sequence
  SiRNA target sequence
ggattcattgctgagtatgac

SEQ ID NO: 4266 - DNA, 21 bp, Artificial sequence
  SiRNA target sequence
gattcattgctgagtatgaca

SEQ ID NO: 4267 - DNA, 21 bp, Artificial sequence
  SiRNA target sequence
attcattgctgagtatgacac

SEQ ID NO: 4268 - DNA, 21 bp, Artificial sequence
  SiRNA target sequence
ttcattgctgagtatgacaca

SEQ ID NO: 4269 - DNA, 21 bp, Artificial sequence
  SiRNA target sequence
tcattgctgagtatgacacaa

SEQ ID NO: 4270 - DNA, 21 bp, Artificial sequence
  SiRNA target sequence
cattgctgagtatgacacaat

SEQ ID NO: 4271 - DNA, 21 bp, Artificial sequence
  SiRNA target sequence
attgctgagtatgacacaatt

SEQ ID NO: 4272 - DNA, 21 bp, Artificial sequence
  SiRNA target sequence
ttgctgagtatgacacaattg

SEQ ID NO: 4273 - DNA, 21 bp, Artificial sequence
  SiRNA target sequence
tgctgagtatgacacaattga

SEQ ID NO: 4274 - DNA, 21 bp, Artificial sequence
  SiRNA target sequence
gctgagtatgacacaattgaa

SEQ ID NO: 4275 - DNA, 21 bp, Artificial sequence
  SiRNA target sequence
ctgagtatgacacaattgaaa

SEQ ID NO: 4276 - DNA, 21 bp, Artificial sequence
  SiRNA target sequence
tgagtatgacacaattgaaat

SEQ ID NO: 4277 - DNA, 21 bp, Artificial sequence
  SiRNA target sequence
gagtatgacacaattgaaatt

SEQ ID NO: 4278 - DNA, 21 bp, Artificial sequence
  SiRNA target sequence
agtatgacacaattgaaattc

SEQ ID NO: 4279 - DNA, 21 bp, Artificial sequence
  SiRNA target sequence
gtatgacacaattgaaattcg

SEQ ID NO: 4280 - DNA, 21 bp, Artificial sequence
  SiRNA target sequence
tatgacacaattgaaattcga

SEQ ID NO: 4281 - DNA, 21 bp, Artificial sequence
  SiRNA target sequence
atgacacaattgaaattcgaa

SEQ ID NO: 4282 - DNA, 21 bp, Artificial sequence
  SiRNA target sequence
tgacacaattgaaattcgaaa

SEQ ID NO: 4283 - DNA, 21 bp, Artificial sequence
  SiRNA target sequence
gacacaattgaaattcgaaat

SEQ ID NO: 4284 - DNA, 21 bp, Artificial sequence
  SiRNA target sequence
acacaattgaaattcgaaatc

SEQ ID NO: 4285 - DNA, 21 bp, Artificial sequence
  SiRNA target sequence
cacaattgaaattcgaaatct

SEQ ID NO: 4286 - DNA, 21 bp, Artificial sequence
  SiRNA target sequence
acaattgaaattcgaaatctc

SEQ ID NO: 4287 - DNA, 21 bp, Artificial sequence
  SiRNA target sequence
caattgaaattcgaaatctct

SEQ ID NO: 4288 - DNA, 21 bp, Artificial sequence
  SiRNA target sequence
aattgaaattcgaaatctctt

SEQ ID NO: 4289 - DNA, 21 bp, Artificial sequence
  SiRNA target sequence
attgaaattcgaaatctcttt

SEQ ID NO: 4290 - DNA, 21 bp, Artificial sequence
  SiRNA target sequence
ttgaaattcgaaatctctttg

SEQ ID NO: 4291 - DNA, 21 bp, Artificial sequence
  SiRNA target sequence
tgaaattcgaaatctctttga

SEQ ID NO: 4292 - DNA, 21 bp, Artificial sequence
  SiRNA target sequence
gaaattcgaaatctctttgac

SEQ ID NO: 4293 - DNA, 21 bp, Artificial sequence
  SiRNA target sequence
aaattcgaaatctctttgacg

SEQ ID NO: 4294 - DNA, 21 bp, Artificial sequence
  SiRNA target sequence
aattcgaaatctctttgacgt

SEQ ID NO: 4295 - DNA, 21 bp, Artificial sequence
  SiRNA target sequence
attcgaaatctctttgacgtg

SEQ ID NO: 4296 - DNA, 21 bp, Artificial sequence
  SiRNA target sequence
ttcgaaatctctttgacgtgg

SEQ ID NO: 4297 - DNA, 21 bp, Artificial sequence
  SiRNA target sequence
tcgaaatctctttgacgtggt

SEQ ID NO: 4298 - DNA, 21 bp, Artificial sequence
  SiRNA target sequence
cgaaatctctttgacgtggta

SEQ ID NO: 4299 - DNA, 21 bp, Artificial sequence
  SiRNA target sequence
gaaatctctttgacgtggtat

SEQ ID NO: 4300 - DNA, 21 bp, Artificial sequence
  SiRNA target sequence
aaatctctttgacgtggtatt

SEQ ID NO: 4301 - DNA, 21 bp, Artificial sequence
  SiRNA target sequence
aatctctttgacgtggtattt

SEQ ID NO: 4302 - DNA, 21 bp, Artificial sequence
  SiRNA target sequence
atctctttgacgtggtattta

SEQ ID NO: 4303 - DNA, 21 bp, Artificial sequence
  SiRNA target sequence
tctctttgacgtggtatttag

SEQ ID NO: 4304 - DNA, 21 bp, Artificial sequence
  SiRNA target sequence
ctctttgacgtggtatttaga

SEQ ID NO: 4305 - DNA, 21 bp, Artificial sequence
  SiRNA target sequence
tctttgacgtggtatttagag

SEQ ID NO: 4306 - DNA, 21 bp, Artificial sequence
  SiRNA target sequence
ctttgacgtggtatttagagt

SEQ ID NO: 4307 - DNA, 21 bp, Artificial sequence
  SiRNA target sequence
tttgacgtggtatttagagtg

SEQ ID NO: 4308 - DNA, 21 bp, Artificial sequence
  SiRNA target sequence
ttgacgtggtatttagagtgc

SEQ ID NO: 4309 - DNA, 21 bp, Artificial sequence
  SiRNA target sequence
tgacgtggtatttagagtgcc

SEQ ID NO: 4310 - DNA, 21 bp, Artificial sequence
  SiRNA target sequence
gacgtggtatttagagtgcca

SEQ ID NO: 4311 - DNA, 21 bp, Artificial sequence
  SiRNA target sequence
acgtggtatttagagtgccat

SEQ ID NO: 4312 - DNA, 21 bp, Artificial sequence
  SiRNA target sequence
cgtggtatttagagtgccatg

SEQ ID NO: 4313 - DNA, 21 bp, Artificial sequence
  SiRNA target sequence
gtggtatttagagtgccatgg

SEQ ID NO: 4314 - DNA, 21 bp, Artificial sequence
  SiRNA target sequence
tggtatttagagtgccatgga

SEQ ID NO: 4315 - DNA, 21 bp, Artificial sequence
  SiRNA target sequence
ggtatttagagtgccatggaa

SEQ ID NO: 4316 - DNA, 21 bp, Artificial sequence
  SiRNA target sequence
gtatttagagtgccatggaaa

SEQ ID NO: 4317 - DNA, 21 bp, Artificial sequence
  SiRNA target sequence
tatttagagtgccatggaaag

SEQ ID NO: 4318 - DNA, 21 bp, Artificial sequence
  SiRNA target sequence
atttagagtgccatggaaaga

SEQ ID NO: 4319 - DNA, 21 bp, Artificial sequence
  SiRNA target sequence
tttagagtgccatggaaagat

SEQ ID NO: 4320 - DNA, 21 bp, Artificial sequence
  SiRNA target sequence
ttagagtgccatggaaagatg

SEQ ID NO: 4321 - DNA, 21 bp, Artificial sequence
  SiRNA target sequence
tagagtgccatggaaagatgt

SEQ ID NO: 4322 - DNA, 21 bp, Artificial sequence
  SiRNA target sequence
agagtgccatggaaagatgtg

SEQ ID NO: 4323 - DNA, 21 bp, Artificial sequence
  SiRNA target sequence
gagtgccatggaaagatgtga

SEQ ID NO: 4324 - DNA, 21 bp, Artificial sequence
  SiRNA target sequence
agtgccatggaaagatgtgaa

SEQ ID NO: 4325 - DNA, 21 bp, Artificial sequence
  SiRNA target sequence
gtgccatggaaagatgtgaag

SEQ ID NO: 4326 - DNA, 21 bp, Artificial sequence
  SiRNA target sequence
tgccatggaaagatgtgaaga

SEQ ID NO: 4327 - DNA, 21 bp, Artificial sequence
  SiRNA target sequence
gccatggaaagatgtgaagaa

SEQ ID NO: 4328 - DNA, 21 bp, Artificial sequence
  SiRNA target sequence
ccatggaaagatgtgaagaaa

SEQ ID NO: 4329 - DNA, 21 bp, Artificial sequence
  SiRNA target sequence
catggaaagatgtgaagaaag

SEQ ID NO: 4330 - DNA, 21 bp, Artificial sequence
  SiRNA target sequence
atggaaagatgtgaagaaagt

SEQ ID NO: 4331 - DNA, 21 bp, Artificial sequence
  SiRNA target sequence
tggaaagatgtgaagaaagtt

SEQ ID NO: 4332 - DNA, 21 bp, Artificial sequence
  SiRNA target sequence
ggaaagatgtgaagaaagttc

SEQ ID NO: 4333 - DNA, 21 bp, Artificial sequence
  SiRNA target sequence
gaaagatgtgaagaaagttcc

SEQ ID NO: 4334 - DNA, 21 bp, Artificial sequence
  SiRNA target sequence
aaagatgtgaagaaagttcca

SEQ ID NO: 4335 - DNA, 21 bp, Artificial sequence
  SiRNA target sequence
aagatgtgaagaaagttccaa

SEQ ID NO: 4336 - DNA, 21 bp, Artificial sequence
  SiRNA target sequence
agatgtgaagaaagttccaat

SEQ ID NO: 4337 - DNA, 21 bp, Artificial sequence
  SiRNA target sequence
gatgtgaagaaagttccaatt

SEQ ID NO: 4338 - DNA, 21 bp, Artificial sequence
  SiRNA target sequence
atgtgaagaaagttccaattg

SEQ ID NO: 4339 - DNA, 21 bp, Artificial sequence
  SiRNA target sequence
tgtgaagaaagttccaattgt

SEQ ID NO: 4340 - DNA, 21 bp, Artificial sequence
  SiRNA target sequence
gtgaagaaagttccaattgtt

SEQ ID NO: 4341 - DNA, 21 bp, Artificial sequence
  SiRNA target sequence
tgaagaaagttccaattgtta

SEQ ID NO: 4342 - DNA, 21 bp, Artificial sequence
  SiRNA target sequence
gaagaaagttccaattgttaa

SEQ ID NO: 4343 - DNA, 21 bp, Artificial sequence
  SiRNA target sequence
aagaaagttccaattgttaat

SEQ ID NO: 4344 - DNA, 21 bp, Artificial sequence
  SiRNA target sequence
agaaagttccaattgttaatg

SEQ ID NO: 4345 - DNA, 21 bp, Artificial sequence
  SiRNA target sequence
gaaagttccaattgttaatgc

SEQ ID NO: 4346 - DNA, 21 bp, Artificial sequence
  SiRNA target sequence
aaagttccaattgttaatgct

SEQ ID NO: 4347 - DNA, 21 bp, Artificial sequence
  SiRNA target sequence
aagttccaattgttaatgctt

SEQ ID NO: 4348 - DNA, 21 bp, Artificial sequence
  SiRNA target sequence
agttccaattgttaatgcttt

SEQ ID NO: 4349 - DNA, 21 bp, Artificial sequence
  SiRNA target sequence
gttccaattgttaatgctttt

SEQ ID NO: 4350 - DNA, 21 bp, Artificial sequence
  SiRNA target sequence
ttccaattgttaatgcttttg

SEQ ID NO: 4351 - DNA, 21 bp, Artificial sequence
  SiRNA target sequence
tccaattgttaatgcttttgg

SEQ ID NO: 4352 - DNA, 21 bp, Artificial sequence
  SiRNA target sequence
ccaattgttaatgcttttggt

SEQ ID NO: 4353 - DNA, 21 bp, Artificial sequence
  SiRNA target sequence
caattgttaatgcttttggtg

SEQ ID NO: 4354 - DNA, 21 bp, Artificial sequence
  SiRNA target sequence
aattgttaatgcttttggtga

SEQ ID NO: 4355 - DNA, 21 bp, Artificial sequence
  SiRNA target sequence
attgttaatgcttttggtgaa

SEQ ID NO: 4356 - DNA, 21 bp, Artificial sequence
  SiRNA target sequence
ttgttaatgcttttggtgaat

SEQ ID NO: 4357 - DNA, 21 bp, Artificial sequence
  SiRNA target sequence
tgttaatgcttttggtgaatc

SEQ ID NO: 4358 - DNA, 21 bp, Artificial sequence
  SiRNA target sequence
gttaatgcttttggtgaatct

SEQ ID NO: 4359 - DNA, 21 bp, Artificial sequence
  SiRNA target sequence
ttaatgcttttggtgaatcta

SEQ ID NO: 4360 - DNA, 21 bp, Artificial sequence
  SiRNA target sequence
taatgcttttggtgaatctaa

SEQ ID NO: 4361 - DNA, 21 bp, Artificial sequence
  SiRNA target sequence
aatgcttttggtgaatctaaa

SEQ ID NO: 4362 - DNA, 21 bp, Artificial sequence
  SiRNA target sequence
atgcttttggtgaatctaaag

SEQ ID NO: 4363 - DNA, 21 bp, Artificial sequence
  SiRNA target sequence
tgcttttggtgaatctaaaga

SEQ ID NO: 4364 - DNA, 21 bp, Artificial sequence
  SiRNA target sequence
gcttttggtgaatctaaagaa

SEQ ID NO: 4365 - DNA, 21 bp, Artificial sequence
  SiRNA target sequence
cttttggtgaatctaaagaag

SEQ ID NO: 4366 - DNA, 21 bp, Artificial sequence
  SiRNA target sequence
ttttggtgaatctaaagaagc

SEQ ID NO: 4367 - DNA, 21 bp, Artificial sequence
  SiRNA target sequence
tttggtgaatctaaagaagca

SEQ ID NO: 4368 - DNA, 21 bp, Artificial sequence
  SiRNA target sequence
ttggtgaatctaaagaagcag

SEQ ID NO: 4369 - DNA, 21 bp, Artificial sequence
  SiRNA target sequence
tggtgaatctaaagaagcagc

SEQ ID NO: 4370 - DNA, 21 bp, Artificial sequence
  SiRNA target sequence
ggtgaatctaaagaagcagcg

SEQ ID NO: 4371 - DNA, 21 bp, Artificial sequence
  SiRNA target sequence
gtgaatctaaagaagcagcgt

SEQ ID NO: 4372 - DNA, 21 bp, Artificial sequence
  SiRNA target sequence
tgaatctaaagaagcagcgtt

SEQ ID NO: 4373 - DNA, 21 bp, Artificial sequence
  SiRNA target sequence
gaatctaaagaagcagcgtta

SEQ ID NO: 4374 - DNA, 21 bp, Artificial sequence
  SiRNA target sequence
aatctaaagaagcagcgttat

SEQ ID NO: 4375 - DNA, 21 bp, Artificial sequence
  SiRNA target sequence
atctaaagaagcagcgttatt

SEQ ID NO: 4376 - DNA, 21 bp, Artificial sequence
  SiRNA target sequence
tctaaagaagcagcgttattg

SEQ ID NO: 4377 - DNA, 21 bp, Artificial sequence
  SiRNA target sequence
ctaaagaagcagcgttattgg

SEQ ID NO: 4378 - DNA, 21 bp, Artificial sequence
  SiRNA target sequence
taaagaagcagcgttattggc

SEQ ID NO: 4379 - DNA, 21 bp, Artificial sequence
  SiRNA target sequence
aaagaagcagcgttattggcc

SEQ ID NO: 4380 - DNA, 21 bp, Artificial sequence
  SiRNA target sequence
aagaagcagcgttattggcct

SEQ ID NO: 4381 - DNA, 21 bp, Artificial sequence
  SiRNA target sequence
agaagcagcgttattggcctt

SEQ ID NO: 4382 - DNA, 21 bp, Artificial sequence
  SiRNA target sequence
gaagcagcgttattggccttc

SEQ ID NO: 4383 - DNA, 21 bp, Artificial sequence
  SiRNA target sequence
aagcagcgttattggccttcc

SEQ ID NO: 4384 - DNA, 21 bp, Artificial sequence
  SiRNA target sequence
agcagcgttattggccttccc

SEQ ID NO: 4385 - DNA, 21 bp, Artificial sequence
  SiRNA target sequence
gcagcgttattggccttccca

SEQ ID NO: 4386 - DNA, 21 bp, Artificial sequence
  SiRNA target sequence
cagcgttattggccttcccaa

SEQ ID NO: 4387 - DNA, 21 bp, Artificial sequence
  SiRNA target sequence
agcgttattggccttcccaaa

SEQ ID NO: 4388 - DNA, 21 bp, Artificial sequence
  SiRNA target sequence
gcgttattggccttcccaaaa

SEQ ID NO: 4389 - DNA, 21 bp, Artificial sequence
  SiRNA target sequence
cgttattggccttcccaaaat

SEQ ID NO: 4390 - DNA, 21 bp, Artificial sequence
  SiRNA target sequence
gttattggccttcccaaaatt

SEQ ID NO: 4391 - DNA, 21 bp, Artificial sequence
  SiRNA target sequence
ttattggccttcccaaaattc

SEQ ID NO: 4392 - DNA, 21 bp, Artificial sequence
  SiRNA target sequence
tattggccttcccaaaattcg

SEQ ID NO: 4393 - DNA, 21 bp, Artificial sequence
  SiRNA target sequence
attggccttcccaaaattcgt

SEQ ID NO: 4394 - DNA, 21 bp, Artificial sequence
  SiRNA target sequence
ttggccttcccaaaattcgtt

SEQ ID NO: 4395 - DNA, 21 bp, Artificial sequence
  SiRNA target sequence
tggccttcccaaaattcgttt

SEQ ID NO: 4396 - DNA, 21 bp, Artificial sequence
  SiRNA target sequence
ggccttcccaaaattcgtttg

SEQ ID NO: 4397 - DNA, 21 bp, Artificial sequence
  SiRNA target sequence
gccttcccaaaattcgtttgc

SEQ ID NO: 4398 - DNA, 21 bp, Artificial sequence
  SiRNA target sequence
ccttcccaaaattcgtttgcc

SEQ ID NO: 4399 - DNA, 21 bp, Artificial sequence
  SiRNA target sequence
cttcccaaaattcgtttgcca

SEQ ID NO: 4400 - DNA, 21 bp, Artificial sequence
  SiRNA target sequence
ttcccaaaattcgtttgccaa

SEQ ID NO: 4401 - DNA, 21 bp, Artificial sequence
  SiRNA target sequence
tcccaaaattcgtttgccaac

SEQ ID NO: 4402 - DNA, 21 bp, Artificial sequence
  SiRNA target sequence
cccaaaattcgtttgccaaca

SEQ ID NO: 4403 - DNA, 21 bp, Artificial sequence
  SiRNA target sequence
ccaaaattcgtttgccaacat

SEQ ID NO: 4404 - DNA, 21 bp, Artificial sequence
  SiRNA target sequence
caaaattcgtttgccaacatt

SEQ ID NO: 4405 - DNA, 21 bp, Artificial sequence
  SiRNA target sequence
aaaattcgtttgccaacattc

SEQ ID NO: 4406 - DNA, 21 bp, Artificial sequence
  SiRNA target sequence
aaattcgtttgccaacattct

SEQ ID NO: 4407 - DNA, 21 bp, Artificial sequence
  SiRNA target sequence
aattcgtttgccaacattctg

SEQ ID NO: 4408 - DNA, 21 bp, Artificial sequence
  SiRNA target sequence
attcgtttgccaacattctga

SEQ ID NO: 4409 - DNA, 21 bp, Artificial sequence
  SiRNA target sequence
ttcgtttgccaacattctgat

SEQ ID NO: 4410 - DNA, 21 bp, Artificial sequence
  SiRNA target sequence
tcgtttgccaacattctgatt

SEQ ID NO: 4411 - DNA, 21 bp, Artificial sequence
  SiRNA target sequence
cgtttgccaacattctgattt

SEQ ID NO: 4412 - DNA, 21 bp, Artificial sequence
  SiRNA target sequence
gtttgccaacattctgattta

SEQ ID NO: 4413 - DNA, 21 bp, Artificial sequence
  SiRNA target sequence
tttgccaacattctgatttag

SEQ ID NO: 4414 - DNA, 21 bp, Artificial sequence
  SiRNA target sequence
ttgccaacattctgatttagt

SEQ ID NO: 4415 - DNA, 21 bp, Artificial sequence
  SiRNA target sequence
tgccaacattctgatttagtt

SEQ ID NO: 4416 - DNA, 21 bp, Artificial sequence
  SiRNA target sequence
gccaacattctgatttagtta

SEQ ID NO: 4417 - DNA, 21 bp, Artificial sequence
  SiRNA target sequence
ccaacattctgatttagttaa

SEQ ID NO: 4418 - DNA, 21 bp, Artificial sequence
  SiRNA target sequence
caacattctgatttagttaag

SEQ ID NO: 4419 - DNA, 21 bp, Artificial sequence
  SiRNA target sequence
aacattctgatttagttaagc

SEQ ID NO: 4420 - DNA, 21 bp, Artificial sequence
  SiRNA target sequence
acattctgatttagttaagca

SEQ ID NO: 4421 - DNA, 21 bp, Artificial sequence
  SiRNA target sequence
cattctgatttagttaagcat

SEQ ID NO: 4422 - DNA, 21 bp, Artificial sequence
  SiRNA target sequence
attctgatttagttaagcatt

SEQ ID NO: 4423 - DNA, 21 bp, Artificial sequence
  SiRNA target sequence
ttctgatttagttaagcattt

SEQ ID NO: 4424 - DNA, 21 bp, Artificial sequence
  SiRNA target sequence
tctgatttagttaagcatttc

SEQ ID NO: 4425 - DNA, 21 bp, Artificial sequence
  SiRNA target sequence
ctgatttagttaagcatttcc

SEQ ID NO: 4426 - DNA, 21 bp, Artificial sequence
  SiRNA target sequence
tgatttagttaagcatttcca

SEQ ID NO: 4427 - DNA, 21 bp, Artificial sequence
  SiRNA target sequence
gatttagttaagcatttccaa

SEQ ID NO: 4428 - DNA, 21 bp, Artificial sequence
  SiRNA target sequence
atttagttaagcatttccaaa

SEQ ID NO: 4429 - DNA, 21 bp, Artificial sequence
  SiRNA target sequence
tttagttaagcatttccaaaa

SEQ ID NO: 4430 - DNA, 21 bp, Artificial sequence
  SiRNA target sequence
ttagttaagcatttccaaaat

SEQ ID NO: 4431 - DNA, 21 bp, Artificial sequence
  SiRNA target sequence
tagttaagcatttccaaaatg

SEQ ID NO: 4432 - DNA, 21 bp, Artificial sequence
  SiRNA target sequence
agttaagcatttccaaaatgc

SEQ ID NO: 4433 - DNA, 21 bp, Artificial sequence
  SiRNA target sequence
gttaagcatttccaaaatgct

SEQ ID NO: 4434 - DNA, 21 bp, Artificial sequence
  SiRNA target sequence
ttaagcatttccaaaatgctg

SEQ ID NO: 4435 - DNA, 21 bp, Artificial sequence
  SiRNA target sequence
taagcatttccaaaatgctga

SEQ ID NO: 4436 - DNA, 21 bp, Artificial sequence
  SiRNA target sequence
aagcatttccaaaatgctgaa

SEQ ID NO: 4437 - DNA, 21 bp, Artificial sequence
  SiRNA target sequence
agcatttccaaaatgctgaat

SEQ ID NO: 4438 - DNA, 21 bp, Artificial sequence
  SiRNA target sequence
gcatttccaaaatgctgaatc

SEQ ID NO: 4439 - DNA, 21 bp, Artificial sequence
  SiRNA target sequence
catttccaaaatgctgaatct

SEQ ID NO: 4440 - DNA, 21 bp, Artificial sequence
  SiRNA target sequence
atttccaaaatgctgaatcta

SEQ ID NO: 4441 - DNA, 21 bp, Artificial sequence
  SiRNA target sequence
tttccaaaatgctgaatctat

SEQ ID NO: 4442 - DNA, 21 bp, Artificial sequence
  SiRNA target sequence
ttccaaaatgctgaatctatg

SEQ ID NO: 4443 - DNA, 21 bp, Artificial sequence
  SiRNA target sequence
tccaaaatgctgaatctatgt

SEQ ID NO: 4444 - DNA, 21 bp, Artificial sequence
  SiRNA target sequence
ccaaaatgctgaatctatgtc

SEQ ID NO: 4445 - DNA, 21 bp, Artificial sequence
  SiRNA target sequence
caaaatgctgaatctatgtcg

SEQ ID NO: 4446 - DNA, 21 bp, Artificial sequence
  SiRNA target sequence
aaaatgctgaatctatgtcga

SEQ ID NO: 4447 - DNA, 21 bp, Artificial sequence
  SiRNA target sequence
aaatgctgaatctatgtcgaa

SEQ ID NO: 4448 - DNA, 21 bp, Artificial sequence
  SiRNA target sequence
aatgctgaatctatgtcgaaa

SEQ ID NO: 4449 - DNA, 21 bp, Artificial sequence
  SiRNA target sequence
atgctgaatctatgtcgaaat

SEQ ID NO: 4450 - DNA, 21 bp, Artificial sequence
  SiRNA target sequence
tgctgaatctatgtcgaaatt

SEQ ID NO: 4451 - DNA, 21 bp, Artificial sequence
  SiRNA target sequence
gctgaatctatgtcgaaattt

SEQ ID NO: 4452 - DNA, 21 bp, Artificial sequence
  SiRNA target sequence
ctgaatctatgtcgaaattta

SEQ ID NO: 4453 - DNA, 21 bp, Artificial sequence
  SiRNA target sequence
tgaatctatgtcgaaatttaa

SEQ ID NO: 4454 - DNA, 21 bp, Artificial sequence
  SiRNA target sequence
gaatctatgtcgaaatttaaa

SEQ ID NO: 4455 - DNA, 21 bp, Artificial sequence
  SiRNA target sequence
aatctatgtcgaaatttaaac

SEQ ID NO: 4456 - DNA, 21 bp, Artificial sequence
  SiRNA target sequence
atctatgtcgaaatttaaacg

SEQ ID NO: 4457 - DNA, 21 bp, Artificial sequence
  SiRNA target sequence
tctatgtcgaaatttaaacga

SEQ ID NO: 4458 - DNA, 21 bp, Artificial sequence
  SiRNA target sequence
ctatgtcgaaatttaaacgat

SEQ ID NO: 4459 - DNA, 21 bp, Artificial sequence
  SiRNA target sequence
tatgtcgaaatttaaacgatg

SEQ ID NO: 4460 - DNA, 21 bp, Artificial sequence
  SiRNA target sequence
atgtcgaaatttaaacgatgt

SEQ ID NO: 4461 - DNA, 21 bp, Artificial sequence
  SiRNA target sequence
tgtcgaaatttaaacgatgtg

SEQ ID NO: 4462 - DNA, 21 bp, Artificial sequence
  SiRNA target sequence
gtcgaaatttaaacgatgtga

SEQ ID NO: 4463 - DNA, 21 bp, Artificial sequence
  SiRNA target sequence
tcgaaatttaaacgatgtgaa

SEQ ID NO: 4464 - DNA, 21 bp, Artificial sequence
  SiRNA target sequence
cgaaatttaaacgatgtgaag

SEQ ID NO: 4465 - DNA, 21 bp, Artificial sequence
  SiRNA target sequence
gaaatttaaacgatgtgaagt

SEQ ID NO: 4466 - DNA, 21 bp, Artificial sequence
  SiRNA target sequence
aaatttaaacgatgtgaagtc

SEQ ID NO: 4467 - DNA, 21 bp, Artificial sequence
  SiRNA target sequence
aatttaaacgatgtgaagtca

SEQ ID NO: 4468 - DNA, 21 bp, Artificial sequence
  SiRNA target sequence
atttaaacgatgtgaagtcac

SEQ ID NO: 4469 - DNA, 21 bp, Artificial sequence
  SiRNA target sequence
tttaaacgatgtgaagtcact

SEQ ID NO: 4470 - DNA, 21 bp, Artificial sequence
  SiRNA target sequence
ttaaacgatgtgaagtcactc

SEQ ID NO: 4471 - DNA, 21 bp, Artificial sequence
  SiRNA target sequence
taaacgatgtgaagtcactct

SEQ ID NO: 4472 - DNA, 21 bp, Artificial sequence
  SiRNA target sequence
aaacgatgtgaagtcactcta

SEQ ID NO: 4473 - DNA, 21 bp, Artificial sequence
  SiRNA target sequence
aacgatgtgaagtcactctac

SEQ ID NO: 4474 - DNA, 21 bp, Artificial sequence
  SiRNA target sequence
acgatgtgaagtcactctacc

SEQ ID NO: 4475 - DNA, 21 bp, Artificial sequence
  SiRNA target sequence
cgatgtgaagtcactctaccc

SEQ ID NO: 4476 - DNA, 21 bp, Artificial sequence
  SiRNA target sequence
gatgtgaagtcactctacccg

SEQ ID NO: 4477 - DNA, 21 bp, Artificial sequence
  SiRNA target sequence
atgtgaagtcactctacccgt

SEQ ID NO: 4478 - DNA, 21 bp, Artificial sequence
  SiRNA target sequence
tgtgaagtcactctacccgtt

SEQ ID NO: 4479 - DNA, 21 bp, Artificial sequence
  SiRNA target sequence
gtgaagtcactctacccgttt

SEQ ID NO: 4480 - DNA, 21 bp, Artificial sequence
  SiRNA target sequence
tgaagtcactctacccgtttt

SEQ ID NO: 4481 - DNA, 21 bp, Artificial sequence
  SiRNA target sequence
gaagtcactctacccgtttta

SEQ ID NO: 4482 - DNA, 21 bp, Artificial sequence
  SiRNA target sequence
aagtcactctacccgttttac

SEQ ID NO: 4483 - DNA, 21 bp, Artificial sequence
  SiRNA target sequence
agtcactctacccgttttacg

SEQ ID NO: 4484 - DNA, 21 bp, Artificial sequence
  SiRNA target sequence
gtcactctacccgttttacgt

SEQ ID NO: 4485 - DNA, 21 bp, Artificial sequence
  SiRNA target sequence
tcactctacccgttttacgtt

SEQ ID NO: 4486 - DNA, 21 bp, Artificial sequence
  SiRNA target sequence
cactctacccgttttacgttt

SEQ ID NO: 4487 - DNA, 21 bp, Artificial sequence
  SiRNA target sequence
actctacccgttttacgtttc

SEQ ID NO: 4488 - DNA, 21 bp, Artificial sequence
  SiRNA target sequence
ctctacccgttttacgtttct

SEQ ID NO: 4489 - DNA, 21 bp, Artificial sequence
  SiRNA target sequence
tctacccgttttacgtttctc

SEQ ID NO: 4490 - DNA, 21 bp, Artificial sequence
  SiRNA target sequence
ctacccgttttacgtttctct

SEQ ID NO: 4491 - DNA, 21 bp, Artificial sequence
  SiRNA target sequence
tacccgttttacgtttctctg

SEQ ID NO: 4492 - DNA, 21 bp, Artificial sequence
  SiRNA target sequence
acccgttttacgtttctctga

SEQ ID NO: 4493 - DNA, 21 bp, Artificial sequence
  SiRNA target sequence
cccgttttacgtttctctgag

SEQ ID NO: 4494 - DNA, 21 bp, Artificial sequence
  SiRNA target sequence
ccgttttacgtttctctgaga

SEQ ID NO: 4495 - DNA, 21 bp, Artificial sequence
  SiRNA target sequence
cgttttacgtttctctgagaa

SEQ ID NO: 4496 - DNA, 21 bp, Artificial sequence
  SiRNA target sequence
gttttacgtttctctgagaaa

SEQ ID NO: 4497 - DNA, 21 bp, Artificial sequence
  SiRNA target sequence
ttttacgtttctctgagaaag

SEQ ID NO: 4498 - DNA, 21 bp, Artificial sequence
  SiRNA target sequence
tttacgtttctctgagaaagt

SEQ ID NO: 4499 - DNA, 21 bp, Artificial sequence
  SiRNA target sequence
ttacgtttctctgagaaagtt

SEQ ID NO: 4500 - DNA, 21 bp, Artificial sequence
  SiRNA target sequence
tacgtttctctgagaaagttg

SEQ ID NO: 4501 - DNA, 21 bp, Artificial sequence
  SiRNA target sequence
acgtttctctgagaaagttgg

SEQ ID NO: 4502 - DNA, 21 bp, Artificial sequence
  SiRNA target sequence
cgtttctctgagaaagttggt

SEQ ID NO: 4503 - DNA, 21 bp, Artificial sequence
  SiRNA target sequence
gtttctctgagaaagttggta

SEQ ID NO: 4504 - DNA, 21 bp, Artificial sequence
  SiRNA target sequence
tttctctgagaaagttggtaa

SEQ ID NO: 4505 - DNA, 21 bp, Artificial sequence
  SiRNA target sequence
ttctctgagaaagttggtaaa

SEQ ID NO: 4506 - DNA, 21 bp, Artificial sequence
  SiRNA target sequence
tctctgagaaagttggtaaat

SEQ ID NO: 4507 - DNA, 21 bp, Artificial sequence
  SiRNA target sequence
ctctgagaaagttggtaaatt

SEQ ID NO: 4508 - DNA, 21 bp, Artificial sequence
  SiRNA target sequence
tctgagaaagttggtaaattt

SEQ ID NO: 4509 - DNA, 21 bp, Artificial sequence
  SiRNA target sequence
ctgagaaagttggtaaatttt

SEQ ID NO: 4510 - DNA, 21 bp, Artificial sequence
  SiRNA target sequence
tgagaaagttggtaaattttt

SEQ ID NO: 4511 - DNA, 21 bp, Artificial sequence
  SiRNA target sequence
gagaaagttggtaaattttta

SEQ ID NO: 4512 - DNA, 21 bp, Artificial sequence
  SiRNA target sequence
agaaagttggtaaatttttat

SEQ ID NO: 4513 - DNA, 21 bp, Artificial sequence
  SiRNA target sequence
gaaagttggtaaatttttatc

SEQ ID NO: 4514 - DNA, 21 bp, Artificial sequence
  SiRNA target sequence
aaagttggtaaatttttatca

SEQ ID NO: 4515 - DNA, 21 bp, Artificial sequence
  SiRNA target sequence
aagttggtaaatttttatcaa

SEQ ID NO: 4516 - DNA, 21 bp, Artificial sequence
  SiRNA target sequence
agttggtaaatttttatcaac

SEQ ID NO: 4517 - DNA, 21 bp, Artificial sequence
  SiRNA target sequence
gttggtaaatttttatcaaca

SEQ ID NO: 4518 - DNA, 21 bp, Artificial sequence
  SiRNA target sequence
ttggtaaatttttatcaacac

SEQ ID NO: 4519 - DNA, 21 bp, Artificial sequence
  SiRNA target sequence
tggtaaatttttatcaacact

SEQ ID NO: 4520 - DNA, 21 bp, Artificial sequence
  SiRNA target sequence
ggtaaatttttatcaacactc

SEQ ID NO: 4521 - DNA, 21 bp, Artificial sequence
  SiRNA target sequence
gtaaatttttatcaacactca

SEQ ID NO: 4522 - DNA, 21 bp, Artificial sequence
  SiRNA target sequence
taaatttttatcaacactcat

SEQ ID NO: 4523 - DNA, 21 bp, Artificial sequence
  SiRNA target sequence
aaatttttatcaacactcatt

SEQ ID NO: 4524 - DNA, 21 bp, Artificial sequence
  SiRNA target sequence
aatttttatcaacactcattg

SEQ ID NO: 4525 - DNA, 21 bp, Artificial sequence
  SiRNA target sequence
atttttatcaacactcattga

SEQ ID NO: 4526 - DNA, 21 bp, Artificial sequence
  SiRNA target sequence
tttttatcaacactcattgaa

SEQ ID NO: 4527 - DNA, 21 bp, Artificial sequence
  SiRNA target sequence
ttttatcaacactcattgaat

SEQ ID NO: 4528 - DNA, 21 bp, Artificial sequence
  SiRNA target sequence
tttatcaacactcattgaatg

SEQ ID NO: 4529 - DNA, 21 bp, Artificial sequence
  SiRNA target sequence
ttatcaacactcattgaatgt

SEQ ID NO: 4530 - DNA, 21 bp, Artificial sequence
  SiRNA target sequence
tatcaacactcattgaatgtg

SEQ ID NO: 4531 - DNA, 21 bp, Artificial sequence
  SiRNA target sequence
atcaacactcattgaatgtga

SEQ ID NO: 4532 - DNA, 21 bp, Artificial sequence
  SiRNA target sequence
tcaacactcattgaatgtgat

SEQ ID NO: 4533 - DNA, 21 bp, Artificial sequence
  SiRNA target sequence
caacactcattgaatgtgatc

SEQ ID NO: 4534 - DNA, 21 bp, Artificial sequence
  SiRNA target sequence
aacactcattgaatgtgatcg

SEQ ID NO: 4535 - DNA, 21 bp, Artificial sequence
  SiRNA target sequence
acactcattgaatgtgatcga

SEQ ID NO: 4536 - DNA, 21 bp, Artificial sequence
  SiRNA target sequence
cactcattgaatgtgatcgag

SEQ ID NO: 4537 - DNA, 21 bp, Artificial sequence
  SiRNA target sequence
actcattgaatgtgatcgagt

SEQ ID NO: 4538 - DNA, 21 bp, Artificial sequence
  SiRNA target sequence
ctcattgaatgtgatcgagtg

SEQ ID NO: 4539 - DNA, 21 bp, Artificial sequence
  SiRNA target sequence
tcattgaatgtgatcgagtgg

SEQ ID NO: 4540 - DNA, 21 bp, Artificial sequence
  SiRNA target sequence
cattgaatgtgatcgagtgga

SEQ ID NO: 4541 - DNA, 21 bp, Artificial sequence
  SiRNA target sequence
attgaatgtgatcgagtggag

SEQ ID NO: 4542 - DNA, 21 bp, Artificial sequence
  SiRNA target sequence
ttgaatgtgatcgagtggagg

SEQ ID NO: 4543 - DNA, 21 bp, Artificial sequence
  SiRNA target sequence
tgaatgtgatcgagtggaggc

SEQ ID NO: 4544 - DNA, 21 bp, Artificial sequence
  SiRNA target sequence
gaatgtgatcgagtggaggct

SEQ ID NO: 4545 - DNA, 21 bp, Artificial sequence
  SiRNA target sequence
aatgtgatcgagtggaggctt

SEQ ID NO: 4546 - DNA, 21 bp, Artificial sequence
  SiRNA target sequence
atgtgatcgagtggaggctta

SEQ ID NO: 4547 - DNA, 21 bp, Artificial sequence
  SiRNA target sequence
tgtgatcgagtggaggcttat

SEQ ID NO: 4548 - DNA, 21 bp, Artificial sequence
  SiRNA target sequence
gtgatcgagtggaggcttatg

SEQ ID NO: 4549 - DNA, 21 bp, Artificial sequence
  SiRNA target sequence
tgatcgagtggaggcttatga

SEQ ID NO: 4550 - DNA, 21 bp, Artificial sequence
  SiRNA target sequence
gatcgagtggaggcttatgat

SEQ ID NO: 4551 - DNA, 21 bp, Artificial sequence
  SiRNA target sequence
atcgagtggaggcttatgata

SEQ ID NO: 4552 - DNA, 21 bp, Artificial sequence
  SiRNA target sequence
tcgagtggaggcttatgatag

SEQ ID NO: 4553 - DNA, 21 bp, Artificial sequence
  SiRNA target sequence
cgagtggaggcttatgataga

SEQ ID NO: 4554 - DNA, 21 bp, Artificial sequence
  SiRNA target sequence
gagtggaggcttatgatagac

SEQ ID NO: 4555 - DNA, 21 bp, Artificial sequence
  SiRNA target sequence
agtggaggcttatgatagacc

SEQ ID NO: 4556 - DNA, 21 bp, Artificial sequence
  SiRNA target sequence
gtggaggcttatgatagacct

SEQ ID NO: 4557 - DNA, 21 bp, Artificial sequence
  SiRNA target sequence
tggaggcttatgatagacctt

SEQ ID NO: 4558 - DNA, 21 bp, Artificial sequence
  SiRNA target sequence
ggaggcttatgatagacctta

SEQ ID NO: 4559 - DNA, 21 bp, Artificial sequence
  SiRNA target sequence
gaggcttatgatagaccttat

SEQ ID NO: 4560 - DNA, 21 bp, Artificial sequence
  SiRNA target sequence
aggcttatgatagaccttata

SEQ ID NO: 4561 - DNA, 21 bp, Artificial sequence
  SiRNA target sequence
ggcttatgatagaccttatac

SEQ ID NO: 4562 - DNA, 21 bp, Artificial sequence
  SiRNA target sequence
gcttatgatagaccttatacg

SEQ ID NO: 4563 - DNA, 21 bp, Artificial sequence
  SiRNA target sequence
cttatgatagaccttatacgc

SEQ ID NO: 4564 - DNA, 21 bp, Artificial sequence
  SiRNA target sequence
ttatgatagaccttatacgct

SEQ ID NO: 4565 - DNA, 21 bp, Artificial sequence
  SiRNA target sequence
tatgatagaccttatacgctg

SEQ ID NO: 4566 - DNA, 21 bp, Artificial sequence
  SiRNA target sequence
atgatagaccttatacgctga

SEQ ID NO: 4567 - DNA, 21 bp, Artificial sequence
  SiRNA target sequence
tgatagaccttatacgctgaa

SEQ ID NO: 4568 - DNA, 21 bp, Artificial sequence
  SiRNA target sequence
gatagaccttatacgctgaac

SEQ ID NO: 4569 - DNA, 21 bp, Artificial sequence
  SiRNA target sequence
atagaccttatacgctgaacg

SEQ ID NO: 4570 - DNA, 21 bp, Artificial sequence
  SiRNA target sequence
tagaccttatacgctgaacga

SEQ ID NO: 4571 - DNA, 21 bp, Artificial sequence
  SiRNA target sequence
agaccttatacgctgaacgat

SEQ ID NO: 4572 - DNA, 21 bp, Artificial sequence
  SiRNA target sequence
gaccttatacgctgaacgatt

SEQ ID NO: 4573 - DNA, 21 bp, Artificial sequence
  SiRNA target sequence
accttatacgctgaacgattc

SEQ ID NO: 4574 - DNA, 21 bp, Artificial sequence
  SiRNA target sequence
ccttatacgctgaacgattct

SEQ ID NO: 4575 - DNA, 21 bp, Artificial sequence
  SiRNA target sequence
cttatacgctgaacgattctc

SEQ ID NO: 4576 - DNA, 21 bp, Artificial sequence
  SiRNA target sequence
ttatacgctgaacgattctca

SEQ ID NO: 4577 - DNA, 21 bp, Artificial sequence
  SiRNA target sequence
tatacgctgaacgattctcaa

SEQ ID NO: 4578 - DNA, 21 bp, Artificial sequence
  SiRNA target sequence
atacgctgaacgattctcaaa

SEQ ID NO: 4579 - DNA, 21 bp, Artificial sequence
  SiRNA target sequence
tacgctgaacgattctcaaaa

SEQ ID NO: 4580 - DNA, 21 bp, Artificial sequence
  SiRNA target sequence
acgctgaacgattctcaaaaa

SEQ ID NO: 4581 - DNA, 21 bp, Artificial sequence
  SiRNA target sequence
cgctgaacgattctcaaaaag

SEQ ID NO: 4582 - DNA, 21 bp, Artificial sequence
  SiRNA target sequence
gctgaacgattctcaaaaagg

SEQ ID NO: 4583 - DNA, 21 bp, Artificial sequence
  SiRNA target sequence
ctgaacgattctcaaaaagga

SEQ ID NO: 4584 - DNA, 21 bp, Artificial sequence
  SiRNA target sequence
tgaacgattctcaaaaaggac

SEQ ID NO: 4585 - DNA, 21 bp, Artificial sequence
  SiRNA target sequence
gaacgattctcaaaaaggaca

SEQ ID NO: 4586 - DNA, 21 bp, Artificial sequence
  SiRNA target sequence
aacgattctcaaaaaggacaa

SEQ ID NO: 4587 - DNA, 21 bp, Artificial sequence
  SiRNA target sequence
acgattctcaaaaaggacaat

SEQ ID NO: 4588 - DNA, 21 bp, Artificial sequence
  SiRNA target sequence
cgattctcaaaaaggacaata

SEQ ID NO: 4589 - DNA, 21 bp, Artificial sequence
  SiRNA target sequence
gattctcaaaaaggacaatat

SEQ ID NO: 4590 - DNA, 21 bp, Artificial sequence
  SiRNA target sequence
attctcaaaaaggacaatata

SEQ ID NO: 4591 - DNA, 21 bp, Artificial sequence
  SiRNA target sequence
ttctcaaaaaggacaatatat

SEQ ID NO: 4592 - DNA, 21 bp, Artificial sequence
  SiRNA target sequence
tctcaaaaaggacaatatatt

SEQ ID NO: 4593 - DNA, 21 bp, Artificial sequence
  SiRNA target sequence
ctcaaaaaggacaatatattc

SEQ ID NO: 4594 - DNA, 21 bp, Artificial sequence
  SiRNA target sequence
tcaaaaaggacaatatattct

SEQ ID NO: 4595 - DNA, 21 bp, Artificial sequence
  SiRNA target sequence
caaaaaggacaatatattcta

SEQ ID NO: 4596 - DNA, 21 bp, Artificial sequence
  SiRNA target sequence
aaaaaggacaatatattctac

SEQ ID NO: 4597 - DNA, 21 bp, Artificial sequence
  SiRNA target sequence
aaaaggacaatatattctacg

SEQ ID NO: 4598 - DNA, 21 bp, Artificial sequence
  SiRNA target sequence
aaaggacaatatattctacgt

SEQ ID NO: 4599 - DNA, 21 bp, Artificial sequence
  SiRNA target sequence
aaggacaatatattctacgtc

SEQ ID NO: 4600 - DNA, 21 bp, Artificial sequence
  SiRNA target sequence
aggacaatatattctacgtca

SEQ ID NO: 4601 - DNA, 21 bp, Artificial sequence
  SiRNA target sequence
ggacaatatattctacgtcaa

SEQ ID NO: 4602 - DNA, 21 bp, Artificial sequence
  SiRNA target sequence
gacaatatattctacgtcaag

SEQ ID NO: 4603 - DNA, 21 bp, Artificial sequence
  SiRNA target sequence
acaatatattctacgtcaagg

SEQ ID NO: 4604 - DNA, 21 bp, Artificial sequence
  SiRNA target sequence
caatatattctacgtcaaggc

SEQ ID NO: 4605 - DNA, 21 bp, Artificial sequence
  SiRNA target sequence
aatatattctacgtcaaggct

SEQ ID NO: 4606 - DNA, 21 bp, Artificial sequence
  SiRNA target sequence
atatattctacgtcaaggctt

SEQ ID NO: 4607 - DNA, 21 bp, Artificial sequence
  SiRNA target sequence
tatattctacgtcaaggctta

SEQ ID NO: 4608 - DNA, 21 bp, Artificial sequence
  SiRNA target sequence
atattctacgtcaaggcttag

SEQ ID NO: 4609 - DNA, 21 bp, Artificial sequence
  SiRNA target sequence
tattctacgtcaaggcttaga

SEQ ID NO: 4610 - DNA, 21 bp, Artificial sequence
  SiRNA target sequence
attctacgtcaaggcttagaa

SEQ ID NO: 4611 - DNA, 21 bp, Artificial sequence
  SiRNA target sequence
ttctacgtcaaggcttagaat

SEQ ID NO: 4612 - DNA, 21 bp, Artificial sequence
  SiRNA target sequence
tctacgtcaaggcttagaata

SEQ ID NO: 4613 - DNA, 21 bp, Artificial sequence
  SiRNA target sequence
ctacgtcaaggcttagaatat

SEQ ID NO: 4614 - DNA, 21 bp, Artificial sequence
  SiRNA target sequence
tacgtcaaggcttagaatata

SEQ ID NO: 4615 - DNA, 21 bp, Artificial sequence
  SiRNA target sequence
acgtcaaggcttagaatatat

SEQ ID NO: 4616 - DNA, 21 bp, Artificial sequence
  SiRNA target sequence
cgtcaaggcttagaatatatg

SEQ ID NO: 4617 - DNA, 21 bp, Artificial sequence
  SiRNA target sequence
gtcaaggcttagaatatatga

SEQ ID NO: 4618 - DNA, 21 bp, Artificial sequence
  SiRNA target sequence
tcaaggcttagaatatatgat

SEQ ID NO: 4619 - DNA, 21 bp, Artificial sequence
  SiRNA target sequence
caaggcttagaatatatgatg

SEQ ID NO: 4620 - DNA, 21 bp, Artificial sequence
  SiRNA target sequence
aaggcttagaatatatgatgc

SEQ ID NO: 4621 - DNA, 21 bp, Artificial sequence
  SiRNA target sequence
aggcttagaatatatgatgcc

SEQ ID NO: 4622 - DNA, 21 bp, Artificial sequence
  SiRNA target sequence
ggcttagaatatatgatgccc

SEQ ID NO: 4623 - DNA, 21 bp, Artificial sequence
  SiRNA target sequence
gcttagaatatatgatgccca

SEQ ID NO: 4624 - DNA, 21 bp, Artificial sequence
  SiRNA target sequence
cttagaatatatgatgcccac

SEQ ID NO: 4625 - DNA, 21 bp, Artificial sequence
  SiRNA target sequence
ttagaatatatgatgcccacg

SEQ ID NO: 4626 - DNA, 21 bp, Artificial sequence
  SiRNA target sequence
tagaatatatgatgcccacga

SEQ ID NO: 4627 - DNA, 21 bp, Artificial sequence
  SiRNA target sequence
agaatatatgatgcccacgac

SEQ ID NO: 4628 - DNA, 21 bp, Artificial sequence
  SiRNA target sequence
gaatatatgatgcccacgact

SEQ ID NO: 4629 - DNA, 21 bp, Artificial sequence
  SiRNA target sequence
aatatatgatgcccacgacta

SEQ ID NO: 4630 - DNA, 21 bp, Artificial sequence
  SiRNA target sequence
atatatgatgcccacgactaa

SEQ ID NO: 4631 - DNA, 21 bp, Artificial sequence
  SiRNA target sequence
tatatgatgcccacgactaat

SEQ ID NO: 4632 - DNA, 21 bp, Artificial sequence
  SiRNA target sequence
atatgatgcccacgactaatg

SEQ ID NO: 4633 - DNA, 21 bp, Artificial sequence
  SiRNA target sequence
tatgatgcccacgactaatgg

SEQ ID NO: 4634 - DNA, 21 bp, Artificial sequence
  SiRNA target sequence
atgatgcccacgactaatggt

SEQ ID NO: 4635 - DNA, 21 bp, Artificial sequence
  SiRNA target sequence
tgatgcccacgactaatggtg

SEQ ID NO: 4636 - DNA, 21 bp, Artificial sequence
  SiRNA target sequence
gatgcccacgactaatggtga

SEQ ID NO: 4637 - DNA, 21 bp, Artificial sequence
  SiRNA target sequence
atgcccacgactaatggtgat

SEQ ID NO: 4638 - DNA, 21 bp, Artificial sequence
  SiRNA target sequence
tgcccacgactaatggtgatt

SEQ ID NO: 4639 - DNA, 21 bp, Artificial sequence
  SiRNA target sequence
gcccacgactaatggtgattg

SEQ ID NO: 4640 - DNA, 21 bp, Artificial sequence
  SiRNA target sequence
cccacgactaatggtgattgt

SEQ ID NO: 4641 - DNA, 21 bp, Artificial sequence
  SiRNA target sequence
ccacgactaatggtgattgtg

SEQ ID NO: 4642 - DNA, 21 bp, Artificial sequence
  SiRNA target sequence
cacgactaatggtgattgtgg

SEQ ID NO: 4643 - DNA, 21 bp, Artificial sequence
  SiRNA target sequence
acgactaatggtgattgtggc

SEQ ID NO: 4644 - DNA, 21 bp, Artificial sequence
  SiRNA target sequence
cgactaatggtgattgtggct

SEQ ID NO: 4645 - DNA, 21 bp, Artificial sequence
  SiRNA target sequence
gactaatggtgattgtggctc

SEQ ID NO: 4646 - DNA, 21 bp, Artificial sequence
  SiRNA target sequence
actaatggtgattgtggctcg

SEQ ID NO: 4647 - DNA, 21 bp, Artificial sequence
  SiRNA target sequence
ctaatggtgattgtggctcgc

SEQ ID NO: 4648 - DNA, 21 bp, Artificial sequence
  SiRNA target sequence
taatggtgattgtggctcgcc

SEQ ID NO: 4649 - DNA, 21 bp, Artificial sequence
  SiRNA target sequence
aatggtgattgtggctcgccg

SEQ ID NO: 4650 - DNA, 21 bp, Artificial sequence
  SiRNA target sequence
atggtgattgtggctcgccgc

SEQ ID NO: 4651 - DNA, 21 bp, Artificial sequence
  SiRNA target sequence
tggtgattgtggctcgccgct

SEQ ID NO: 4652 - DNA, 21 bp, Artificial sequence
  SiRNA target sequence
ggtgattgtggctcgccgctc

SEQ ID NO: 4653 - DNA, 21 bp, Artificial sequence
  SiRNA target sequence
gtgattgtggctcgccgctca

SEQ ID NO: 4654 - DNA, 21 bp, Artificial sequence
  SiRNA target sequence
tgattgtggctcgccgctcat

SEQ ID NO: 4655 - DNA, 21 bp, Artificial sequence
  SiRNA target sequence
gattgtggctcgccgctcatc

SEQ ID NO: 4656 - DNA, 21 bp, Artificial sequence
  SiRNA target sequence
attgtggctcgccgctcatca

SEQ ID NO: 4657 - DNA, 21 bp, Artificial sequence
  SiRNA target sequence
ttgtggctcgccgctcatcat

SEQ ID NO: 4658 - DNA, 21 bp, Artificial sequence
  SiRNA target sequence
tgtggctcgccgctcatcatt

SEQ ID NO: 4659 - DNA, 21 bp, Artificial sequence
  SiRNA target sequence
gtggctcgccgctcatcatta

SEQ ID NO: 4660 - DNA, 21 bp, Artificial sequence
  SiRNA target sequence
tggctcgccgctcatcattaa

SEQ ID NO: 4661 - DNA, 21 bp, Artificial sequence
  SiRNA target sequence
ggctcgccgctcatcattaat

SEQ ID NO: 4662 - DNA, 21 bp, Artificial sequence
  SiRNA target sequence
gctcgccgctcatcattaatg

SEQ ID NO: 4663 - DNA, 21 bp, Artificial sequence
  SiRNA target sequence
ctcgccgctcatcattaatga

SEQ ID NO: 4664 - DNA, 21 bp, Artificial sequence
  SiRNA target sequence
tcgccgctcatcattaatgaa

SEQ ID NO: 4665 - DNA, 21 bp, Artificial sequence
  SiRNA target sequence
cgccgctcatcattaatgaaa

SEQ ID NO: 4666 - DNA, 21 bp, Artificial sequence
  SiRNA target sequence
gccgctcatcattaatgaaac

SEQ ID NO: 4667 - DNA, 21 bp, Artificial sequence
  SiRNA target sequence
ccgctcatcattaatgaaacc

SEQ ID NO: 4668 - DNA, 21 bp, Artificial sequence
  SiRNA target sequence
cgctcatcattaatgaaaccc

SEQ ID NO: 4669 - DNA, 21 bp, Artificial sequence
  SiRNA target sequence
gctcatcattaatgaaaccca

SEQ ID NO: 4670 - DNA, 21 bp, Artificial sequence
  SiRNA target sequence
ctcatcattaatgaaacccaa

SEQ ID NO: 4671 - DNA, 21 bp, Artificial sequence
  SiRNA target sequence
tcatcattaatgaaacccaag

SEQ ID NO: 4672 - DNA, 21 bp, Artificial sequence
  SiRNA target sequence
catcattaatgaaacccaagt

SEQ ID NO: 4673 - DNA, 21 bp, Artificial sequence
  SiRNA target sequence
atcattaatgaaacccaagtt

SEQ ID NO: 4674 - DNA, 21 bp, Artificial sequence
  SiRNA target sequence
tcattaatgaaacccaagttt

SEQ ID NO: 4675 - DNA, 21 bp, Artificial sequence
  SiRNA target sequence
cattaatgaaacccaagtttt

SEQ ID NO: 4676 - DNA, 21 bp, Artificial sequence
  SiRNA target sequence
attaatgaaacccaagttttg

SEQ ID NO: 4677 - DNA, 21 bp, Artificial sequence
  SiRNA target sequence
ttaatgaaacccaagttttga

SEQ ID NO: 4678 - DNA, 21 bp, Artificial sequence
  SiRNA target sequence
taatgaaacccaagttttgag

SEQ ID NO: 4679 - DNA, 21 bp, Artificial sequence
  SiRNA target sequence
aatgaaacccaagttttgagg

SEQ ID NO: 4680 - DNA, 21 bp, Artificial sequence
  SiRNA target sequence
atgaaacccaagttttgagga

SEQ ID NO: 4681 - DNA, 21 bp, Artificial sequence
  SiRNA target sequence
tgaaacccaagttttgaggaa

SEQ ID NO: 4682 - DNA, 21 bp, Artificial sequence
  SiRNA target sequence
gaaacccaagttttgaggaaa

SEQ ID NO: 4683 - DNA, 21 bp, Artificial sequence
  SiRNA target sequence
aaacccaagttttgaggaaaa

SEQ ID NO: 4684 - DNA, 21 bp, Artificial sequence
  SiRNA target sequence
aacccaagttttgaggaaaat

SEQ ID NO: 4685 - DNA, 21 bp, Artificial sequence
  SiRNA target sequence
acccaagttttgaggaaaatt

SEQ ID NO: 4686 - DNA, 21 bp, Artificial sequence
  SiRNA target sequence
cccaagttttgaggaaaattg

SEQ ID NO: 4687 - DNA, 21 bp, Artificial sequence
  SiRNA target sequence
ccaagttttgaggaaaattgc

SEQ ID NO: 4688 - DNA, 21 bp, Artificial sequence
  SiRNA target sequence
caagttttgaggaaaattgct

SEQ ID NO: 4689 - DNA, 21 bp, Artificial sequence
  SiRNA target sequence
aagttttgaggaaaattgctg

SEQ ID NO: 4690 - DNA, 21 bp, Artificial sequence
  SiRNA target sequence
agttttgaggaaaattgctgg

SEQ ID NO: 4691 - DNA, 21 bp, Artificial sequence
  SiRNA target sequence
gttttgaggaaaattgctggt

SEQ ID NO: 4692 - DNA, 21 bp, Artificial sequence
  SiRNA target sequence
ttttgaggaaaattgctggta

SEQ ID NO: 4693 - DNA, 21 bp, Artificial sequence
  SiRNA target sequence
tttgaggaaaattgctggtat

SEQ ID NO: 4694 - DNA, 21 bp, Artificial sequence
  SiRNA target sequence
ttgaggaaaattgctggtatt

SEQ ID NO: 4695 - DNA, 21 bp, Artificial sequence
  SiRNA target sequence
tgaggaaaattgctggtattc

SEQ ID NO: 4696 - DNA, 21 bp, Artificial sequence
  SiRNA target sequence
gaggaaaattgctggtattca

SEQ ID NO: 4697 - DNA, 21 bp, Artificial sequence
  SiRNA target sequence
aggaaaattgctggtattcat

SEQ ID NO: 4698 - DNA, 21 bp, Artificial sequence
  SiRNA target sequence
ggaaaattgctggtattcatg

SEQ ID NO: 4699 - DNA, 21 bp, Artificial sequence
  SiRNA target sequence
gaaaattgctggtattcatgt

SEQ ID NO: 4700 - DNA, 21 bp, Artificial sequence
  SiRNA target sequence
aaaattgctggtattcatgta

SEQ ID NO: 4701 - DNA, 21 bp, Artificial sequence
  SiRNA target sequence
aaattgctggtattcatgtag

SEQ ID NO: 4702 - DNA, 21 bp, Artificial sequence
  SiRNA target sequence
aattgctggtattcatgtagc

SEQ ID NO: 4703 - DNA, 21 bp, Artificial sequence
  SiRNA target sequence
attgctggtattcatgtagct

SEQ ID NO: 4704 - DNA, 21 bp, Artificial sequence
  SiRNA target sequence
ttgctggtattcatgtagctg

SEQ ID NO: 4705 - DNA, 21 bp, Artificial sequence
  SiRNA target sequence
tgctggtattcatgtagctgg

SEQ ID NO: 4706 - DNA, 21 bp, Artificial sequence
  SiRNA target sequence
gctggtattcatgtagctgga

SEQ ID NO: 4707 - DNA, 21 bp, Artificial sequence
  SiRNA target sequence
ctggtattcatgtagctggag

SEQ ID NO: 4708 - DNA, 21 bp, Artificial sequence
  SiRNA target sequence
tggtattcatgtagctggagc

SEQ ID NO: 4709 - DNA, 21 bp, Artificial sequence
  SiRNA target sequence
ggtattcatgtagctggagct

SEQ ID NO: 4710 - DNA, 21 bp, Artificial sequence
  SiRNA target sequence
gtattcatgtagctggagcta

SEQ ID NO: 4711 - DNA, 21 bp, Artificial sequence
  SiRNA target sequence
tattcatgtagctggagctac

SEQ ID NO: 4712 - DNA, 21 bp, Artificial sequence
  SiRNA target sequence
attcatgtagctggagctaca

SEQ ID NO: 4713 - DNA, 21 bp, Artificial sequence
  SiRNA target sequence
ttcatgtagctggagctacaa

SEQ ID NO: 4714 - DNA, 21 bp, Artificial sequence
  SiRNA target sequence
tcatgtagctggagctacaac

SEQ ID NO: 4715 - DNA, 21 bp, Artificial sequence
  SiRNA target sequence
catgtagctggagctacaact

SEQ ID NO: 4716 - DNA, 21 bp, Artificial sequence
  SiRNA target sequence
atgtagctggagctacaactg

SEQ ID NO: 4717 - DNA, 21 bp, Artificial sequence
  SiRNA target sequence
tgtagctggagctacaactgg

SEQ ID NO: 4718 - DNA, 21 bp, Artificial sequence
  SiRNA target sequence
gtagctggagctacaactggc

SEQ ID NO: 4719 - DNA, 21 bp, Artificial sequence
  SiRNA target sequence
tagctggagctacaactggca

SEQ ID NO: 4720 - DNA, 21 bp, Artificial sequence
  SiRNA target sequence
agctggagctacaactggcaa

SEQ ID NO: 4721 - DNA, 21 bp, Artificial sequence
  SiRNA target sequence
gctggagctacaactggcaaa

SEQ ID NO: 4722 - DNA, 21 bp, Artificial sequence
  SiRNA target sequence
ctggagctacaactggcaaag

SEQ ID NO: 4723 - DNA, 21 bp, Artificial sequence
  SiRNA target sequence
tggagctacaactggcaaagc

SEQ ID NO: 4724 - DNA, 21 bp, Artificial sequence
  SiRNA target sequence
ggagctacaactggcaaagcc

SEQ ID NO: 4725 - DNA, 21 bp, Artificial sequence
  SiRNA target sequence
gagctacaactggcaaagcct

SEQ ID NO: 4726 - DNA, 21 bp, Artificial sequence
  SiRNA target sequence
agctacaactggcaaagccta

SEQ ID NO: 4727 - DNA, 21 bp, Artificial sequence
  SiRNA target sequence
gctacaactggcaaagcctat

SEQ ID NO: 4728 - DNA, 21 bp, Artificial sequence
  SiRNA target sequence
ctacaactggcaaagcctatg

SEQ ID NO: 4729 - DNA, 21 bp, Artificial sequence
  SiRNA target sequence
tacaactggcaaagcctatgc

SEQ ID NO: 4730 - DNA, 21 bp, Artificial sequence
  SiRNA target sequence
acaactggcaaagcctatgct

SEQ ID NO: 4731 - DNA, 21 bp, Artificial sequence
  SiRNA target sequence
caactggcaaagcctatgctg

SEQ ID NO: 4732 - DNA, 21 bp, Artificial sequence
  SiRNA target sequence
aactggcaaagcctatgctga

SEQ ID NO: 4733 - DNA, 21 bp, Artificial sequence
  SiRNA target sequence
actggcaaagcctatgctgag

SEQ ID NO: 4734 - DNA, 21 bp, Artificial sequence
  SiRNA target sequence
ctggcaaagcctatgctgagt

SEQ ID NO: 4735 - DNA, 21 bp, Artificial sequence
  SiRNA target sequence
tggcaaagcctatgctgagtc

SEQ ID NO: 4736 - DNA, 21 bp, Artificial sequence
  SiRNA target sequence
ggcaaagcctatgctgagtct

SEQ ID NO: 4737 - DNA, 21 bp, Artificial sequence
  SiRNA target sequence
gcaaagcctatgctgagtcta

SEQ ID NO: 4738 - DNA, 21 bp, Artificial sequence
  SiRNA target sequence
caaagcctatgctgagtctat

SEQ ID NO: 4739 - DNA, 21 bp, Artificial sequence
  SiRNA target sequence
aaagcctatgctgagtctata

SEQ ID NO: 4740 - DNA, 21 bp, Artificial sequence
  SiRNA target sequence
aagcctatgctgagtctataa

SEQ ID NO: 4741 - DNA, 21 bp, Artificial sequence
  SiRNA target sequence
agcctatgctgagtctataac

SEQ ID NO: 4742 - DNA, 21 bp, Artificial sequence
  SiRNA target sequence
gcctatgctgagtctataacc

SEQ ID NO: 4743 - DNA, 21 bp, Artificial sequence
  SiRNA target sequence
cctatgctgagtctataaccc

SEQ ID NO: 4744 - DNA, 21 bp, Artificial sequence
  SiRNA target sequence
ctatgctgagtctataaccca

SEQ ID NO: 4745 - DNA, 21 bp, Artificial sequence
  SiRNA target sequence
tatgctgagtctataacccaa

SEQ ID NO: 4746 - DNA, 21 bp, Artificial sequence
  SiRNA target sequence
atgctgagtctataacccaaa

SEQ ID NO: 4747 - DNA, 21 bp, Artificial sequence
  SiRNA target sequence
tgctgagtctataacccaaaa

SEQ ID NO: 4748 - DNA, 21 bp, Artificial sequence
  SiRNA target sequence
gctgagtctataacccaaaaa

SEQ ID NO: 4749 - DNA, 21 bp, Artificial sequence
  SiRNA target sequence
ctgagtctataacccaaaaag

SEQ ID NO: 4750 - DNA, 21 bp, Artificial sequence
  SiRNA target sequence
tgagtctataacccaaaaaga

SEQ ID NO: 4751 - DNA, 21 bp, Artificial sequence
  SiRNA target sequence
gagtctataacccaaaaagat

SEQ ID NO: 4752 - DNA, 21 bp, Artificial sequence
  SiRNA target sequence
agtctataacccaaaaagatc

SEQ ID NO: 4753 - DNA, 21 bp, Artificial sequence
  SiRNA target sequence
gtctataacccaaaaagatct

SEQ ID NO: 4754 - DNA, 21 bp, Artificial sequence
  SiRNA target sequence
tctataacccaaaaagatctt

SEQ ID NO: 4755 - DNA, 21 bp, Artificial sequence
  SiRNA target sequence
ctataacccaaaaagatcttg

SEQ ID NO: 4756 - DNA, 21 bp, Artificial sequence
  SiRNA target sequence
tataacccaaaaagatcttga

SEQ ID NO: 4757 - DNA, 21 bp, Artificial sequence
  SiRNA target sequence
ataacccaaaaagatcttgag

SEQ ID NO: 4758 - DNA, 21 bp, Artificial sequence
  SiRNA target sequence
taacccaaaaagatcttgagc

SEQ ID NO: 4759 - DNA, 21 bp, Artificial sequence
  SiRNA target sequence
aacccaaaaagatcttgagcg

SEQ ID NO: 4760 - DNA, 21 bp, Artificial sequence
  SiRNA target sequence
acccaaaaagatcttgagcga

SEQ ID NO: 4761 - DNA, 21 bp, Artificial sequence
  SiRNA target sequence
cccaaaaagatcttgagcgag

SEQ ID NO: 4762 - DNA, 21 bp, Artificial sequence
  SiRNA target sequence
ccaaaaagatcttgagcgagc

SEQ ID NO: 4763 - DNA, 21 bp, Artificial sequence
  SiRNA target sequence
caaaaagatcttgagcgagca

SEQ ID NO: 4764 - DNA, 21 bp, Artificial sequence
  SiRNA target sequence
aaaaagatcttgagcgagcat

SEQ ID NO: 4765 - DNA, 21 bp, Artificial sequence
  SiRNA target sequence
aaaagatcttgagcgagcatt

SEQ ID NO: 4766 - DNA, 21 bp, Artificial sequence
  SiRNA target sequence
aaagatcttgagcgagcattt

SEQ ID NO: 4767 - DNA, 21 bp, Artificial sequence
  SiRNA target sequence
aagatcttgagcgagcattta

SEQ ID NO: 4768 - DNA, 21 bp, Artificial sequence
  SiRNA target sequence
agatcttgagcgagcatttat

SEQ ID NO: 4769 - DNA, 21 bp, Artificial sequence
  SiRNA target sequence
gatcttgagcgagcatttatt

SEQ ID NO: 4770 - DNA, 21 bp, Artificial sequence
  SiRNA target sequence
atcttgagcgagcatttatta

SEQ ID NO: 4771 - DNA, 21 bp, Artificial sequence
  SiRNA target sequence
tcttgagcgagcatttattaa

SEQ ID NO: 4772 - DNA, 21 bp, Artificial sequence
  SiRNA target sequence
cttgagcgagcatttattaaa

SEQ ID NO: 4773 - DNA, 21 bp, Artificial sequence
  SiRNA target sequence
ttgagcgagcatttattaaaa

SEQ ID NO: 4774 - DNA, 21 bp, Artificial sequence
  SiRNA target sequence
tgagcgagcatttattaaaat

SEQ ID NO: 4775 - DNA, 21 bp, Artificial sequence
  SiRNA target sequence
gagcgagcatttattaaaata

SEQ ID NO: 4776 - DNA, 21 bp, Artificial sequence
  SiRNA target sequence
agcgagcatttattaaaatag

SEQ ID NO: 4777 - DNA, 21 bp, Artificial sequence
  SiRNA target sequence
gcgagcatttattaaaataga

SEQ ID NO: 4778 - DNA, 21 bp, Artificial sequence
  SiRNA target sequence
cgagcatttattaaaatagat

SEQ ID NO: 4779 - DNA, 21 bp, Artificial sequence
  SiRNA target sequence
gagcatttattaaaatagatg

SEQ ID NO: 4780 - DNA, 21 bp, Artificial sequence
  SiRNA target sequence
agcatttattaaaatagatgt

SEQ ID NO: 4781 - DNA, 21 bp, Artificial sequence
  SiRNA target sequence
gcatttattaaaatagatgta

SEQ ID NO: 4782 - DNA, 21 bp, Artificial sequence
  SiRNA target sequence
catttattaaaatagatgtaa

SEQ ID NO: 4783 - DNA, 21 bp, Artificial sequence
  SiRNA target sequence
atttattaaaatagatgtaag

SEQ ID NO: 4784 - DNA, 21 bp, Artificial sequence
  SiRNA target sequence
tttattaaaatagatgtaagc

SEQ ID NO: 4785 - DNA, 21 bp, Artificial sequence
  SiRNA target sequence
ttattaaaatagatgtaagca

SEQ ID NO: 4786 - DNA, 21 bp, Artificial sequence
  SiRNA target sequence
tattaaaatagatgtaagcat

SEQ ID NO: 4787 - DNA, 21 bp, Artificial sequence
  SiRNA target sequence
attaaaatagatgtaagcatg

SEQ ID NO: 4788 - DNA, 21 bp, Artificial sequence
  SiRNA target sequence
ttaaaatagatgtaagcatgc

SEQ ID NO: 4789 - DNA, 21 bp, Artificial sequence
  SiRNA target sequence
taaaatagatgtaagcatgca

SEQ ID NO: 4790 - DNA, 21 bp, Artificial sequence
  SiRNA target sequence
aaaatagatgtaagcatgcag

SEQ ID NO: 4791 - DNA, 21 bp, Artificial sequence
  SiRNA target sequence
aaatagatgtaagcatgcaga

SEQ ID NO: 4792 - DNA, 21 bp, Artificial sequence
  SiRNA target sequence
aatagatgtaagcatgcagat

SEQ ID NO: 4793 - DNA, 21 bp, Artificial sequence
  SiRNA target sequence
atagatgtaagcatgcagatc

SEQ ID NO: 4794 - DNA, 21 bp, Artificial sequence
  SiRNA target sequence
tagatgtaagcatgcagatcc

SEQ ID NO: 4795 - DNA, 21 bp, Artificial sequence
  SiRNA target sequence
agatgtaagcatgcagatcca

SEQ ID NO: 4796 - DNA, 21 bp, Artificial sequence
  SiRNA target sequence
gatgtaagcatgcagatccaa

SEQ ID NO: 4797 - DNA, 21 bp, Artificial sequence
  SiRNA target sequence
atgtaagcatgcagatccaat

SEQ ID NO: 4798 - DNA, 21 bp, Artificial sequence
  SiRNA target sequence
tgtaagcatgcagatccaatt

SEQ ID NO: 4799 - DNA, 21 bp, Artificial sequence
  SiRNA target sequence
gtaagcatgcagatccaattg

SEQ ID NO: 4800 - DNA, 21 bp, Artificial sequence
  SiRNA target sequence
taagcatgcagatccaattgg

SEQ ID NO: 4801 - DNA, 21 bp, Artificial sequence
  SiRNA target sequence
aagcatgcagatccaattgga

SEQ ID NO: 4802 - DNA, 21 bp, Artificial sequence
  SiRNA target sequence
agcatgcagatccaattggat

SEQ ID NO: 4803 - DNA, 21 bp, Artificial sequence
  SiRNA target sequence
gcatgcagatccaattggatt

SEQ ID NO: 4804 - DNA, 21 bp, Artificial sequence
  SiRNA target sequence
catgcagatccaattggattt

SEQ ID NO: 4805 - DNA, 21 bp, Artificial sequence
  SiRNA target sequence
atgcagatccaattggatttg

SEQ ID NO: 4806 - DNA, 21 bp, Artificial sequence
  SiRNA target sequence
tgcagatccaattggatttgg

SEQ ID NO: 4807 - DNA, 21 bp, Artificial sequence
  SiRNA target sequence
gcagatccaattggatttgga

SEQ ID NO: 4808 - DNA, 21 bp, Artificial sequence
  SiRNA target sequence
cagatccaattggatttggat

SEQ ID NO: 4809 - DNA, 21 bp, Artificial sequence
  SiRNA target sequence
agatccaattggatttggatt

SEQ ID NO: 4810 - DNA, 21 bp, Artificial sequence
  SiRNA target sequence
gatccaattggatttggattc

SEQ ID NO: 4811 - DNA, 21 bp, Artificial sequence
  SiRNA target sequence
atccaattggatttggattca

SEQ ID NO: 4812 - DNA, 21 bp, Artificial sequence
  SiRNA target sequence
tccaattggatttggattcaa

SEQ ID NO: 4813 - DNA, 21 bp, Artificial sequence
  SiRNA target sequence
ccaattggatttggattcaac

SEQ ID NO: 4814 - DNA, 21 bp, Artificial sequence
  SiRNA target sequence
caattggatttggattcaaca

SEQ ID NO: 4815 - DNA, 21 bp, Artificial sequence
  SiRNA target sequence
aattggatttggattcaacat

SEQ ID NO: 4816 - DNA, 21 bp, Artificial sequence
  SiRNA target sequence
attggatttggattcaacatt

SEQ ID NO: 4817 - DNA, 21 bp, Artificial sequence
  SiRNA target sequence
ttggatttggattcaacattg

SEQ ID NO: 4818 - DNA, 21 bp, Artificial sequence
  SiRNA target sequence
tggatttggattcaacattgg

SEQ ID NO: 4819 - DNA, 21 bp, Artificial sequence
  SiRNA target sequence
ggatttggattcaacattgga

SEQ ID NO: 4820 - DNA, 21 bp, Artificial sequence
  SiRNA target sequence
gatttggattcaacattggat

SEQ ID NO: 4821 - DNA, 21 bp, Artificial sequence
  SiRNA target sequence
atttggattcaacattggatt

SEQ ID NO: 4822 - DNA, 21 bp, Artificial sequence
  SiRNA target sequence
tttggattcaacattggattt

SEQ ID NO: 4823 - DNA, 21 bp, Artificial sequence
  SiRNA target sequence
ttggattcaacattggatttc

SEQ ID NO: 4824 - DNA, 21 bp, Artificial sequence
  SiRNA target sequence
tggattcaacattggatttct

SEQ ID NO: 4825 - DNA, 21 bp, Artificial sequence
  SiRNA target sequence
ggattcaacattggatttctc

SEQ ID NO: 4826 - DNA, 21 bp, Artificial sequence
  SiRNA target sequence
gattcaacattggatttctca

SEQ ID NO: 4827 - DNA, 21 bp, Artificial sequence
  SiRNA target sequence
attcaacattggatttctcaa

SEQ ID NO: 4828 - DNA, 21 bp, Artificial sequence
  SiRNA target sequence
ttcaacattggatttctcaaa

SEQ ID NO: 4829 - DNA, 21 bp, Artificial sequence
  SiRNA target sequence
tcaacattggatttctcaaaa

SEQ ID NO: 4830 - DNA, 21 bp, Artificial sequence
  SiRNA target sequence
caacattggatttctcaaaac

SEQ ID NO: 4831 - DNA, 21 bp, Artificial sequence
  SiRNA target sequence
aacattggatttctcaaaacc

SEQ ID NO: 4832 - DNA, 21 bp, Artificial sequence
  SiRNA target sequence
acattggatttctcaaaaccc

SEQ ID NO: 4833 - DNA, 21 bp, Artificial sequence
  SiRNA target sequence
cattggatttctcaaaacccg

SEQ ID NO: 4834 - DNA, 21 bp, Artificial sequence
  SiRNA target sequence
attggatttctcaaaacccga

SEQ ID NO: 4835 - DNA, 21 bp, Artificial sequence
  SiRNA target sequence
ttggatttctcaaaacccgaa

SEQ ID NO: 4836 - DNA, 21 bp, Artificial sequence
  SiRNA target sequence
tggatttctcaaaacccgaac

SEQ ID NO: 4837 - DNA, 21 bp, Artificial sequence
  SiRNA target sequence
ggatttctcaaaacccgaacc

SEQ ID NO: 4838 - DNA, 21 bp, Artificial sequence
  SiRNA target sequence
gatttctcaaaacccgaaccc

SEQ ID NO: 4839 - DNA, 21 bp, Artificial sequence
  SiRNA target sequence
atttctcaaaacccgaaccca

SEQ ID NO: 4840 - DNA, 21 bp, Artificial sequence
  SiRNA target sequence
tttctcaaaacccgaacccaa

SEQ ID NO: 4841 - DNA, 21 bp, Artificial sequence
  SiRNA target sequence
ttctcaaaacccgaacccaaa

SEQ ID NO: 4842 - DNA, 21 bp, Artificial sequence
  SiRNA target sequence
tctcaaaacccgaacccaaat

SEQ ID NO: 4843 - DNA, 21 bp, Artificial sequence
  SiRNA target sequence
ctcaaaacccgaacccaaatt

SEQ ID NO: 4844 - DNA, 21 bp, Artificial sequence
  SiRNA target sequence
tcaaaacccgaacccaaattg

SEQ ID NO: 4845 - DNA, 21 bp, Artificial sequence
  SiRNA target sequence
caaaacccgaacccaaattgc

SEQ ID NO: 4846 - DNA, 21 bp, Artificial sequence
  SiRNA target sequence
aaaacccgaacccaaattgcc

SEQ ID NO: 4847 - DNA, 21 bp, Artificial sequence
  SiRNA target sequence
aaacccgaacccaaattgcct

SEQ ID NO: 4848 - DNA, 21 bp, Artificial sequence
  SiRNA target sequence
aacccgaacccaaattgcctt

SEQ ID NO: 4849 - DNA, 21 bp, Artificial sequence
  SiRNA target sequence
acccgaacccaaattgccttc

SEQ ID NO: 4850 - DNA, 21 bp, Artificial sequence
  SiRNA target sequence
cccgaacccaaattgccttct

SEQ ID NO: 4851 - DNA, 21 bp, Artificial sequence
  SiRNA target sequence
ccgaacccaaattgccttctg

SEQ ID NO: 4852 - DNA, 21 bp, Artificial sequence
  SiRNA target sequence
cgaacccaaattgccttctgg

SEQ ID NO: 4853 - DNA, 21 bp, Artificial sequence
  SiRNA target sequence
gaacccaaattgccttctggt

SEQ ID NO: 4854 - DNA, 21 bp, Artificial sequence
  SiRNA target sequence
aacccaaattgccttctggta

SEQ ID NO: 4855 - DNA, 21 bp, Artificial sequence
  SiRNA target sequence
acccaaattgccttctggtac

SEQ ID NO: 4856 - DNA, 21 bp, Artificial sequence
  SiRNA target sequence
cccaaattgccttctggtact

SEQ ID NO: 4857 - DNA, 21 bp, Artificial sequence
  SiRNA target sequence
ccaaattgccttctggtactg

SEQ ID NO: 4858 - DNA, 21 bp, Artificial sequence
  SiRNA target sequence
caaattgccttctggtactga

SEQ ID NO: 4859 - DNA, 21 bp, Artificial sequence
  SiRNA target sequence
aaattgccttctggtactgaa

SEQ ID NO: 4860 - DNA, 21 bp, Artificial sequence
  SiRNA target sequence
aattgccttctggtactgaat

SEQ ID NO: 4861 - DNA, 21 bp, Artificial sequence
  SiRNA target sequence
attgccttctggtactgaatt

SEQ ID NO: 4862 - DNA, 21 bp, Artificial sequence
  SiRNA target sequence
ttgccttctggtactgaattt

SEQ ID NO: 4863 - DNA, 21 bp, Artificial sequence
  SiRNA target sequence
tgccttctggtactgaatttg

SEQ ID NO: 4864 - DNA, 21 bp, Artificial sequence
  SiRNA target sequence
gccttctggtactgaatttgg

SEQ ID NO: 4865 - DNA, 21 bp, Artificial sequence
  SiRNA target sequence
ccttctggtactgaatttggt

SEQ ID NO: 4866 - DNA, 21 bp, Artificial sequence
  SiRNA target sequence
cttctggtactgaatttggtc

SEQ ID NO: 4867 - DNA, 21 bp, Artificial sequence
  SiRNA target sequence
ttctggtactgaatttggtcc

SEQ ID NO: 4868 - DNA, 21 bp, Artificial sequence
  SiRNA target sequence
tctggtactgaatttggtcct

SEQ ID NO: 4869 - DNA, 21 bp, Artificial sequence
  SiRNA target sequence
ctggtactgaatttggtcctg

SEQ ID NO: 4870 - DNA, 21 bp, Artificial sequence
  SiRNA target sequence
tggtactgaatttggtcctga

SEQ ID NO: 4871 - DNA, 21 bp, Artificial sequence
  SiRNA target sequence
ggtactgaatttggtcctgaa

SEQ ID NO: 4872 - DNA, 21 bp, Artificial sequence
  SiRNA target sequence
gtactgaatttggtcctgaag

SEQ ID NO: 4873 - DNA, 21 bp, Artificial sequence
  SiRNA target sequence
tactgaatttggtcctgaaga

SEQ ID NO: 4874 - DNA, 21 bp, Artificial sequence
  SiRNA target sequence
actgaatttggtcctgaagat

SEQ ID NO: 4875 - DNA, 21 bp, Artificial sequence
  SiRNA target sequence
ctgaatttggtcctgaagatc

SEQ ID NO: 4876 - DNA, 21 bp, Artificial sequence
  SiRNA target sequence
tgaatttggtcctgaagatct

SEQ ID NO: 4877 - DNA, 21 bp, Artificial sequence
  SiRNA target sequence
gaatttggtcctgaagatctc

SEQ ID NO: 4878 - DNA, 21 bp, Artificial sequence
  SiRNA target sequence
aatttggtcctgaagatctca

SEQ ID NO: 4879 - DNA, 21 bp, Artificial sequence
  SiRNA target sequence
atttggtcctgaagatctcag

SEQ ID NO: 4880 - DNA, 21 bp, Artificial sequence
  SiRNA target sequence
tttggtcctgaagatctcagc

SEQ ID NO: 4881 - DNA, 21 bp, Artificial sequence
  SiRNA target sequence
ttggtcctgaagatctcagct

SEQ ID NO: 4882 - DNA, 21 bp, Artificial sequence
  SiRNA target sequence
tggtcctgaagatctcagctt

SEQ ID NO: 4883 - DNA, 21 bp, Artificial sequence
  SiRNA target sequence
ggtcctgaagatctcagcttt

SEQ ID NO: 4884 - DNA, 21 bp, Artificial sequence
  SiRNA target sequence
gtcctgaagatctcagctttt

SEQ ID NO: 4885 - DNA, 21 bp, Artificial sequence
  SiRNA target sequence
tcctgaagatctcagcttttg

SEQ ID NO: 4886 - DNA, 21 bp, Artificial sequence
  SiRNA target sequence
cctgaagatctcagcttttgt

SEQ ID NO: 4887 - DNA, 21 bp, Artificial sequence
  SiRNA target sequence
ctgaagatctcagcttttgtg

SEQ ID NO: 4888 - DNA, 21 bp, Artificial sequence
  SiRNA target sequence
tgaagatctcagcttttgtga

SEQ ID NO: 4889 - DNA, 21 bp, Artificial sequence
  SiRNA target sequence
gaagatctcagcttttgtgat

SEQ ID NO: 4890 - DNA, 21 bp, Artificial sequence
  SiRNA target sequence
aagatctcagcttttgtgatc

SEQ ID NO: 4891 - DNA, 21 bp, Artificial sequence
  SiRNA target sequence
agatctcagcttttgtgatct

SEQ ID NO: 4892 - DNA, 21 bp, Artificial sequence
  SiRNA target sequence
gatctcagcttttgtgatctt

SEQ ID NO: 4893 - DNA, 21 bp, Artificial sequence
  SiRNA target sequence
atctcagcttttgtgatcttc

SEQ ID NO: 4894 - DNA, 21 bp, Artificial sequence
  SiRNA target sequence
tctcagcttttgtgatcttcc

SEQ ID NO: 4895 - DNA, 21 bp, Artificial sequence
  SiRNA target sequence
ctcagcttttgtgatcttccc

SEQ ID NO: 4896 - DNA, 21 bp, Artificial sequence
  SiRNA target sequence
tcagcttttgtgatcttcccg

SEQ ID NO: 4897 - DNA, 21 bp, Artificial sequence
  SiRNA target sequence
cagcttttgtgatcttcccgc

SEQ ID NO: 4898 - DNA, 21 bp, Artificial sequence
  SiRNA target sequence
agcttttgtgatcttcccgcc

SEQ ID NO: 4899 - DNA, 21 bp, Artificial sequence
  SiRNA target sequence
gcttttgtgatcttcccgccc

SEQ ID NO: 4900 - DNA, 21 bp, Artificial sequence
  SiRNA target sequence
cttttgtgatcttcccgccct

SEQ ID NO: 4901 - DNA, 21 bp, Artificial sequence
  SiRNA target sequence
ttttgtgatcttcccgcccta

SEQ ID NO: 4902 - DNA, 21 bp, Artificial sequence
  SiRNA target sequence
tttgtgatcttcccgccctaa

SEQ ID NO: 4903 - DNA, 21 bp, Artificial sequence
  SiRNA target sequence
ttgtgatcttcccgccctaaa

SEQ ID NO: 4904 - DNA, 21 bp, Artificial sequence
  SiRNA target sequence
tgtgatcttcccgccctaaag

SEQ ID NO: 4905 - DNA, 21 bp, Artificial sequence
  SiRNA target sequence
gtgatcttcccgccctaaaga

SEQ ID NO: 4906 - DNA, 21 bp, Artificial sequence
  SiRNA target sequence
tgatcttcccgccctaaagat

SEQ ID NO: 4907 - DNA, 21 bp, Artificial sequence
  SiRNA target sequence
gatcttcccgccctaaagatg

SEQ ID NO: 4908 - DNA, 21 bp, Artificial sequence
  SiRNA target sequence
atcttcccgccctaaagatgt

SEQ ID NO: 4909 - DNA, 21 bp, Artificial sequence
  SiRNA target sequence
tcttcccgccctaaagatgtt

SEQ ID NO: 4910 - DNA, 21 bp, Artificial sequence
  SiRNA target sequence
cttcccgccctaaagatgtta

SEQ ID NO: 4911 - DNA, 21 bp, Artificial sequence
  SiRNA target sequence
ttcccgccctaaagatgttac

SEQ ID NO: 4912 - DNA, 21 bp, Artificial sequence
  SiRNA target sequence
tcccgccctaaagatgttacc

SEQ ID NO: 4913 - DNA, 21 bp, Artificial sequence
  SiRNA target sequence
cccgccctaaagatgttacca

SEQ ID NO: 4914 - DNA, 21 bp, Artificial sequence
  SiRNA target sequence
ccgccctaaagatgttaccag

SEQ ID NO: 4915 - DNA, 21 bp, Artificial sequence
  SiRNA target sequence
cgccctaaagatgttaccagt

SEQ ID NO: 4916 - DNA, 21 bp, Artificial sequence
  SiRNA target sequence
gccctaaagatgttaccagtt

SEQ ID NO: 4917 - DNA, 21 bp, Artificial sequence
  SiRNA target sequence
ccctaaagatgttaccagttg

SEQ ID NO: 4918 - DNA, 21 bp, Artificial sequence
  SiRNA target sequence
cctaaagatgttaccagttgg

SEQ ID NO: 4919 - DNA, 21 bp, Artificial sequence
  SiRNA target sequence
ctaaagatgttaccagttggt

SEQ ID NO: 4920 - DNA, 21 bp, Artificial sequence
  SiRNA target sequence
taaagatgttaccagttggta

SEQ ID NO: 4921 - DNA, 21 bp, Artificial sequence
  SiRNA target sequence
aaagatgttaccagttggtaa

SEQ ID NO: 4922 - DNA, 21 bp, Artificial sequence
  SiRNA target sequence
aagatgttaccagttggtaaa

SEQ ID NO: 4923 - DNA, 21 bp, Artificial sequence
  SiRNA target sequence
agatgttaccagttggtaaac

SEQ ID NO: 4924 - DNA, 21 bp, Artificial sequence
  SiRNA target sequence
gatgttaccagttggtaaact

SEQ ID NO: 4925 - DNA, 21 bp, Artificial sequence
  SiRNA target sequence
atgttaccagttggtaaactt

SEQ ID NO: 4926 - DNA, 21 bp, Artificial sequence
  SiRNA target sequence
tgttaccagttggtaaacttt

SEQ ID NO: 4927 - DNA, 21 bp, Artificial sequence
  SiRNA target sequence
gttaccagttggtaaactttc

SEQ ID NO: 4928 - DNA, 21 bp, Artificial sequence
  SiRNA target sequence
ttaccagttggtaaactttct

SEQ ID NO: 4929 - DNA, 21 bp, Artificial sequence
  SiRNA target sequence
taccagttggtaaactttctg

SEQ ID NO: 4930 - DNA, 21 bp, Artificial sequence
  SiRNA target sequence
accagttggtaaactttctga

SEQ ID NO: 4931 - DNA, 21 bp, Artificial sequence
  SiRNA target sequence
ccagttggtaaactttctgaa

SEQ ID NO: 4932 - DNA, 21 bp, Artificial sequence
  SiRNA target sequence
cagttggtaaactttctgaat

SEQ ID NO: 4933 - DNA, 21 bp, Artificial sequence
  SiRNA target sequence
agttggtaaactttctgaatc

SEQ ID NO: 4934 - DNA, 21 bp, Artificial sequence
  SiRNA target sequence
gttggtaaactttctgaatcc

SEQ ID NO: 4935 - DNA, 21 bp, Artificial sequence
  SiRNA target sequence
ttggtaaactttctgaatcct

SEQ ID NO: 4936 - DNA, 21 bp, Artificial sequence
  SiRNA target sequence
tggtaaactttctgaatcctt

SEQ ID NO: 4937 - DNA, 21 bp, Artificial sequence
  SiRNA target sequence
ggtaaactttctgaatcctta

SEQ ID NO: 4938 - DNA, 21 bp, Artificial sequence
  SiRNA target sequence
gtaaactttctgaatccttat

SEQ ID NO: 4939 - DNA, 21 bp, Artificial sequence
  SiRNA target sequence
taaactttctgaatccttatt

SEQ ID NO: 4940 - DNA, 21 bp, Artificial sequence
  SiRNA target sequence
aaactttctgaatccttattc

SEQ ID NO: 4941 - DNA, 21 bp, Artificial sequence
  SiRNA target sequence
aactttctgaatccttattcg

SEQ ID NO: 4942 - DNA, 21 bp, Artificial sequence
  SiRNA target sequence
actttctgaatccttattcga

SEQ ID NO: 4943 - DNA, 21 bp, Artificial sequence
  SiRNA target sequence
ctttctgaatccttattcgaa

SEQ ID NO: 4944 - DNA, 21 bp, Artificial sequence
  SiRNA target sequence
tttctgaatccttattcgaac

SEQ ID NO: 4945 - DNA, 21 bp, Artificial sequence
  SiRNA target sequence
ttctgaatccttattcgaacc

SEQ ID NO: 4946 - DNA, 21 bp, Artificial sequence
  SiRNA target sequence
tctgaatccttattcgaacct

SEQ ID NO: 4947 - DNA, 21 bp, Artificial sequence
  SiRNA target sequence
ctgaatccttattcgaacctg

SEQ ID NO: 4948 - DNA, 21 bp, Artificial sequence
  SiRNA target sequence
tgaatccttattcgaacctgg

SEQ ID NO: 4949 - DNA, 21 bp, Artificial sequence
  SiRNA target sequence
gaatccttattcgaacctggc

SEQ ID NO: 4950 - DNA, 21 bp, Artificial sequence
  SiRNA target sequence
aatccttattcgaacctggca

SEQ ID NO: 4951 - DNA, 21 bp, Artificial sequence
  SiRNA target sequence
atccttattcgaacctggcaa

SEQ ID NO: 4952 - DNA, 21 bp, Artificial sequence
  SiRNA target sequence
tccttattcgaacctggcaag

SEQ ID NO: 4953 - DNA, 21 bp, Artificial sequence
  SiRNA target sequence
ccttattcgaacctggcaaga

SEQ ID NO: 4954 - DNA, 21 bp, Artificial sequence
  SiRNA target sequence
cttattcgaacctggcaagac

SEQ ID NO: 4955 - DNA, 21 bp, Artificial sequence
  SiRNA target sequence
ttattcgaacctggcaagacg

SEQ ID NO: 4956 - DNA, 21 bp, Artificial sequence
  SiRNA target sequence
tattcgaacctggcaagacgg

SEQ ID NO: 4957 - DNA, 21 bp, Artificial sequence
  SiRNA target sequence
attcgaacctggcaagacgga

SEQ ID NO: 4958 - DNA, 21 bp, Artificial sequence
  SiRNA target sequence
ttcgaacctggcaagacggat

SEQ ID NO: 4959 - DNA, 21 bp, Artificial sequence
  SiRNA target sequence
tcgaacctggcaagacggata

SEQ ID NO: 4960 - DNA, 21 bp, Artificial sequence
  SiRNA target sequence
cgaacctggcaagacggatat

SEQ ID NO: 4961 - DNA, 21 bp, Artificial sequence
  SiRNA target sequence
gaacctggcaagacggatata

SEQ ID NO: 4962 - DNA, 21 bp, Artificial sequence
  SiRNA target sequence
aacctggcaagacggatataa

SEQ ID NO: 4963 - DNA, 21 bp, Artificial sequence
  SiRNA target sequence
acctggcaagacggatataag

SEQ ID NO: 4964 - DNA, 21 bp, Artificial sequence
  SiRNA target sequence
cctggcaagacggatataagg

SEQ ID NO: 4965 - DNA, 21 bp, Artificial sequence
  SiRNA target sequence
ctggcaagacggatataaggc

SEQ ID NO: 4966 - DNA, 21 bp, Artificial sequence
  SiRNA target sequence
tggcaagacggatataaggcc

SEQ ID NO: 4967 - DNA, 21 bp, Artificial sequence
  SiRNA target sequence
ggcaagacggatataaggccc

SEQ ID NO: 4968 - DNA, 21 bp, Artificial sequence
  SiRNA target sequence
gcaagacggatataaggccct

SEQ ID NO: 4969 - DNA, 21 bp, Artificial sequence
  SiRNA target sequence
caagacggatataaggccctc

SEQ ID NO: 4970 - DNA, 21 bp, Artificial sequence
  SiRNA target sequence
aagacggatataaggccctct

SEQ ID NO: 4971 - DNA, 21 bp, Artificial sequence
  SiRNA target sequence
agacggatataaggccctctt

SEQ ID NO: 4972 - DNA, 21 bp, Artificial sequence
  SiRNA target sequence
gacggatataaggccctcttt

SEQ ID NO: 4973 - DNA, 21 bp, Artificial sequence
  SiRNA target sequence
acggatataaggccctctttg

SEQ ID NO: 4974 - DNA, 21 bp, Artificial sequence
  SiRNA target sequence
cggatataaggccctctttgg

SEQ ID NO: 4975 - DNA, 21 bp, Artificial sequence
  SiRNA target sequence
ggatataaggccctctttggt

SEQ ID NO: 4976 - DNA, 21 bp, Artificial sequence
  SiRNA target sequence
gatataaggccctctttggta

SEQ ID NO: 4977 - DNA, 21 bp, Artificial sequence
  SiRNA target sequence
atataaggccctctttggtac

SEQ ID NO: 4978 - DNA, 21 bp, Artificial sequence
  SiRNA target sequence
tataaggccctctttggtaca

SEQ ID NO: 4979 - DNA, 21 bp, Artificial sequence
  SiRNA target sequence
ataaggccctctttggtacat

SEQ ID NO: 4980 - DNA, 21 bp, Artificial sequence
  SiRNA target sequence
taaggccctctttggtacatg

SEQ ID NO: 4981 - DNA, 21 bp, Artificial sequence
  SiRNA target sequence
aaggccctctttggtacatgg

SEQ ID NO: 4982 - DNA, 21 bp, Artificial sequence
  SiRNA target sequence
aggccctctttggtacatggt

SEQ ID NO: 4983 - DNA, 21 bp, Artificial sequence
  SiRNA target sequence
ggccctctttggtacatggtc

SEQ ID NO: 4984 - DNA, 21 bp, Artificial sequence
  SiRNA target sequence
gccctctttggtacatggtca

SEQ ID NO: 4985 - DNA, 21 bp, Artificial sequence
  SiRNA target sequence
ccctctttggtacatggtcaa

SEQ ID NO: 4986 - DNA, 21 bp, Artificial sequence
  SiRNA target sequence
cctctttggtacatggtcaaa

SEQ ID NO: 4987 - DNA, 21 bp, Artificial sequence
  SiRNA target sequence
ctctttggtacatggtcaaat

SEQ ID NO: 4988 - DNA, 21 bp, Artificial sequence
  SiRNA target sequence
tctttggtacatggtcaaatt

SEQ ID NO: 4989 - DNA, 21 bp, Artificial sequence
  SiRNA target sequence
ctttggtacatggtcaaatta

SEQ ID NO: 4990 - DNA, 21 bp, Artificial sequence
  SiRNA target sequence
tttggtacatggtcaaattag

SEQ ID NO: 4991 - DNA, 21 bp, Artificial sequence
  SiRNA target sequence
ttggtacatggtcaaattagt

SEQ ID NO: 4992 - DNA, 21 bp, Artificial sequence
  SiRNA target sequence
tggtacatggtcaaattagtg

SEQ ID NO: 4993 - DNA, 21 bp, Artificial sequence
  SiRNA target sequence
ggtacatggtcaaattagtga

SEQ ID NO: 4994 - DNA, 21 bp, Artificial sequence
  SiRNA target sequence
gtacatggtcaaattagtgac

SEQ ID NO: 4995 - DNA, 21 bp, Artificial sequence
  SiRNA target sequence
tacatggtcaaattagtgaca

SEQ ID NO: 4996 - DNA, 21 bp, Artificial sequence
  SiRNA target sequence
acatggtcaaattagtgacat

SEQ ID NO: 4997 - DNA, 21 bp, Artificial sequence
  SiRNA target sequence
catggtcaaattagtgacata

SEQ ID NO: 4998 - DNA, 21 bp, Artificial sequence
  SiRNA target sequence
atggtcaaattagtgacataa

SEQ ID NO: 4999 - DNA, 21 bp, Artificial sequence
  SiRNA target sequence
tggtcaaattagtgacataaa

SEQ ID NO: 5000 - DNA, 21 bp, Artificial sequence
  SiRNA target sequence
ggtcaaattagtgacataaaa

SEQ ID NO: 5001 - DNA, 21 bp, Artificial sequence
  SiRNA target sequence
gtcaaattagtgacataaaaa

SEQ ID NO: 5002 - DNA, 21 bp, Artificial sequence
  SiRNA target sequence
tcaaattagtgacataaaaac

SEQ ID NO: 5003 - DNA, 21 bp, Artificial sequence
  SiRNA target sequence
caaattagtgacataaaaaca

SEQ ID NO: 5004 - DNA, 21 bp, Artificial sequence
  SiRNA target sequence
aaattagtgacataaaaacaa

SEQ ID NO: 5005 - DNA, 21 bp, Artificial sequence
  SiRNA target sequence
aattagtgacataaaaacaaa

SEQ ID NO: 5006 - DNA, 21 bp, Artificial sequence
  SiRNA target sequence
attagtgacataaaaacaaaa

SEQ ID NO: 5007 - DNA, 21 bp, Artificial sequence
  SiRNA target sequence
ttagtgacataaaaacaaaac

SEQ ID NO: 5008 - DNA, 21 bp, Artificial sequence
  SiRNA target sequence
tagtgacataaaaacaaaacc

SEQ ID NO: 5009 - DNA, 21 bp, Artificial sequence
  SiRNA target sequence
agtgacataaaaacaaaacca

SEQ ID NO: 5010 - DNA, 21 bp, Artificial sequence
  SiRNA target sequence
gtgacataaaaacaaaaccag

SEQ ID NO: 5011 - DNA, 21 bp, Artificial sequence
  SiRNA target sequence
tgacataaaaacaaaaccagc

SEQ ID NO: 5012 - DNA, 21 bp, Artificial sequence
  SiRNA target sequence
gacataaaaacaaaaccagcc

SEQ ID NO: 5013 - DNA, 21 bp, Artificial sequence
  SiRNA target sequence
acataaaaacaaaaccagcct

SEQ ID NO: 5014 - DNA, 21 bp, Artificial sequence
  SiRNA target sequence
cataaaaacaaaaccagccta

SEQ ID NO: 5015 - DNA, 21 bp, Artificial sequence
  SiRNA target sequence
ataaaaacaaaaccagcctat

SEQ ID NO: 5016 - DNA, 21 bp, Artificial sequence
  SiRNA target sequence
taaaaacaaaaccagcctatt

SEQ ID NO: 5017 - DNA, 21 bp, Artificial sequence
  SiRNA target sequence
aaaaacaaaaccagcctattt

SEQ ID NO: 5018 - DNA, 21 bp, Artificial sequence
  SiRNA target sequence
aaaacaaaaccagcctattta

SEQ ID NO: 5019 - DNA, 21 bp, Artificial sequence
  SiRNA target sequence
aaacaaaaccagcctatttac

SEQ ID NO: 5020 - DNA, 21 bp, Artificial sequence
  SiRNA target sequence
aacaaaaccagcctatttacg

SEQ ID NO: 5021 - DNA, 21 bp, Artificial sequence
  SiRNA target sequence
acaaaaccagcctatttacgt

SEQ ID NO: 5022 - DNA, 21 bp, Artificial sequence
  SiRNA target sequence
caaaaccagcctatttacgta

SEQ ID NO: 5023 - DNA, 21 bp, Artificial sequence
  SiRNA target sequence
aaaaccagcctatttacgtaa

SEQ ID NO: 5024 - DNA, 21 bp, Artificial sequence
  SiRNA target sequence
aaaccagcctatttacgtaat

SEQ ID NO: 5025 - DNA, 21 bp, Artificial sequence
  SiRNA target sequence
aaccagcctatttacgtaatg

SEQ ID NO: 5026 - DNA, 21 bp, Artificial sequence
  SiRNA target sequence
accagcctatttacgtaatgt

SEQ ID NO: 5027 - DNA, 21 bp, Artificial sequence
  SiRNA target sequence
ccagcctatttacgtaatgta

SEQ ID NO: 5028 - DNA, 21 bp, Artificial sequence
  SiRNA target sequence
cagcctatttacgtaatgtaa

SEQ ID NO: 5029 - DNA, 21 bp, Artificial sequence
  SiRNA target sequence
agcctatttacgtaatgtaat

SEQ ID NO: 5030 - DNA, 21 bp, Artificial sequence
  SiRNA target sequence
gcctatttacgtaatgtaatt

SEQ ID NO: 5031 - DNA, 21 bp, Artificial sequence
  SiRNA target sequence
cctatttacgtaatgtaatta

SEQ ID NO: 5032 - DNA, 21 bp, Artificial sequence
  SiRNA target sequence
ctatttacgtaatgtaattaa

SEQ ID NO: 5033 - DNA, 21 bp, Artificial sequence
  SiRNA target sequence
tatttacgtaatgtaattaag

SEQ ID NO: 5034 - DNA, 21 bp, Artificial sequence
  SiRNA target sequence
atttacgtaatgtaattaagg

SEQ ID NO: 5035 - DNA, 21 bp, Artificial sequence
  SiRNA target sequence
tttacgtaatgtaattaagga

SEQ ID NO: 5036 - DNA, 21 bp, Artificial sequence
  SiRNA target sequence
ttacgtaatgtaattaaggat

SEQ ID NO: 5037 - DNA, 21 bp, Artificial sequence
  SiRNA target sequence
tacgtaatgtaattaaggatg

SEQ ID NO: 5038 - DNA, 21 bp, Artificial sequence
  SiRNA target sequence
acgtaatgtaattaaggatgg

SEQ ID NO: 5039 - DNA, 21 bp, Artificial sequence
  SiRNA target sequence
cgtaatgtaattaaggatgga

SEQ ID NO: 5040 - DNA, 21 bp, Artificial sequence
  SiRNA target sequence
gtaatgtaattaaggatggag

SEQ ID NO: 5041 - DNA, 21 bp, Artificial sequence
  SiRNA target sequence
taatgtaattaaggatggaga

SEQ ID NO: 5042 - DNA, 21 bp, Artificial sequence
  SiRNA target sequence
aatgtaattaaggatggagat

SEQ ID NO: 5043 - DNA, 21 bp, Artificial sequence
  SiRNA target sequence
atgtaattaaggatggagatt

SEQ ID NO: 5044 - DNA, 21 bp, Artificial sequence
  SiRNA target sequence
tgtaattaaggatggagattt

SEQ ID NO: 5045 - DNA, 21 bp, Artificial sequence
  SiRNA target sequence
gtaattaaggatggagatttt

SEQ ID NO: 5046 - DNA, 21 bp, Artificial sequence
  SiRNA target sequence
taattaaggatggagattttg

SEQ ID NO: 5047 - DNA, 21 bp, Artificial sequence
  SiRNA target sequence
aattaaggatggagattttgt

SEQ ID NO: 5048 - DNA, 21 bp, Artificial sequence
  SiRNA target sequence
attaaggatggagattttgtt

SEQ ID NO: 5049 - DNA, 21 bp, Artificial sequence
  SiRNA target sequence
ttaaggatggagattttgtta

SEQ ID NO: 5050 - DNA, 21 bp, Artificial sequence
  SiRNA target sequence
taaggatggagattttgttaa

SEQ ID NO: 5051 - DNA, 21 bp, Artificial sequence
  SiRNA target sequence
aaggatggagattttgttaat

SEQ ID NO: 5052 - DNA, 21 bp, Artificial sequence
  SiRNA target sequence
aggatggagattttgttaata

SEQ ID NO: 5053 - DNA, 21 bp, Artificial sequence
  SiRNA target sequence
ggatggagattttgttaatat

SEQ ID NO: 5054 - DNA, 21 bp, Artificial sequence
  SiRNA target sequence
gatggagattttgttaatatg

SEQ ID NO: 5055 - DNA, 21 bp, Artificial sequence
  SiRNA target sequence
atggagattttgttaatatga

SEQ ID NO: 5056 - DNA, 21 bp, Artificial sequence
  SiRNA target sequence
tggagattttgttaatatgaa

SEQ ID NO: 5057 - DNA, 21 bp, Artificial sequence
  SiRNA target sequence
ggagattttgttaatatgaaa

SEQ ID NO: 5058 - DNA, 21 bp, Artificial sequence
  SiRNA target sequence
gagattttgttaatatgaaac

SEQ ID NO: 5059 - DNA, 21 bp, Artificial sequence
  SiRNA target sequence
agattttgttaatatgaaaca

SEQ ID NO: 5060 - DNA, 21 bp, Artificial sequence
  SiRNA target sequence
gattttgttaatatgaaacat

SEQ ID NO: 5061 - DNA, 21 bp, Artificial sequence
  SiRNA target sequence
attttgttaatatgaaacata

SEQ ID NO: 5062 - DNA, 21 bp, Artificial sequence
  SiRNA target sequence
ttttgttaatatgaaacataa

SEQ ID NO: 5063 - DNA, 21 bp, Artificial sequence
  SiRNA target sequence
tttgttaatatgaaacataaa

SEQ ID NO: 5064 - DNA, 21 bp, Artificial sequence
  SiRNA target sequence
ttgttaatatgaaacataaaa

SEQ ID NO: 5065 - DNA, 21 bp, Artificial sequence
  SiRNA target sequence
tgttaatatgaaacataaaaa

SEQ ID NO: 5066 - DNA, 21 bp, Artificial sequence
  SiRNA target sequence
gttaatatgaaacataaaaat

SEQ ID NO: 5067 - DNA, 21 bp, Artificial sequence
  SiRNA target sequence
ttaatatgaaacataaaaatt

SEQ ID NO: 5068 - DNA, 21 bp, Artificial sequence
  SiRNA target sequence
taatatgaaacataaaaattt

SEQ ID NO: 5069 - DNA, 21 bp, Artificial sequence
  SiRNA target sequence
aatatgaaacataaaaatttg

SEQ ID NO: 5070 - DNA, 21 bp, Artificial sequence
  SiRNA target sequence
atatgaaacataaaaatttga

SEQ ID NO: 5071 - DNA, 21 bp, Artificial sequence
  SiRNA target sequence
tatgaaacataaaaatttgat

SEQ ID NO: 5072 - DNA, 21 bp, Artificial sequence
  SiRNA target sequence
atgaaacataaaaatttgatg

SEQ ID NO: 5073 - DNA, 21 bp, Artificial sequence
  SiRNA target sequence
tgaaacataaaaatttgatga

SEQ ID NO: 5074 - DNA, 21 bp, Artificial sequence
  SiRNA target sequence
gaaacataaaaatttgatgaa

SEQ ID NO: 5075 - DNA, 21 bp, Artificial sequence
  SiRNA target sequence
aaacataaaaatttgatgaaa

SEQ ID NO: 5076 - DNA, 21 bp, Artificial sequence
  SiRNA target sequence
aacataaaaatttgatgaaat

SEQ ID NO: 5077 - DNA, 21 bp, Artificial sequence
  SiRNA target sequence
acataaaaatttgatgaaatg

SEQ ID NO: 5078 - DNA, 21 bp, Artificial sequence
  SiRNA target sequence
cataaaaatttgatgaaatgt

SEQ ID NO: 5079 - DNA, 21 bp, Artificial sequence
  SiRNA target sequence
ataaaaatttgatgaaatgtg

SEQ ID NO: 5080 - DNA, 21 bp, Artificial sequence
  SiRNA target sequence
taaaaatttgatgaaatgtgc

SEQ ID NO: 5081 - DNA, 21 bp, Artificial sequence
  SiRNA target sequence
aaaaatttgatgaaatgtgct

SEQ ID NO: 5082 - DNA, 21 bp, Artificial sequence
  SiRNA target sequence
aaaatttgatgaaatgtgcta

SEQ ID NO: 5083 - DNA, 21 bp, Artificial sequence
  SiRNA target sequence
aaatttgatgaaatgtgctat

SEQ ID NO: 5084 - DNA, 21 bp, Artificial sequence
  SiRNA target sequence
aatttgatgaaatgtgctatg

SEQ ID NO: 5085 - DNA, 21 bp, Artificial sequence
  SiRNA target sequence
atttgatgaaatgtgctatgg

SEQ ID NO: 5086 - DNA, 21 bp, Artificial sequence
  SiRNA target sequence
tttgatgaaatgtgctatgga

SEQ ID NO: 5087 - DNA, 21 bp, Artificial sequence
  SiRNA target sequence
ttgatgaaatgtgctatggat

SEQ ID NO: 5088 - DNA, 21 bp, Artificial sequence
  SiRNA target sequence
tgatgaaatgtgctatggata

SEQ ID NO: 5089 - DNA, 21 bp, Artificial sequence
  SiRNA target sequence
gatgaaatgtgctatggatac

SEQ ID NO: 5090 - DNA, 21 bp, Artificial sequence
  SiRNA target sequence
atgaaatgtgctatggataca

SEQ ID NO: 5091 - DNA, 21 bp, Artificial sequence
  SiRNA target sequence
tgaaatgtgctatggatacac

SEQ ID NO: 5092 - DNA, 21 bp, Artificial sequence
  SiRNA target sequence
gaaatgtgctatggatacacc

SEQ ID NO: 5093 - DNA, 21 bp, Artificial sequence
  SiRNA target sequence
aaatgtgctatggatacaccc

SEQ ID NO: 5094 - DNA, 21 bp, Artificial sequence
  SiRNA target sequence
aatgtgctatggatacaccct

SEQ ID NO: 5095 - DNA, 21 bp, Artificial sequence
  SiRNA target sequence
atgtgctatggatacacccta

SEQ ID NO: 5096 - DNA, 21 bp, Artificial sequence
  SiRNA target sequence
tgtgctatggatacaccctat

SEQ ID NO: 5097 - DNA, 21 bp, Artificial sequence
  SiRNA target sequence
gtgctatggatacaccctata

SEQ ID NO: 5098 - DNA, 21 bp, Artificial sequence
  SiRNA target sequence
tgctatggatacaccctatat

SEQ ID NO: 5099 - DNA, 21 bp, Artificial sequence
  SiRNA target sequence
gctatggatacaccctatatc

SEQ ID NO: 5100 - DNA, 21 bp, Artificial sequence
  SiRNA target sequence
ctatggatacaccctatatcg

SEQ ID NO: 5101 - DNA, 21 bp, Artificial sequence
  SiRNA target sequence
tatggatacaccctatatcga

SEQ ID NO: 5102 - DNA, 21 bp, Artificial sequence
  SiRNA target sequence
atggatacaccctatatcgac

SEQ ID NO: 5103 - DNA, 21 bp, Artificial sequence
  SiRNA target sequence
tggatacaccctatatcgaca

SEQ ID NO: 5104 - DNA, 21 bp, Artificial sequence
  SiRNA target sequence
ggatacaccctatatcgacaa

SEQ ID NO: 5105 - DNA, 21 bp, Artificial sequence
  SiRNA target sequence
gatacaccctatatcgacaag

SEQ ID NO: 5106 - DNA, 21 bp, Artificial sequence
  SiRNA target sequence
atacaccctatatcgacaagg

SEQ ID NO: 5107 - DNA, 21 bp, Artificial sequence
  SiRNA target sequence
tacaccctatatcgacaagga

SEQ ID NO: 5108 - DNA, 21 bp, Artificial sequence
  SiRNA target sequence
acaccctatatcgacaaggac

SEQ ID NO: 5109 - DNA, 21 bp, Artificial sequence
  SiRNA target sequence
caccctatatcgacaaggaca

SEQ ID NO: 5110 - DNA, 21 bp, Artificial sequence
  SiRNA target sequence
accctatatcgacaaggacat

SEQ ID NO: 5111 - DNA, 21 bp, Artificial sequence
  SiRNA target sequence
ccctatatcgacaaggacatg

SEQ ID NO: 5112 - DNA, 21 bp, Artificial sequence
  SiRNA target sequence
cctatatcgacaaggacatga

SEQ ID NO: 5113 - DNA, 21 bp, Artificial sequence
  SiRNA target sequence
ctatatcgacaaggacatgat

SEQ ID NO: 5114 - DNA, 21 bp, Artificial sequence
  SiRNA target sequence
tatatcgacaaggacatgatt

SEQ ID NO: 5115 - DNA, 21 bp, Artificial sequence
  SiRNA target sequence
atatcgacaaggacatgattg

SEQ ID NO: 5116 - DNA, 21 bp, Artificial sequence
  SiRNA target sequence
tatcgacaaggacatgattga

SEQ ID NO: 5117 - DNA, 21 bp, Artificial sequence
  SiRNA target sequence
atcgacaaggacatgattgat

SEQ ID NO: 5118 - DNA, 21 bp, Artificial sequence
  SiRNA target sequence
tcgacaaggacatgattgatg

SEQ ID NO: 5119 - DNA, 21 bp, Artificial sequence
  SiRNA target sequence
cgacaaggacatgattgatga

SEQ ID NO: 5120 - DNA, 21 bp, Artificial sequence
  SiRNA target sequence
gacaaggacatgattgatgag

SEQ ID NO: 5121 - DNA, 21 bp, Artificial sequence
  SiRNA target sequence
acaaggacatgattgatgagg

SEQ ID NO: 5122 - DNA, 21 bp, Artificial sequence
  SiRNA target sequence
caaggacatgattgatgaggc

SEQ ID NO: 5123 - DNA, 21 bp, Artificial sequence
  SiRNA target sequence
aaggacatgattgatgaggca

SEQ ID NO: 5124 - DNA, 21 bp, Artificial sequence
  SiRNA target sequence
aggacatgattgatgaggcat

SEQ ID NO: 5125 - DNA, 21 bp, Artificial sequence
  SiRNA target sequence
ggacatgattgatgaggcata

SEQ ID NO: 5126 - DNA, 21 bp, Artificial sequence
  SiRNA target sequence
gacatgattgatgaggcatat

SEQ ID NO: 5127 - DNA, 21 bp, Artificial sequence
  SiRNA target sequence
acatgattgatgaggcatatc

SEQ ID NO: 5128 - DNA, 21 bp, Artificial sequence
  SiRNA target sequence
catgattgatgaggcatatca

SEQ ID NO: 5129 - DNA, 21 bp, Artificial sequence
  SiRNA target sequence
atgattgatgaggcatatcag

SEQ ID NO: 5130 - DNA, 21 bp, Artificial sequence
  SiRNA target sequence
tgattgatgaggcatatcagt

SEQ ID NO: 5131 - DNA, 21 bp, Artificial sequence
  SiRNA target sequence
gattgatgaggcatatcagtt

SEQ ID NO: 5132 - DNA, 21 bp, Artificial sequence
  SiRNA target sequence
attgatgaggcatatcagtta

SEQ ID NO: 5133 - DNA, 21 bp, Artificial sequence
  SiRNA target sequence
ttgatgaggcatatcagttaa

SEQ ID NO: 5134 - DNA, 21 bp, Artificial sequence
  SiRNA target sequence
tgatgaggcatatcagttaac

SEQ ID NO: 5135 - DNA, 21 bp, Artificial sequence
  SiRNA target sequence
gatgaggcatatcagttaact

SEQ ID NO: 5136 - DNA, 21 bp, Artificial sequence
  SiRNA target sequence
atgaggcatatcagttaacta

SEQ ID NO: 5137 - DNA, 21 bp, Artificial sequence
  SiRNA target sequence
tgaggcatatcagttaactaa

SEQ ID NO: 5138 - DNA, 21 bp, Artificial sequence
  SiRNA target sequence
gaggcatatcagttaactaaa

SEQ ID NO: 5139 - DNA, 21 bp, Artificial sequence
  SiRNA target sequence
aggcatatcagttaactaaat

SEQ ID NO: 5140 - DNA, 21 bp, Artificial sequence
  SiRNA target sequence
ggcatatcagttaactaaatc

SEQ ID NO: 5141 - DNA, 21 bp, Artificial sequence
  SiRNA target sequence
gcatatcagttaactaaatct

SEQ ID NO: 5142 - DNA, 21 bp, Artificial sequence
  SiRNA target sequence
catatcagttaactaaatctg

SEQ ID NO: 5143 - DNA, 21 bp, Artificial sequence
  SiRNA target sequence
atatcagttaactaaatctgt

SEQ ID NO: 5144 - DNA, 21 bp, Artificial sequence
  SiRNA target sequence
tatcagttaactaaatctgtt

SEQ ID NO: 5145 - DNA, 21 bp, Artificial sequence
  SiRNA target sequence
atcagttaactaaatctgttt

SEQ ID NO: 5146 - DNA, 21 bp, Artificial sequence
  SiRNA target sequence
tcagttaactaaatctgtttg

SEQ ID NO: 5147 - DNA, 21 bp, Artificial sequence
  SiRNA target sequence
cagttaactaaatctgtttgg

SEQ ID NO: 5148 - DNA, 21 bp, Artificial sequence
  SiRNA target sequence
agttaactaaatctgtttggt

SEQ ID NO: 5149 - DNA, 21 bp, Artificial sequence
  SiRNA target sequence
gttaactaaatctgtttggtt

SEQ ID NO: 5150 - DNA, 21 bp, Artificial sequence
  SiRNA target sequence
ttaactaaatctgtttggtta

SEQ ID NO: 5151 - DNA, 21 bp, Artificial sequence
  SiRNA target sequence
taactaaatctgtttggttaa

SEQ ID NO: 5152 - DNA, 21 bp, Artificial sequence
  SiRNA target sequence
aactaaatctgtttggttaaa

SEQ ID NO: 5153 - DNA, 21 bp, Artificial sequence
  SiRNA target sequence
actaaatctgtttggttaaaa

SEQ ID NO: 5154 - DNA, 21 bp, Artificial sequence
  SiRNA target sequence
ctaaatctgtttggttaaaag

SEQ ID NO: 5155 - DNA, 21 bp, Artificial sequence
  SiRNA target sequence
taaatctgtttggttaaaagg

SEQ ID NO: 5156 - DNA, 21 bp, Artificial sequence
  SiRNA target sequence
aaatctgtttggttaaaaggt

SEQ ID NO: 5157 - DNA, 21 bp, Artificial sequence
  SiRNA target sequence
aatctgtttggttaaaaggta

SEQ ID NO: 5158 - DNA, 21 bp, Artificial sequence
  SiRNA target sequence
atctgtttggttaaaaggtat

SEQ ID NO: 5159 - DNA, 21 bp, Artificial sequence
  SiRNA target sequence
tctgtttggttaaaaggtatg

SEQ ID NO: 5160 - DNA, 21 bp, Artificial sequence
  SiRNA target sequence
ctgtttggttaaaaggtatga

SEQ ID NO: 5161 - DNA, 21 bp, Artificial sequence
  SiRNA target sequence
tgtttggttaaaaggtatgag

SEQ ID NO: 5162 - DNA, 21 bp, Artificial sequence
  SiRNA target sequence
gtttggttaaaaggtatgaga

SEQ ID NO: 5163 - DNA, 21 bp, Artificial sequence
  SiRNA target sequence
tttggttaaaaggtatgagag

SEQ ID NO: 5164 - DNA, 21 bp, Artificial sequence
  SiRNA target sequence
ttggttaaaaggtatgagaga

SEQ ID NO: 5165 - DNA, 21 bp, Artificial sequence
  SiRNA target sequence
tggttaaaaggtatgagagat

SEQ ID NO: 5166 - DNA, 21 bp, Artificial sequence
  SiRNA target sequence
ggttaaaaggtatgagagatg

SEQ ID NO: 5167 - DNA, 21 bp, Artificial sequence
  SiRNA target sequence
gttaaaaggtatgagagatga

SEQ ID NO: 5168 - DNA, 21 bp, Artificial sequence
  SiRNA target sequence
ttaaaaggtatgagagatgaa

SEQ ID NO: 5169 - DNA, 21 bp, Artificial sequence
  SiRNA target sequence
taaaaggtatgagagatgaat

SEQ ID NO: 5170 - DNA, 21 bp, Artificial sequence
  SiRNA target sequence
aaaaggtatgagagatgaatt

SEQ ID NO: 5171 - DNA, 21 bp, Artificial sequence
  SiRNA target sequence
aaaggtatgagagatgaattg

SEQ ID NO: 5172 - DNA, 21 bp, Artificial sequence
  SiRNA target sequence
aaggtatgagagatgaattga

SEQ ID NO: 5173 - DNA, 21 bp, Artificial sequence
  SiRNA target sequence
aggtatgagagatgaattgaa

SEQ ID NO: 5174 - DNA, 21 bp, Artificial sequence
  SiRNA target sequence
ggtatgagagatgaattgaag

SEQ ID NO: 5175 - DNA, 21 bp, Artificial sequence
  SiRNA target sequence
gtatgagagatgaattgaaga

SEQ ID NO: 5176 - DNA, 21 bp, Artificial sequence
  SiRNA target sequence
tatgagagatgaattgaagaa

SEQ ID NO: 5177 - DNA, 21 bp, Artificial sequence
  SiRNA target sequence
atgagagatgaattgaagaag

SEQ ID NO: 5178 - DNA, 21 bp, Artificial sequence
  SiRNA target sequence
tgagagatgaattgaagaagg

SEQ ID NO: 5179 - DNA, 21 bp, Artificial sequence
  SiRNA target sequence
gagagatgaattgaagaaggt

SEQ ID NO: 5180 - DNA, 21 bp, Artificial sequence
  SiRNA target sequence
agagatgaattgaagaaggtt

SEQ ID NO: 5181 - DNA, 21 bp, Artificial sequence
  SiRNA target sequence
gagatgaattgaagaaggttc

SEQ ID NO: 5182 - DNA, 21 bp, Artificial sequence
  SiRNA target sequence
agatgaattgaagaaggttct

SEQ ID NO: 5183 - DNA, 21 bp, Artificial sequence
  SiRNA target sequence
gatgaattgaagaaggttctc

SEQ ID NO: 5184 - DNA, 21 bp, Artificial sequence
  SiRNA target sequence
atgaattgaagaaggttctca

SEQ ID NO: 5185 - DNA, 21 bp, Artificial sequence
  SiRNA target sequence
tgaattgaagaaggttctcac

SEQ ID NO: 5186 - DNA, 21 bp, Artificial sequence
  SiRNA target sequence
gaattgaagaaggttctcact

SEQ ID NO: 5187 - DNA, 21 bp, Artificial sequence
  SiRNA target sequence
aattgaagaaggttctcactt

SEQ ID NO: 5188 - DNA, 21 bp, Artificial sequence
  SiRNA target sequence
attgaagaaggttctcactta

SEQ ID NO: 5189 - DNA, 21 bp, Artificial sequence
  SiRNA target sequence
ttgaagaaggttctcacttat

SEQ ID NO: 5190 - DNA, 21 bp, Artificial sequence
  SiRNA target sequence
tgaagaaggttctcacttatg

SEQ ID NO: 5191 - DNA, 21 bp, Artificial sequence
  SiRNA target sequence
gaagaaggttctcacttatga

SEQ ID NO: 5192 - DNA, 21 bp, Artificial sequence
  SiRNA target sequence
aagaaggttctcacttatgaa

SEQ ID NO: 5193 - DNA, 21 bp, Artificial sequence
  SiRNA target sequence
agaaggttctcacttatgaag

SEQ ID NO: 5194 - DNA, 21 bp, Artificial sequence
  SiRNA target sequence
gaaggttctcacttatgaaga

SEQ ID NO: 5195 - DNA, 21 bp, Artificial sequence
  SiRNA target sequence
aaggttctcacttatgaagaa

SEQ ID NO: 5196 - DNA, 21 bp, Artificial sequence
  SiRNA target sequence
aggttctcacttatgaagaag

SEQ ID NO: 5197 - DNA, 21 bp, Artificial sequence
  SiRNA target sequence
ggttctcacttatgaagaagc

SEQ ID NO: 5198 - DNA, 21 bp, Artificial sequence
  SiRNA target sequence
gttctcacttatgaagaagcc

SEQ ID NO: 5199 - DNA, 21 bp, Artificial sequence
  SiRNA target sequence
ttctcacttatgaagaagcca

SEQ ID NO: 5200 - DNA, 21 bp, Artificial sequence
  SiRNA target sequence
tctcacttatgaagaagccat

SEQ ID NO: 5201 - DNA, 21 bp, Artificial sequence
  SiRNA target sequence
ctcacttatgaagaagccatt

SEQ ID NO: 5202 - DNA, 21 bp, Artificial sequence
  SiRNA target sequence
tcacttatgaagaagccattt

SEQ ID NO: 5203 - DNA, 21 bp, Artificial sequence
  SiRNA target sequence
cacttatgaagaagccatttg

SEQ ID NO: 5204 - DNA, 21 bp, Artificial sequence
  SiRNA target sequence
acttatgaagaagccatttgt

SEQ ID NO: 5205 - DNA, 21 bp, Artificial sequence
  SiRNA target sequence
cttatgaagaagccatttgtg

SEQ ID NO: 5206 - DNA, 21 bp, Artificial sequence
  SiRNA target sequence
ttatgaagaagccatttgtgg

SEQ ID NO: 5207 - DNA, 21 bp, Artificial sequence
  SiRNA target sequence
tatgaagaagccatttgtggc

SEQ ID NO: 5208 - DNA, 21 bp, Artificial sequence
  SiRNA target sequence
atgaagaagccatttgtggct

SEQ ID NO: 5209 - DNA, 21 bp, Artificial sequence
  SiRNA target sequence
tgaagaagccatttgtggctc

SEQ ID NO: 5210 - DNA, 21 bp, Artificial sequence
  SiRNA target sequence
gaagaagccatttgtggctct

SEQ ID NO: 5211 - DNA, 21 bp, Artificial sequence
  SiRNA target sequence
aagaagccatttgtggctctg

SEQ ID NO: 5212 - DNA, 21 bp, Artificial sequence
  SiRNA target sequence
agaagccatttgtggctctga

SEQ ID NO: 5213 - DNA, 21 bp, Artificial sequence
  SiRNA target sequence
gaagccatttgtggctctgaa

SEQ ID NO: 5214 - DNA, 21 bp, Artificial sequence
  SiRNA target sequence
aagccatttgtggctctgaag

SEQ ID NO: 5215 - DNA, 21 bp, Artificial sequence
  SiRNA target sequence
agccatttgtggctctgaagt

SEQ ID NO: 5216 - DNA, 21 bp, Artificial sequence
  SiRNA target sequence
gccatttgtggctctgaagta

SEQ ID NO: 5217 - DNA, 21 bp, Artificial sequence
  SiRNA target sequence
ccatttgtggctctgaagtaa

SEQ ID NO: 5218 - DNA, 21 bp, Artificial sequence
  SiRNA target sequence
catttgtggctctgaagtaag

SEQ ID NO: 5219 - DNA, 21 bp, Artificial sequence
  SiRNA target sequence
atttgtggctctgaagtaagt

SEQ ID NO: 5220 - DNA, 21 bp, Artificial sequence
  SiRNA target sequence
tttgtggctctgaagtaagtg

SEQ ID NO: 5221 - DNA, 21 bp, Artificial sequence
  SiRNA target sequence
ttgtggctctgaagtaagtga

SEQ ID NO: 5222 - DNA, 21 bp, Artificial sequence
  SiRNA target sequence
tgtggctctgaagtaagtgag

SEQ ID NO: 5223 - DNA, 21 bp, Artificial sequence
  SiRNA target sequence
gtggctctgaagtaagtgagt

SEQ ID NO: 5224 - DNA, 21 bp, Artificial sequence
  SiRNA target sequence
tggctctgaagtaagtgagta

SEQ ID NO: 5225 - DNA, 21 bp, Artificial sequence
  SiRNA target sequence
ggctctgaagtaagtgagtac

SEQ ID NO: 5226 - DNA, 21 bp, Artificial sequence
  SiRNA target sequence
gctctgaagtaagtgagtaca

SEQ ID NO: 5227 - DNA, 21 bp, Artificial sequence
  SiRNA target sequence
ctctgaagtaagtgagtacat

SEQ ID NO: 5228 - DNA, 21 bp, Artificial sequence
  SiRNA target sequence
tctgaagtaagtgagtacatt

SEQ ID NO: 5229 - DNA, 21 bp, Artificial sequence
  SiRNA target sequence
ctgaagtaagtgagtacattt

SEQ ID NO: 5230 - DNA, 21 bp, Artificial sequence
  SiRNA target sequence
tgaagtaagtgagtacatttc

SEQ ID NO: 5231 - DNA, 21 bp, Artificial sequence
  SiRNA target sequence
gaagtaagtgagtacatttct

SEQ ID NO: 5232 - DNA, 21 bp, Artificial sequence
  SiRNA target sequence
aagtaagtgagtacatttctt

SEQ ID NO: 5233 - DNA, 21 bp, Artificial sequence
  SiRNA target sequence
agtaagtgagtacatttcttc

SEQ ID NO: 5234 - DNA, 21 bp, Artificial sequence
  SiRNA target sequence
gtaagtgagtacatttcttca

SEQ ID NO: 5235 - DNA, 21 bp, Artificial sequence
  SiRNA target sequence
taagtgagtacatttcttcaa

SEQ ID NO: 5236 - DNA, 21 bp, Artificial sequence
  SiRNA target sequence
aagtgagtacatttcttcaat

SEQ ID NO: 5237 - DNA, 21 bp, Artificial sequence
  SiRNA target sequence
agtgagtacatttcttcaata

SEQ ID NO: 5238 - DNA, 21 bp, Artificial sequence
  SiRNA target sequence
gtgagtacatttcttcaataa

SEQ ID NO: 5239 - DNA, 21 bp, Artificial sequence
  SiRNA target sequence
tgagtacatttcttcaataaa

SEQ ID NO: 5240 - DNA, 21 bp, Artificial sequence
  SiRNA target sequence
gagtacatttcttcaataaat

SEQ ID NO: 5241 - DNA, 21 bp, Artificial sequence
  SiRNA target sequence
agtacatttcttcaataaatc

SEQ ID NO: 5242 - DNA, 21 bp, Artificial sequence
  SiRNA target sequence
gtacatttcttcaataaatcg

SEQ ID NO: 5243 - DNA, 21 bp, Artificial sequence
  SiRNA target sequence
tacatttcttcaataaatcga

SEQ ID NO: 5244 - DNA, 21 bp, Artificial sequence
  SiRNA target sequence
acatttcttcaataaatcgaa

SEQ ID NO: 5245 - DNA, 21 bp, Artificial sequence
  SiRNA target sequence
catttcttcaataaatcgaag

SEQ ID NO: 5246 - DNA, 21 bp, Artificial sequence
  SiRNA target sequence
atttcttcaataaatcgaagt

SEQ ID NO: 5247 - DNA, 21 bp, Artificial sequence
  SiRNA target sequence
tttcttcaataaatcgaagta

SEQ ID NO: 5248 - DNA, 21 bp, Artificial sequence
  SiRNA target sequence
ttcttcaataaatcgaagtag

SEQ ID NO: 5249 - DNA, 21 bp, Artificial sequence
  SiRNA target sequence
tcttcaataaatcgaagtagt

SEQ ID NO: 5250 - DNA, 21 bp, Artificial sequence
  SiRNA target sequence
cttcaataaatcgaagtagtt

SEQ ID NO: 5251 - DNA, 21 bp, Artificial sequence
  SiRNA target sequence
ttcaataaatcgaagtagttc

SEQ ID NO: 5252 - DNA, 21 bp, Artificial sequence
  SiRNA target sequence
tcaataaatcgaagtagttcc

SEQ ID NO: 5253 - DNA, 21 bp, Artificial sequence
  SiRNA target sequence
caataaatcgaagtagttccc

SEQ ID NO: 5254 - DNA, 21 bp, Artificial sequence
  SiRNA target sequence
aataaatcgaagtagttcccc

SEQ ID NO: 5255 - DNA, 21 bp, Artificial sequence
  SiRNA target sequence
ataaatcgaagtagttcccct

SEQ ID NO: 5256 - DNA, 21 bp, Artificial sequence
  SiRNA target sequence
taaatcgaagtagttcccctg

SEQ ID NO: 5257 - DNA, 21 bp, Artificial sequence
  SiRNA target sequence
aaatcgaagtagttcccctgg

SEQ ID NO: 5258 - DNA, 21 bp, Artificial sequence
  SiRNA target sequence
aatcgaagtagttcccctgga

SEQ ID NO: 5259 - DNA, 21 bp, Artificial sequence
  SiRNA target sequence
atcgaagtagttcccctggat

SEQ ID NO: 5260 - DNA, 21 bp, Artificial sequence
  SiRNA target sequence
tcgaagtagttcccctggata

SEQ ID NO: 5261 - DNA, 21 bp, Artificial sequence
  SiRNA target sequence
cgaagtagttcccctggatat

SEQ ID NO: 5262 - DNA, 21 bp, Artificial sequence
  SiRNA target sequence
gaagtagttcccctggatatc

SEQ ID NO: 5263 - DNA, 21 bp, Artificial sequence
  SiRNA target sequence
aagtagttcccctggatatcc

SEQ ID NO: 5264 - DNA, 21 bp, Artificial sequence
  SiRNA target sequence
agtagttcccctggatatcct

SEQ ID NO: 5265 - DNA, 21 bp, Artificial sequence
  SiRNA target sequence
gtagttcccctggatatcctt

SEQ ID NO: 5266 - DNA, 21 bp, Artificial sequence
  SiRNA target sequence
tagttcccctggatatccttg

SEQ ID NO: 5267 - DNA, 21 bp, Artificial sequence
  SiRNA target sequence
agttcccctggatatccttgg

SEQ ID NO: 5268 - DNA, 21 bp, Artificial sequence
  SiRNA target sequence
gttcccctggatatccttgga

SEQ ID NO: 5269 - DNA, 21 bp, Artificial sequence
  SiRNA target sequence
ttcccctggatatccttggat

SEQ ID NO: 5270 - DNA, 21 bp, Artificial sequence
  SiRNA target sequence
tcccctggatatccttggatt

SEQ ID NO: 5271 - DNA, 21 bp, Artificial sequence
  SiRNA target sequence
cccctggatatccttggatta

SEQ ID NO: 5272 - DNA, 21 bp, Artificial sequence
  SiRNA target sequence
ccctggatatccttggattaa

SEQ ID NO: 5273 - DNA, 21 bp, Artificial sequence
  SiRNA target sequence
cctggatatccttggattaag

SEQ ID NO: 5274 - DNA, 21 bp, Artificial sequence
  SiRNA target sequence
ctggatatccttggattaagg

SEQ ID NO: 5275 - DNA, 21 bp, Artificial sequence
  SiRNA target sequence
tggatatccttggattaagga

SEQ ID NO: 5276 - DNA, 21 bp, Artificial sequence
  SiRNA target sequence
ggatatccttggattaaggat

SEQ ID NO: 5277 - DNA, 21 bp, Artificial sequence
  SiRNA target sequence
gatatccttggattaaggata

SEQ ID NO: 5278 - DNA, 21 bp, Artificial sequence
  SiRNA target sequence
atatccttggattaaggatag

SEQ ID NO: 5279 - DNA, 21 bp, Artificial sequence
  SiRNA target sequence
tatccttggattaaggataga

SEQ ID NO: 5280 - DNA, 21 bp, Artificial sequence
  SiRNA target sequence
atccttggattaaggatagaa

SEQ ID NO: 5281 - DNA, 21 bp, Artificial sequence
  SiRNA target sequence
tccttggattaaggatagaac

SEQ ID NO: 5282 - DNA, 21 bp, Artificial sequence
  SiRNA target sequence
ccttggattaaggatagaaca

SEQ ID NO: 5283 - DNA, 21 bp, Artificial sequence
  SiRNA target sequence
cttggattaaggatagaacaa

SEQ ID NO: 5284 - DNA, 21 bp, Artificial sequence
  SiRNA target sequence
ttggattaaggatagaacaaa

SEQ ID NO: 5285 - DNA, 21 bp, Artificial sequence
  SiRNA target sequence
tggattaaggatagaacaaaa

SEQ ID NO: 5286 - DNA, 21 bp, Artificial sequence
  SiRNA target sequence
ggattaaggatagaacaaaag

SEQ ID NO: 5287 - DNA, 21 bp, Artificial sequence
  SiRNA target sequence
gattaaggatagaacaaaagg

SEQ ID NO: 5288 - DNA, 21 bp, Artificial sequence
  SiRNA target sequence
attaaggatagaacaaaagga

SEQ ID NO: 5289 - DNA, 21 bp, Artificial sequence
  SiRNA target sequence
ttaaggatagaacaaaaggaa

SEQ ID NO: 5290 - DNA, 21 bp, Artificial sequence
  SiRNA target sequence
taaggatagaacaaaaggaac

SEQ ID NO: 5291 - DNA, 21 bp, Artificial sequence
  SiRNA target sequence
aaggatagaacaaaaggaact

SEQ ID NO: 5292 - DNA, 21 bp, Artificial sequence
  SiRNA target sequence
aggatagaacaaaaggaacta

SEQ ID NO: 5293 - DNA, 21 bp, Artificial sequence
  SiRNA target sequence
ggatagaacaaaaggaactaa

SEQ ID NO: 5294 - DNA, 21 bp, Artificial sequence
  SiRNA target sequence
gatagaacaaaaggaactaaa

SEQ ID NO: 5295 - DNA, 21 bp, Artificial sequence
  SiRNA target sequence
atagaacaaaaggaactaaag

SEQ ID NO: 5296 - DNA, 21 bp, Artificial sequence
  SiRNA target sequence
tagaacaaaaggaactaaagg

SEQ ID NO: 5297 - DNA, 21 bp, Artificial sequence
  SiRNA target sequence
agaacaaaaggaactaaagga

SEQ ID NO: 5298 - DNA, 21 bp, Artificial sequence
  SiRNA target sequence
gaacaaaaggaactaaaggaa

SEQ ID NO: 5299 - DNA, 21 bp, Artificial sequence
  SiRNA target sequence
aacaaaaggaactaaaggaaa

SEQ ID NO: 5300 - DNA, 21 bp, Artificial sequence
  SiRNA target sequence
acaaaaggaactaaaggaaaa

SEQ ID NO: 5301 - DNA, 21 bp, Artificial sequence
  SiRNA target sequence
caaaaggaactaaaggaaaac

SEQ ID NO: 5302 - DNA, 21 bp, Artificial sequence
  SiRNA target sequence
aaaaggaactaaaggaaaaca

SEQ ID NO: 5303 - DNA, 21 bp, Artificial sequence
  SiRNA target sequence
aaaggaactaaaggaaaacaa

SEQ ID NO: 5304 - DNA, 21 bp, Artificial sequence
  SiRNA target sequence
aaggaactaaaggaaaacaag

SEQ ID NO: 5305 - DNA, 21 bp, Artificial sequence
  SiRNA target sequence
aggaactaaaggaaaacaagg

SEQ ID NO: 5306 - DNA, 21 bp, Artificial sequence
  SiRNA target sequence
ggaactaaaggaaaacaaggc

SEQ ID NO: 5307 - DNA, 21 bp, Artificial sequence
  SiRNA target sequence
gaactaaaggaaaacaaggct

SEQ ID NO: 5308 - DNA, 21 bp, Artificial sequence
  SiRNA target sequence
aactaaaggaaaacaaggctg

SEQ ID NO: 5309 - DNA, 21 bp, Artificial sequence
  SiRNA target sequence
actaaaggaaaacaaggctgg

SEQ ID NO: 5310 - DNA, 21 bp, Artificial sequence
  SiRNA target sequence
ctaaaggaaaacaaggctggt

SEQ ID NO: 5311 - DNA, 21 bp, Artificial sequence
  SiRNA target sequence
taaaggaaaacaaggctggtt

SEQ ID NO: 5312 - DNA, 21 bp, Artificial sequence
  SiRNA target sequence
aaaggaaaacaaggctggttt

SEQ ID NO: 5313 - DNA, 21 bp, Artificial sequence
  SiRNA target sequence
aaggaaaacaaggctggtttg

SEQ ID NO: 5314 - DNA, 21 bp, Artificial sequence
  SiRNA target sequence
aggaaaacaaggctggtttgg

SEQ ID NO: 5315 - DNA, 21 bp, Artificial sequence
  SiRNA target sequence
ggaaaacaaggctggtttgga

SEQ ID NO: 5316 - DNA, 21 bp, Artificial sequence
  SiRNA target sequence
gaaaacaaggctggtttggat

SEQ ID NO: 5317 - DNA, 21 bp, Artificial sequence
  SiRNA target sequence
aaaacaaggctggtttggatc

SEQ ID NO: 5318 - DNA, 21 bp, Artificial sequence
  SiRNA target sequence
aaacaaggctggtttggatct

SEQ ID NO: 5319 - DNA, 21 bp, Artificial sequence
  SiRNA target sequence
aacaaggctggtttggatctg

SEQ ID NO: 5320 - DNA, 21 bp, Artificial sequence
  SiRNA target sequence
acaaggctggtttggatctga

SEQ ID NO: 5321 - DNA, 21 bp, Artificial sequence
  SiRNA target sequence
caaggctggtttggatctgaa

SEQ ID NO: 5322 - DNA, 21 bp, Artificial sequence
  SiRNA target sequence
aaggctggtttggatctgaag

SEQ ID NO: 5323 - DNA, 21 bp, Artificial sequence
  SiRNA target sequence
aggctggtttggatctgaagg

SEQ ID NO: 5324 - DNA, 21 bp, Artificial sequence
  SiRNA target sequence
ggctggtttggatctgaagga

SEQ ID NO: 5325 - DNA, 21 bp, Artificial sequence
  SiRNA target sequence
gctggtttggatctgaaggag

SEQ ID NO: 5326 - DNA, 21 bp, Artificial sequence
  SiRNA target sequence
ctggtttggatctgaaggaga

SEQ ID NO: 5327 - DNA, 21 bp, Artificial sequence
  SiRNA target sequence
tggtttggatctgaaggagaa

SEQ ID NO: 5328 - DNA, 21 bp, Artificial sequence
  SiRNA target sequence
ggtttggatctgaaggagaat

SEQ ID NO: 5329 - DNA, 21 bp, Artificial sequence
  SiRNA target sequence
gtttggatctgaaggagaata

SEQ ID NO: 5330 - DNA, 21 bp, Artificial sequence
  SiRNA target sequence
tttggatctgaaggagaatat

SEQ ID NO: 5331 - DNA, 21 bp, Artificial sequence
  SiRNA target sequence
ttggatctgaaggagaatata

SEQ ID NO: 5332 - DNA, 21 bp, Artificial sequence
  SiRNA target sequence
tggatctgaaggagaatatat

SEQ ID NO: 5333 - DNA, 21 bp, Artificial sequence
  SiRNA target sequence
ggatctgaaggagaatatatt

SEQ ID NO: 5334 - DNA, 21 bp, Artificial sequence
  SiRNA target sequence
gatctgaaggagaatatattc

SEQ ID NO: 5335 - DNA, 21 bp, Artificial sequence
  SiRNA target sequence
atctgaaggagaatatattct

SEQ ID NO: 5336 - DNA, 21 bp, Artificial sequence
  SiRNA target sequence
tctgaaggagaatatattctc

SEQ ID NO: 5337 - DNA, 21 bp, Artificial sequence
  SiRNA target sequence
ctgaaggagaatatattctca

SEQ ID NO: 5338 - DNA, 21 bp, Artificial sequence
  SiRNA target sequence
tgaaggagaatatattctcaa

SEQ ID NO: 5339 - DNA, 21 bp, Artificial sequence
  SiRNA target sequence
gaaggagaatatattctcaat

SEQ ID NO: 5340 - DNA, 21 bp, Artificial sequence
  SiRNA target sequence
aaggagaatatattctcaatg

SEQ ID NO: 5341 - DNA, 21 bp, Artificial sequence
  SiRNA target sequence
aggagaatatattctcaatga

SEQ ID NO: 5342 - DNA, 21 bp, Artificial sequence
  SiRNA target sequence
ggagaatatattctcaatgaa

SEQ ID NO: 5343 - DNA, 21 bp, Artificial sequence
  SiRNA target sequence
gagaatatattctcaatgaag

SEQ ID NO: 5344 - DNA, 21 bp, Artificial sequence
  SiRNA target sequence
agaatatattctcaatgaaga

SEQ ID NO: 5345 - DNA, 21 bp, Artificial sequence
  SiRNA target sequence
gaatatattctcaatgaagat

SEQ ID NO: 5346 - DNA, 21 bp, Artificial sequence
  SiRNA target sequence
aatatattctcaatgaagatg

SEQ ID NO: 5347 - DNA, 21 bp, Artificial sequence
  SiRNA target sequence
atatattctcaatgaagatgt

SEQ ID NO: 5348 - DNA, 21 bp, Artificial sequence
  SiRNA target sequence
tatattctcaatgaagatgtt

SEQ ID NO: 5349 - DNA, 21 bp, Artificial sequence
  SiRNA target sequence
atattctcaatgaagatgtta

SEQ ID NO: 5350 - DNA, 21 bp, Artificial sequence
  SiRNA target sequence
tattctcaatgaagatgttag

SEQ ID NO: 5351 - DNA, 21 bp, Artificial sequence
  SiRNA target sequence
attctcaatgaagatgttaga

SEQ ID NO: 5352 - DNA, 21 bp, Artificial sequence
  SiRNA target sequence
ttctcaatgaagatgttagac

SEQ ID NO: 5353 - DNA, 21 bp, Artificial sequence
  SiRNA target sequence
tctcaatgaagatgttagact

SEQ ID NO: 5354 - DNA, 21 bp, Artificial sequence
  SiRNA target sequence
ctcaatgaagatgttagactg

SEQ ID NO: 5355 - DNA, 21 bp, Artificial sequence
  SiRNA target sequence
tcaatgaagatgttagactgg

SEQ ID NO: 5356 - DNA, 21 bp, Artificial sequence
  SiRNA target sequence
caatgaagatgttagactggc

SEQ ID NO: 5357 - DNA, 21 bp, Artificial sequence
  SiRNA target sequence
aatgaagatgttagactggcc

SEQ ID NO: 5358 - DNA, 21 bp, Artificial sequence
  SiRNA target sequence
atgaagatgttagactggccg

SEQ ID NO: 5359 - DNA, 21 bp, Artificial sequence
  SiRNA target sequence
tgaagatgttagactggccgt

SEQ ID NO: 5360 - DNA, 21 bp, Artificial sequence
  SiRNA target sequence
gaagatgttagactggccgtt

SEQ ID NO: 5361 - DNA, 21 bp, Artificial sequence
  SiRNA target sequence
aagatgttagactggccgttc

SEQ ID NO: 5362 - DNA, 21 bp, Artificial sequence
  SiRNA target sequence
agatgttagactggccgttca

SEQ ID NO: 5363 - DNA, 21 bp, Artificial sequence
  SiRNA target sequence
gatgttagactggccgttcaa

SEQ ID NO: 5364 - DNA, 21 bp, Artificial sequence
  SiRNA target sequence
atgttagactggccgttcaac

SEQ ID NO: 5365 - DNA, 21 bp, Artificial sequence
  SiRNA target sequence
tgttagactggccgttcaacg

SEQ ID NO: 5366 - DNA, 21 bp, Artificial sequence
  SiRNA target sequence
gttagactggccgttcaacga

SEQ ID NO: 5367 - DNA, 21 bp, Artificial sequence
  SiRNA target sequence
ttagactggccgttcaacgac

SEQ ID NO: 5368 - DNA, 21 bp, Artificial sequence
  SiRNA target sequence
tagactggccgttcaacgacg

SEQ ID NO: 5369 - DNA, 21 bp, Artificial sequence
  SiRNA target sequence
agactggccgttcaacgacga

SEQ ID NO: 5370 - DNA, 21 bp, Artificial sequence
  SiRNA target sequence
gactggccgttcaacgacgaa

SEQ ID NO: 5371 - DNA, 21 bp, Artificial sequence
  SiRNA target sequence
actggccgttcaacgacgaat

SEQ ID NO: 5372 - DNA, 21 bp, Artificial sequence
  SiRNA target sequence
ctggccgttcaacgacgaatt

SEQ ID NO: 5373 - DNA, 21 bp, Artificial sequence
  SiRNA target sequence
tggccgttcaacgacgaattc

SEQ ID NO: 5374 - DNA, 21 bp, Artificial sequence
  SiRNA target sequence
ggccgttcaacgacgaattca

SEQ ID NO: 5375 - DNA, 21 bp, Artificial sequence
  SiRNA target sequence
gccgttcaacgacgaattcag

SEQ ID NO: 5376 - DNA, 21 bp, Artificial sequence
  SiRNA target sequence
ccgttcaacgacgaattcagg

SEQ ID NO: 5377 - DNA, 21 bp, Artificial sequence
  SiRNA target sequence
cgttcaacgacgaattcaggc

SEQ ID NO: 5378 - DNA, 21 bp, Artificial sequence
  SiRNA target sequence
gttcaacgacgaattcaggca

SEQ ID NO: 5379 - DNA, 21 bp, Artificial sequence
  SiRNA target sequence
ttcaacgacgaattcaggcag

SEQ ID NO: 5380 - DNA, 21 bp, Artificial sequence
  SiRNA target sequence
tcaacgacgaattcaggcagc

SEQ ID NO: 5381 - DNA, 21 bp, Artificial sequence
  SiRNA target sequence
caacgacgaattcaggcagct

SEQ ID NO: 5382 - DNA, 21 bp, Artificial sequence
  SiRNA target sequence
aacgacgaattcaggcagctc

SEQ ID NO: 5383 - DNA, 21 bp, Artificial sequence
  SiRNA target sequence
acgacgaattcaggcagctcg

SEQ ID NO: 5384 - DNA, 21 bp, Artificial sequence
  SiRNA target sequence
cgacgaattcaggcagctcgt

SEQ ID NO: 5385 - DNA, 21 bp, Artificial sequence
  SiRNA target sequence
gacgaattcaggcagctcgtg

SEQ ID NO: 5386 - DNA, 21 bp, Artificial sequence
  SiRNA target sequence
acgaattcaggcagctcgtga

SEQ ID NO: 5387 - DNA, 21 bp, Artificial sequence
  SiRNA target sequence
cgaattcaggcagctcgtgaa

SEQ ID NO: 5388 - DNA, 21 bp, Artificial sequence
  SiRNA target sequence
gaattcaggcagctcgtgaag

SEQ ID NO: 5389 - DNA, 21 bp, Artificial sequence
  SiRNA target sequence
aattcaggcagctcgtgaagg

SEQ ID NO: 5390 - DNA, 21 bp, Artificial sequence
  SiRNA target sequence
attcaggcagctcgtgaagga

SEQ ID NO: 5391 - DNA, 21 bp, Artificial sequence
  SiRNA target sequence
ttcaggcagctcgtgaaggaa

SEQ ID NO: 5392 - DNA, 21 bp, Artificial sequence
  SiRNA target sequence
tcaggcagctcgtgaaggaaa

SEQ ID NO: 5393 - DNA, 21 bp, Artificial sequence
  SiRNA target sequence
caggcagctcgtgaaggaaaa

SEQ ID NO: 5394 - DNA, 21 bp, Artificial sequence
  SiRNA target sequence
aggcagctcgtgaaggaaaac

SEQ ID NO: 5395 - DNA, 21 bp, Artificial sequence
  SiRNA target sequence
ggcagctcgtgaaggaaaacg

SEQ ID NO: 5396 - DNA, 21 bp, Artificial sequence
  SiRNA target sequence
gcagctcgtgaaggaaaacga

SEQ ID NO: 5397 - DNA, 21 bp, Artificial sequence
  SiRNA target sequence
cagctcgtgaaggaaaacgat

SEQ ID NO: 5398 - DNA, 21 bp, Artificial sequence
  SiRNA target sequence
agctcgtgaaggaaaacgatt

SEQ ID NO: 5399 - DNA, 21 bp, Artificial sequence
  SiRNA target sequence
gctcgtgaaggaaaacgatta

SEQ ID NO: 5400 - DNA, 21 bp, Artificial sequence
  SiRNA target sequence
ctcgtgaaggaaaacgattac

SEQ ID NO: 5401 - DNA, 21 bp, Artificial sequence
  SiRNA target sequence
tcgtgaaggaaaacgattacc

SEQ ID NO: 5402 - DNA, 21 bp, Artificial sequence
  SiRNA target sequence
cgtgaaggaaaacgattacct

SEQ ID NO: 5403 - DNA, 21 bp, Artificial sequence
  SiRNA target sequence
gtgaaggaaaacgattacctg

SEQ ID NO: 5404 - DNA, 21 bp, Artificial sequence
  SiRNA target sequence
tgaaggaaaacgattacctgt

SEQ ID NO: 5405 - DNA, 21 bp, Artificial sequence
  SiRNA target sequence
gaaggaaaacgattacctgta

SEQ ID NO: 5406 - DNA, 21 bp, Artificial sequence
  SiRNA target sequence
aaggaaaacgattacctgtaa

SEQ ID NO: 5407 - DNA, 21 bp, Artificial sequence
  SiRNA target sequence
aggaaaacgattacctgtaat

SEQ ID NO: 5408 - DNA, 21 bp, Artificial sequence
  SiRNA target sequence
ggaaaacgattacctgtaatg

SEQ ID NO: 5409 - DNA, 21 bp, Artificial sequence
  SiRNA target sequence
gaaaacgattacctgtaatgt

SEQ ID NO: 5410 - DNA, 21 bp, Artificial sequence
  SiRNA target sequence
aaaacgattacctgtaatgtg

SEQ ID NO: 5411 - DNA, 21 bp, Artificial sequence
  SiRNA target sequence
aaacgattacctgtaatgtgg

SEQ ID NO: 5412 - DNA, 21 bp, Artificial sequence
  SiRNA target sequence
aacgattacctgtaatgtggg

SEQ ID NO: 5413 - DNA, 21 bp, Artificial sequence
  SiRNA target sequence
acgattacctgtaatgtgggt

SEQ ID NO: 5414 - DNA, 21 bp, Artificial sequence
  SiRNA target sequence
cgattacctgtaatgtgggtt

SEQ ID NO: 5415 - DNA, 21 bp, Artificial sequence
  SiRNA target sequence
gattacctgtaatgtgggttg

SEQ ID NO: 5416 - DNA, 21 bp, Artificial sequence
  SiRNA target sequence
attacctgtaatgtgggttga

SEQ ID NO: 5417 - DNA, 21 bp, Artificial sequence
  SiRNA target sequence
ttacctgtaatgtgggttgat

SEQ ID NO: 5418 - DNA, 21 bp, Artificial sequence
  SiRNA target sequence
tacctgtaatgtgggttgata

SEQ ID NO: 5419 - DNA, 21 bp, Artificial sequence
  SiRNA target sequence
acctgtaatgtgggttgatac

SEQ ID NO: 5420 - DNA, 21 bp, Artificial sequence
  SiRNA target sequence
cctgtaatgtgggttgataca

SEQ ID NO: 5421 - DNA, 21 bp, Artificial sequence
  SiRNA target sequence
ctgtaatgtgggttgatacat

SEQ ID NO: 5422 - DNA, 21 bp, Artificial sequence
  SiRNA target sequence
tgtaatgtgggttgatacatt

SEQ ID NO: 5423 - DNA, 21 bp, Artificial sequence
  SiRNA target sequence
gtaatgtgggttgatacattg

SEQ ID NO: 5424 - DNA, 21 bp, Artificial sequence
  SiRNA target sequence
taatgtgggttgatacattga

SEQ ID NO: 5425 - DNA, 21 bp, Artificial sequence
  SiRNA target sequence
aatgtgggttgatacattgaa

SEQ ID NO: 5426 - DNA, 21 bp, Artificial sequence
  SiRNA target sequence
atgtgggttgatacattgaaa

SEQ ID NO: 5427 - DNA, 21 bp, Artificial sequence
  SiRNA target sequence
tgtgggttgatacattgaaag

SEQ ID NO: 5428 - DNA, 21 bp, Artificial sequence
  SiRNA target sequence
gtgggttgatacattgaaaga

SEQ ID NO: 5429 - DNA, 21 bp, Artificial sequence
  SiRNA target sequence
tgggttgatacattgaaagat

SEQ ID NO: 5430 - DNA, 21 bp, Artificial sequence
  SiRNA target sequence
gggttgatacattgaaagatg

SEQ ID NO: 5431 - DNA, 21 bp, Artificial sequence
  SiRNA target sequence
ggttgatacattgaaagatga

SEQ ID NO: 5432 - DNA, 21 bp, Artificial sequence
  SiRNA target sequence
gttgatacattgaaagatgag

SEQ ID NO: 5433 - DNA, 21 bp, Artificial sequence
  SiRNA target sequence
ttgatacattgaaagatgagc

SEQ ID NO: 5434 - DNA, 21 bp, Artificial sequence
  SiRNA target sequence
tgatacattgaaagatgagcg

SEQ ID NO: 5435 - DNA, 21 bp, Artificial sequence
  SiRNA target sequence
gatacattgaaagatgagcgt

SEQ ID NO: 5436 - DNA, 21 bp, Artificial sequence
  SiRNA target sequence
atacattgaaagatgagcgtc

SEQ ID NO: 5437 - DNA, 21 bp, Artificial sequence
  SiRNA target sequence
tacattgaaagatgagcgtcg

SEQ ID NO: 5438 - DNA, 21 bp, Artificial sequence
  SiRNA target sequence
acattgaaagatgagcgtcga

SEQ ID NO: 5439 - DNA, 21 bp, Artificial sequence
  SiRNA target sequence
cattgaaagatgagcgtcgac

SEQ ID NO: 5440 - DNA, 21 bp, Artificial sequence
  SiRNA target sequence
attgaaagatgagcgtcgacc

SEQ ID NO: 5441 - DNA, 21 bp, Artificial sequence
  SiRNA target sequence
ttgaaagatgagcgtcgaccc

SEQ ID NO: 5442 - DNA, 21 bp, Artificial sequence
  SiRNA target sequence
tgaaagatgagcgtcgaccca

SEQ ID NO: 5443 - DNA, 21 bp, Artificial sequence
  SiRNA target sequence
gaaagatgagcgtcgacccat

SEQ ID NO: 5444 - DNA, 21 bp, Artificial sequence
  SiRNA target sequence
aaagatgagcgtcgacccatt

SEQ ID NO: 5445 - DNA, 21 bp, Artificial sequence
  SiRNA target sequence
aagatgagcgtcgacccattg

SEQ ID NO: 5446 - DNA, 21 bp, Artificial sequence
  SiRNA target sequence
agatgagcgtcgacccattga

SEQ ID NO: 5447 - DNA, 21 bp, Artificial sequence
  SiRNA target sequence
gatgagcgtcgacccattgaa

SEQ ID NO: 5448 - DNA, 21 bp, Artificial sequence
  SiRNA target sequence
atgagcgtcgacccattgaaa

SEQ ID NO: 5449 - DNA, 21 bp, Artificial sequence
  SiRNA target sequence
tgagcgtcgacccattgaaaa

SEQ ID NO: 5450 - DNA, 21 bp, Artificial sequence
  SiRNA target sequence
gagcgtcgacccattgaaaaa

SEQ ID NO: 5451 - DNA, 21 bp, Artificial sequence
  SiRNA target sequence
agcgtcgacccattgaaaaag

SEQ ID NO: 5452 - DNA, 21 bp, Artificial sequence
  SiRNA target sequence
gcgtcgacccattgaaaaagt

SEQ ID NO: 5453 - DNA, 21 bp, Artificial sequence
  SiRNA target sequence
cgtcgacccattgaaaaagtt

SEQ ID NO: 5454 - DNA, 21 bp, Artificial sequence
  SiRNA target sequence
gtcgacccattgaaaaagtta

SEQ ID NO: 5455 - DNA, 21 bp, Artificial sequence
  SiRNA target sequence
tcgacccattgaaaaagttaa

SEQ ID NO: 5456 - DNA, 21 bp, Artificial sequence
  SiRNA target sequence
cgacccattgaaaaagttaat

SEQ ID NO: 5457 - DNA, 21 bp, Artificial sequence
  SiRNA target sequence
gacccattgaaaaagttaatc

SEQ ID NO: 5458 - DNA, 21 bp, Artificial sequence
  SiRNA target sequence
acccattgaaaaagttaatca

SEQ ID NO: 5459 - DNA, 21 bp, Artificial sequence
  SiRNA target sequence
cccattgaaaaagttaatcaa

SEQ ID NO: 5460 - DNA, 21 bp, Artificial sequence
  SiRNA target sequence
ccattgaaaaagttaatcaat

SEQ ID NO: 5461 - DNA, 21 bp, Artificial sequence
  SiRNA target sequence
cattgaaaaagttaatcaatt

SEQ ID NO: 5462 - DNA, 21 bp, Artificial sequence
  SiRNA target sequence
attgaaaaagttaatcaattg

SEQ ID NO: 5463 - DNA, 21 bp, Artificial sequence
  SiRNA target sequence
ttgaaaaagttaatcaattga

SEQ ID NO: 5464 - DNA, 21 bp, Artificial sequence
  SiRNA target sequence
tgaaaaagttaatcaattgaa

SEQ ID NO: 5465 - DNA, 21 bp, Artificial sequence
  SiRNA target sequence
gaaaaagttaatcaattgaaa

SEQ ID NO: 5466 - DNA, 21 bp, Artificial sequence
  SiRNA target sequence
aaaaagttaatcaattgaaaa

SEQ ID NO: 5467 - DNA, 21 bp, Artificial sequence
  SiRNA target sequence
aaaagttaatcaattgaaaac

SEQ ID NO: 5468 - DNA, 21 bp, Artificial sequence
  SiRNA target sequence
aaagttaatcaattgaaaaca

SEQ ID NO: 5469 - DNA, 21 bp, Artificial sequence
  SiRNA target sequence
aagttaatcaattgaaaacac

SEQ ID NO: 5470 - DNA, 21 bp, Artificial sequence
  SiRNA target sequence
agttaatcaattgaaaacacg

SEQ ID NO: 5471 - DNA, 21 bp, Artificial sequence
  SiRNA target sequence
gttaatcaattgaaaacacga

SEQ ID NO: 5472 - DNA, 21 bp, Artificial sequence
  SiRNA target sequence
ttaatcaattgaaaacacgag

SEQ ID NO: 5473 - DNA, 21 bp, Artificial sequence
  SiRNA target sequence
taatcaattgaaaacacgagt

SEQ ID NO: 5474 - DNA, 21 bp, Artificial sequence
  SiRNA target sequence
aatcaattgaaaacacgagta

SEQ ID NO: 5475 - DNA, 21 bp, Artificial sequence
  SiRNA target sequence
atcaattgaaaacacgagtat

SEQ ID NO: 5476 - DNA, 21 bp, Artificial sequence
  SiRNA target sequence
tcaattgaaaacacgagtatt

SEQ ID NO: 5477 - DNA, 21 bp, Artificial sequence
  SiRNA target sequence
caattgaaaacacgagtattc

SEQ ID NO: 5478 - DNA, 21 bp, Artificial sequence
  SiRNA target sequence
aattgaaaacacgagtattct

SEQ ID NO: 5479 - DNA, 21 bp, Artificial sequence
  SiRNA target sequence
attgaaaacacgagtattctc

SEQ ID NO: 5480 - DNA, 21 bp, Artificial sequence
  SiRNA target sequence
ttgaaaacacgagtattctca

SEQ ID NO: 5481 - DNA, 21 bp, Artificial sequence
  SiRNA target sequence
tgaaaacacgagtattctcaa

SEQ ID NO: 5482 - DNA, 21 bp, Artificial sequence
  SiRNA target sequence
gaaaacacgagtattctcaaa

SEQ ID NO: 5483 - DNA, 21 bp, Artificial sequence
  SiRNA target sequence
aaaacacgagtattctcaaat

SEQ ID NO: 5484 - DNA, 21 bp, Artificial sequence
  SiRNA target sequence
aaacacgagtattctcaaatg

SEQ ID NO: 5485 - DNA, 21 bp, Artificial sequence
  SiRNA target sequence
aacacgagtattctcaaatgg

SEQ ID NO: 5486 - DNA, 21 bp, Artificial sequence
  SiRNA target sequence
acacgagtattctcaaatgga

SEQ ID NO: 5487 - DNA, 21 bp, Artificial sequence
  SiRNA target sequence
cacgagtattctcaaatggac

SEQ ID NO: 5488 - DNA, 21 bp, Artificial sequence
  SiRNA target sequence
acgagtattctcaaatggacc

SEQ ID NO: 5489 - DNA, 21 bp, Artificial sequence
  SiRNA target sequence
cgagtattctcaaatggacca

SEQ ID NO: 5490 - DNA, 21 bp, Artificial sequence
  SiRNA target sequence
gagtattctcaaatggaccaa

SEQ ID NO: 5491 - DNA, 21 bp, Artificial sequence
  SiRNA target sequence
agtattctcaaatggaccaat

SEQ ID NO: 5492 - DNA, 21 bp, Artificial sequence
  SiRNA target sequence
gtattctcaaatggaccaatg

SEQ ID NO: 5493 - DNA, 21 bp, Artificial sequence
  SiRNA target sequence
tattctcaaatggaccaatgg

SEQ ID NO: 5494 - DNA, 21 bp, Artificial sequence
  SiRNA target sequence
attctcaaatggaccaatgga

SEQ ID NO: 5495 - DNA, 21 bp, Artificial sequence
  SiRNA target sequence
ttctcaaatggaccaatggat

SEQ ID NO: 5496 - DNA, 21 bp, Artificial sequence
  SiRNA target sequence
tctcaaatggaccaatggatt

SEQ ID NO: 5497 - DNA, 21 bp, Artificial sequence
  SiRNA target sequence
ctcaaatggaccaatggattt

SEQ ID NO: 5498 - DNA, 21 bp, Artificial sequence
  SiRNA target sequence
tcaaatggaccaatggatttc

SEQ ID NO: 5499 - DNA, 21 bp, Artificial sequence
  SiRNA target sequence
caaatggaccaatggatttct

SEQ ID NO: 5500 - DNA, 21 bp, Artificial sequence
  SiRNA target sequence
aaatggaccaatggatttctc

SEQ ID NO: 5501 - DNA, 21 bp, Artificial sequence
  SiRNA target sequence
aatggaccaatggatttctct

SEQ ID NO: 5502 - DNA, 21 bp, Artificial sequence
  SiRNA target sequence
atggaccaatggatttctcta

SEQ ID NO: 5503 - DNA, 21 bp, Artificial sequence
  SiRNA target sequence
tggaccaatggatttctctat

SEQ ID NO: 5504 - DNA, 21 bp, Artificial sequence
  SiRNA target sequence
ggaccaatggatttctctata

SEQ ID NO: 5505 - DNA, 21 bp, Artificial sequence
  SiRNA target sequence
gaccaatggatttctctatag

SEQ ID NO: 5506 - DNA, 21 bp, Artificial sequence
  SiRNA target sequence
accaatggatttctctatagc

SEQ ID NO: 5507 - DNA, 21 bp, Artificial sequence
  SiRNA target sequence
ccaatggatttctctatagct

SEQ ID NO: 5508 - DNA, 21 bp, Artificial sequence
  SiRNA target sequence
caatggatttctctatagctt

SEQ ID NO: 5509 - DNA, 21 bp, Artificial sequence
  SiRNA target sequence
aatggatttctctatagcttt

SEQ ID NO: 5510 - DNA, 21 bp, Artificial sequence
  SiRNA target sequence
atggatttctctatagctttt

SEQ ID NO: 5511 - DNA, 21 bp, Artificial sequence
  SiRNA target sequence
tggatttctctatagcttttc

SEQ ID NO: 5512 - DNA, 21 bp, Artificial sequence
  SiRNA target sequence
ggatttctctatagcttttcg

SEQ ID NO: 5513 - DNA, 21 bp, Artificial sequence
  SiRNA target sequence
gatttctctatagcttttcga

SEQ ID NO: 5514 - DNA, 21 bp, Artificial sequence
  SiRNA target sequence
atttctctatagcttttcgaa

SEQ ID NO: 5515 - DNA, 21 bp, Artificial sequence
  SiRNA target sequence
tttctctatagcttttcgaat

SEQ ID NO: 5516 - DNA, 21 bp, Artificial sequence
  SiRNA target sequence
ttctctatagcttttcgaatg

SEQ ID NO: 5517 - DNA, 21 bp, Artificial sequence
  SiRNA target sequence
tctctatagcttttcgaatgt

SEQ ID NO: 5518 - DNA, 21 bp, Artificial sequence
  SiRNA target sequence
ctctatagcttttcgaatgta

SEQ ID NO: 5519 - DNA, 21 bp, Artificial sequence
  SiRNA target sequence
tctatagcttttcgaatgtat

SEQ ID NO: 5520 - DNA, 21 bp, Artificial sequence
  SiRNA target sequence
ctatagcttttcgaatgtatt

SEQ ID NO: 5521 - DNA, 21 bp, Artificial sequence
  SiRNA target sequence
tatagcttttcgaatgtatta

SEQ ID NO: 5522 - DNA, 21 bp, Artificial sequence
  SiRNA target sequence
atagcttttcgaatgtattat

SEQ ID NO: 5523 - DNA, 21 bp, Artificial sequence
  SiRNA target sequence
tagcttttcgaatgtattatt

SEQ ID NO: 5524 - DNA, 21 bp, Artificial sequence
  SiRNA target sequence
agcttttcgaatgtattattt

SEQ ID NO: 5525 - DNA, 21 bp, Artificial sequence
  SiRNA target sequence
gcttttcgaatgtattatttg

SEQ ID NO: 5526 - DNA, 21 bp, Artificial sequence
  SiRNA target sequence
cttttcgaatgtattatttgg

SEQ ID NO: 5527 - DNA, 21 bp, Artificial sequence
  SiRNA target sequence
ttttcgaatgtattatttggg

SEQ ID NO: 5528 - DNA, 21 bp, Artificial sequence
  SiRNA target sequence
tttcgaatgtattatttgggc

SEQ ID NO: 5529 - DNA, 21 bp, Artificial sequence
  SiRNA target sequence
ttcgaatgtattatttgggct

SEQ ID NO: 5530 - DNA, 21 bp, Artificial sequence
  SiRNA target sequence
tcgaatgtattatttgggctt

SEQ ID NO: 5531 - DNA, 21 bp, Artificial sequence
  SiRNA target sequence
cgaatgtattatttgggcttt

SEQ ID NO: 5532 - DNA, 21 bp, Artificial sequence
  SiRNA target sequence
gaatgtattatttgggcttta

SEQ ID NO: 5533 - DNA, 21 bp, Artificial sequence
  SiRNA target sequence
aatgtattatttgggctttat

SEQ ID NO: 5534 - DNA, 21 bp, Artificial sequence
  SiRNA target sequence
atgtattatttgggctttata

SEQ ID NO: 5535 - DNA, 21 bp, Artificial sequence
  SiRNA target sequence
tgtattatttgggctttatag

SEQ ID NO: 5536 - DNA, 21 bp, Artificial sequence
  SiRNA target sequence
gtattatttgggctttatagc

SEQ ID NO: 5537 - DNA, 21 bp, Artificial sequence
  SiRNA target sequence
tattatttgggctttatagct

SEQ ID NO: 5538 - DNA, 21 bp, Artificial sequence
  SiRNA target sequence
attatttgggctttatagctc

SEQ ID NO: 5539 - DNA, 21 bp, Artificial sequence
  SiRNA target sequence
ttatttgggctttatagctca

SEQ ID NO: 5540 - DNA, 21 bp, Artificial sequence
  SiRNA target sequence
tatttgggctttatagctcat

SEQ ID NO: 5541 - DNA, 21 bp, Artificial sequence
  SiRNA target sequence
atttgggctttatagctcatt

SEQ ID NO: 5542 - DNA, 21 bp, Artificial sequence
  SiRNA target sequence
tttgggctttatagctcattt

SEQ ID NO: 5543 - DNA, 21 bp, Artificial sequence
  SiRNA target sequence
ttgggctttatagctcatttg

SEQ ID NO: 5544 - DNA, 21 bp, Artificial sequence
  SiRNA target sequence
tgggctttatagctcatttga

SEQ ID NO: 5545 - DNA, 21 bp, Artificial sequence
  SiRNA target sequence
gggctttatagctcatttgat

SEQ ID NO: 5546 - DNA, 21 bp, Artificial sequence
  SiRNA target sequence
ggctttatagctcatttgatg

SEQ ID NO: 5547 - DNA, 21 bp, Artificial sequence
  SiRNA target sequence
gctttatagctcatttgatgg

SEQ ID NO: 5548 - DNA, 21 bp, Artificial sequence
  SiRNA target sequence
ctttatagctcatttgatgga

SEQ ID NO: 5549 - DNA, 21 bp, Artificial sequence
  SiRNA target sequence
tttatagctcatttgatggaa

SEQ ID NO: 5550 - DNA, 21 bp, Artificial sequence
  SiRNA target sequence
ttatagctcatttgatggaaa

SEQ ID NO: 5551 - DNA, 21 bp, Artificial sequence
  SiRNA target sequence
tatagctcatttgatggaaaa

SEQ ID NO: 5552 - DNA, 21 bp, Artificial sequence
  SiRNA target sequence
atagctcatttgatggaaaat

SEQ ID NO: 5553 - DNA, 21 bp, Artificial sequence
  SiRNA target sequence
tagctcatttgatggaaaatc

SEQ ID NO: 5554 - DNA, 21 bp, Artificial sequence
  SiRNA target sequence
agctcatttgatggaaaatcg

SEQ ID NO: 5555 - DNA, 21 bp, Artificial sequence
  SiRNA target sequence
gctcatttgatggaaaatcga

SEQ ID NO: 5556 - DNA, 21 bp, Artificial sequence
  SiRNA target sequence
ctcatttgatggaaaatcgaa

SEQ ID NO: 5557 - DNA, 21 bp, Artificial sequence
  SiRNA target sequence
tcatttgatggaaaatcgaat

SEQ ID NO: 5558 - DNA, 21 bp, Artificial sequence
  SiRNA target sequence
catttgatggaaaatcgaatt

SEQ ID NO: 5559 - DNA, 21 bp, Artificial sequence
  SiRNA target sequence
atttgatggaaaatcgaatta

SEQ ID NO: 5560 - DNA, 21 bp, Artificial sequence
  SiRNA target sequence
tttgatggaaaatcgaattac

SEQ ID NO: 5561 - DNA, 21 bp, Artificial sequence
  SiRNA target sequence
ttgatggaaaatcgaattact

SEQ ID NO: 5562 - DNA, 21 bp, Artificial sequence
  SiRNA target sequence
tgatggaaaatcgaattacta

SEQ ID NO: 5563 - DNA, 21 bp, Artificial sequence
  SiRNA target sequence
gatggaaaatcgaattactaa

SEQ ID NO: 5564 - DNA, 21 bp, Artificial sequence
  SiRNA target sequence
atggaaaatcgaattactaat

SEQ ID NO: 5565 - DNA, 21 bp, Artificial sequence
  SiRNA target sequence
tggaaaatcgaattactaatg

SEQ ID NO: 5566 - DNA, 21 bp, Artificial sequence
  SiRNA target sequence
ggaaaatcgaattactaatga

SEQ ID NO: 5567 - DNA, 21 bp, Artificial sequence
  SiRNA target sequence
gaaaatcgaattactaatgag

SEQ ID NO: 5568 - DNA, 21 bp, Artificial sequence
  SiRNA target sequence
aaaatcgaattactaatgagg

SEQ ID NO: 5569 - DNA, 21 bp, Artificial sequence
  SiRNA target sequence
aaatcgaattactaatgaggt

SEQ ID NO: 5570 - DNA, 21 bp, Artificial sequence
  SiRNA target sequence
aatcgaattactaatgaggtg

SEQ ID NO: 5571 - DNA, 21 bp, Artificial sequence
  SiRNA target sequence
atcgaattactaatgaggtgt

SEQ ID NO: 5572 - DNA, 21 bp, Artificial sequence
  SiRNA target sequence
tcgaattactaatgaggtgtc

SEQ ID NO: 5573 - DNA, 21 bp, Artificial sequence
  SiRNA target sequence
cgaattactaatgaggtgtcc

SEQ ID NO: 5574 - DNA, 21 bp, Artificial sequence
  SiRNA target sequence
gaattactaatgaggtgtcca

SEQ ID NO: 5575 - DNA, 21 bp, Artificial sequence
  SiRNA target sequence
aattactaatgaggtgtccat

SEQ ID NO: 5576 - DNA, 21 bp, Artificial sequence
  SiRNA target sequence
attactaatgaggtgtccatt

SEQ ID NO: 5577 - DNA, 21 bp, Artificial sequence
  SiRNA target sequence
ttactaatgaggtgtccattg

SEQ ID NO: 5578 - DNA, 21 bp, Artificial sequence
  SiRNA target sequence
tactaatgaggtgtccattgg

SEQ ID NO: 5579 - DNA, 21 bp, Artificial sequence
  SiRNA target sequence
actaatgaggtgtccattgga

SEQ ID NO: 5580 - DNA, 21 bp, Artificial sequence
  SiRNA target sequence
ctaatgaggtgtccattggaa

SEQ ID NO: 5581 - DNA, 21 bp, Artificial sequence
  SiRNA target sequence
taatgaggtgtccattggaac

SEQ ID NO: 5582 - DNA, 21 bp, Artificial sequence
  SiRNA target sequence
aatgaggtgtccattggaacg

SEQ ID NO: 5583 - DNA, 21 bp, Artificial sequence
  SiRNA target sequence
atgaggtgtccattggaacga

SEQ ID NO: 5584 - DNA, 21 bp, Artificial sequence
  SiRNA target sequence
tgaggtgtccattggaacgaa

SEQ ID NO: 5585 - DNA, 21 bp, Artificial sequence
  SiRNA target sequence
gaggtgtccattggaacgaat

SEQ ID NO: 5586 - DNA, 21 bp, Artificial sequence
  SiRNA target sequence
aggtgtccattggaacgaatg

SEQ ID NO: 5587 - DNA, 21 bp, Artificial sequence
  SiRNA target sequence
ggtgtccattggaacgaatgt

SEQ ID NO: 5588 - DNA, 21 bp, Artificial sequence
  SiRNA target sequence
gtgtccattggaacgaatgtg

SEQ ID NO: 5589 - DNA, 21 bp, Artificial sequence
  SiRNA target sequence
tgtccattggaacgaatgtgt

SEQ ID NO: 5590 - DNA, 21 bp, Artificial sequence
  SiRNA target sequence
gtccattggaacgaatgtgta

SEQ ID NO: 5591 - DNA, 21 bp, Artificial sequence
  SiRNA target sequence
tccattggaacgaatgtgtat

SEQ ID NO: 5592 - DNA, 21 bp, Artificial sequence
  SiRNA target sequence
ccattggaacgaatgtgtatt

SEQ ID NO: 5593 - DNA, 21 bp, Artificial sequence
  SiRNA target sequence
cattggaacgaatgtgtattc

SEQ ID NO: 5594 - DNA, 21 bp, Artificial sequence
  SiRNA target sequence
attggaacgaatgtgtattct

SEQ ID NO: 5595 - DNA, 21 bp, Artificial sequence
  SiRNA target sequence
ttggaacgaatgtgtattctc

SEQ ID NO: 5596 - DNA, 21 bp, Artificial sequence
  SiRNA target sequence
tggaacgaatgtgtattctca

SEQ ID NO: 5597 - DNA, 21 bp, Artificial sequence
  SiRNA target sequence
ggaacgaatgtgtattctcaa

SEQ ID NO: 5598 - DNA, 21 bp, Artificial sequence
  SiRNA target sequence
gaacgaatgtgtattctcaag

SEQ ID NO: 5599 - DNA, 21 bp, Artificial sequence
  SiRNA target sequence
aacgaatgtgtattctcaaga

SEQ ID NO: 5600 - DNA, 21 bp, Artificial sequence
  SiRNA target sequence
acgaatgtgtattctcaagac

SEQ ID NO: 5601 - DNA, 21 bp, Artificial sequence
  SiRNA target sequence
cgaatgtgtattctcaagact

SEQ ID NO: 5602 - DNA, 21 bp, Artificial sequence
  SiRNA target sequence
gaatgtgtattctcaagactg

SEQ ID NO: 5603 - DNA, 21 bp, Artificial sequence
  SiRNA target sequence
aatgtgtattctcaagactgg

SEQ ID NO: 5604 - DNA, 21 bp, Artificial sequence
  SiRNA target sequence
atgtgtattctcaagactgga

SEQ ID NO: 5605 - DNA, 21 bp, Artificial sequence
  SiRNA target sequence
tgtgtattctcaagactggag

SEQ ID NO: 5606 - DNA, 21 bp, Artificial sequence
  SiRNA target sequence
gtgtattctcaagactggagt

SEQ ID NO: 5607 - DNA, 21 bp, Artificial sequence
  SiRNA target sequence
tgtattctcaagactggagta

SEQ ID NO: 5608 - DNA, 21 bp, Artificial sequence
  SiRNA target sequence
gtattctcaagactggagtaa

SEQ ID NO: 5609 - DNA, 21 bp, Artificial sequence
  SiRNA target sequence
tattctcaagactggagtaaa

SEQ ID NO: 5610 - DNA, 21 bp, Artificial sequence
  SiRNA target sequence
attctcaagactggagtaaaa

SEQ ID NO: 5611 - DNA, 21 bp, Artificial sequence
  SiRNA target sequence
ttctcaagactggagtaaaac

SEQ ID NO: 5612 - DNA, 21 bp, Artificial sequence
  SiRNA target sequence
tctcaagactggagtaaaact

SEQ ID NO: 5613 - DNA, 21 bp, Artificial sequence
  SiRNA target sequence
ctcaagactggagtaaaactg

SEQ ID NO: 5614 - DNA, 21 bp, Artificial sequence
  SiRNA target sequence
tcaagactggagtaaaactgt

SEQ ID NO: 5615 - DNA, 21 bp, Artificial sequence
  SiRNA target sequence
caagactggagtaaaactgtt

SEQ ID NO: 5616 - DNA, 21 bp, Artificial sequence
  SiRNA target sequence
aagactggagtaaaactgttc

SEQ ID NO: 5617 - DNA, 21 bp, Artificial sequence
  SiRNA target sequence
agactggagtaaaactgttcg

SEQ ID NO: 5618 - DNA, 21 bp, Artificial sequence
  SiRNA target sequence
gactggagtaaaactgttcgt

SEQ ID NO: 5619 - DNA, 21 bp, Artificial sequence
  SiRNA target sequence
actggagtaaaactgttcgta

SEQ ID NO: 5620 - DNA, 21 bp, Artificial sequence
  SiRNA target sequence
ctggagtaaaactgttcgtaa

SEQ ID NO: 5621 - DNA, 21 bp, Artificial sequence
  SiRNA target sequence
tggagtaaaactgttcgtaag

SEQ ID NO: 5622 - DNA, 21 bp, Artificial sequence
  SiRNA target sequence
ggagtaaaactgttcgtaagt

SEQ ID NO: 5623 - DNA, 21 bp, Artificial sequence
  SiRNA target sequence
gagtaaaactgttcgtaagtt

SEQ ID NO: 5624 - DNA, 21 bp, Artificial sequence
  SiRNA target sequence
agtaaaactgttcgtaagttg

SEQ ID NO: 5625 - DNA, 21 bp, Artificial sequence
  SiRNA target sequence
gtaaaactgttcgtaagttga

SEQ ID NO: 5626 - DNA, 21 bp, Artificial sequence
  SiRNA target sequence
taaaactgttcgtaagttgac

SEQ ID NO: 5627 - DNA, 21 bp, Artificial sequence
  SiRNA target sequence
aaaactgttcgtaagttgact

SEQ ID NO: 5628 - DNA, 21 bp, Artificial sequence
  SiRNA target sequence
aaactgttcgtaagttgacta

SEQ ID NO: 5629 - DNA, 21 bp, Artificial sequence
  SiRNA target sequence
aactgttcgtaagttgactaa

SEQ ID NO: 5630 - DNA, 21 bp, Artificial sequence
  SiRNA target sequence
actgttcgtaagttgactaaa

SEQ ID NO: 5631 - DNA, 21 bp, Artificial sequence
  SiRNA target sequence
ctgttcgtaagttgactaaat

SEQ ID NO: 5632 - DNA, 21 bp, Artificial sequence
  SiRNA target sequence
tgttcgtaagttgactaaatt

SEQ ID NO: 5633 - DNA, 21 bp, Artificial sequence
  SiRNA target sequence
gttcgtaagttgactaaattt

SEQ ID NO: 5634 - DNA, 21 bp, Artificial sequence
  SiRNA target sequence
ttcgtaagttgactaaatttg

SEQ ID NO: 5635 - DNA, 21 bp, Artificial sequence
  SiRNA target sequence
tcgtaagttgactaaatttgg

SEQ ID NO: 5636 - DNA, 21 bp, Artificial sequence
  SiRNA target sequence
cgtaagttgactaaatttgga

SEQ ID NO: 5637 - DNA, 21 bp, Artificial sequence
  SiRNA target sequence
gtaagttgactaaatttggaa

SEQ ID NO: 5638 - DNA, 21 bp, Artificial sequence
  SiRNA target sequence
taagttgactaaatttggaaa

SEQ ID NO: 5639 - DNA, 21 bp, Artificial sequence
  SiRNA target sequence
aagttgactaaatttggaaat

SEQ ID NO: 5640 - DNA, 21 bp, Artificial sequence
  SiRNA target sequence
agttgactaaatttggaaata

SEQ ID NO: 5641 - DNA, 21 bp, Artificial sequence
  SiRNA target sequence
gttgactaaatttggaaataa

SEQ ID NO: 5642 - DNA, 21 bp, Artificial sequence
  SiRNA target sequence
ttgactaaatttggaaataaa

SEQ ID NO: 5643 - DNA, 21 bp, Artificial sequence
  SiRNA target sequence
tgactaaatttggaaataaag

SEQ ID NO: 5644 - DNA, 21 bp, Artificial sequence
  SiRNA target sequence
gactaaatttggaaataaagt

SEQ ID NO: 5645 - DNA, 21 bp, Artificial sequence
  SiRNA target sequence
actaaatttggaaataaagtt

SEQ ID NO: 5646 - DNA, 21 bp, Artificial sequence
  SiRNA target sequence
ctaaatttggaaataaagtta

SEQ ID NO: 5647 - DNA, 21 bp, Artificial sequence
  SiRNA target sequence
taaatttggaaataaagttat

SEQ ID NO: 5648 - DNA, 21 bp, Artificial sequence
  SiRNA target sequence
aaatttggaaataaagttatt

SEQ ID NO: 5649 - DNA, 21 bp, Artificial sequence
  SiRNA target sequence
aatttggaaataaagttattg

SEQ ID NO: 5650 - DNA, 21 bp, Artificial sequence
  SiRNA target sequence
atttggaaataaagttattgc

SEQ ID NO: 5651 - DNA, 21 bp, Artificial sequence
  SiRNA target sequence
tttggaaataaagttattgca

SEQ ID NO: 5652 - DNA, 21 bp, Artificial sequence
  SiRNA target sequence
ttggaaataaagttattgcag

SEQ ID NO: 5653 - DNA, 21 bp, Artificial sequence
  SiRNA target sequence
tggaaataaagttattgcagg

SEQ ID NO: 5654 - DNA, 21 bp, Artificial sequence
  SiRNA target sequence
ggaaataaagttattgcaggt

SEQ ID NO: 5655 - DNA, 21 bp, Artificial sequence
  SiRNA target sequence
gaaataaagttattgcaggtg

SEQ ID NO: 5656 - DNA, 21 bp, Artificial sequence
  SiRNA target sequence
aaataaagttattgcaggtga

SEQ ID NO: 5657 - DNA, 21 bp, Artificial sequence
  SiRNA target sequence
aataaagttattgcaggtgat

SEQ ID NO: 5658 - DNA, 21 bp, Artificial sequence
  SiRNA target sequence
ataaagttattgcaggtgatt

SEQ ID NO: 5659 - DNA, 21 bp, Artificial sequence
  SiRNA target sequence
taaagttattgcaggtgattt

SEQ ID NO: 5660 - DNA, 21 bp, Artificial sequence
  SiRNA target sequence
aaagttattgcaggtgatttt

SEQ ID NO: 5661 - DNA, 21 bp, Artificial sequence
  SiRNA target sequence
aagttattgcaggtgattttt

SEQ ID NO: 5662 - DNA, 21 bp, Artificial sequence
  SiRNA target sequence
agttattgcaggtgatttttc

SEQ ID NO: 5663 - DNA, 21 bp, Artificial sequence
  SiRNA target sequence
gttattgcaggtgatttttca

SEQ ID NO: 5664 - DNA, 21 bp, Artificial sequence
  SiRNA target sequence
ttattgcaggtgatttttcaa

SEQ ID NO: 5665 - DNA, 21 bp, Artificial sequence
  SiRNA target sequence
tattgcaggtgatttttcaac

SEQ ID NO: 5666 - DNA, 21 bp, Artificial sequence
  SiRNA target sequence
attgcaggtgatttttcaact

SEQ ID NO: 5667 - DNA, 21 bp, Artificial sequence
  SiRNA target sequence
ttgcaggtgatttttcaactt

SEQ ID NO: 5668 - DNA, 21 bp, Artificial sequence
  SiRNA target sequence
tgcaggtgatttttcaacttt

SEQ ID NO: 5669 - DNA, 21 bp, Artificial sequence
  SiRNA target sequence
gcaggtgatttttcaactttt

SEQ ID NO: 5670 - DNA, 21 bp, Artificial sequence
  SiRNA target sequence
caggtgatttttcaacttttg

SEQ ID NO: 5671 - DNA, 21 bp, Artificial sequence
  SiRNA target sequence
aggtgatttttcaacttttga

SEQ ID NO: 5672 - DNA, 21 bp, Artificial sequence
  SiRNA target sequence
ggtgatttttcaacttttgat

SEQ ID NO: 5673 - DNA, 21 bp, Artificial sequence
  SiRNA target sequence
gtgatttttcaacttttgatg

SEQ ID NO: 5674 - DNA, 21 bp, Artificial sequence
  SiRNA target sequence
tgatttttcaacttttgatgg

SEQ ID NO: 5675 - DNA, 21 bp, Artificial sequence
  SiRNA target sequence
gatttttcaacttttgatgga

SEQ ID NO: 5676 - DNA, 21 bp, Artificial sequence
  SiRNA target sequence
atttttcaacttttgatggat

SEQ ID NO: 5677 - DNA, 21 bp, Artificial sequence
  SiRNA target sequence
tttttcaacttttgatggatc

SEQ ID NO: 5678 - DNA, 21 bp, Artificial sequence
  SiRNA target sequence
ttttcaacttttgatggatca

SEQ ID NO: 5679 - DNA, 21 bp, Artificial sequence
  SiRNA target sequence
tttcaacttttgatggatcac

SEQ ID NO: 5680 - DNA, 21 bp, Artificial sequence
  SiRNA target sequence
ttcaacttttgatggatcact

SEQ ID NO: 5681 - DNA, 21 bp, Artificial sequence
  SiRNA target sequence
tcaacttttgatggatcactg

SEQ ID NO: 5682 - DNA, 21 bp, Artificial sequence
  SiRNA target sequence
caacttttgatggatcactga

SEQ ID NO: 5683 - DNA, 21 bp, Artificial sequence
  SiRNA target sequence
aacttttgatggatcactgaa

SEQ ID NO: 5684 - DNA, 21 bp, Artificial sequence
  SiRNA target sequence
acttttgatggatcactgaat

SEQ ID NO: 5685 - DNA, 21 bp, Artificial sequence
  SiRNA target sequence
cttttgatggatcactgaatg

SEQ ID NO: 5686 - DNA, 21 bp, Artificial sequence
  SiRNA target sequence
ttttgatggatcactgaatgt

SEQ ID NO: 5687 - DNA, 21 bp, Artificial sequence
  SiRNA target sequence
tttgatggatcactgaatgta

SEQ ID NO: 5688 - DNA, 21 bp, Artificial sequence
  SiRNA target sequence
ttgatggatcactgaatgtat

SEQ ID NO: 5689 - DNA, 21 bp, Artificial sequence
  SiRNA target sequence
tgatggatcactgaatgtatg

SEQ ID NO: 5690 - DNA, 21 bp, Artificial sequence
  SiRNA target sequence
gatggatcactgaatgtatgt

SEQ ID NO: 5691 - DNA, 21 bp, Artificial sequence
  SiRNA target sequence
atggatcactgaatgtatgta

SEQ ID NO: 5692 - DNA, 21 bp, Artificial sequence
  SiRNA target sequence
tggatcactgaatgtatgtat

SEQ ID NO: 5693 - DNA, 21 bp, Artificial sequence
  SiRNA target sequence
ggatcactgaatgtatgtatt

SEQ ID NO: 5694 - DNA, 21 bp, Artificial sequence
  SiRNA target sequence
gatcactgaatgtatgtatta

SEQ ID NO: 5695 - DNA, 21 bp, Artificial sequence
  SiRNA target sequence
atcactgaatgtatgtattat

SEQ ID NO: 5696 - DNA, 21 bp, Artificial sequence
  SiRNA target sequence
tcactgaatgtatgtattatg

SEQ ID NO: 5697 - DNA, 21 bp, Artificial sequence
  SiRNA target sequence
cactgaatgtatgtattatgg

SEQ ID NO: 5698 - DNA, 21 bp, Artificial sequence
  SiRNA target sequence
actgaatgtatgtattatgga

SEQ ID NO: 5699 - DNA, 21 bp, Artificial sequence
  SiRNA target sequence
ctgaatgtatgtattatggaa

SEQ ID NO: 5700 - DNA, 21 bp, Artificial sequence
  SiRNA target sequence
tgaatgtatgtattatggaaa

SEQ ID NO: 5701 - DNA, 21 bp, Artificial sequence
  SiRNA target sequence
gaatgtatgtattatggaaaa

SEQ ID NO: 5702 - DNA, 21 bp, Artificial sequence
  SiRNA target sequence
aatgtatgtattatggaaaaa

SEQ ID NO: 5703 - DNA, 21 bp, Artificial sequence
  SiRNA target sequence
atgtatgtattatggaaaaat

SEQ ID NO: 5704 - DNA, 21 bp, Artificial sequence
  SiRNA target sequence
tgtatgtattatggaaaaatt

SEQ ID NO: 5705 - DNA, 21 bp, Artificial sequence
  SiRNA target sequence
gtatgtattatggaaaaattt

SEQ ID NO: 5706 - DNA, 21 bp, Artificial sequence
  SiRNA target sequence
tatgtattatggaaaaatttg

SEQ ID NO: 5707 - DNA, 21 bp, Artificial sequence
  SiRNA target sequence
atgtattatggaaaaatttgc

SEQ ID NO: 5708 - DNA, 21 bp, Artificial sequence
  SiRNA target sequence
tgtattatggaaaaatttgca

SEQ ID NO: 5709 - DNA, 21 bp, Artificial sequence
  SiRNA target sequence
gtattatggaaaaatttgcag

SEQ ID NO: 5710 - DNA, 21 bp, Artificial sequence
  SiRNA target sequence
tattatggaaaaatttgcaga

SEQ ID NO: 5711 - DNA, 21 bp, Artificial sequence
  SiRNA target sequence
attatggaaaaatttgcagat

SEQ ID NO: 5712 - DNA, 21 bp, Artificial sequence
  SiRNA target sequence
ttatggaaaaatttgcagatt

SEQ ID NO: 5713 - DNA, 21 bp, Artificial sequence
  SiRNA target sequence
tatggaaaaatttgcagattt

SEQ ID NO: 5714 - DNA, 21 bp, Artificial sequence
  SiRNA target sequence
atggaaaaatttgcagattta

SEQ ID NO: 5715 - DNA, 21 bp, Artificial sequence
  SiRNA target sequence
tggaaaaatttgcagatttag

SEQ ID NO: 5716 - DNA, 21 bp, Artificial sequence
  SiRNA target sequence
ggaaaaatttgcagatttagc

SEQ ID NO: 5717 - DNA, 21 bp, Artificial sequence
  SiRNA target sequence
gaaaaatttgcagatttagcg

SEQ ID NO: 5718 - DNA, 21 bp, Artificial sequence
  SiRNA target sequence
aaaaatttgcagatttagcga

SEQ ID NO: 5719 - DNA, 21 bp, Artificial sequence
  SiRNA target sequence
aaaatttgcagatttagcgaa

SEQ ID NO: 5720 - DNA, 21 bp, Artificial sequence
  SiRNA target sequence
aaatttgcagatttagcgaat

SEQ ID NO: 5721 - DNA, 21 bp, Artificial sequence
  SiRNA target sequence
aatttgcagatttagcgaatg

SEQ ID NO: 5722 - DNA, 21 bp, Artificial sequence
  SiRNA target sequence
atttgcagatttagcgaatga

SEQ ID NO: 5723 - DNA, 21 bp, Artificial sequence
  SiRNA target sequence
tttgcagatttagcgaatgag

SEQ ID NO: 5724 - DNA, 21 bp, Artificial sequence
  SiRNA target sequence
ttgcagatttagcgaatgagt

SEQ ID NO: 5725 - DNA, 21 bp, Artificial sequence
  SiRNA target sequence
tgcagatttagcgaatgagtt

SEQ ID NO: 5726 - DNA, 21 bp, Artificial sequence
  SiRNA target sequence
gcagatttagcgaatgagttt

SEQ ID NO: 5727 - DNA, 21 bp, Artificial sequence
  SiRNA target sequence
cagatttagcgaatgagtttt

SEQ ID NO: 5728 - DNA, 21 bp, Artificial sequence
  SiRNA target sequence
agatttagcgaatgagtttta

SEQ ID NO: 5729 - DNA, 21 bp, Artificial sequence
  SiRNA target sequence
gatttagcgaatgagttttat

SEQ ID NO: 5730 - DNA, 21 bp, Artificial sequence
  SiRNA target sequence
atttagcgaatgagttttatg

SEQ ID NO: 5731 - DNA, 21 bp, Artificial sequence
  SiRNA target sequence
tttagcgaatgagttttatga

SEQ ID NO: 5732 - DNA, 21 bp, Artificial sequence
  SiRNA target sequence
ttagcgaatgagttttatgat

SEQ ID NO: 5733 - DNA, 21 bp, Artificial sequence
  SiRNA target sequence
tagcgaatgagttttatgatg

SEQ ID NO: 5734 - DNA, 21 bp, Artificial sequence
  SiRNA target sequence
agcgaatgagttttatgatga

SEQ ID NO: 5735 - DNA, 21 bp, Artificial sequence
  SiRNA target sequence
gcgaatgagttttatgatgat

SEQ ID NO: 5736 - DNA, 21 bp, Artificial sequence
  SiRNA target sequence
cgaatgagttttatgatgatg

SEQ ID NO: 5737 - DNA, 21 bp, Artificial sequence
  SiRNA target sequence
gaatgagttttatgatgatgg

SEQ ID NO: 5738 - DNA, 21 bp, Artificial sequence
  SiRNA target sequence
aatgagttttatgatgatgga

SEQ ID NO: 5739 - DNA, 21 bp, Artificial sequence
  SiRNA target sequence
atgagttttatgatgatggaa

SEQ ID NO: 5740 - DNA, 21 bp, Artificial sequence
  SiRNA target sequence
tgagttttatgatgatggaaa

SEQ ID NO: 5741 - DNA, 21 bp, Artificial sequence
  SiRNA target sequence
gagttttatgatgatggaaaa

SEQ ID NO: 5742 - DNA, 21 bp, Artificial sequence
  SiRNA target sequence
agttttatgatgatggaaaag

SEQ ID NO: 5743 - DNA, 21 bp, Artificial sequence
  SiRNA target sequence
gttttatgatgatggaaaaga

SEQ ID NO: 5744 - DNA, 21 bp, Artificial sequence
  SiRNA target sequence
ttttatgatgatggaaaagaa

SEQ ID NO: 5745 - DNA, 21 bp, Artificial sequence
  SiRNA target sequence
tttatgatgatggaaaagaaa

SEQ ID NO: 5746 - DNA, 21 bp, Artificial sequence
  SiRNA target sequence
ttatgatgatggaaaagaaaa

SEQ ID NO: 5747 - DNA, 21 bp, Artificial sequence
  SiRNA target sequence
tatgatgatggaaaagaaaat

SEQ ID NO: 5748 - DNA, 21 bp, Artificial sequence
  SiRNA target sequence
atgatgatggaaaagaaaata

SEQ ID NO: 5749 - DNA, 21 bp, Artificial sequence
  SiRNA target sequence
tgatgatggaaaagaaaataa

SEQ ID NO: 5750 - DNA, 21 bp, Artificial sequence
  SiRNA target sequence
gatgatggaaaagaaaataat

SEQ ID NO: 5751 - DNA, 21 bp, Artificial sequence
  SiRNA target sequence
atgatggaaaagaaaataatc

SEQ ID NO: 5752 - DNA, 21 bp, Artificial sequence
  SiRNA target sequence
tgatggaaaagaaaataatct

SEQ ID NO: 5753 - DNA, 21 bp, Artificial sequence
  SiRNA target sequence
gatggaaaagaaaataatctg

SEQ ID NO: 5754 - DNA, 21 bp, Artificial sequence
  SiRNA target sequence
atggaaaagaaaataatctga

SEQ ID NO: 5755 - DNA, 21 bp, Artificial sequence
  SiRNA target sequence
tggaaaagaaaataatctgat

SEQ ID NO: 5756 - DNA, 21 bp, Artificial sequence
  SiRNA target sequence
ggaaaagaaaataatctgatc

SEQ ID NO: 5757 - DNA, 21 bp, Artificial sequence
  SiRNA target sequence
gaaaagaaaataatctgatca

SEQ ID NO: 5758 - DNA, 21 bp, Artificial sequence
  SiRNA target sequence
aaaagaaaataatctgatcag

SEQ ID NO: 5759 - DNA, 21 bp, Artificial sequence
  SiRNA target sequence
aaagaaaataatctgatcaga

SEQ ID NO: 5760 - DNA, 21 bp, Artificial sequence
  SiRNA target sequence
aagaaaataatctgatcagac

SEQ ID NO: 5761 - DNA, 21 bp, Artificial sequence
  SiRNA target sequence
agaaaataatctgatcagaca

SEQ ID NO: 5762 - DNA, 21 bp, Artificial sequence
  SiRNA target sequence
gaaaataatctgatcagacac

SEQ ID NO: 5763 - DNA, 21 bp, Artificial sequence
  SiRNA target sequence
aaaataatctgatcagacacg

SEQ ID NO: 5764 - DNA, 21 bp, Artificial sequence
  SiRNA target sequence
aaataatctgatcagacacgt

SEQ ID NO: 5765 - DNA, 21 bp, Artificial sequence
  SiRNA target sequence
aataatctgatcagacacgta

SEQ ID NO: 5766 - DNA, 21 bp, Artificial sequence
  SiRNA target sequence
ataatctgatcagacacgtat

SEQ ID NO: 5767 - DNA, 21 bp, Artificial sequence
  SiRNA target sequence
taatctgatcagacacgtatt

SEQ ID NO: 5768 - DNA, 21 bp, Artificial sequence
  SiRNA target sequence
aatctgatcagacacgtattg

SEQ ID NO: 5769 - DNA, 21 bp, Artificial sequence
  SiRNA target sequence
atctgatcagacacgtattgt

SEQ ID NO: 5770 - DNA, 21 bp, Artificial sequence
  SiRNA target sequence
tctgatcagacacgtattgtt

SEQ ID NO: 5771 - DNA, 21 bp, Artificial sequence
  SiRNA target sequence
ctgatcagacacgtattgttg

SEQ ID NO: 5772 - DNA, 21 bp, Artificial sequence
  SiRNA target sequence
tgatcagacacgtattgttga

SEQ ID NO: 5773 - DNA, 21 bp, Artificial sequence
  SiRNA target sequence
gatcagacacgtattgttgat

SEQ ID NO: 5774 - DNA, 21 bp, Artificial sequence
  SiRNA target sequence
atcagacacgtattgttgatg

SEQ ID NO: 5775 - DNA, 21 bp, Artificial sequence
  SiRNA target sequence
tcagacacgtattgttgatgg

SEQ ID NO: 5776 - DNA, 21 bp, Artificial sequence
  SiRNA target sequence
cagacacgtattgttgatgga

SEQ ID NO: 5777 - DNA, 21 bp, Artificial sequence
  SiRNA target sequence
agacacgtattgttgatggat

SEQ ID NO: 5778 - DNA, 21 bp, Artificial sequence
  SiRNA target sequence
gacacgtattgttgatggatg

SEQ ID NO: 5779 - DNA, 21 bp, Artificial sequence
  SiRNA target sequence
acacgtattgttgatggatgt

SEQ ID NO: 5780 - DNA, 21 bp, Artificial sequence
  SiRNA target sequence
cacgtattgttgatggatgtg

SEQ ID NO: 5781 - DNA, 21 bp, Artificial sequence
  SiRNA target sequence
acgtattgttgatggatgtgt

SEQ ID NO: 5782 - DNA, 21 bp, Artificial sequence
  SiRNA target sequence
cgtattgttgatggatgtgta

SEQ ID NO: 5783 - DNA, 21 bp, Artificial sequence
  SiRNA target sequence
gtattgttgatggatgtgtac

SEQ ID NO: 5784 - DNA, 21 bp, Artificial sequence
  SiRNA target sequence
tattgttgatggatgtgtaca

SEQ ID NO: 5785 - DNA, 21 bp, Artificial sequence
  SiRNA target sequence
attgttgatggatgtgtacaa

SEQ ID NO: 5786 - DNA, 21 bp, Artificial sequence
  SiRNA target sequence
ttgttgatggatgtgtacaat

SEQ ID NO: 5787 - DNA, 21 bp, Artificial sequence
  SiRNA target sequence
tgttgatggatgtgtacaatt

SEQ ID NO: 5788 - DNA, 21 bp, Artificial sequence
  SiRNA target sequence
gttgatggatgtgtacaattc

SEQ ID NO: 5789 - DNA, 21 bp, Artificial sequence
  SiRNA target sequence
ttgatggatgtgtacaattct

SEQ ID NO: 5790 - DNA, 21 bp, Artificial sequence
  SiRNA target sequence
tgatggatgtgtacaattctg

SEQ ID NO: 5791 - DNA, 21 bp, Artificial sequence
  SiRNA target sequence
gatggatgtgtacaattctgt

SEQ ID NO: 5792 - DNA, 21 bp, Artificial sequence
  SiRNA target sequence
atggatgtgtacaattctgta

SEQ ID NO: 5793 - DNA, 21 bp, Artificial sequence
  SiRNA target sequence
tggatgtgtacaattctgtac

SEQ ID NO: 5794 - DNA, 21 bp, Artificial sequence
  SiRNA target sequence
ggatgtgtacaattctgtaca

SEQ ID NO: 5795 - DNA, 21 bp, Artificial sequence
  SiRNA target sequence
gatgtgtacaattctgtacac

SEQ ID NO: 5796 - DNA, 21 bp, Artificial sequence
  SiRNA target sequence
atgtgtacaattctgtacaca

SEQ ID NO: 5797 - DNA, 21 bp, Artificial sequence
  SiRNA target sequence
tgtgtacaattctgtacacat

SEQ ID NO: 5798 - DNA, 21 bp, Artificial sequence
  SiRNA target sequence
gtgtacaattctgtacacatt

SEQ ID NO: 5799 - DNA, 21 bp, Artificial sequence
  SiRNA target sequence
tgtacaattctgtacacattt

SEQ ID NO: 5800 - DNA, 21 bp, Artificial sequence
  SiRNA target sequence
gtacaattctgtacacatttg

SEQ ID NO: 5801 - DNA, 21 bp, Artificial sequence
  SiRNA target sequence
tacaattctgtacacatttgc

SEQ ID NO: 5802 - DNA, 21 bp, Artificial sequence
  SiRNA target sequence
acaattctgtacacatttgca

SEQ ID NO: 5803 - DNA, 21 bp, Artificial sequence
  SiRNA target sequence
caattctgtacacatttgcaa

SEQ ID NO: 5804 - DNA, 21 bp, Artificial sequence
  SiRNA target sequence
aattctgtacacatttgcaat

SEQ ID NO: 5805 - DNA, 21 bp, Artificial sequence
  SiRNA target sequence
attctgtacacatttgcaatg

SEQ ID NO: 5806 - DNA, 21 bp, Artificial sequence
  SiRNA target sequence
ttctgtacacatttgcaatga

SEQ ID NO: 5807 - DNA, 21 bp, Artificial sequence
  SiRNA target sequence
tctgtacacatttgcaatgac

SEQ ID NO: 5808 - DNA, 21 bp, Artificial sequence
  SiRNA target sequence
ctgtacacatttgcaatgact

SEQ ID NO: 5809 - DNA, 21 bp, Artificial sequence
  SiRNA target sequence
tgtacacatttgcaatgactc

SEQ ID NO: 5810 - DNA, 21 bp, Artificial sequence
  SiRNA target sequence
gtacacatttgcaatgactcc

SEQ ID NO: 5811 - DNA, 21 bp, Artificial sequence
  SiRNA target sequence
tacacatttgcaatgactccg

SEQ ID NO: 5812 - DNA, 21 bp, Artificial sequence
  SiRNA target sequence
acacatttgcaatgactccgt

SEQ ID NO: 5813 - DNA, 21 bp, Artificial sequence
  SiRNA target sequence
cacatttgcaatgactccgtg

SEQ ID NO: 5814 - DNA, 21 bp, Artificial sequence
  SiRNA target sequence
acatttgcaatgactccgtgt

SEQ ID NO: 5815 - DNA, 21 bp, Artificial sequence
  SiRNA target sequence
catttgcaatgactccgtgta

SEQ ID NO: 5816 - DNA, 21 bp, Artificial sequence
  SiRNA target sequence
atttgcaatgactccgtgtat

SEQ ID NO: 5817 - DNA, 21 bp, Artificial sequence
  SiRNA target sequence
tttgcaatgactccgtgtata

SEQ ID NO: 5818 - DNA, 21 bp, Artificial sequence
  SiRNA target sequence
ttgcaatgactccgtgtatat

SEQ ID NO: 5819 - DNA, 21 bp, Artificial sequence
  SiRNA target sequence
tgcaatgactccgtgtatatg

SEQ ID NO: 5820 - DNA, 21 bp, Artificial sequence
  SiRNA target sequence
gcaatgactccgtgtatatga

SEQ ID NO: 5821 - DNA, 21 bp, Artificial sequence
  SiRNA target sequence
caatgactccgtgtatatgat

SEQ ID NO: 5822 - DNA, 21 bp, Artificial sequence
  SiRNA target sequence
aatgactccgtgtatatgatg

SEQ ID NO: 5823 - DNA, 21 bp, Artificial sequence
  SiRNA target sequence
atgactccgtgtatatgatga

SEQ ID NO: 5824 - DNA, 21 bp, Artificial sequence
  SiRNA target sequence
tgactccgtgtatatgatgac

SEQ ID NO: 5825 - DNA, 21 bp, Artificial sequence
  SiRNA target sequence
gactccgtgtatatgatgaca

SEQ ID NO: 5826 - DNA, 21 bp, Artificial sequence
  SiRNA target sequence
actccgtgtatatgatgacac

SEQ ID NO: 5827 - DNA, 21 bp, Artificial sequence
  SiRNA target sequence
ctccgtgtatatgatgacaca

SEQ ID NO: 5828 - DNA, 21 bp, Artificial sequence
  SiRNA target sequence
tccgtgtatatgatgacacac

SEQ ID NO: 5829 - DNA, 21 bp, Artificial sequence
  SiRNA target sequence
ccgtgtatatgatgacacaca

SEQ ID NO: 5830 - DNA, 21 bp, Artificial sequence
  SiRNA target sequence
cgtgtatatgatgacacacag

SEQ ID NO: 5831 - DNA, 21 bp, Artificial sequence
  SiRNA target sequence
gtgtatatgatgacacacagc

SEQ ID NO: 5832 - DNA, 21 bp, Artificial sequence
  SiRNA target sequence
tgtatatgatgacacacagcc

SEQ ID NO: 5833 - DNA, 21 bp, Artificial sequence
  SiRNA target sequence
gtatatgatgacacacagcca

SEQ ID NO: 5834 - DNA, 21 bp, Artificial sequence
  SiRNA target sequence
tatatgatgacacacagccaa

SEQ ID NO: 5835 - DNA, 21 bp, Artificial sequence
  SiRNA target sequence
atatgatgacacacagccaac

SEQ ID NO: 5836 - DNA, 21 bp, Artificial sequence
  SiRNA target sequence
tatgatgacacacagccaacc

SEQ ID NO: 5837 - DNA, 21 bp, Artificial sequence
  SiRNA target sequence
atgatgacacacagccaaccc

SEQ ID NO: 5838 - DNA, 21 bp, Artificial sequence
  SiRNA target sequence
tgatgacacacagccaaccct

SEQ ID NO: 5839 - DNA, 21 bp, Artificial sequence
  SiRNA target sequence
gatgacacacagccaaccctc

SEQ ID NO: 5840 - DNA, 21 bp, Artificial sequence
  SiRNA target sequence
atgacacacagccaaccctct

SEQ ID NO: 5841 - DNA, 21 bp, Artificial sequence
  SiRNA target sequence
tgacacacagccaaccctctg

SEQ ID NO: 5842 - DNA, 21 bp, Artificial sequence
  SiRNA target sequence
gacacacagccaaccctctgg

SEQ ID NO: 5843 - DNA, 21 bp, Artificial sequence
  SiRNA target sequence
acacacagccaaccctctgga

SEQ ID NO: 5844 - DNA, 21 bp, Artificial sequence
  SiRNA target sequence
cacacagccaaccctctggaa

SEQ ID NO: 5845 - DNA, 21 bp, Artificial sequence
  SiRNA target sequence
acacagccaaccctctggaaa

SEQ ID NO: 5846 - DNA, 21 bp, Artificial sequence
  SiRNA target sequence
cacagccaaccctctggaaat

SEQ ID NO: 5847 - DNA, 21 bp, Artificial sequence
  SiRNA target sequence
acagccaaccctctggaaatc

SEQ ID NO: 5848 - DNA, 21 bp, Artificial sequence
  SiRNA target sequence
cagccaaccctctggaaatcc

SEQ ID NO: 5849 - DNA, 21 bp, Artificial sequence
  SiRNA target sequence
agccaaccctctggaaatccc

SEQ ID NO: 5850 - DNA, 21 bp, Artificial sequence
  SiRNA target sequence
gccaaccctctggaaatcccg

SEQ ID NO: 5851 - DNA, 21 bp, Artificial sequence
  SiRNA target sequence
ccaaccctctggaaatcccgc

SEQ ID NO: 5852 - DNA, 21 bp, Artificial sequence
  SiRNA target sequence
caaccctctggaaatcccgca

SEQ ID NO: 5853 - DNA, 21 bp, Artificial sequence
  SiRNA target sequence
aaccctctggaaatcccgcaa

SEQ ID NO: 5854 - DNA, 21 bp, Artificial sequence
  SiRNA target sequence
accctctggaaatcccgcaac

SEQ ID NO: 5855 - DNA, 21 bp, Artificial sequence
  SiRNA target sequence
ccctctggaaatcccgcaacg

SEQ ID NO: 5856 - DNA, 21 bp, Artificial sequence
  SiRNA target sequence
cctctggaaatcccgcaacga

SEQ ID NO: 5857 - DNA, 21 bp, Artificial sequence
  SiRNA target sequence
ctctggaaatcccgcaacgac

SEQ ID NO: 5858 - DNA, 21 bp, Artificial sequence
  SiRNA target sequence
tctggaaatcccgcaacgact

SEQ ID NO: 5859 - DNA, 21 bp, Artificial sequence
  SiRNA target sequence
ctggaaatcccgcaacgactc

SEQ ID NO: 5860 - DNA, 21 bp, Artificial sequence
  SiRNA target sequence
tggaaatcccgcaacgactcc

SEQ ID NO: 5861 - DNA, 21 bp, Artificial sequence
  SiRNA target sequence
ggaaatcccgcaacgactccg

SEQ ID NO: 5862 - DNA, 21 bp, Artificial sequence
  SiRNA target sequence
gaaatcccgcaacgactccgc

SEQ ID NO: 5863 - DNA, 21 bp, Artificial sequence
  SiRNA target sequence
aaatcccgcaacgactccgct

SEQ ID NO: 5864 - DNA, 21 bp, Artificial sequence
  SiRNA target sequence
aatcccgcaacgactccgctc

SEQ ID NO: 5865 - DNA, 21 bp, Artificial sequence
  SiRNA target sequence
atcccgcaacgactccgctca

SEQ ID NO: 5866 - DNA, 21 bp, Artificial sequence
  SiRNA target sequence
tcccgcaacgactccgctcaa

SEQ ID NO: 5867 - DNA, 21 bp, Artificial sequence
  SiRNA target sequence
cccgcaacgactccgctcaat

SEQ ID NO: 5868 - DNA, 21 bp, Artificial sequence
  SiRNA target sequence
ccgcaacgactccgctcaatt

SEQ ID NO: 5869 - DNA, 21 bp, Artificial sequence
  SiRNA target sequence
cgcaacgactccgctcaattg

SEQ ID NO: 5870 - DNA, 21 bp, Artificial sequence
  SiRNA target sequence
gcaacgactccgctcaattgc

SEQ ID NO: 5871 - DNA, 21 bp, Artificial sequence
  SiRNA target sequence
caacgactccgctcaattgct

SEQ ID NO: 5872 - DNA, 21 bp, Artificial sequence
  SiRNA target sequence
aacgactccgctcaattgctt

SEQ ID NO: 5873 - DNA, 21 bp, Artificial sequence
  SiRNA target sequence
acgactccgctcaattgcttc

SEQ ID NO: 5874 - DNA, 21 bp, Artificial sequence
  SiRNA target sequence
cgactccgctcaattgcttca

SEQ ID NO: 5875 - DNA, 21 bp, Artificial sequence
  SiRNA target sequence
gactccgctcaattgcttcat

SEQ ID NO: 5876 - DNA, 21 bp, Artificial sequence
  SiRNA target sequence
actccgctcaattgcttcatt

SEQ ID NO: 5877 - DNA, 21 bp, Artificial sequence
  SiRNA target sequence
ctccgctcaattgcttcatta

SEQ ID NO: 5878 - DNA, 21 bp, Artificial sequence
  SiRNA target sequence
tccgctcaattgcttcattaa

SEQ ID NO: 5879 - DNA, 21 bp, Artificial sequence
  SiRNA target sequence
ccgctcaattgcttcattaat

SEQ ID NO: 5880 - DNA, 21 bp, Artificial sequence
  SiRNA target sequence
cgctcaattgcttcattaata

SEQ ID NO: 5881 - DNA, 21 bp, Artificial sequence
  SiRNA target sequence
gctcaattgcttcattaatag

SEQ ID NO: 5882 - DNA, 21 bp, Artificial sequence
  SiRNA target sequence
ctcaattgcttcattaatagt

SEQ ID NO: 5883 - DNA, 21 bp, Artificial sequence
  SiRNA target sequence
tcaattgcttcattaatagta

SEQ ID NO: 5884 - DNA, 21 bp, Artificial sequence
  SiRNA target sequence
caattgcttcattaatagtat

SEQ ID NO: 5885 - DNA, 21 bp, Artificial sequence
  SiRNA target sequence
aattgcttcattaatagtatg

SEQ ID NO: 5886 - DNA, 21 bp, Artificial sequence
  SiRNA target sequence
attgcttcattaatagtatgg

SEQ ID NO: 5887 - DNA, 21 bp, Artificial sequence
  SiRNA target sequence
ttgcttcattaatagtatggg

SEQ ID NO: 5888 - DNA, 21 bp, Artificial sequence
  SiRNA target sequence
tgcttcattaatagtatggga

SEQ ID NO: 5889 - DNA, 21 bp, Artificial sequence
  SiRNA target sequence
gcttcattaatagtatgggat

SEQ ID NO: 5890 - DNA, 21 bp, Artificial sequence
  SiRNA target sequence
cttcattaatagtatgggatt

SEQ ID NO: 5891 - DNA, 21 bp, Artificial sequence
  SiRNA target sequence
ttcattaatagtatgggatta

SEQ ID NO: 5892 - DNA, 21 bp, Artificial sequence
  SiRNA target sequence
tcattaatagtatgggattac

SEQ ID NO: 5893 - DNA, 21 bp, Artificial sequence
  SiRNA target sequence
cattaatagtatgggattacg

SEQ ID NO: 5894 - DNA, 21 bp, Artificial sequence
  SiRNA target sequence
attaatagtatgggattacga

SEQ ID NO: 5895 - DNA, 21 bp, Artificial sequence
  SiRNA target sequence
ttaatagtatgggattacgaa

SEQ ID NO: 5896 - DNA, 21 bp, Artificial sequence
  SiRNA target sequence
taatagtatgggattacgaat

SEQ ID NO: 5897 - DNA, 21 bp, Artificial sequence
  SiRNA target sequence
aatagtatgggattacgaatg

SEQ ID NO: 5898 - DNA, 21 bp, Artificial sequence
  SiRNA target sequence
atagtatgggattacgaatgt

SEQ ID NO: 5899 - DNA, 21 bp, Artificial sequence
  SiRNA target sequence
tagtatgggattacgaatgtg

SEQ ID NO: 5900 - DNA, 21 bp, Artificial sequence
  SiRNA target sequence
agtatgggattacgaatgtgt

SEQ ID NO: 5901 - DNA, 21 bp, Artificial sequence
  SiRNA target sequence
gtatgggattacgaatgtgtt

SEQ ID NO: 5902 - DNA, 21 bp, Artificial sequence
  SiRNA target sequence
tatgggattacgaatgtgttt

SEQ ID NO: 5903 - DNA, 21 bp, Artificial sequence
  SiRNA target sequence
atgggattacgaatgtgtttc

SEQ ID NO: 5904 - DNA, 21 bp, Artificial sequence
  SiRNA target sequence
tgggattacgaatgtgtttcg

SEQ ID NO: 5905 - DNA, 21 bp, Artificial sequence
  SiRNA target sequence
gggattacgaatgtgtttcgc

SEQ ID NO: 5906 - DNA, 21 bp, Artificial sequence
  SiRNA target sequence
ggattacgaatgtgtttcgca

SEQ ID NO: 5907 - DNA, 21 bp, Artificial sequence
  SiRNA target sequence
gattacgaatgtgtttcgcaa

SEQ ID NO: 5908 - DNA, 21 bp, Artificial sequence
  SiRNA target sequence
attacgaatgtgtttcgcaat

SEQ ID NO: 5909 - DNA, 21 bp, Artificial sequence
  SiRNA target sequence
ttacgaatgtgtttcgcaatt

SEQ ID NO: 5910 - DNA, 21 bp, Artificial sequence
  SiRNA target sequence
tacgaatgtgtttcgcaattt

SEQ ID NO: 5911 - DNA, 21 bp, Artificial sequence
  SiRNA target sequence
acgaatgtgtttcgcaatttg

SEQ ID NO: 5912 - DNA, 21 bp, Artificial sequence
  SiRNA target sequence
cgaatgtgtttcgcaatttgt

SEQ ID NO: 5913 - DNA, 21 bp, Artificial sequence
  SiRNA target sequence
gaatgtgtttcgcaatttgtg

SEQ ID NO: 5914 - DNA, 21 bp, Artificial sequence
  SiRNA target sequence
aatgtgtttcgcaatttgtgt

SEQ ID NO: 5915 - DNA, 21 bp, Artificial sequence
  SiRNA target sequence
atgtgtttcgcaatttgtgtt

SEQ ID NO: 5916 - DNA, 21 bp, Artificial sequence
  SiRNA target sequence
tgtgtttcgcaatttgtgtta

SEQ ID NO: 5917 - DNA, 21 bp, Artificial sequence
  SiRNA target sequence
gtgtttcgcaatttgtgttaa

SEQ ID NO: 5918 - DNA, 21 bp, Artificial sequence
  SiRNA target sequence
tgtttcgcaatttgtgttaag

SEQ ID NO: 5919 - DNA, 21 bp, Artificial sequence
  SiRNA target sequence
gtttcgcaatttgtgttaaga

SEQ ID NO: 5920 - DNA, 21 bp, Artificial sequence
  SiRNA target sequence
tttcgcaatttgtgttaagaa

SEQ ID NO: 5921 - DNA, 21 bp, Artificial sequence
  SiRNA target sequence
ttcgcaatttgtgttaagaat

SEQ ID NO: 5922 - DNA, 21 bp, Artificial sequence
  SiRNA target sequence
tcgcaatttgtgttaagaatg

SEQ ID NO: 5923 - DNA, 21 bp, Artificial sequence
  SiRNA target sequence
cgcaatttgtgttaagaatgc

SEQ ID NO: 5924 - DNA, 21 bp, Artificial sequence
  SiRNA target sequence
gcaatttgtgttaagaatgca

SEQ ID NO: 5925 - DNA, 21 bp, Artificial sequence
  SiRNA target sequence
caatttgtgttaagaatgcag

SEQ ID NO: 5926 - DNA, 21 bp, Artificial sequence
  SiRNA target sequence
aatttgtgttaagaatgcagg

SEQ ID NO: 5927 - DNA, 21 bp, Artificial sequence
  SiRNA target sequence
atttgtgttaagaatgcaggc

SEQ ID NO: 5928 - DNA, 21 bp, Artificial sequence
  SiRNA target sequence
tttgtgttaagaatgcaggca

SEQ ID NO: 5929 - DNA, 21 bp, Artificial sequence
  SiRNA target sequence
ttgtgttaagaatgcaggcat

SEQ ID NO: 5930 - DNA, 21 bp, Artificial sequence
  SiRNA target sequence
tgtgttaagaatgcaggcata

SEQ ID NO: 5931 - DNA, 21 bp, Artificial sequence
  SiRNA target sequence
gtgttaagaatgcaggcataa

SEQ ID NO: 5932 - DNA, 21 bp, Artificial sequence
  SiRNA target sequence
tgttaagaatgcaggcataaa

SEQ ID NO: 5933 - DNA, 21 bp, Artificial sequence
  SiRNA target sequence
gttaagaatgcaggcataaag

SEQ ID NO: 5934 - DNA, 21 bp, Artificial sequence
  SiRNA target sequence
ttaagaatgcaggcataaaga

SEQ ID NO: 5935 - DNA, 21 bp, Artificial sequence
  SiRNA target sequence
taagaatgcaggcataaagat

SEQ ID NO: 5936 - DNA, 21 bp, Artificial sequence
  SiRNA target sequence
aagaatgcaggcataaagatg

SEQ ID NO: 5937 - DNA, 21 bp, Artificial sequence
  SiRNA target sequence
agaatgcaggcataaagatga

SEQ ID NO: 5938 - DNA, 21 bp, Artificial sequence
  SiRNA target sequence
gaatgcaggcataaagatgac

SEQ ID NO: 5939 - DNA, 21 bp, Artificial sequence
  SiRNA target sequence
aatgcaggcataaagatgaca

SEQ ID NO: 5940 - DNA, 21 bp, Artificial sequence
  SiRNA target sequence
atgcaggcataaagatgacaa

SEQ ID NO: 5941 - DNA, 21 bp, Artificial sequence
  SiRNA target sequence
tgcaggcataaagatgacaat

SEQ ID NO: 5942 - DNA, 21 bp, Artificial sequence
  SiRNA target sequence
gcaggcataaagatgacaatg

SEQ ID NO: 5943 - DNA, 21 bp, Artificial sequence
  SiRNA target sequence
caggcataaagatgacaatga

SEQ ID NO: 5944 - DNA, 21 bp, Artificial sequence
  SiRNA target sequence
aggcataaagatgacaatgag

SEQ ID NO: 5945 - DNA, 21 bp, Artificial sequence
  SiRNA target sequence
ggcataaagatgacaatgaga

SEQ ID NO: 5946 - DNA, 21 bp, Artificial sequence
  SiRNA target sequence
gcataaagatgacaatgagag

SEQ ID NO: 5947 - DNA, 21 bp, Artificial sequence
  SiRNA target sequence
cataaagatgacaatgagaga

SEQ ID NO: 5948 - DNA, 21 bp, Artificial sequence
  SiRNA target sequence
ataaagatgacaatgagagat

SEQ ID NO: 5949 - DNA, 21 bp, Artificial sequence
  SiRNA target sequence
taaagatgacaatgagagatt

SEQ ID NO: 5950 - DNA, 21 bp, Artificial sequence
  SiRNA target sequence
aaagatgacaatgagagattt

SEQ ID NO: 5951 - DNA, 21 bp, Artificial sequence
  SiRNA target sequence
aagatgacaatgagagatttt

SEQ ID NO: 5952 - DNA, 21 bp, Artificial sequence
  SiRNA target sequence
agatgacaatgagagattttg

SEQ ID NO: 5953 - DNA, 21 bp, Artificial sequence
  SiRNA target sequence
gatgacaatgagagattttgg

SEQ ID NO: 5954 - DNA, 21 bp, Artificial sequence
  SiRNA target sequence
atgacaatgagagattttggt

SEQ ID NO: 5955 - DNA, 21 bp, Artificial sequence
  SiRNA target sequence
tgacaatgagagattttggta

SEQ ID NO: 5956 - DNA, 21 bp, Artificial sequence
  SiRNA target sequence
gacaatgagagattttggtaa

SEQ ID NO: 5957 - DNA, 21 bp, Artificial sequence
  SiRNA target sequence
acaatgagagattttggtaag

SEQ ID NO: 5958 - DNA, 21 bp, Artificial sequence
  SiRNA target sequence
caatgagagattttggtaagc

SEQ ID NO: 5959 - DNA, 21 bp, Artificial sequence
  SiRNA target sequence
aatgagagattttggtaagca

SEQ ID NO: 5960 - DNA, 21 bp, Artificial sequence
  SiRNA target sequence
atgagagattttggtaagcat

SEQ ID NO: 5961 - DNA, 21 bp, Artificial sequence
  SiRNA target sequence
tgagagattttggtaagcatg

SEQ ID NO: 5962 - DNA, 21 bp, Artificial sequence
  SiRNA target sequence
gagagattttggtaagcatgt

SEQ ID NO: 5963 - DNA, 21 bp, Artificial sequence
  SiRNA target sequence
agagattttggtaagcatgtt

SEQ ID NO: 5964 - DNA, 21 bp, Artificial sequence
  SiRNA target sequence
gagattttggtaagcatgttt

SEQ ID NO: 5965 - DNA, 21 bp, Artificial sequence
  SiRNA target sequence
agattttggtaagcatgtttc

SEQ ID NO: 5966 - DNA, 21 bp, Artificial sequence
  SiRNA target sequence
gattttggtaagcatgtttcc

SEQ ID NO: 5967 - DNA, 21 bp, Artificial sequence
  SiRNA target sequence
attttggtaagcatgtttcca

SEQ ID NO: 5968 - DNA, 21 bp, Artificial sequence
  SiRNA target sequence
ttttggtaagcatgtttccat

SEQ ID NO: 5969 - DNA, 21 bp, Artificial sequence
  SiRNA target sequence
tttggtaagcatgtttccatg

SEQ ID NO: 5970 - DNA, 21 bp, Artificial sequence
  SiRNA target sequence
ttggtaagcatgtttccatgg

SEQ ID NO: 5971 - DNA, 21 bp, Artificial sequence
  SiRNA target sequence
tggtaagcatgtttccatggt

SEQ ID NO: 5972 - DNA, 21 bp, Artificial sequence
  SiRNA target sequence
ggtaagcatgtttccatggtc

SEQ ID NO: 5973 - DNA, 21 bp, Artificial sequence
  SiRNA target sequence
gtaagcatgtttccatggtct

SEQ ID NO: 5974 - DNA, 21 bp, Artificial sequence
  SiRNA target sequence
taagcatgtttccatggtctc

SEQ ID NO: 5975 - DNA, 21 bp, Artificial sequence
  SiRNA target sequence
aagcatgtttccatggtctct

SEQ ID NO: 5976 - DNA, 21 bp, Artificial sequence
  SiRNA target sequence
agcatgtttccatggtctctt

SEQ ID NO: 5977 - DNA, 21 bp, Artificial sequence
  SiRNA target sequence
gcatgtttccatggtctctta

SEQ ID NO: 5978 - DNA, 21 bp, Artificial sequence
  SiRNA target sequence
catgtttccatggtctcttat

SEQ ID NO: 5979 - DNA, 21 bp, Artificial sequence
  SiRNA target sequence
atgtttccatggtctcttatg

SEQ ID NO: 5980 - DNA, 21 bp, Artificial sequence
  SiRNA target sequence
tgtttccatggtctcttatgg

SEQ ID NO: 5981 - DNA, 21 bp, Artificial sequence
  SiRNA target sequence
gtttccatggtctcttatgga

SEQ ID NO: 5982 - DNA, 21 bp, Artificial sequence
  SiRNA target sequence
tttccatggtctcttatggag

SEQ ID NO: 5983 - DNA, 21 bp, Artificial sequence
  SiRNA target sequence
ttccatggtctcttatggaga

SEQ ID NO: 5984 - DNA, 21 bp, Artificial sequence
  SiRNA target sequence
tccatggtctcttatggagat

SEQ ID NO: 5985 - DNA, 21 bp, Artificial sequence
  SiRNA target sequence
ccatggtctcttatggagatg

SEQ ID NO: 5986 - DNA, 21 bp, Artificial sequence
  SiRNA target sequence
catggtctcttatggagatga

SEQ ID NO: 5987 - DNA, 21 bp, Artificial sequence
  SiRNA target sequence
atggtctcttatggagatgac

SEQ ID NO: 5988 - DNA, 21 bp, Artificial sequence
  SiRNA target sequence
tggtctcttatggagatgaca

SEQ ID NO: 5989 - DNA, 21 bp, Artificial sequence
  SiRNA target sequence
ggtctcttatggagatgacaa

SEQ ID NO: 5990 - DNA, 21 bp, Artificial sequence
  SiRNA target sequence
gtctcttatggagatgacaat

SEQ ID NO: 5991 - DNA, 21 bp, Artificial sequence
  SiRNA target sequence
tctcttatggagatgacaatg

SEQ ID NO: 5992 - DNA, 21 bp, Artificial sequence
  SiRNA target sequence
ctcttatggagatgacaatgt

SEQ ID NO: 5993 - DNA, 21 bp, Artificial sequence
  SiRNA target sequence
tcttatggagatgacaatgtc

SEQ ID NO: 5994 - DNA, 21 bp, Artificial sequence
  SiRNA target sequence
cttatggagatgacaatgtca

SEQ ID NO: 5995 - DNA, 21 bp, Artificial sequence
  SiRNA target sequence
ttatggagatgacaatgtcat

SEQ ID NO: 5996 - DNA, 21 bp, Artificial sequence
  SiRNA target sequence
tatggagatgacaatgtcata

SEQ ID NO: 5997 - DNA, 21 bp, Artificial sequence
  SiRNA target sequence
atggagatgacaatgtcataa

SEQ ID NO: 5998 - DNA, 21 bp, Artificial sequence
  SiRNA target sequence
tggagatgacaatgtcataaa

SEQ ID NO: 5999 - DNA, 21 bp, Artificial sequence
  SiRNA target sequence
ggagatgacaatgtcataaac

SEQ ID NO: 6000 - DNA, 21 bp, Artificial sequence
  SiRNA target sequence
gagatgacaatgtcataaact

SEQ ID NO: 6001 - DNA, 21 bp, Artificial sequence
  SiRNA target sequence
agatgacaatgtcataaactt

SEQ ID NO: 6002 - DNA, 21 bp, Artificial sequence
  SiRNA target sequence
gatgacaatgtcataaacttc

SEQ ID NO: 6003 - DNA, 21 bp, Artificial sequence
  SiRNA target sequence
atgacaatgtcataaacttca

SEQ ID NO: 6004 - DNA, 21 bp, Artificial sequence
  SiRNA target sequence
tgacaatgtcataaacttcag

SEQ ID NO: 6005 - DNA, 21 bp, Artificial sequence
  SiRNA target sequence
gacaatgtcataaacttcagt

SEQ ID NO: 6006 - DNA, 21 bp, Artificial sequence
  SiRNA target sequence
acaatgtcataaacttcagtg

SEQ ID NO: 6007 - DNA, 21 bp, Artificial sequence
  SiRNA target sequence
caatgtcataaacttcagtga

SEQ ID NO: 6008 - DNA, 21 bp, Artificial sequence
  SiRNA target sequence
aatgtcataaacttcagtgat

SEQ ID NO: 6009 - DNA, 21 bp, Artificial sequence
  SiRNA target sequence
atgtcataaacttcagtgatg

SEQ ID NO: 6010 - DNA, 21 bp, Artificial sequence
  SiRNA target sequence
tgtcataaacttcagtgatga

SEQ ID NO: 6011 - DNA, 21 bp, Artificial sequence
  SiRNA target sequence
gtcataaacttcagtgatgaa

SEQ ID NO: 6012 - DNA, 21 bp, Artificial sequence
  SiRNA target sequence
tcataaacttcagtgatgaag

SEQ ID NO: 6013 - DNA, 21 bp, Artificial sequence
  SiRNA target sequence
cataaacttcagtgatgaagt

SEQ ID NO: 6014 - DNA, 21 bp, Artificial sequence
  SiRNA target sequence
ataaacttcagtgatgaagta

SEQ ID NO: 6015 - DNA, 21 bp, Artificial sequence
  SiRNA target sequence
taaacttcagtgatgaagtat

SEQ ID NO: 6016 - DNA, 21 bp, Artificial sequence
  SiRNA target sequence
aaacttcagtgatgaagtatg

SEQ ID NO: 6017 - DNA, 21 bp, Artificial sequence
  SiRNA target sequence
aacttcagtgatgaagtatgt

SEQ ID NO: 6018 - DNA, 21 bp, Artificial sequence
  SiRNA target sequence
acttcagtgatgaagtatgtg

SEQ ID NO: 6019 - DNA, 21 bp, Artificial sequence
  SiRNA target sequence
cttcagtgatgaagtatgtga

SEQ ID NO: 6020 - DNA, 21 bp, Artificial sequence
  SiRNA target sequence
ttcagtgatgaagtatgtgaa

SEQ ID NO: 6021 - DNA, 21 bp, Artificial sequence
  SiRNA target sequence
tcagtgatgaagtatgtgaat

SEQ ID NO: 6022 - DNA, 21 bp, Artificial sequence
  SiRNA target sequence
cagtgatgaagtatgtgaatg

SEQ ID NO: 6023 - DNA, 21 bp, Artificial sequence
  SiRNA target sequence
agtgatgaagtatgtgaatgg

SEQ ID NO: 6024 - DNA, 21 bp, Artificial sequence
  SiRNA target sequence
gtgatgaagtatgtgaatggt

SEQ ID NO: 6025 - DNA, 21 bp, Artificial sequence
  SiRNA target sequence
tgatgaagtatgtgaatggta

SEQ ID NO: 6026 - DNA, 21 bp, Artificial sequence
  SiRNA target sequence
gatgaagtatgtgaatggtat

SEQ ID NO: 6027 - DNA, 21 bp, Artificial sequence
  SiRNA target sequence
atgaagtatgtgaatggtata

SEQ ID NO: 6028 - DNA, 21 bp, Artificial sequence
  SiRNA target sequence
tgaagtatgtgaatggtataa

SEQ ID NO: 6029 - DNA, 21 bp, Artificial sequence
  SiRNA target sequence
gaagtatgtgaatggtataac

SEQ ID NO: 6030 - DNA, 21 bp, Artificial sequence
  SiRNA target sequence
aagtatgtgaatggtataaca

SEQ ID NO: 6031 - DNA, 21 bp, Artificial sequence
  SiRNA target sequence
agtatgtgaatggtataacat

SEQ ID NO: 6032 - DNA, 21 bp, Artificial sequence
  SiRNA target sequence
gtatgtgaatggtataacatg

SEQ ID NO: 6033 - DNA, 21 bp, Artificial sequence
  SiRNA target sequence
tatgtgaatggtataacatgg

SEQ ID NO: 6034 - DNA, 21 bp, Artificial sequence
  SiRNA target sequence
atgtgaatggtataacatgga

SEQ ID NO: 6035 - DNA, 21 bp, Artificial sequence
  SiRNA target sequence
tgtgaatggtataacatggaa

SEQ ID NO: 6036 - DNA, 21 bp, Artificial sequence
  SiRNA target sequence
gtgaatggtataacatggaaa

SEQ ID NO: 6037 - DNA, 21 bp, Artificial sequence
  SiRNA target sequence
tgaatggtataacatggaaac

SEQ ID NO: 6038 - DNA, 21 bp, Artificial sequence
  SiRNA target sequence
gaatggtataacatggaaact

SEQ ID NO: 6039 - DNA, 21 bp, Artificial sequence
  SiRNA target sequence
aatggtataacatggaaacta

SEQ ID NO: 6040 - DNA, 21 bp, Artificial sequence
  SiRNA target sequence
atggtataacatggaaactat

SEQ ID NO: 6041 - DNA, 21 bp, Artificial sequence
  SiRNA target sequence
tggtataacatggaaactatt

SEQ ID NO: 6042 - DNA, 21 bp, Artificial sequence
  SiRNA target sequence
ggtataacatggaaactattg

SEQ ID NO: 6043 - DNA, 21 bp, Artificial sequence
  SiRNA target sequence
gtataacatggaaactattgc

SEQ ID NO: 6044 - DNA, 21 bp, Artificial sequence
  SiRNA target sequence
tataacatggaaactattgct

SEQ ID NO: 6045 - DNA, 21 bp, Artificial sequence
  SiRNA target sequence
ataacatggaaactattgcta

SEQ ID NO: 6046 - DNA, 21 bp, Artificial sequence
  SiRNA target sequence
taacatggaaactattgctaa

SEQ ID NO: 6047 - DNA, 21 bp, Artificial sequence
  SiRNA target sequence
aacatggaaactattgctaaa

SEQ ID NO: 6048 - DNA, 21 bp, Artificial sequence
  SiRNA target sequence
acatggaaactattgctaaag

SEQ ID NO: 6049 - DNA, 21 bp, Artificial sequence
  SiRNA target sequence
catggaaactattgctaaagc

SEQ ID NO: 6050 - DNA, 21 bp, Artificial sequence
  SiRNA target sequence
atggaaactattgctaaagca

SEQ ID NO: 6051 - DNA, 21 bp, Artificial sequence
  SiRNA target sequence
tggaaactattgctaaagcat

SEQ ID NO: 6052 - DNA, 21 bp, Artificial sequence
  SiRNA target sequence
ggaaactattgctaaagcatt

SEQ ID NO: 6053 - DNA, 21 bp, Artificial sequence
  SiRNA target sequence
gaaactattgctaaagcattt

SEQ ID NO: 6054 - DNA, 21 bp, Artificial sequence
  SiRNA target sequence
aaactattgctaaagcatttg

SEQ ID NO: 6055 - DNA, 21 bp, Artificial sequence
  SiRNA target sequence
aactattgctaaagcatttga

SEQ ID NO: 6056 - DNA, 21 bp, Artificial sequence
  SiRNA target sequence
actattgctaaagcatttgaa

SEQ ID NO: 6057 - DNA, 21 bp, Artificial sequence
  SiRNA target sequence
ctattgctaaagcatttgaaa

SEQ ID NO: 6058 - DNA, 21 bp, Artificial sequence
  SiRNA target sequence
tattgctaaagcatttgaaac

SEQ ID NO: 6059 - DNA, 21 bp, Artificial sequence
  SiRNA target sequence
attgctaaagcatttgaaacc

SEQ ID NO: 6060 - DNA, 21 bp, Artificial sequence
  SiRNA target sequence
ttgctaaagcatttgaaaccc

SEQ ID NO: 6061 - DNA, 21 bp, Artificial sequence
  SiRNA target sequence
tgctaaagcatttgaaaccct

SEQ ID NO: 6062 - DNA, 21 bp, Artificial sequence
  SiRNA target sequence
gctaaagcatttgaaaccctt

SEQ ID NO: 6063 - DNA, 21 bp, Artificial sequence
  SiRNA target sequence
ctaaagcatttgaaacccttg

SEQ ID NO: 6064 - DNA, 21 bp, Artificial sequence
  SiRNA target sequence
taaagcatttgaaacccttgg

SEQ ID NO: 6065 - DNA, 21 bp, Artificial sequence
  SiRNA target sequence
aaagcatttgaaacccttgga

SEQ ID NO: 6066 - DNA, 21 bp, Artificial sequence
  SiRNA target sequence
aagcatttgaaacccttggat

SEQ ID NO: 6067 - DNA, 21 bp, Artificial sequence
  SiRNA target sequence
agcatttgaaacccttggatt

SEQ ID NO: 6068 - DNA, 21 bp, Artificial sequence
  SiRNA target sequence
gcatttgaaacccttggattc

SEQ ID NO: 6069 - DNA, 21 bp, Artificial sequence
  SiRNA target sequence
catttgaaacccttggattca

SEQ ID NO: 6070 - DNA, 21 bp, Artificial sequence
  SiRNA target sequence
atttgaaacccttggattcac

SEQ ID NO: 6071 - DNA, 21 bp, Artificial sequence
  SiRNA target sequence
tttgaaacccttggattcacc

SEQ ID NO: 6072 - DNA, 21 bp, Artificial sequence
  SiRNA target sequence
ttgaaacccttggattcacct

SEQ ID NO: 6073 - DNA, 21 bp, Artificial sequence
  SiRNA target sequence
tgaaacccttggattcaccta

SEQ ID NO: 6074 - DNA, 21 bp, Artificial sequence
  SiRNA target sequence
gaaacccttggattcacctat

SEQ ID NO: 6075 - DNA, 21 bp, Artificial sequence
  SiRNA target sequence
aaacccttggattcacctata

SEQ ID NO: 6076 - DNA, 21 bp, Artificial sequence
  SiRNA target sequence
aacccttggattcacctatac

SEQ ID NO: 6077 - DNA, 21 bp, Artificial sequence
  SiRNA target sequence
acccttggattcacctatact

SEQ ID NO: 6078 - DNA, 21 bp, Artificial sequence
  SiRNA target sequence
cccttggattcacctatactg

SEQ ID NO: 6079 - DNA, 21 bp, Artificial sequence
  SiRNA target sequence
ccttggattcacctatactga

SEQ ID NO: 6080 - DNA, 21 bp, Artificial sequence
  SiRNA target sequence
cttggattcacctatactgat

SEQ ID NO: 6081 - DNA, 21 bp, Artificial sequence
  SiRNA target sequence
ttggattcacctatactgatg

SEQ ID NO: 6082 - DNA, 21 bp, Artificial sequence
  SiRNA target sequence
tggattcacctatactgatga

SEQ ID NO: 6083 - DNA, 21 bp, Artificial sequence
  SiRNA target sequence
ggattcacctatactgatgag

SEQ ID NO: 6084 - DNA, 21 bp, Artificial sequence
  SiRNA target sequence
gattcacctatactgatgagc

SEQ ID NO: 6085 - DNA, 21 bp, Artificial sequence
  SiRNA target sequence
attcacctatactgatgagct

SEQ ID NO: 6086 - DNA, 21 bp, Artificial sequence
  SiRNA target sequence
ttcacctatactgatgagctt

SEQ ID NO: 6087 - DNA, 21 bp, Artificial sequence
  SiRNA target sequence
tcacctatactgatgagctta

SEQ ID NO: 6088 - DNA, 21 bp, Artificial sequence
  SiRNA target sequence
cacctatactgatgagcttaa

SEQ ID NO: 6089 - DNA, 21 bp, Artificial sequence
  SiRNA target sequence
acctatactgatgagcttaag

SEQ ID NO: 6090 - DNA, 21 bp, Artificial sequence
  SiRNA target sequence
cctatactgatgagcttaagg

SEQ ID NO: 6091 - DNA, 21 bp, Artificial sequence
  SiRNA target sequence
ctatactgatgagcttaaggg

SEQ ID NO: 6092 - DNA, 21 bp, Artificial sequence
  SiRNA target sequence
tatactgatgagcttaagggc

SEQ ID NO: 6093 - DNA, 21 bp, Artificial sequence
  SiRNA target sequence
atactgatgagcttaagggcg

SEQ ID NO: 6094 - DNA, 21 bp, Artificial sequence
  SiRNA target sequence
tactgatgagcttaagggcgt

SEQ ID NO: 6095 - DNA, 21 bp, Artificial sequence
  SiRNA target sequence
actgatgagcttaagggcgta

SEQ ID NO: 6096 - DNA, 21 bp, Artificial sequence
  SiRNA target sequence
ctgatgagcttaagggcgtaa

SEQ ID NO: 6097 - DNA, 21 bp, Artificial sequence
  SiRNA target sequence
tgatgagcttaagggcgtaaa

SEQ ID NO: 6098 - DNA, 21 bp, Artificial sequence
  SiRNA target sequence
gatgagcttaagggcgtaaat

SEQ ID NO: 6099 - DNA, 21 bp, Artificial sequence
  SiRNA target sequence
atgagcttaagggcgtaaatg

SEQ ID NO: 6100 - DNA, 21 bp, Artificial sequence
  SiRNA target sequence
tgagcttaagggcgtaaatgg

SEQ ID NO: 6101 - DNA, 21 bp, Artificial sequence
  SiRNA target sequence
gagcttaagggcgtaaatggc

SEQ ID NO: 6102 - DNA, 21 bp, Artificial sequence
  SiRNA target sequence
agcttaagggcgtaaatggcg

SEQ ID NO: 6103 - DNA, 21 bp, Artificial sequence
  SiRNA target sequence
gcttaagggcgtaaatggcga

SEQ ID NO: 6104 - DNA, 21 bp, Artificial sequence
  SiRNA target sequence
cttaagggcgtaaatggcgaa

SEQ ID NO: 6105 - DNA, 21 bp, Artificial sequence
  SiRNA target sequence
ttaagggcgtaaatggcgaag

SEQ ID NO: 6106 - DNA, 21 bp, Artificial sequence
  SiRNA target sequence
taagggcgtaaatggcgaagt

SEQ ID NO: 6107 - DNA, 21 bp, Artificial sequence
  SiRNA target sequence
aagggcgtaaatggcgaagta

SEQ ID NO: 6108 - DNA, 21 bp, Artificial sequence
  SiRNA target sequence
agggcgtaaatggcgaagtac

SEQ ID NO: 6109 - DNA, 21 bp, Artificial sequence
  SiRNA target sequence
gggcgtaaatggcgaagtacc

SEQ ID NO: 6110 - DNA, 21 bp, Artificial sequence
  SiRNA target sequence
ggcgtaaatggcgaagtacca

SEQ ID NO: 6111 - DNA, 21 bp, Artificial sequence
  SiRNA target sequence
gcgtaaatggcgaagtaccaa

SEQ ID NO: 6112 - DNA, 21 bp, Artificial sequence
  SiRNA target sequence
cgtaaatggcgaagtaccaaa

SEQ ID NO: 6113 - DNA, 21 bp, Artificial sequence
  SiRNA target sequence
gtaaatggcgaagtaccaaaa

SEQ ID NO: 6114 - DNA, 21 bp, Artificial sequence
  SiRNA target sequence
taaatggcgaagtaccaaaat

SEQ ID NO: 6115 - DNA, 21 bp, Artificial sequence
  SiRNA target sequence
aaatggcgaagtaccaaaatg

SEQ ID NO: 6116 - DNA, 21 bp, Artificial sequence
  SiRNA target sequence
aatggcgaagtaccaaaatgg

SEQ ID NO: 6117 - DNA, 21 bp, Artificial sequence
  SiRNA target sequence
atggcgaagtaccaaaatggc

SEQ ID NO: 6118 - DNA, 21 bp, Artificial sequence
  SiRNA target sequence
tggcgaagtaccaaaatggcg

SEQ ID NO: 6119 - DNA, 21 bp, Artificial sequence
  SiRNA target sequence
ggcgaagtaccaaaatggcga

SEQ ID NO: 6120 - DNA, 21 bp, Artificial sequence
  SiRNA target sequence
gcgaagtaccaaaatggcgat

SEQ ID NO: 6121 - DNA, 21 bp, Artificial sequence
  SiRNA target sequence
cgaagtaccaaaatggcgatc

SEQ ID NO: 6122 - DNA, 21 bp, Artificial sequence
  SiRNA target sequence
gaagtaccaaaatggcgatca

SEQ ID NO: 6123 - DNA, 21 bp, Artificial sequence
  SiRNA target sequence
aagtaccaaaatggcgatcaa

SEQ ID NO: 6124 - DNA, 21 bp, Artificial sequence
  SiRNA target sequence
agtaccaaaatggcgatcaat

SEQ ID NO: 6125 - DNA, 21 bp, Artificial sequence
  SiRNA target sequence
gtaccaaaatggcgatcaatt

SEQ ID NO: 6126 - DNA, 21 bp, Artificial sequence
  SiRNA target sequence
taccaaaatggcgatcaatta

SEQ ID NO: 6127 - DNA, 21 bp, Artificial sequence
  SiRNA target sequence
accaaaatggcgatcaattaa

SEQ ID NO: 6128 - DNA, 21 bp, Artificial sequence
  SiRNA target sequence
ccaaaatggcgatcaattaag

SEQ ID NO: 6129 - DNA, 21 bp, Artificial sequence
  SiRNA target sequence
caaaatggcgatcaattaagg

SEQ ID NO: 6130 - DNA, 21 bp, Artificial sequence
  SiRNA target sequence
aaaatggcgatcaattaagga

SEQ ID NO: 6131 - DNA, 21 bp, Artificial sequence
  SiRNA target sequence
aaatggcgatcaattaaggac

SEQ ID NO: 6132 - DNA, 21 bp, Artificial sequence
  SiRNA target sequence
aatggcgatcaattaaggacg

SEQ ID NO: 6133 - DNA, 21 bp, Artificial sequence
  SiRNA target sequence
atggcgatcaattaaggacgt

SEQ ID NO: 6134 - DNA, 21 bp, Artificial sequence
  SiRNA target sequence
tggcgatcaattaaggacgtg

SEQ ID NO: 6135 - DNA, 21 bp, Artificial sequence
  SiRNA target sequence
ggcgatcaattaaggacgtgc

SEQ ID NO: 6136 - DNA, 21 bp, Artificial sequence
  SiRNA target sequence
gcgatcaattaaggacgtgca

SEQ ID NO: 6137 - DNA, 21 bp, Artificial sequence
  SiRNA target sequence
cgatcaattaaggacgtgcag

SEQ ID NO: 6138 - DNA, 21 bp, Artificial sequence
  SiRNA target sequence
gatcaattaaggacgtgcagt

SEQ ID NO: 6139 - DNA, 21 bp, Artificial sequence
  SiRNA target sequence
atcaattaaggacgtgcagta

SEQ ID NO: 6140 - DNA, 21 bp, Artificial sequence
  SiRNA target sequence
tcaattaaggacgtgcagtat

SEQ ID NO: 6141 - DNA, 21 bp, Artificial sequence
  SiRNA target sequence
caattaaggacgtgcagtatt

SEQ ID NO: 6142 - DNA, 21 bp, Artificial sequence
  SiRNA target sequence
aattaaggacgtgcagtattt

SEQ ID NO: 6143 - DNA, 21 bp, Artificial sequence
  SiRNA target sequence
attaaggacgtgcagtattta

SEQ ID NO: 6144 - DNA, 21 bp, Artificial sequence
  SiRNA target sequence
ttaaggacgtgcagtatttaa

SEQ ID NO: 6145 - DNA, 21 bp, Artificial sequence
  SiRNA target sequence
taaggacgtgcagtatttaaa

SEQ ID NO: 6146 - DNA, 21 bp, Artificial sequence
  SiRNA target sequence
aaggacgtgcagtatttaaaa

SEQ ID NO: 6147 - DNA, 21 bp, Artificial sequence
  SiRNA target sequence
aggacgtgcagtatttaaaac

SEQ ID NO: 6148 - DNA, 21 bp, Artificial sequence
  SiRNA target sequence
ggacgtgcagtatttaaaacg

SEQ ID NO: 6149 - DNA, 21 bp, Artificial sequence
  SiRNA target sequence
gacgtgcagtatttaaaacgt

SEQ ID NO: 6150 - DNA, 21 bp, Artificial sequence
  SiRNA target sequence
acgtgcagtatttaaaacgta

SEQ ID NO: 6151 - DNA, 21 bp, Artificial sequence
  SiRNA target sequence
cgtgcagtatttaaaacgtaa

SEQ ID NO: 6152 - DNA, 21 bp, Artificial sequence
  SiRNA target sequence
gtgcagtatttaaaacgtaag

SEQ ID NO: 6153 - DNA, 21 bp, Artificial sequence
  SiRNA target sequence
tgcagtatttaaaacgtaagt

SEQ ID NO: 6154 - DNA, 21 bp, Artificial sequence
  SiRNA target sequence
gcagtatttaaaacgtaagtt

SEQ ID NO: 6155 - DNA, 21 bp, Artificial sequence
  SiRNA target sequence
cagtatttaaaacgtaagttt

SEQ ID NO: 6156 - DNA, 21 bp, Artificial sequence
  SiRNA target sequence
agtatttaaaacgtaagttta

SEQ ID NO: 6157 - DNA, 21 bp, Artificial sequence
  SiRNA target sequence
gtatttaaaacgtaagtttag

SEQ ID NO: 6158 - DNA, 21 bp, Artificial sequence
  SiRNA target sequence
tatttaaaacgtaagtttaga

SEQ ID NO: 6159 - DNA, 21 bp, Artificial sequence
  SiRNA target sequence
atttaaaacgtaagtttagat

SEQ ID NO: 6160 - DNA, 21 bp, Artificial sequence
  SiRNA target sequence
tttaaaacgtaagtttagata

SEQ ID NO: 6161 - DNA, 21 bp, Artificial sequence
  SiRNA target sequence
ttaaaacgtaagtttagatac

SEQ ID NO: 6162 - DNA, 21 bp, Artificial sequence
  SiRNA target sequence
taaaacgtaagtttagatacg

SEQ ID NO: 6163 - DNA, 21 bp, Artificial sequence
  SiRNA target sequence
aaaacgtaagtttagatacga

SEQ ID NO: 6164 - DNA, 21 bp, Artificial sequence
  SiRNA target sequence
aaacgtaagtttagatacgat

SEQ ID NO: 6165 - DNA, 21 bp, Artificial sequence
  SiRNA target sequence
aacgtaagtttagatacgatg

SEQ ID NO: 6166 - DNA, 21 bp, Artificial sequence
  SiRNA target sequence
acgtaagtttagatacgatga

SEQ ID NO: 6167 - DNA, 21 bp, Artificial sequence
  SiRNA target sequence
cgtaagtttagatacgatgaa

SEQ ID NO: 6168 - DNA, 21 bp, Artificial sequence
  SiRNA target sequence
gtaagtttagatacgatgaac

SEQ ID NO: 6169 - DNA, 21 bp, Artificial sequence
  SiRNA target sequence
taagtttagatacgatgaaca

SEQ ID NO: 6170 - DNA, 21 bp, Artificial sequence
  SiRNA target sequence
aagtttagatacgatgaacaa

SEQ ID NO: 6171 - DNA, 21 bp, Artificial sequence
  SiRNA target sequence
agtttagatacgatgaacaac

SEQ ID NO: 6172 - DNA, 21 bp, Artificial sequence
  SiRNA target sequence
gtttagatacgatgaacaacg

SEQ ID NO: 6173 - DNA, 21 bp, Artificial sequence
  SiRNA target sequence
tttagatacgatgaacaacgg

SEQ ID NO: 6174 - DNA, 21 bp, Artificial sequence
  SiRNA target sequence
ttagatacgatgaacaacgga

SEQ ID NO: 6175 - DNA, 21 bp, Artificial sequence
  SiRNA target sequence
tagatacgatgaacaacggaa

SEQ ID NO: 6176 - DNA, 21 bp, Artificial sequence
  SiRNA target sequence
agatacgatgaacaacggaag

SEQ ID NO: 6177 - DNA, 21 bp, Artificial sequence
  SiRNA target sequence
gatacgatgaacaacggaagg

SEQ ID NO: 6178 - DNA, 21 bp, Artificial sequence
  SiRNA target sequence
atacgatgaacaacggaaggt

SEQ ID NO: 6179 - DNA, 21 bp, Artificial sequence
  SiRNA target sequence
tacgatgaacaacggaaggtt

SEQ ID NO: 6180 - DNA, 21 bp, Artificial sequence
  SiRNA target sequence
acgatgaacaacggaaggttt

SEQ ID NO: 6181 - DNA, 21 bp, Artificial sequence
  SiRNA target sequence
cgatgaacaacggaaggtttg

SEQ ID NO: 6182 - DNA, 21 bp, Artificial sequence
  SiRNA target sequence
gatgaacaacggaaggtttgg

SEQ ID NO: 6183 - DNA, 21 bp, Artificial sequence
  SiRNA target sequence
atgaacaacggaaggtttggg

SEQ ID NO: 6184 - DNA, 21 bp, Artificial sequence
  SiRNA target sequence
tgaacaacggaaggtttggga

SEQ ID NO: 6185 - DNA, 21 bp, Artificial sequence
  SiRNA target sequence
gaacaacggaaggtttgggaa

SEQ ID NO: 6186 - DNA, 21 bp, Artificial sequence
  SiRNA target sequence
aacaacggaaggtttgggaag

SEQ ID NO: 6187 - DNA, 21 bp, Artificial sequence
  SiRNA target sequence
acaacggaaggtttgggaagc

SEQ ID NO: 6188 - DNA, 21 bp, Artificial sequence
  SiRNA target sequence
caacggaaggtttgggaagcc

SEQ ID NO: 6189 - DNA, 21 bp, Artificial sequence
  SiRNA target sequence
aacggaaggtttgggaagccc

SEQ ID NO: 6190 - DNA, 21 bp, Artificial sequence
  SiRNA target sequence
acggaaggtttgggaagcccc

SEQ ID NO: 6191 - DNA, 21 bp, Artificial sequence
  SiRNA target sequence
cggaaggtttgggaagcccca

SEQ ID NO: 6192 - DNA, 21 bp, Artificial sequence
  SiRNA target sequence
ggaaggtttgggaagccccac

SEQ ID NO: 6193 - DNA, 21 bp, Artificial sequence
  SiRNA target sequence
gaaggtttgggaagccccact

SEQ ID NO: 6194 - DNA, 21 bp, Artificial sequence
  SiRNA target sequence
aaggtttgggaagccccactt

SEQ ID NO: 6195 - DNA, 21 bp, Artificial sequence
  SiRNA target sequence
aggtttgggaagccccacttt

SEQ ID NO: 6196 - DNA, 21 bp, Artificial sequence
  SiRNA target sequence
ggtttgggaagccccactttg

SEQ ID NO: 6197 - DNA, 21 bp, Artificial sequence
  SiRNA target sequence
gtttgggaagccccactttgt

SEQ ID NO: 6198 - DNA, 21 bp, Artificial sequence
  SiRNA target sequence
tttgggaagccccactttgta

SEQ ID NO: 6199 - DNA, 21 bp, Artificial sequence
  SiRNA target sequence
ttgggaagccccactttgtat

SEQ ID NO: 6200 - DNA, 21 bp, Artificial sequence
  SiRNA target sequence
tgggaagccccactttgtatg

SEQ ID NO: 6201 - DNA, 21 bp, Artificial sequence
  SiRNA target sequence
gggaagccccactttgtatgg

SEQ ID NO: 6202 - DNA, 21 bp, Artificial sequence
  SiRNA target sequence
ggaagccccactttgtatgga

SEQ ID NO: 6203 - DNA, 21 bp, Artificial sequence
  SiRNA target sequence
gaagccccactttgtatggac

SEQ ID NO: 6204 - DNA, 21 bp, Artificial sequence
  SiRNA target sequence
aagccccactttgtatggaca

SEQ ID NO: 6205 - DNA, 21 bp, Artificial sequence
  SiRNA target sequence
agccccactttgtatggacac

SEQ ID NO: 6206 - DNA, 21 bp, Artificial sequence
  SiRNA target sequence
gccccactttgtatggacaca

SEQ ID NO: 6207 - DNA, 21 bp, Artificial sequence
  SiRNA target sequence
ccccactttgtatggacacaa

SEQ ID NO: 6208 - DNA, 21 bp, Artificial sequence
  SiRNA target sequence
cccactttgtatggacacaat

SEQ ID NO: 6209 - DNA, 21 bp, Artificial sequence
  SiRNA target sequence
ccactttgtatggacacaatt

SEQ ID NO: 6210 - DNA, 21 bp, Artificial sequence
  SiRNA target sequence
cactttgtatggacacaattc

SEQ ID NO: 6211 - DNA, 21 bp, Artificial sequence
  SiRNA target sequence
actttgtatggacacaattct

SEQ ID NO: 6212 - DNA, 21 bp, Artificial sequence
  SiRNA target sequence
ctttgtatggacacaattctt

SEQ ID NO: 6213 - DNA, 21 bp, Artificial sequence
  SiRNA target sequence
tttgtatggacacaattcttg

SEQ ID NO: 6214 - DNA, 21 bp, Artificial sequence
  SiRNA target sequence
ttgtatggacacaattcttga

SEQ ID NO: 6215 - DNA, 21 bp, Artificial sequence
  SiRNA target sequence
tgtatggacacaattcttgaa

SEQ ID NO: 6216 - DNA, 21 bp, Artificial sequence
  SiRNA target sequence
gtatggacacaattcttgaaa

SEQ ID NO: 6217 - DNA, 21 bp, Artificial sequence
  SiRNA target sequence
tatggacacaattcttgaaat

SEQ ID NO: 6218 - DNA, 21 bp, Artificial sequence
  SiRNA target sequence
atggacacaattcttgaaatg

SEQ ID NO: 6219 - DNA, 21 bp, Artificial sequence
  SiRNA target sequence
tggacacaattcttgaaatgc

SEQ ID NO: 6220 - DNA, 21 bp, Artificial sequence
  SiRNA target sequence
ggacacaattcttgaaatgcc

SEQ ID NO: 6221 - DNA, 21 bp, Artificial sequence
  SiRNA target sequence
gacacaattcttgaaatgcca

SEQ ID NO: 6222 - DNA, 21 bp, Artificial sequence
  SiRNA target sequence
acacaattcttgaaatgccaa

SEQ ID NO: 6223 - DNA, 21 bp, Artificial sequence
  SiRNA target sequence
cacaattcttgaaatgccaaa

SEQ ID NO: 6224 - DNA, 21 bp, Artificial sequence
  SiRNA target sequence
acaattcttgaaatgccaaac

SEQ ID NO: 6225 - DNA, 21 bp, Artificial sequence
  SiRNA target sequence
caattcttgaaatgccaaact

SEQ ID NO: 6226 - DNA, 21 bp, Artificial sequence
  SiRNA target sequence
aattcttgaaatgccaaactg

SEQ ID NO: 6227 - DNA, 21 bp, Artificial sequence
  SiRNA target sequence
attcttgaaatgccaaactgg

SEQ ID NO: 6228 - DNA, 21 bp, Artificial sequence
  SiRNA target sequence
ttcttgaaatgccaaactggt

SEQ ID NO: 6229 - DNA, 21 bp, Artificial sequence
  SiRNA target sequence
tcttgaaatgccaaactggtg

SEQ ID NO: 6230 - DNA, 21 bp, Artificial sequence
  SiRNA target sequence
cttgaaatgccaaactggtgt

SEQ ID NO: 6231 - DNA, 21 bp, Artificial sequence
  SiRNA target sequence
ttgaaatgccaaactggtgtc

SEQ ID NO: 6232 - DNA, 21 bp, Artificial sequence
  SiRNA target sequence
tgaaatgccaaactggtgtcg

SEQ ID NO: 6233 - DNA, 21 bp, Artificial sequence
  SiRNA target sequence
gaaatgccaaactggtgtcga

SEQ ID NO: 6234 - DNA, 21 bp, Artificial sequence
  SiRNA target sequence
aaatgccaaactggtgtcgag

SEQ ID NO: 6235 - DNA, 21 bp, Artificial sequence
  SiRNA target sequence
aatgccaaactggtgtcgagg

SEQ ID NO: 6236 - DNA, 21 bp, Artificial sequence
  SiRNA target sequence
atgccaaactggtgtcgagga

SEQ ID NO: 6237 - DNA, 21 bp, Artificial sequence
  SiRNA target sequence
tgccaaactggtgtcgaggag

SEQ ID NO: 6238 - DNA, 21 bp, Artificial sequence
  SiRNA target sequence
gccaaactggtgtcgaggagg

SEQ ID NO: 6239 - DNA, 21 bp, Artificial sequence
  SiRNA target sequence
ccaaactggtgtcgaggagga

SEQ ID NO: 6240 - DNA, 21 bp, Artificial sequence
  SiRNA target sequence
caaactggtgtcgaggaggac

SEQ ID NO: 6241 - DNA, 21 bp, Artificial sequence
  SiRNA target sequence
aaactggtgtcgaggaggact

SEQ ID NO: 6242 - DNA, 21 bp, Artificial sequence
  SiRNA target sequence
aactggtgtcgaggaggactt

SEQ ID NO: 6243 - DNA, 21 bp, Artificial sequence
  SiRNA target sequence
actggtgtcgaggaggacttg

SEQ ID NO: 6244 - DNA, 21 bp, Artificial sequence
  SiRNA target sequence
ctggtgtcgaggaggacttga

SEQ ID NO: 6245 - DNA, 21 bp, Artificial sequence
  SiRNA target sequence
tggtgtcgaggaggacttgac

SEQ ID NO: 6246 - DNA, 21 bp, Artificial sequence
  SiRNA target sequence
ggtgtcgaggaggacttgaca

SEQ ID NO: 6247 - DNA, 21 bp, Artificial sequence
  SiRNA target sequence
gtgtcgaggaggacttgacat

SEQ ID NO: 6248 - DNA, 21 bp, Artificial sequence
  SiRNA target sequence
tgtcgaggaggacttgacatt

SEQ ID NO: 6249 - DNA, 21 bp, Artificial sequence
  SiRNA target sequence
gtcgaggaggacttgacattc

SEQ ID NO: 6250 - DNA, 21 bp, Artificial sequence
  SiRNA target sequence
tcgaggaggacttgacattca

SEQ ID NO: 6251 - DNA, 21 bp, Artificial sequence
  SiRNA target sequence
cgaggaggacttgacattcaa

SEQ ID NO: 6252 - DNA, 21 bp, Artificial sequence
  SiRNA target sequence
gaggaggacttgacattcaag

SEQ ID NO: 6253 - DNA, 21 bp, Artificial sequence
  SiRNA target sequence
aggaggacttgacattcaaga

SEQ ID NO: 6254 - DNA, 21 bp, Artificial sequence
  SiRNA target sequence
ggaggacttgacattcaagaa

SEQ ID NO: 6255 - DNA, 21 bp, Artificial sequence
  SiRNA target sequence
gaggacttgacattcaagaag

SEQ ID NO: 6256 - DNA, 21 bp, Artificial sequence
  SiRNA target sequence
aggacttgacattcaagaagg

SEQ ID NO: 6257 - DNA, 21 bp, Artificial sequence
  SiRNA target sequence
ggacttgacattcaagaaggt

SEQ ID NO: 6258 - DNA, 21 bp, Artificial sequence
  SiRNA target sequence
gacttgacattcaagaaggta

SEQ ID NO: 6259 - DNA, 21 bp, Artificial sequence
  SiRNA target sequence
acttgacattcaagaaggtac

SEQ ID NO: 6260 - DNA, 21 bp, Artificial sequence
  SiRNA target sequence
cttgacattcaagaaggtaca

SEQ ID NO: 6261 - DNA, 21 bp, Artificial sequence
  SiRNA target sequence
ttgacattcaagaaggtacaa

SEQ ID NO: 6262 - DNA, 21 bp, Artificial sequence
  SiRNA target sequence
tgacattcaagaaggtacaaa

SEQ ID NO: 6263 - DNA, 21 bp, Artificial sequence
  SiRNA target sequence
gacattcaagaaggtacaaag

SEQ ID NO: 6264 - DNA, 21 bp, Artificial sequence
  SiRNA target sequence
acattcaagaaggtacaaagt

SEQ ID NO: 6265 - DNA, 21 bp, Artificial sequence
  SiRNA target sequence
cattcaagaaggtacaaagtt

SEQ ID NO: 6266 - DNA, 21 bp, Artificial sequence
  SiRNA target sequence
attcaagaaggtacaaagttg

SEQ ID NO: 6267 - DNA, 21 bp, Artificial sequence
  SiRNA target sequence
ttcaagaaggtacaaagttga

SEQ ID NO: 6268 - DNA, 21 bp, Artificial sequence
  SiRNA target sequence
tcaagaaggtacaaagttgaa

SEQ ID NO: 6269 - DNA, 21 bp, Artificial sequence
  SiRNA target sequence
caagaaggtacaaagttgaat

SEQ ID NO: 6270 - DNA, 21 bp, Artificial sequence
  SiRNA target sequence
aagaaggtacaaagttgaatt

SEQ ID NO: 6271 - DNA, 21 bp, Artificial sequence
  SiRNA target sequence
agaaggtacaaagttgaattg

SEQ ID NO: 6272 - DNA, 21 bp, Artificial sequence
  SiRNA target sequence
gaaggtacaaagttgaattgt

SEQ ID NO: 6273 - DNA, 21 bp, Artificial sequence
  SiRNA target sequence
aaggtacaaagttgaattgtg

SEQ ID NO: 6274 - DNA, 21 bp, Artificial sequence
  SiRNA target sequence
aggtacaaagttgaattgtga

SEQ ID NO: 6275 - DNA, 21 bp, Artificial sequence
  SiRNA target sequence
ggtacaaagttgaattgtgaa

SEQ ID NO: 6276 - DNA, 21 bp, Artificial sequence
  SiRNA target sequence
gtacaaagttgaattgtgaaa

SEQ ID NO: 6277 - DNA, 21 bp, Artificial sequence
  SiRNA target sequence
tacaaagttgaattgtgaaaa

SEQ ID NO: 6278 - DNA, 21 bp, Artificial sequence
  SiRNA target sequence
acaaagttgaattgtgaaaat

SEQ ID NO: 6279 - DNA, 21 bp, Artificial sequence
  SiRNA target sequence
caaagttgaattgtgaaaatg

SEQ ID NO: 6280 - DNA, 21 bp, Artificial sequence
  SiRNA target sequence
aaagttgaattgtgaaaatgc

SEQ ID NO: 6281 - DNA, 21 bp, Artificial sequence
  SiRNA target sequence
aagttgaattgtgaaaatgca

SEQ ID NO: 6282 - DNA, 21 bp, Artificial sequence
  SiRNA target sequence
agttgaattgtgaaaatgcaa

SEQ ID NO: 6283 - DNA, 21 bp, Artificial sequence
  SiRNA target sequence
gttgaattgtgaaaatgcaat

SEQ ID NO: 6284 - DNA, 21 bp, Artificial sequence
  SiRNA target sequence
ttgaattgtgaaaatgcaatt

SEQ ID NO: 6285 - DNA, 21 bp, Artificial sequence
  SiRNA target sequence
tgaattgtgaaaatgcaatta

SEQ ID NO: 6286 - DNA, 21 bp, Artificial sequence
  SiRNA target sequence
gaattgtgaaaatgcaattat

SEQ ID NO: 6287 - DNA, 21 bp, Artificial sequence
  SiRNA target sequence
aattgtgaaaatgcaattatg

SEQ ID NO: 6288 - DNA, 21 bp, Artificial sequence
  SiRNA target sequence
attgtgaaaatgcaattatgg

SEQ ID NO: 6289 - DNA, 21 bp, Artificial sequence
  SiRNA target sequence
ttgtgaaaatgcaattatgga

SEQ ID NO: 6290 - DNA, 21 bp, Artificial sequence
  SiRNA target sequence
tgtgaaaatgcaattatggag

SEQ ID NO: 6291 - DNA, 21 bp, Artificial sequence
  SiRNA target sequence
gtgaaaatgcaattatggagc

SEQ ID NO: 6292 - DNA, 21 bp, Artificial sequence
  SiRNA target sequence
tgaaaatgcaattatggagct

SEQ ID NO: 6293 - DNA, 21 bp, Artificial sequence
  SiRNA target sequence
gaaaatgcaattatggagctt

SEQ ID NO: 6294 - DNA, 21 bp, Artificial sequence
  SiRNA target sequence
aaaatgcaattatggagcttt

SEQ ID NO: 6295 - DNA, 21 bp, Artificial sequence
  SiRNA target sequence
aaatgcaattatggagctttc

SEQ ID NO: 6296 - DNA, 21 bp, Artificial sequence
  SiRNA target sequence
aatgcaattatggagctttcc

SEQ ID NO: 6297 - DNA, 21 bp, Artificial sequence
  SiRNA target sequence
atgcaattatggagctttcca

SEQ ID NO: 6298 - DNA, 21 bp, Artificial sequence
  SiRNA target sequence
tgcaattatggagctttccat

SEQ ID NO: 6299 - DNA, 21 bp, Artificial sequence
  SiRNA target sequence
gcaattatggagctttccatg

SEQ ID NO: 6300 - DNA, 21 bp, Artificial sequence
  SiRNA target sequence
caattatggagctttccatgc

SEQ ID NO: 6301 - DNA, 21 bp, Artificial sequence
  SiRNA target sequence
aattatggagctttccatgca

SEQ ID NO: 6302 - DNA, 21 bp, Artificial sequence
  SiRNA target sequence
attatggagctttccatgcat

SEQ ID NO: 6303 - DNA, 21 bp, Artificial sequence
  SiRNA target sequence
ttatggagctttccatgcatg

SEQ ID NO: 6304 - DNA, 21 bp, Artificial sequence
  SiRNA target sequence
tatggagctttccatgcatga

SEQ ID NO: 6305 - DNA, 21 bp, Artificial sequence
  SiRNA target sequence
atggagctttccatgcatgaa

SEQ ID NO: 6306 - DNA, 21 bp, Artificial sequence
  SiRNA target sequence
tggagctttccatgcatgaag

SEQ ID NO: 6307 - DNA, 21 bp, Artificial sequence
  SiRNA target sequence
ggagctttccatgcatgaaga

SEQ ID NO: 6308 - DNA, 21 bp, Artificial sequence
  SiRNA target sequence
gagctttccatgcatgaagag

SEQ ID NO: 6309 - DNA, 21 bp, Artificial sequence
  SiRNA target sequence
agctttccatgcatgaagaga

SEQ ID NO: 6310 - DNA, 21 bp, Artificial sequence
  SiRNA target sequence
gctttccatgcatgaagagag

SEQ ID NO: 6311 - DNA, 21 bp, Artificial sequence
  SiRNA target sequence
ctttccatgcatgaagagagc

SEQ ID NO: 6312 - DNA, 21 bp, Artificial sequence
  SiRNA target sequence
tttccatgcatgaagagagcg

SEQ ID NO: 6313 - DNA, 21 bp, Artificial sequence
  SiRNA target sequence
ttccatgcatgaagagagcgt

SEQ ID NO: 6314 - DNA, 21 bp, Artificial sequence
  SiRNA target sequence
tccatgcatgaagagagcgtt

SEQ ID NO: 6315 - DNA, 21 bp, Artificial sequence
  SiRNA target sequence
ccatgcatgaagagagcgttt

SEQ ID NO: 6316 - DNA, 21 bp, Artificial sequence
  SiRNA target sequence
catgcatgaagagagcgtttt

SEQ ID NO: 6317 - DNA, 21 bp, Artificial sequence
  SiRNA target sequence
atgcatgaagagagcgttttt

SEQ ID NO: 6318 - DNA, 21 bp, Artificial sequence
  SiRNA target sequence
tgcatgaagagagcgttttta

SEQ ID NO: 6319 - DNA, 21 bp, Artificial sequence
  SiRNA target sequence
gcatgaagagagcgtttttaa

SEQ ID NO: 6320 - DNA, 21 bp, Artificial sequence
  SiRNA target sequence
catgaagagagcgtttttaat

SEQ ID NO: 6321 - DNA, 21 bp, Artificial sequence
  SiRNA target sequence
atgaagagagcgtttttaata

SEQ ID NO: 6322 - DNA, 21 bp, Artificial sequence
  SiRNA target sequence
tgaagagagcgtttttaatac

SEQ ID NO: 6323 - DNA, 21 bp, Artificial sequence
  SiRNA target sequence
gaagagagcgtttttaatacc

SEQ ID NO: 6324 - DNA, 21 bp, Artificial sequence
  SiRNA target sequence
aagagagcgtttttaatacct

SEQ ID NO: 6325 - DNA, 21 bp, Artificial sequence
  SiRNA target sequence
agagagcgtttttaatacctg

SEQ ID NO: 6326 - DNA, 21 bp, Artificial sequence
  SiRNA target sequence
gagagcgtttttaatacctgg

SEQ ID NO: 6327 - DNA, 21 bp, Artificial sequence
  SiRNA target sequence
agagcgtttttaatacctggt

SEQ ID NO: 6328 - DNA, 21 bp, Artificial sequence
  SiRNA target sequence
gagcgtttttaatacctggtc

SEQ ID NO: 6329 - DNA, 21 bp, Artificial sequence
  SiRNA target sequence
agcgtttttaatacctggtct

SEQ ID NO: 6330 - DNA, 21 bp, Artificial sequence
  SiRNA target sequence
gcgtttttaatacctggtcta

SEQ ID NO: 6331 - DNA, 21 bp, Artificial sequence
  SiRNA target sequence
cgtttttaatacctggtctaa

SEQ ID NO: 6332 - DNA, 21 bp, Artificial sequence
  SiRNA target sequence
gtttttaatacctggtctaaa

SEQ ID NO: 6333 - DNA, 21 bp, Artificial sequence
  SiRNA target sequence
tttttaatacctggtctaaaa

SEQ ID NO: 6334 - DNA, 21 bp, Artificial sequence
  SiRNA target sequence
ttttaatacctggtctaaaat

SEQ ID NO: 6335 - DNA, 21 bp, Artificial sequence
  SiRNA target sequence
tttaatacctggtctaaaata

SEQ ID NO: 6336 - DNA, 21 bp, Artificial sequence
  SiRNA target sequence
ttaatacctggtctaaaataa

SEQ ID NO: 6337 - DNA, 21 bp, Artificial sequence
  SiRNA target sequence
taatacctggtctaaaataat

SEQ ID NO: 6338 - DNA, 21 bp, Artificial sequence
  SiRNA target sequence
aatacctggtctaaaataatt

SEQ ID NO: 6339 - DNA, 21 bp, Artificial sequence
  SiRNA target sequence
atacctggtctaaaataattg

SEQ ID NO: 6340 - DNA, 21 bp, Artificial sequence
  SiRNA target sequence
tacctggtctaaaataattga

SEQ ID NO: 6341 - DNA, 21 bp, Artificial sequence
  SiRNA target sequence
acctggtctaaaataattgac

SEQ ID NO: 6342 - DNA, 21 bp, Artificial sequence
  SiRNA target sequence
cctggtctaaaataattgacc

SEQ ID NO: 6343 - DNA, 21 bp, Artificial sequence
  SiRNA target sequence
ctggtctaaaataattgaccg

SEQ ID NO: 6344 - DNA, 21 bp, Artificial sequence
  SiRNA target sequence
tggtctaaaataattgaccga

SEQ ID NO: 6345 - DNA, 21 bp, Artificial sequence
  SiRNA target sequence
ggtctaaaataattgaccgag

SEQ ID NO: 6346 - DNA, 21 bp, Artificial sequence
  SiRNA target sequence
gtctaaaataattgaccgagt

SEQ ID NO: 6347 - DNA, 21 bp, Artificial sequence
  SiRNA target sequence
tctaaaataattgaccgagta

SEQ ID NO: 6348 - DNA, 21 bp, Artificial sequence
  SiRNA target sequence
ctaaaataattgaccgagtat

SEQ ID NO: 6349 - DNA, 21 bp, Artificial sequence
  SiRNA target sequence
taaaataattgaccgagtata

SEQ ID NO: 6350 - DNA, 21 bp, Artificial sequence
  SiRNA target sequence
aaaataattgaccgagtatat

SEQ ID NO: 6351 - DNA, 21 bp, Artificial sequence
  SiRNA target sequence
aaataattgaccgagtatatg

SEQ ID NO: 6352 - DNA, 21 bp, Artificial sequence
  SiRNA target sequence
aataattgaccgagtatatgc

SEQ ID NO: 6353 - DNA, 21 bp, Artificial sequence
  SiRNA target sequence
ataattgaccgagtatatgca

SEQ ID NO: 6354 - DNA, 21 bp, Artificial sequence
  SiRNA target sequence
taattgaccgagtatatgcaa

SEQ ID NO: 6355 - DNA, 21 bp, Artificial sequence
  SiRNA target sequence
aattgaccgagtatatgcaaa

SEQ ID NO: 6356 - DNA, 21 bp, Artificial sequence
  SiRNA target sequence
attgaccgagtatatgcaaat

SEQ ID NO: 6357 - DNA, 21 bp, Artificial sequence
  SiRNA target sequence
ttgaccgagtatatgcaaatg

SEQ ID NO: 6358 - DNA, 21 bp, Artificial sequence
  SiRNA target sequence
tgaccgagtatatgcaaatgc

SEQ ID NO: 6359 - DNA, 21 bp, Artificial sequence
  SiRNA target sequence
gaccgagtatatgcaaatgcg

SEQ ID NO: 6360 - DNA, 21 bp, Artificial sequence
  SiRNA target sequence
accgagtatatgcaaatgcga

SEQ ID NO: 6361 - DNA, 21 bp, Artificial sequence
  SiRNA target sequence
ccgagtatatgcaaatgcgac

SEQ ID NO: 6362 - DNA, 21 bp, Artificial sequence
  SiRNA target sequence
cgagtatatgcaaatgcgact

SEQ ID NO: 6363 - DNA, 21 bp, Artificial sequence
  SiRNA target sequence
gagtatatgcaaatgcgactg

SEQ ID NO: 6364 - DNA, 21 bp, Artificial sequence
  SiRNA target sequence
agtatatgcaaatgcgactgg

SEQ ID NO: 6365 - DNA, 21 bp, Artificial sequence
  SiRNA target sequence
gtatatgcaaatgcgactgga

SEQ ID NO: 6366 - DNA, 21 bp, Artificial sequence
  SiRNA target sequence
tatatgcaaatgcgactggag

SEQ ID NO: 6367 - DNA, 21 bp, Artificial sequence
  SiRNA target sequence
atatgcaaatgcgactggaga

SEQ ID NO: 6368 - DNA, 21 bp, Artificial sequence
  SiRNA target sequence
tatgcaaatgcgactggagat

SEQ ID NO: 6369 - DNA, 21 bp, Artificial sequence
  SiRNA target sequence
atgcaaatgcgactggagatc

SEQ ID NO: 6370 - DNA, 21 bp, Artificial sequence
  SiRNA target sequence
tgcaaatgcgactggagatca

SEQ ID NO: 6371 - DNA, 21 bp, Artificial sequence
  SiRNA target sequence
gcaaatgcgactggagatcac

SEQ ID NO: 6372 - DNA, 21 bp, Artificial sequence
  SiRNA target sequence
caaatgcgactggagatcacc

SEQ ID NO: 6373 - DNA, 21 bp, Artificial sequence
  SiRNA target sequence
aaatgcgactggagatcacct

SEQ ID NO: 6374 - DNA, 21 bp, Artificial sequence
  SiRNA target sequence
aatgcgactggagatcacctg

SEQ ID NO: 6375 - DNA, 21 bp, Artificial sequence
  SiRNA target sequence
atgcgactggagatcacctgg

SEQ ID NO: 6376 - DNA, 21 bp, Artificial sequence
  SiRNA target sequence
tgcgactggagatcacctgga

SEQ ID NO: 6377 - DNA, 21 bp, Artificial sequence
  SiRNA target sequence
gcgactggagatcacctggac

SEQ ID NO: 6378 - DNA, 21 bp, Artificial sequence
  SiRNA target sequence
cgactggagatcacctggaca

SEQ ID NO: 6379 - DNA, 21 bp, Artificial sequence
  SiRNA target sequence
gactggagatcacctggacat

SEQ ID NO: 6380 - DNA, 21 bp, Artificial sequence
  SiRNA target sequence
actggagatcacctggacata

SEQ ID NO: 6381 - DNA, 21 bp, Artificial sequence
  SiRNA target sequence
ctggagatcacctggacataa

SEQ ID NO: 6382 - DNA, 21 bp, Artificial sequence
  SiRNA target sequence
tggagatcacctggacataaa

SEQ ID NO: 6383 - DNA, 21 bp, Artificial sequence
  SiRNA target sequence
ggagatcacctggacataaac

SEQ ID NO: 6384 - DNA, 21 bp, Artificial sequence
  SiRNA target sequence
gagatcacctggacataaaca

SEQ ID NO: 6385 - DNA, 21 bp, Artificial sequence
  SiRNA target sequence
agatcacctggacataaacac

SEQ ID NO: 6386 - DNA, 21 bp, Artificial sequence
  SiRNA target sequence
gatcacctggacataaacact

SEQ ID NO: 6387 - DNA, 21 bp, Artificial sequence
  SiRNA target sequence
atcacctggacataaacactt

SEQ ID NO: 6388 - DNA, 21 bp, Artificial sequence
  SiRNA target sequence
tcacctggacataaacactta

SEQ ID NO: 6389 - DNA, 21 bp, Artificial sequence
  SiRNA target sequence
cacctggacataaacacttat

SEQ ID NO: 6390 - DNA, 21 bp, Artificial sequence
  SiRNA target sequence
acctggacataaacacttatc

SEQ ID NO: 6391 - DNA, 21 bp, Artificial sequence
  SiRNA target sequence
cctggacataaacacttatcg

SEQ ID NO: 6392 - DNA, 21 bp, Artificial sequence
  SiRNA target sequence
ctggacataaacacttatcgt

SEQ ID NO: 6393 - DNA, 21 bp, Artificial sequence
  SiRNA target sequence
tggacataaacacttatcgtg

SEQ ID NO: 6394 - DNA, 21 bp, Artificial sequence
  SiRNA target sequence
ggacataaacacttatcgtgg

SEQ ID NO: 6395 - DNA, 21 bp, Artificial sequence
  SiRNA target sequence
gacataaacacttatcgtggt

SEQ ID NO: 6396 - DNA, 21 bp, Artificial sequence
  SiRNA target sequence
acataaacacttatcgtggtt

SEQ ID NO: 6397 - DNA, 21 bp, Artificial sequence
  SiRNA target sequence
cataaacacttatcgtggtta

SEQ ID NO: 6398 - DNA, 21 bp, Artificial sequence
  SiRNA target sequence
ataaacacttatcgtggttat

SEQ ID NO: 6399 - DNA, 21 bp, Artificial sequence
  SiRNA target sequence
taaacacttatcgtggttatg

SEQ ID NO: 6400 - DNA, 21 bp, Artificial sequence
  SiRNA target sequence
aaacacttatcgtggttatgc

SEQ ID NO: 6401 - DNA, 21 bp, Artificial sequence
  SiRNA target sequence
aacacttatcgtggttatgct

SEQ ID NO: 6402 - DNA, 21 bp, Artificial sequence
  SiRNA target sequence
acacttatcgtggttatgctc

SEQ ID NO: 6403 - DNA, 21 bp, Artificial sequence
  SiRNA target sequence
cacttatcgtggttatgctca

SEQ ID NO: 6404 - DNA, 21 bp, Artificial sequence
  SiRNA target sequence
acttatcgtggttatgctcag

SEQ ID NO: 6405 - DNA, 21 bp, Artificial sequence
  SiRNA target sequence
cttatcgtggttatgctcagg

SEQ ID NO: 6406 - DNA, 21 bp, Artificial sequence
  SiRNA target sequence
ttatcgtggttatgctcagga

SEQ ID NO: 6407 - DNA, 21 bp, Artificial sequence
  SiRNA target sequence
tatcgtggttatgctcaggag

SEQ ID NO: 6408 - DNA, 21 bp, Artificial sequence
  SiRNA target sequence
atcgtggttatgctcaggagc

SEQ ID NO: 6409 - DNA, 21 bp, Artificial sequence
  SiRNA target sequence
tcgtggttatgctcaggagcg

SEQ ID NO: 6410 - DNA, 21 bp, Artificial sequence
  SiRNA target sequence
cgtggttatgctcaggagcgg

SEQ ID NO: 6411 - DNA, 21 bp, Artificial sequence
  SiRNA target sequence
gtggttatgctcaggagcggt

SEQ ID NO: 6412 - DNA, 21 bp, Artificial sequence
  SiRNA target sequence
tggttatgctcaggagcggtt

SEQ ID NO: 6413 - DNA, 21 bp, Artificial sequence
  SiRNA target sequence
ggttatgctcaggagcggttt

SEQ ID NO: 6414 - DNA, 21 bp, Artificial sequence
  SiRNA target sequence
gttatgctcaggagcggtttc

SEQ ID NO: 6415 - DNA, 21 bp, Artificial sequence
  SiRNA target sequence
ttatgctcaggagcggtttct

SEQ ID NO: 6416 - DNA, 21 bp, Artificial sequence
  SiRNA target sequence
tatgctcaggagcggtttctg

SEQ ID NO: 6417 - DNA, 21 bp, Artificial sequence
  SiRNA target sequence
atgctcaggagcggtttctgg

SEQ ID NO: 6418 - DNA, 21 bp, Artificial sequence
  SiRNA target sequence
tgctcaggagcggtttctgga

SEQ ID NO: 6419 - DNA, 21 bp, Artificial sequence
  SiRNA target sequence
gctcaggagcggtttctggaa

SEQ ID NO: 6420 - DNA, 21 bp, Artificial sequence
  SiRNA target sequence
ctcaggagcggtttctggaat

SEQ ID NO: 6421 - DNA, 21 bp, Artificial sequence
  SiRNA target sequence
tcaggagcggtttctggaata

SEQ ID NO: 6422 - DNA, 21 bp, Artificial sequence
  SiRNA target sequence
caggagcggtttctggaatac

SEQ ID NO: 6423 - DNA, 21 bp, Artificial sequence
  SiRNA target sequence
aggagcggtttctggaatact

SEQ ID NO: 6424 - DNA, 21 bp, Artificial sequence
  SiRNA target sequence
ggagcggtttctggaatacta

SEQ ID NO: 6425 - DNA, 21 bp, Artificial sequence
  SiRNA target sequence
gagcggtttctggaatactat

SEQ ID NO: 6426 - DNA, 21 bp, Artificial sequence
  SiRNA target sequence
agcggtttctggaatactata

SEQ ID NO: 6427 - DNA, 21 bp, Artificial sequence
  SiRNA target sequence
gcggtttctggaatactatat

SEQ ID NO: 6428 - DNA, 21 bp, Artificial sequence
  SiRNA target sequence
cggtttctggaatactatatg

SEQ ID NO: 6429 - DNA, 21 bp, Artificial sequence
  SiRNA target sequence
ggtttctggaatactatatgt

SEQ ID NO: 6430 - DNA, 21 bp, Artificial sequence
  SiRNA target sequence
gtttctggaatactatatgta

SEQ ID NO: 6431 - DNA, 21 bp, Artificial sequence
  SiRNA target sequence
tttctggaatactatatgtaa

SEQ ID NO: 6432 - DNA, 21 bp, Artificial sequence
  SiRNA target sequence
ttctggaatactatatgtaag

SEQ ID NO: 6433 - DNA, 21 bp, Artificial sequence
  SiRNA target sequence
tctggaatactatatgtaagt

SEQ ID NO: 6434 - DNA, 21 bp, Artificial sequence
  SiRNA target sequence
ctggaatactatatgtaagta

SEQ ID NO: 6435 - DNA, 21 bp, Artificial sequence
  SiRNA target sequence
tggaatactatatgtaagtat

SEQ ID NO: 6436 - DNA, 21 bp, Artificial sequence
  SiRNA target sequence
ggaatactatatgtaagtata

SEQ ID NO: 6437 - DNA, 21 bp, Artificial sequence
  SiRNA target sequence
gaatactatatgtaagtatag

SEQ ID NO: 6438 - DNA, 21 bp, Artificial sequence
  SiRNA target sequence
aatactatatgtaagtatagt

SEQ ID NO: 6439 - DNA, 21 bp, Artificial sequence
  SiRNA target sequence
atactatatgtaagtatagtg

SEQ ID NO: 6440 - DNA, 21 bp, Artificial sequence
  SiRNA target sequence
tactatatgtaagtatagtgt

SEQ ID NO: 6441 - DNA, 21 bp, Artificial sequence
  SiRNA target sequence
actatatgtaagtatagtgtt

SEQ ID NO: 6442 - DNA, 21 bp, Artificial sequence
  SiRNA target sequence
ctatatgtaagtatagtgttc

SEQ ID NO: 6443 - DNA, 21 bp, Artificial sequence
  SiRNA target sequence
tatatgtaagtatagtgttct

SEQ ID NO: 6444 - DNA, 21 bp, Artificial sequence
  SiRNA target sequence
atatgtaagtatagtgttctg

SEQ ID NO: 6445 - DNA, 21 bp, Artificial sequence
  SiRNA target sequence
tatgtaagtatagtgttctgg

SEQ ID NO: 6446 - DNA, 21 bp, Artificial sequence
  SiRNA target sequence
atgtaagtatagtgttctgga

SEQ ID NO: 6447 - DNA, 21 bp, Artificial sequence
  SiRNA target sequence
tgtaagtatagtgttctggag

SEQ ID NO: 6448 - DNA, 21 bp, Artificial sequence
  SiRNA target sequence
gtaagtatagtgttctggagg

SEQ ID NO: 6449 - DNA, 21 bp, Artificial sequence
  SiRNA target sequence
taagtatagtgttctggaggc

SEQ ID NO: 6450 - DNA, 21 bp, Artificial sequence
  SiRNA target sequence
aagtatagtgttctggaggca

SEQ ID NO: 6451 - DNA, 21 bp, Artificial sequence
  SiRNA target sequence
agtatagtgttctggaggcat

SEQ ID NO: 6452 - DNA, 21 bp, Artificial sequence
  SiRNA target sequence
gtatagtgttctggaggcatc

SEQ ID NO: 6453 - DNA, 21 bp, Artificial sequence
  SiRNA target sequence
tatagtgttctggaggcatca

SEQ ID NO: 6454 - DNA, 21 bp, Artificial sequence
  SiRNA target sequence
atagtgttctggaggcatcat

SEQ ID NO: 6455 - DNA, 21 bp, Artificial sequence
  SiRNA target sequence
tagtgttctggaggcatcatt

SEQ ID NO: 6456 - DNA, 21 bp, Artificial sequence
  SiRNA target sequence
agtgttctggaggcatcattc

SEQ ID NO: 6457 - DNA, 21 bp, Artificial sequence
  SiRNA target sequence
gtgttctggaggcatcattct

SEQ ID NO: 6458 - DNA, 21 bp, Artificial sequence
  SiRNA target sequence
tgttctggaggcatcattcta

SEQ ID NO: 6459 - DNA, 21 bp, Artificial sequence
  SiRNA target sequence
gttctggaggcatcattctat

SEQ ID NO: 6460 - DNA, 21 bp, Artificial sequence
  SiRNA target sequence
ttctggaggcatcattctatg

SEQ ID NO: 6461 - DNA, 21 bp, Artificial sequence
  SiRNA target sequence
tctggaggcatcattctatgg

SEQ ID NO: 6462 - DNA, 21 bp, Artificial sequence
  SiRNA target sequence
ctggaggcatcattctatggt

SEQ ID NO: 6463 - DNA, 21 bp, Artificial sequence
  SiRNA target sequence
tggaggcatcattctatggtt

SEQ ID NO: 6464 - DNA, 21 bp, Artificial sequence
  SiRNA target sequence
ggaggcatcattctatggtta

SEQ ID NO: 6465 - DNA, 21 bp, Artificial sequence
  SiRNA target sequence
gaggcatcattctatggttac

SEQ ID NO: 6466 - DNA, 21 bp, Artificial sequence
  SiRNA target sequence
aggcatcattctatggttacc

SEQ ID NO: 6467 - DNA, 21 bp, Artificial sequence
  SiRNA target sequence
ggcatcattctatggttaccc

SEQ ID NO: 6468 - DNA, 21 bp, Artificial sequence
  SiRNA target sequence
gcatcattctatggttaccca

SEQ ID NO: 6469 - DNA, 21 bp, Artificial sequence
  SiRNA target sequence
catcattctatggttacccat

SEQ ID NO: 6470 - DNA, 21 bp, Artificial sequence
  SiRNA target sequence
atcattctatggttacccatc

SEQ ID NO: 6471 - DNA, 21 bp, Artificial sequence
  SiRNA target sequence
tcattctatggttacccatca

SEQ ID NO: 6472 - DNA, 21 bp, Artificial sequence
  SiRNA target sequence
cattctatggttacccatcat

SEQ ID NO: 6473 - DNA, 21 bp, Artificial sequence
  SiRNA target sequence
attctatggttacccatcatt

SEQ ID NO: 6474 - DNA, 21 bp, Artificial sequence
  SiRNA target sequence
ttctatggttacccatcatta

SEQ ID NO: 6475 - DNA, 21 bp, Artificial sequence
  SiRNA target sequence
tctatggttacccatcattag

SEQ ID NO: 6476 - DNA, 21 bp, Artificial sequence
  SiRNA target sequence
ctatggttacccatcattaga

SEQ ID NO: 6477 - DNA, 21 bp, Artificial sequence
  SiRNA target sequence
tatggttacccatcattagag

SEQ ID NO: 6478 - DNA, 21 bp, Artificial sequence
  SiRNA target sequence
atggttacccatcattagagg

SEQ ID NO: 6479 - DNA, 21 bp, Artificial sequence
  SiRNA target sequence
tggttacccatcattagagga

SEQ ID NO: 6480 - DNA, 21 bp, Artificial sequence
  SiRNA target sequence
ggttacccatcattagaggaa

SEQ ID NO: 6481 - DNA, 21 bp, Artificial sequence
  SiRNA target sequence
gttacccatcattagaggaaa

SEQ ID NO: 6482 - DNA, 21 bp, Artificial sequence
  SiRNA target sequence
ttacccatcattagaggaaat

SEQ ID NO: 6483 - DNA, 21 bp, Artificial sequence
  SiRNA target sequence
tacccatcattagaggaaatt

SEQ ID NO: 6484 - DNA, 21 bp, Artificial sequence
  SiRNA target sequence
acccatcattagaggaaattt

SEQ ID NO: 6485 - DNA, 21 bp, Artificial sequence
  SiRNA target sequence
cccatcattagaggaaatttc

SEQ ID NO: 6486 - DNA, 21 bp, Artificial sequence
  SiRNA target sequence
ccatcattagaggaaatttcc

SEQ ID NO: 6487 - DNA, 21 bp, Artificial sequence
  SiRNA target sequence
catcattagaggaaatttcca

SEQ ID NO: 6488 - DNA, 21 bp, Artificial sequence
  SiRNA target sequence
atcattagaggaaatttccaa

SEQ ID NO: 6489 - DNA, 21 bp, Artificial sequence
  SiRNA target sequence
tcattagaggaaatttccaat

SEQ ID NO: 6490 - DNA, 21 bp, Artificial sequence
  SiRNA target sequence
cattagaggaaatttccaata

SEQ ID NO: 6491 - DNA, 21 bp, Artificial sequence
  SiRNA target sequence
attagaggaaatttccaataa

SEQ ID NO: 6492 - DNA, 21 bp, Artificial sequence
  SiRNA target sequence
ttagaggaaatttccaataaa

SEQ ID NO: 6493 - DNA, 21 bp, Artificial sequence
  SiRNA target sequence
tagaggaaatttccaataaac

SEQ ID NO: 6494 - DNA, 21 bp, Artificial sequence
  SiRNA target sequence
agaggaaatttccaataaact

SEQ ID NO: 6495 - DNA, 21 bp, Artificial sequence
  SiRNA target sequence
gaggaaatttccaataaactc

SEQ ID NO: 6496 - DNA, 21 bp, Artificial sequence
  SiRNA target sequence
aggaaatttccaataaactct

SEQ ID NO: 6497 - DNA, 21 bp, Artificial sequence
  SiRNA target sequence
ggaaatttccaataaactctg

SEQ ID NO: 6498 - DNA, 21 bp, Artificial sequence
  SiRNA target sequence
gaaatttccaataaactctgg

SEQ ID NO: 6499 - DNA, 21 bp, Artificial sequence
  SiRNA target sequence
aaatttccaataaactctggt

SEQ ID NO: 6500 - DNA, 21 bp, Artificial sequence
  SiRNA target sequence
aatttccaataaactctggtg

SEQ ID NO: 6501 - DNA, 21 bp, Artificial sequence
  SiRNA target sequence
atttccaataaactctggtgt

SEQ ID NO: 6502 - DNA, 21 bp, Artificial sequence
  SiRNA target sequence
tttccaataaactctggtgta

SEQ ID NO: 6503 - DNA, 21 bp, Artificial sequence
  SiRNA target sequence
ttccaataaactctggtgtaa

SEQ ID NO: 6504 - DNA, 21 bp, Artificial sequence
  SiRNA target sequence
tccaataaactctggtgtaag

SEQ ID NO: 6505 - DNA, 21 bp, Artificial sequence
  SiRNA target sequence
ccaataaactctggtgtaagg

SEQ ID NO: 6506 - DNA, 21 bp, Artificial sequence
  SiRNA target sequence
caataaactctggtgtaaggc

SEQ ID NO: 6507 - DNA, 21 bp, Artificial sequence
  SiRNA target sequence
aataaactctggtgtaaggct

SEQ ID NO: 6508 - DNA, 21 bp, Artificial sequence
  SiRNA target sequence
ataaactctggtgtaaggctt

SEQ ID NO: 6509 - DNA, 21 bp, Artificial sequence
  SiRNA target sequence
taaactctggtgtaaggctta

SEQ ID NO: 6510 - DNA, 21 bp, Artificial sequence
  SiRNA target sequence
aaactctggtgtaaggcttag

SEQ ID NO: 6511 - DNA, 21 bp, Artificial sequence
  SiRNA target sequence
aactctggtgtaaggcttaga

SEQ ID NO: 6512 - DNA, 21 bp, Artificial sequence
  SiRNA target sequence
actctggtgtaaggcttagag

SEQ ID NO: 6513 - DNA, 21 bp, Artificial sequence
  SiRNA target sequence
ctctggtgtaaggcttagagt

SEQ ID NO: 6514 - DNA, 21 bp, Artificial sequence
  SiRNA target sequence
tctggtgtaaggcttagagtg

SEQ ID NO: 6515 - DNA, 21 bp, Artificial sequence
  SiRNA target sequence
ctggtgtaaggcttagagtga

SEQ ID NO: 6516 - DNA, 21 bp, Artificial sequence
  SiRNA target sequence
tggtgtaaggcttagagtgat

SEQ ID NO: 6517 - DNA, 21 bp, Artificial sequence
  SiRNA target sequence
ggtgtaaggcttagagtgatg

SEQ ID NO: 6518 - DNA, 21 bp, Artificial sequence
  SiRNA target sequence
gtgtaaggcttagagtgatgg

SEQ ID NO: 6519 - DNA, 21 bp, Artificial sequence
  SiRNA target sequence
tgtaaggcttagagtgatggt

SEQ ID NO: 6520 - DNA, 21 bp, Artificial sequence
  SiRNA target sequence
gtaaggcttagagtgatggtc

SEQ ID NO: 6521 - DNA, 21 bp, Artificial sequence
  SiRNA target sequence
taaggcttagagtgatggtcg

SEQ ID NO: 6522 - DNA, 21 bp, Artificial sequence
  SiRNA target sequence
aaggcttagagtgatggtcga

SEQ ID NO: 6523 - DNA, 21 bp, Artificial sequence
  SiRNA target sequence
aggcttagagtgatggtcgag

SEQ ID NO: 6524 - DNA, 21 bp, Artificial sequence
  SiRNA target sequence
ggcttagagtgatggtcgagg

SEQ ID NO: 6525 - DNA, 21 bp, Artificial sequence
  SiRNA target sequence
gcttagagtgatggtcgaggt

SEQ ID NO: 6526 - DNA, 21 bp, Artificial sequence
  SiRNA target sequence
cttagagtgatggtcgaggtg

SEQ ID NO: 6527 - DNA, 21 bp, Artificial sequence
  SiRNA target sequence
ttagagtgatggtcgaggtgc

SEQ ID NO: 6528 - DNA, 21 bp, Artificial sequence
  SiRNA target sequence
tagagtgatggtcgaggtgcc

SEQ ID NO: 6529 - DNA, 21 bp, Artificial sequence
  SiRNA target sequence
agagtgatggtcgaggtgccc

SEQ ID NO: 6530 - DNA, 21 bp, Artificial sequence
  SiRNA target sequence
gagtgatggtcgaggtgccct

SEQ ID NO: 6531 - DNA, 21 bp, Artificial sequence
  SiRNA target sequence
agtgatggtcgaggtgcccta

SEQ ID NO: 6532 - DNA, 21 bp, Artificial sequence
  SiRNA target sequence
gtgatggtcgaggtgccctat

SEQ ID NO: 6533 - DNA, 21 bp, Artificial sequence
  SiRNA target sequence
tgatggtcgaggtgccctatt

SEQ ID NO: 6534 - DNA, 21 bp, Artificial sequence
  SiRNA target sequence
gatggtcgaggtgccctattt

SEQ ID NO: 6535 - DNA, 21 bp, Artificial sequence
  SiRNA target sequence
atggtcgaggtgccctattta

SEQ ID NO: 6536 - DNA, 21 bp, Artificial sequence
  SiRNA target sequence
tggtcgaggtgccctatttag

SEQ ID NO: 6537 - DNA, 21 bp, Artificial sequence
  SiRNA target sequence
ggtcgaggtgccctatttagg

SEQ ID NO: 6538 - DNA, 21 bp, Artificial sequence
  SiRNA target sequence
gtcgaggtgccctatttaggg

SEQ ID NO: 6539 - DNA, 21 bp, Artificial sequence
  SiRNA target sequence
tcgaggtgccctatttagggt

SEQ ID NO: 6540 - DNA, 21 bp, Artificial sequence
  SiRNA target sequence
cgaggtgccctatttagggtg

SEQ ID NO: 6541 - DNA, 21 bp, Artificial sequence
  SiRNA target sequence
gaggtgccctatttagggtga

SEQ ID NO: 6542 - DNA, 21 bp, Artificial sequence
  SiRNA target sequence
aggtgccctatttagggtgag

SEQ ID NO: 6543 - DNA, 21 bp, Artificial sequence
  SiRNA target sequence
ggtgccctatttagggtgagg

SEQ ID NO: 6544 - DNA, 21 bp, Artificial sequence
  SiRNA target sequence
gtgccctatttagggtgagga

SEQ ID NO: 6545 - DNA, 21 bp, Artificial sequence
  SiRNA target sequence
tgccctatttagggtgaggag

SEQ ID NO: 6546 - DNA, 21 bp, Artificial sequence
  SiRNA target sequence
gccctatttagggtgaggagc

SEQ ID NO: 6547 - DNA, 21 bp, Artificial sequence
  SiRNA target sequence
ccctatttagggtgaggagcc

SEQ ID NO: 6548 - DNA, 21 bp, Artificial sequence
  SiRNA target sequence
cctatttagggtgaggagcct

SEQ ID NO: 6549 - DNA, 21 bp, Artificial sequence
  SiRNA target sequence
ctatttagggtgaggagcctc

SEQ ID NO: 6550 - DNA, 21 bp, Artificial sequence
  SiRNA target sequence
tatttagggtgaggagcctcg

SEQ ID NO: 6551 - DNA, 21 bp, Artificial sequence
  SiRNA target sequence
atttagggtgaggagcctcgg

SEQ ID NO: 6552 - DNA, 21 bp, Artificial sequence
  SiRNA target sequence
tttagggtgaggagcctcggt

SEQ ID NO: 6553 - DNA, 21 bp, Artificial sequence
  SiRNA target sequence
ttagggtgaggagcctcggtg

SEQ ID NO: 6554 - DNA, 21 bp, Artificial sequence
  SiRNA target sequence
tagggtgaggagcctcggtgg

SEQ ID NO: 6555 - DNA, 21 bp, Artificial sequence
  SiRNA target sequence
agggtgaggagcctcggtggc

SEQ ID NO: 6556 - DNA, 21 bp, Artificial sequence
  SiRNA target sequence
gggtgaggagcctcggtggca

SEQ ID NO: 6557 - DNA, 21 bp, Artificial sequence
  SiRNA target sequence
ggtgaggagcctcggtggcag

SEQ ID NO: 6558 - DNA, 21 bp, Artificial sequence
  SiRNA target sequence
gtgaggagcctcggtggcagc

SEQ ID NO: 6559 - DNA, 21 bp, Artificial sequence
  SiRNA target sequence
tgaggagcctcggtggcagcc

SEQ ID NO: 6560 - DNA, 21 bp, Artificial sequence
  SiRNA target sequence
gaggagcctcggtggcagccc

SEQ ID NO: 6561 - DNA, 21 bp, Artificial sequence
  SiRNA target sequence
aggagcctcggtggcagcccc

SEQ ID NO: 6562 - DNA, 21 bp, Artificial sequence
  SiRNA target sequence
ggagcctcggtggcagcccca

SEQ ID NO: 6563 - DNA, 21 bp, Artificial sequence
  SiRNA target sequence
gagcctcggtggcagccccac

SEQ ID NO: 6564 - DNA, 21 bp, Artificial sequence
  SiRNA target sequence
agcctcggtggcagccccacc

SEQ ID NO: 6565 - DNA, 21 bp, Artificial sequence
  SiRNA target sequence
gcctcggtggcagccccacca

SEQ ID NO: 6566 - DNA, 21 bp, Artificial sequence
  SiRNA target sequence
cctcggtggcagccccaccaa

SEQ ID NO: 6567 - DNA, 21 bp, Artificial sequence
  SiRNA target sequence
ctcggtggcagccccaccaaa

SEQ ID NO: 6568 - DNA, 21 bp, Artificial sequence
  SiRNA target sequence
tcggtggcagccccaccaaat

SEQ ID NO: 6569 - DNA, 21 bp, Artificial sequence
  SiRNA target sequence
cggtggcagccccaccaaatc

SEQ ID NO: 6570 - DNA, 21 bp, Artificial sequence
  SiRNA target sequence
ggtggcagccccaccaaatcc

SEQ ID NO: 6571 - DNA, 21 bp, Artificial sequence
  SiRNA target sequence
gtggcagccccaccaaatcct

SEQ ID NO: 6572 - DNA, 21 bp, Artificial sequence
  SiRNA target sequence
tggcagccccaccaaatcctc

SEQ ID NO: 6573 - DNA, 21 bp, Artificial sequence
  SiRNA target sequence
ggcagccccaccaaatcctct

SEQ ID NO: 6574 - DNA, 21 bp, Artificial sequence
  SiRNA target sequence
gcagccccaccaaatcctcta

SEQ ID NO: 6575 - DNA, 21 bp, Artificial sequence
  SiRNA target sequence
cagccccaccaaatcctctat

SEQ ID NO: 6576 - DNA, 21 bp, Artificial sequence
  SiRNA target sequence
agccccaccaaatcctctatt

SEQ ID NO: 6577 - DNA, 21 bp, Artificial sequence
  SiRNA target sequence
gccccaccaaatcctctattg

SEQ ID NO: 6578 - DNA, 21 bp, Artificial sequence
  SiRNA target sequence
ccccaccaaatcctctattgg

SEQ ID NO: 6579 - DNA, 21 bp, Artificial sequence
  SiRNA target sequence
cccaccaaatcctctattgga

SEQ ID NO: 6580 - DNA, 21 bp, Artificial sequence
  SiRNA target sequence
ccaccaaatcctctattggat

SEQ ID NO: 6581 - DNA, 21 bp, Artificial sequence
  SiRNA target sequence
caccaaatcctctattggata

SEQ ID NO: 6582 - DNA, 21 bp, Artificial sequence
  SiRNA target sequence
accaaatcctctattggatag

SEQ ID NO: 6583 - DNA, 21 bp, Artificial sequence
  SiRNA target sequence
ccaaatcctctattggatagg

SEQ ID NO: 6584 - DNA, 21 bp, Artificial sequence
  SiRNA target sequence
caaatcctctattggatagga

SEQ ID NO: 6585 - DNA, 21 bp, Artificial sequence
  SiRNA target sequence
aaatcctctattggataggaa

SEQ ID NO: 6586 - DNA, 21 bp, Artificial sequence
  SiRNA target sequence
aatcctctattggataggaac

SEQ ID NO: 6587 - DNA, 21 bp, Artificial sequence
  SiRNA target sequence
atcctctattggataggaaca

SEQ ID NO: 6588 - DNA, 21 bp, Artificial sequence
  SiRNA target sequence
tcctctattggataggaacag

SEQ ID NO: 6589 - DNA, 21 bp, Artificial sequence
  SiRNA target sequence
cctctattggataggaacagc

SEQ ID NO: 6590 - DNA, 21 bp, Artificial sequence
  SiRNA target sequence
ctctattggataggaacagct

SEQ ID NO: 6591 - DNA, 21 bp, Artificial sequence
  SiRNA target sequence
tctattggataggaacagctg

SEQ ID NO: 6592 - DNA, 21 bp, Artificial sequence
  SiRNA target sequence
ctattggataggaacagctgt

SEQ ID NO: 6593 - DNA, 21 bp, Artificial sequence
  SiRNA target sequence
tattggataggaacagctgta

SEQ ID NO: 6594 - DNA, 21 bp, Artificial sequence
  SiRNA target sequence
attggataggaacagctgtac

SEQ ID NO: 6595 - DNA, 21 bp, Artificial sequence
  SiRNA target sequence
ttggataggaacagctgtact

SEQ ID NO: 6596 - DNA, 21 bp, Artificial sequence
  SiRNA target sequence
tggataggaacagctgtactg

SEQ ID NO: 6597 - DNA, 21 bp, Artificial sequence
  SiRNA target sequence
ggataggaacagctgtactgg

SEQ ID NO: 6598 - DNA, 21 bp, Artificial sequence
  SiRNA target sequence
gataggaacagctgtactggg

SEQ ID NO: 6599 - DNA, 21 bp, Artificial sequence
  SiRNA target sequence
ataggaacagctgtactgggc

SEQ ID NO: 6600 - DNA, 21 bp, Artificial sequence
  SiRNA target sequence
taggaacagctgtactgggca

SEQ ID NO: 6601 - DNA, 21 bp, Artificial sequence
  SiRNA target sequence
aggaacagctgtactgggcag

SEQ ID NO: 6602 - DNA, 21 bp, Artificial sequence
  SiRNA target sequence
ggaacagctgtactgggcagt

SEQ ID NO: 6603 - DNA, 21 bp, Artificial sequence
  SiRNA target sequence
gaacagctgtactgggcagtt

SEQ ID NO: 6604 - DNA, 21 bp, Artificial sequence
  SiRNA target sequence
aacagctgtactgggcagtta

SEQ ID NO: 6605 - DNA, 21 bp, Artificial sequence
  SiRNA target sequence
acagctgtactgggcagttac

SEQ ID NO: 6606 - DNA, 21 bp, Artificial sequence
  SiRNA target sequence
cagctgtactgggcagttaca

SEQ ID NO: 6607 - DNA, 21 bp, Artificial sequence
  SiRNA target sequence
agctgtactgggcagttacag

SEQ ID NO: 6608 - DNA, 21 bp, Artificial sequence
  SiRNA target sequence
gctgtactgggcagttacagc

SEQ ID NO: 6609 - DNA, 21 bp, Artificial sequence
  SiRNA target sequence
ctgtactgggcagttacagca

SEQ ID NO: 6610 - DNA, 21 bp, Artificial sequence
  SiRNA target sequence
tgtactgggcagttacagcag

SEQ ID NO: 6611 - DNA, 21 bp, Artificial sequence
  SiRNA target sequence
gtactgggcagttacagcagt

SEQ ID NO: 6612 - DNA, 21 bp, Artificial sequence
  SiRNA target sequence
tactgggcagttacagcagtc

SEQ ID NO: 6613 - DNA, 21 bp, Artificial sequence
  SiRNA target sequence
actgggcagttacagcagtcg

SEQ ID NO: 6614 - DNA, 21 bp, Artificial sequence
  SiRNA target sequence
ctgggcagttacagcagtcgt

SEQ ID NO: 6615 - DNA, 21 bp, Artificial sequence
  SiRNA target sequence
tgggcagttacagcagtcgta

SEQ ID NO: 6616 - DNA, 21 bp, Artificial sequence
  SiRNA target sequence
gggcagttacagcagtcgtat

SEQ ID NO: 6617 - DNA, 21 bp, Artificial sequence
  SiRNA target sequence
ggcagttacagcagtcgtatg

SEQ ID NO: 6618 - DNA, 21 bp, Artificial sequence
  SiRNA target sequence
gcagttacagcagtcgtatgg

SEQ ID NO: 6619 - DNA, 21 bp, Artificial sequence
  SiRNA target sequence
cagttacagcagtcgtatggt

SEQ ID NO: 6620 - DNA, 21 bp, Artificial sequence
  SiRNA target sequence
agttacagcagtcgtatggta

SEQ ID NO: 6621 - DNA, 21 bp, Artificial sequence
  SiRNA target sequence
gttacagcagtcgtatggtaa

SEQ ID NO: 6622 - DNA, 21 bp, Artificial sequence
  SiRNA target sequence
ttacagcagtcgtatggtaac

SEQ ID NO: 6623 - DNA, 21 bp, Artificial sequence
  SiRNA target sequence
tacagcagtcgtatggtaaca

SEQ ID NO: 6624 - DNA, 21 bp, Artificial sequence
  SiRNA target sequence
acagcagtcgtatggtaacac

SEQ ID NO: 6625 - DNA, 21 bp, Artificial sequence
  SiRNA target sequence
cagcagtcgtatggtaacaca

SEQ ID NO: 6626 - DNA, 21 bp, Artificial sequence
  SiRNA target sequence
agcagtcgtatggtaacacat

SEQ ID NO: 6627 - DNA, 21 bp, Artificial sequence
  SiRNA target sequence
gcagtcgtatggtaacacatg

SEQ ID NO: 6628 - DNA, 21 bp, Artificial sequence
  SiRNA target sequence
cagtcgtatggtaacacatgc

SEQ ID NO: 6629 - DNA, 21 bp, Artificial sequence
  SiRNA target sequence
agtcgtatggtaacacatgcg

SEQ ID NO: 6630 - DNA, 21 bp, Artificial sequence
  SiRNA target sequence
gtcgtatggtaacacatgcgg

SEQ ID NO: 6631 - DNA, 21 bp, Artificial sequence
  SiRNA target sequence
tcgtatggtaacacatgcggc

SEQ ID NO: 6632 - DNA, 21 bp, Artificial sequence
  SiRNA target sequence
cgtatggtaacacatgcggcg

SEQ ID NO: 6633 - DNA, 21 bp, Artificial sequence
  SiRNA target sequence
gtatggtaacacatgcggcgt

SEQ ID NO: 6634 - DNA, 21 bp, Artificial sequence
  SiRNA target sequence
tatggtaacacatgcggcgtt

SEQ ID NO: 6635 - DNA, 21 bp, Artificial sequence
  SiRNA target sequence
atggtaacacatgcggcgttc

SEQ ID NO: 6636 - DNA, 21 bp, Artificial sequence
  SiRNA target sequence
tggtaacacatgcggcgttcc

SEQ ID NO: 6637 - DNA, 21 bp, Artificial sequence
  SiRNA target sequence
ggtaacacatgcggcgttccg

SEQ ID NO: 6638 - DNA, 21 bp, Artificial sequence
  SiRNA target sequence
gtaacacatgcggcgttccga

SEQ ID NO: 6639 - DNA, 21 bp, Artificial sequence
  SiRNA target sequence
taacacatgcggcgttccgaa

SEQ ID NO: 6640 - DNA, 21 bp, Artificial sequence
  SiRNA target sequence
aacacatgcggcgttccgaaa

SEQ ID NO: 6641 - DNA, 21 bp, Artificial sequence
  SiRNA target sequence
acacatgcggcgttccgaaat

SEQ ID NO: 6642 - DNA, 21 bp, Artificial sequence
  SiRNA target sequence
cacatgcggcgttccgaaata

SEQ ID NO: 6643 - DNA, 21 bp, Artificial sequence
  SiRNA target sequence
acatgcggcgttccgaaatac

SEQ ID NO: 6644 - DNA, 21 bp, Artificial sequence
  SiRNA target sequence
catgcggcgttccgaaatacc

SEQ ID NO: 6645 - DNA, 21 bp, Artificial sequence
  SiRNA target sequence
atgcggcgttccgaaatacca

SEQ ID NO: 6646 - DNA, 21 bp, Artificial sequence
  SiRNA target sequence
tgcggcgttccgaaataccat

SEQ ID NO: 6647 - DNA, 21 bp, Artificial sequence
  SiRNA target sequence
gcggcgttccgaaataccatg

SEQ ID NO: 6648 - DNA, 21 bp, Artificial sequence
  SiRNA target sequence
cggcgttccgaaataccatgc

SEQ ID NO: 6649 - DNA, 21 bp, Artificial sequence
  SiRNA target sequence
ggcgttccgaaataccatgcc

SEQ ID NO: 6650 - DNA, 21 bp, Artificial sequence
  SiRNA target sequence
gcgttccgaaataccatgcct

SEQ ID NO: 6651 - DNA, 21 bp, Artificial sequence
  SiRNA target sequence
cgttccgaaataccatgcctg

SEQ ID NO: 6652 - DNA, 21 bp, Artificial sequence
  SiRNA target sequence
gttccgaaataccatgcctgg

SEQ ID NO: 6653 - DNA, 21 bp, Artificial sequence
  SiRNA target sequence
ttccgaaataccatgcctggc

SEQ ID NO: 6654 - DNA, 21 bp, Artificial sequence
  SiRNA target sequence
tccgaaataccatgcctggcg

SEQ ID NO: 6655 - DNA, 21 bp, Artificial sequence
  SiRNA target sequence
ccgaaataccatgcctggcga

SEQ ID NO: 6656 - DNA, 21 bp, Artificial sequence
  SiRNA target sequence
cgaaataccatgcctggcgat

SEQ ID NO: 6657 - DNA, 21 bp, Artificial sequence
  SiRNA target sequence
gaaataccatgcctggcgatt

SEQ ID NO: 6658 - DNA, 21 bp, Artificial sequence
  SiRNA target sequence
aaataccatgcctggcgattc

SEQ ID NO: 6659 - DNA, 21 bp, Artificial sequence
  SiRNA target sequence
aataccatgcctggcgattca

SEQ ID NO: 6660 - DNA, 21 bp, Artificial sequence
  SiRNA target sequence
ataccatgcctggcgattcac

SEQ ID NO: 6661 - DNA, 21 bp, Artificial sequence
  SiRNA target sequence
taccatgcctggcgattcaca

SEQ ID NO: 6662 - DNA, 21 bp, Artificial sequence
  SiRNA target sequence
accatgcctggcgattcacaa

SEQ ID NO: 6663 - DNA, 21 bp, Artificial sequence
  SiRNA target sequence
ccatgcctggcgattcacaac

SEQ ID NO: 6664 - DNA, 21 bp, Artificial sequence
  SiRNA target sequence
catgcctggcgattcacaaca

SEQ ID NO: 6665 - DNA, 21 bp, Artificial sequence
  SiRNA target sequence
atgcctggcgattcacaacaa

SEQ ID NO: 6666 - DNA, 21 bp, Artificial sequence
  SiRNA target sequence
tgcctggcgattcacaacaag

SEQ ID NO: 6667 - DNA, 21 bp, Artificial sequence
  SiRNA target sequence
gcctggcgattcacaacaaga

SEQ ID NO: 6668 - DNA, 21 bp, Artificial sequence
  SiRNA target sequence
cctggcgattcacaacaagaa

SEQ ID NO: 6669 - DNA, 21 bp, Artificial sequence
  SiRNA target sequence
ctggcgattcacaacaagaaa

SEQ ID NO: 6670 - DNA, 21 bp, Artificial sequence
  SiRNA target sequence
tggcgattcacaacaagaaag

SEQ ID NO: 6671 - DNA, 21 bp, Artificial sequence
  SiRNA target sequence
ggcgattcacaacaagaaagc

SEQ ID NO: 6672 - DNA, 21 bp, Artificial sequence
  SiRNA target sequence
gcgattcacaacaagaaagca

SEQ ID NO: 6673 - DNA, 21 bp, Artificial sequence
  SiRNA target sequence
cgattcacaacaagaaagcaa

SEQ ID NO: 6674 - DNA, 21 bp, Artificial sequence
  SiRNA target sequence
gattcacaacaagaaagcaat

SEQ ID NO: 6675 - DNA, 21 bp, Artificial sequence
  SiRNA target sequence
attcacaacaagaaagcaata

SEQ ID NO: 6676 - DNA, 21 bp, Artificial sequence
  SiRNA target sequence
ttcacaacaagaaagcaatac

SEQ ID NO: 6677 - DNA, 21 bp, Artificial sequence
  SiRNA target sequence
tcacaacaagaaagcaatact

SEQ ID NO: 6678 - DNA, 21 bp, Artificial sequence
  SiRNA target sequence
cacaacaagaaagcaatactc

SEQ ID NO: 6679 - DNA, 21 bp, Artificial sequence
  SiRNA target sequence
acaacaagaaagcaatactcc

SEQ ID NO: 6680 - DNA, 21 bp, Artificial sequence
  SiRNA target sequence
caacaagaaagcaatactccc

SEQ ID NO: 6681 - DNA, 21 bp, Artificial sequence
  SiRNA target sequence
aacaagaaagcaatactccca

SEQ ID NO: 6682 - DNA, 21 bp, Artificial sequence
  SiRNA target sequence
acaagaaagcaatactcccaa

SEQ ID NO: 6683 - DNA, 21 bp, Artificial sequence
  SiRNA target sequence
caagaaagcaatactcccaac

SEQ ID NO: 6684 - DNA, 21 bp, Artificial sequence
  SiRNA target sequence
aagaaagcaatactcccaacg

SEQ ID NO: 6685 - DNA, 21 bp, Artificial sequence
  SiRNA target sequence
agaaagcaatactcccaacgt

SEQ ID NO: 6686 - DNA, 21 bp, Artificial sequence
  SiRNA target sequence
gaaagcaatactcccaacgta

SEQ ID NO: 6687 - DNA, 21 bp, Artificial sequence
  SiRNA target sequence
aaagcaatactcccaacgtac

SEQ ID NO: 6688 - DNA, 21 bp, Artificial sequence
  SiRNA target sequence
aagcaatactcccaacgtaca

SEQ ID NO: 6689 - DNA, 21 bp, Artificial sequence
  SiRNA target sequence
agcaatactcccaacgtacac

SEQ ID NO: 6690 - DNA, 21 bp, Artificial sequence
  SiRNA target sequence
gcaatactcccaacgtacaca

SEQ ID NO: 6691 - DNA, 21 bp, Artificial sequence
  SiRNA target sequence
caatactcccaacgtacacaa

SEQ ID NO: 6692 - DNA, 21 bp, Artificial sequence
  SiRNA target sequence
aatactcccaacgtacacaat

SEQ ID NO: 6693 - DNA, 21 bp, Artificial sequence
  SiRNA target sequence
atactcccaacgtacacaata

SEQ ID NO: 6694 - DNA, 21 bp, Artificial sequence
  SiRNA target sequence
tactcccaacgtacacaatac

SEQ ID NO: 6695 - DNA, 21 bp, Artificial sequence
  SiRNA target sequence
actcccaacgtacacaatacg

SEQ ID NO: 6696 - DNA, 21 bp, Artificial sequence
  SiRNA target sequence
ctcccaacgtacacaatacgg

SEQ ID NO: 6697 - DNA, 21 bp, Artificial sequence
  SiRNA target sequence
tcccaacgtacacaatacgga

SEQ ID NO: 6698 - DNA, 21 bp, Artificial sequence
  SiRNA target sequence
cccaacgtacacaatacggaa

SEQ ID NO: 6699 - DNA, 21 bp, Artificial sequence
  SiRNA target sequence
ccaacgtacacaatacggaac

SEQ ID NO: 6700 - DNA, 21 bp, Artificial sequence
  SiRNA target sequence
caacgtacacaatacggaact

SEQ ID NO: 6701 - DNA, 21 bp, Artificial sequence
  SiRNA target sequence
aacgtacacaatacggaactc

SEQ ID NO: 6702 - DNA, 21 bp, Artificial sequence
  SiRNA target sequence
acgtacacaatacggaactcg

SEQ ID NO: 6703 - DNA, 21 bp, Artificial sequence
  SiRNA target sequence
cgtacacaatacggaactcgc

SEQ ID NO: 6704 - DNA, 21 bp, Artificial sequence
  SiRNA target sequence
gtacacaatacggaactcgct

SEQ ID NO: 6705 - DNA, 21 bp, Artificial sequence
  SiRNA target sequence
tacacaatacggaactcgctt

SEQ ID NO: 6706 - DNA, 21 bp, Artificial sequence
  SiRNA target sequence
acacaatacggaactcgcttc

SEQ ID NO: 6707 - DNA, 21 bp, Artificial sequence
  SiRNA target sequence
cacaatacggaactcgcttcg

SEQ ID NO: 6708 - DNA, 21 bp, Artificial sequence
  SiRNA target sequence
acaatacggaactcgcttcgt

SEQ ID NO: 6709 - DNA, 21 bp, Artificial sequence
  SiRNA target sequence
caatacggaactcgcttcgtc

SEQ ID NO: 6710 - DNA, 21 bp, Artificial sequence
  SiRNA target sequence
aatacggaactcgcttcgtcc

SEQ ID NO: 6711 - DNA, 21 bp, Artificial sequence
  SiRNA target sequence
atacggaactcgcttcgtcca

SEQ ID NO: 6712 - DNA, 21 bp, Artificial sequence
  SiRNA target sequence
tacggaactcgcttcgtccac

SEQ ID NO: 6713 - DNA, 21 bp, Artificial sequence
  SiRNA target sequence
acggaactcgcttcgtccact

SEQ ID NO: 6714 - DNA, 21 bp, Artificial sequence
  SiRNA target sequence
cggaactcgcttcgtccacta

SEQ ID NO: 6715 - DNA, 21 bp, Artificial sequence
  SiRNA target sequence
ggaactcgcttcgtccactag

SEQ ID NO: 6716 - DNA, 21 bp, Artificial sequence
  SiRNA target sequence
gaactcgcttcgtccactagt

SEQ ID NO: 6717 - DNA, 21 bp, Artificial sequence
  SiRNA target sequence
aactcgcttcgtccactagtg

SEQ ID NO: 6718 - DNA, 21 bp, Artificial sequence
  SiRNA target sequence
actcgcttcgtccactagtga

SEQ ID NO: 6719 - DNA, 21 bp, Artificial sequence
  SiRNA target sequence
ctcgcttcgtccactagtgaa

SEQ ID NO: 6720 - DNA, 21 bp, Artificial sequence
  SiRNA target sequence
tcgcttcgtccactagtgaaa

SEQ ID NO: 6721 - DNA, 21 bp, Artificial sequence
  SiRNA target sequence
cgcttcgtccactagtgaaaa

SEQ ID NO: 6722 - DNA, 21 bp, Artificial sequence
  SiRNA target sequence
gcttcgtccactagtgaaaac

SEQ ID NO: 6723 - DNA, 21 bp, Artificial sequence
  SiRNA target sequence
cttcgtccactagtgaaaact

SEQ ID NO: 6724 - DNA, 21 bp, Artificial sequence
  SiRNA target sequence
ttcgtccactagtgaaaactc

SEQ ID NO: 6725 - DNA, 21 bp, Artificial sequence
  SiRNA target sequence
tcgtccactagtgaaaactcg

SEQ ID NO: 6726 - DNA, 21 bp, Artificial sequence
  SiRNA target sequence
cgtccactagtgaaaactcgg

SEQ ID NO: 6727 - DNA, 21 bp, Artificial sequence
  SiRNA target sequence
gtccactagtgaaaactcggt

SEQ ID NO: 6728 - DNA, 21 bp, Artificial sequence
  SiRNA target sequence
tccactagtgaaaactcggtt

SEQ ID NO: 6729 - DNA, 21 bp, Artificial sequence
  SiRNA target sequence
ccactagtgaaaactcggttg

SEQ ID NO: 6730 - DNA, 21 bp, Artificial sequence
  SiRNA target sequence
cactagtgaaaactcggttga

SEQ ID NO: 6731 - DNA, 21 bp, Artificial sequence
  SiRNA target sequence
actagtgaaaactcggttgag

SEQ ID NO: 6732 - DNA, 21 bp, Artificial sequence
  SiRNA target sequence
ctagtgaaaactcggttgaga

SEQ ID NO: 6733 - DNA, 21 bp, Artificial sequence
  SiRNA target sequence
tagtgaaaactcggttgagac

SEQ ID NO: 6734 - DNA, 21 bp, Artificial sequence
  SiRNA target sequence
agtgaaaactcggttgagacc

SEQ ID NO: 6735 - DNA, 21 bp, Artificial sequence
  SiRNA target sequence
gtgaaaactcggttgagaccc

SEQ ID NO: 6736 - DNA, 21 bp, Artificial sequence
  SiRNA target sequence
tgaaaactcggttgagaccca

SEQ ID NO: 6737 - DNA, 21 bp, Artificial sequence
  SiRNA target sequence
gaaaactcggttgagacccaa

SEQ ID NO: 6738 - DNA, 21 bp, Artificial sequence
  SiRNA target sequence
aaaactcggttgagacccaag

SEQ ID NO: 6739 - DNA, 21 bp, Artificial sequence
  SiRNA target sequence
aaactcggttgagacccaaga

SEQ ID NO: 6740 - DNA, 21 bp, Artificial sequence
  SiRNA target sequence
aactcggttgagacccaagaa

SEQ ID NO: 6741 - DNA, 21 bp, Artificial sequence
  SiRNA target sequence
actcggttgagacccaagaaa

SEQ ID NO: 6742 - DNA, 21 bp, Artificial sequence
  SiRNA target sequence
ctcggttgagacccaagaaat

SEQ ID NO: 6743 - DNA, 21 bp, Artificial sequence
  SiRNA target sequence
tcggttgagacccaagaaatc

SEQ ID NO: 6744 - DNA, 21 bp, Artificial sequence
  SiRNA target sequence
cggttgagacccaagaaatca

SEQ ID NO: 6745 - DNA, 21 bp, Artificial sequence
  SiRNA target sequence
ggttgagacccaagaaatcac

SEQ ID NO: 6746 - DNA, 21 bp, Artificial sequence
  SiRNA target sequence
gttgagacccaagaaatcaca

SEQ ID NO: 6747 - DNA, 21 bp, Artificial sequence
  SiRNA target sequence
ttgagacccaagaaatcacaa

SEQ ID NO: 6748 - DNA, 21 bp, Artificial sequence
  SiRNA target sequence
tgagacccaagaaatcacaac

SEQ ID NO: 6749 - DNA, 21 bp, Artificial sequence
  SiRNA target sequence
gagacccaagaaatcacaacc

SEQ ID NO: 6750 - DNA, 21 bp, Artificial sequence
  SiRNA target sequence
agacccaagaaatcacaacct

SEQ ID NO: 6751 - DNA, 21 bp, Artificial sequence
  SiRNA target sequence
gacccaagaaatcacaacctt

SEQ ID NO: 6752 - DNA, 21 bp, Artificial sequence
  SiRNA target sequence
acccaagaaatcacaaccttt

SEQ ID NO: 6753 - DNA, 21 bp, Artificial sequence
  SiRNA target sequence
cccaagaaatcacaacctttc

SEQ ID NO: 6754 - DNA, 21 bp, Artificial sequence
  SiRNA target sequence
ccaagaaatcacaacctttca

SEQ ID NO: 6755 - DNA, 21 bp, Artificial sequence
  SiRNA target sequence
caagaaatcacaacctttcat

SEQ ID NO: 6756 - DNA, 21 bp, Artificial sequence
  SiRNA target sequence
aagaaatcacaacctttcatg

SEQ ID NO: 6757 - DNA, 21 bp, Artificial sequence
  SiRNA target sequence
agaaatcacaacctttcatga

SEQ ID NO: 6758 - DNA, 21 bp, Artificial sequence
  SiRNA target sequence
gaaatcacaacctttcatgat

SEQ ID NO: 6759 - DNA, 21 bp, Artificial sequence
  SiRNA target sequence
aaatcacaacctttcatgatg

SEQ ID NO: 6760 - DNA, 21 bp, Artificial sequence
  SiRNA target sequence
aatcacaacctttcatgatgt

SEQ ID NO: 6761 - DNA, 21 bp, Artificial sequence
  SiRNA target sequence
atcacaacctttcatgatgtg

SEQ ID NO: 6762 - DNA, 21 bp, Artificial sequence
  SiRNA target sequence
tcacaacctttcatgatgtgg

SEQ ID NO: 6763 - DNA, 21 bp, Artificial sequence
  SiRNA target sequence
cacaacctttcatgatgtgga

SEQ ID NO: 6764 - DNA, 21 bp, Artificial sequence
  SiRNA target sequence
acaacctttcatgatgtggaa

SEQ ID NO: 6765 - DNA, 21 bp, Artificial sequence
  SiRNA target sequence
caacctttcatgatgtggaaa

SEQ ID NO: 6766 - DNA, 21 bp, Artificial sequence
  SiRNA target sequence
aacctttcatgatgtggaaac

SEQ ID NO: 6767 - DNA, 21 bp, Artificial sequence
  SiRNA target sequence
acctttcatgatgtggaaact

SEQ ID NO: 6768 - DNA, 21 bp, Artificial sequence
  SiRNA target sequence
cctttcatgatgtggaaactc

SEQ ID NO: 6769 - DNA, 21 bp, Artificial sequence
  SiRNA target sequence
ctttcatgatgtggaaactcc

SEQ ID NO: 6770 - DNA, 21 bp, Artificial sequence
  SiRNA target sequence
tttcatgatgtggaaactcca

SEQ ID NO: 6771 - DNA, 21 bp, Artificial sequence
  SiRNA target sequence
ttcatgatgtggaaactccaa

SEQ ID NO: 6772 - DNA, 21 bp, Artificial sequence
  SiRNA target sequence
tcatgatgtggaaactccaaa

SEQ ID NO: 6773 - DNA, 21 bp, Artificial sequence
  SiRNA target sequence
catgatgtggaaactccaaat

SEQ ID NO: 6774 - DNA, 21 bp, Artificial sequence
  SiRNA target sequence
atgatgtggaaactccaaata

SEQ ID NO: 6775 - DNA, 21 bp, Artificial sequence
  SiRNA target sequence
tgatgtggaaactccaaatag

SEQ ID NO: 6776 - DNA, 21 bp, Artificial sequence
  SiRNA target sequence
gatgtggaaactccaaatagg

SEQ ID NO: 6777 - DNA, 21 bp, Artificial sequence
  SiRNA target sequence
atgtggaaactccaaatagga

SEQ ID NO: 6778 - DNA, 21 bp, Artificial sequence
  SiRNA target sequence
tgtggaaactccaaataggat

SEQ ID NO: 6779 - DNA, 21 bp, Artificial sequence
  SiRNA target sequence
gtggaaactccaaataggatc

SEQ ID NO: 6780 - DNA, 21 bp, Artificial sequence
  SiRNA target sequence
tggaaactccaaataggatcg

SEQ ID NO: 6781 - DNA, 21 bp, Artificial sequence
  SiRNA target sequence
ggaaactccaaataggatcga

SEQ ID NO: 6782 - DNA, 21 bp, Artificial sequence
  SiRNA target sequence
gaaactccaaataggatcgat

SEQ ID NO: 6783 - DNA, 21 bp, Artificial sequence
  SiRNA target sequence
aaactccaaataggatcgata

SEQ ID NO: 6784 - DNA, 21 bp, Artificial sequence
  SiRNA target sequence
aactccaaataggatcgatac

SEQ ID NO: 6785 - DNA, 21 bp, Artificial sequence
  SiRNA target sequence
actccaaataggatcgatacc

SEQ ID NO: 6786 - DNA, 21 bp, Artificial sequence
  SiRNA target sequence
ctccaaataggatcgataccc

SEQ ID NO: 6787 - DNA, 21 bp, Artificial sequence
  SiRNA target sequence
tccaaataggatcgatacccc

SEQ ID NO: 6788 - DNA, 21 bp, Artificial sequence
  SiRNA target sequence
ccaaataggatcgataccccc

SEQ ID NO: 6789 - DNA, 21 bp, Artificial sequence
  SiRNA target sequence
caaataggatcgataccccca

SEQ ID NO: 6790 - DNA, 21 bp, Artificial sequence
  SiRNA target sequence
aaataggatcgatacccccat

SEQ ID NO: 6791 - DNA, 21 bp, Artificial sequence
  SiRNA target sequence
aataggatcgatacccccatg

SEQ ID NO: 6792 - DNA, 21 bp, Artificial sequence
  SiRNA target sequence
ataggatcgatacccccatgg

SEQ ID NO: 6793 - DNA, 21 bp, Artificial sequence
  SiRNA target sequence
taggatcgatacccccatggc

SEQ ID NO: 6794 - DNA, 21 bp, Artificial sequence
  SiRNA target sequence
aggatcgatacccccatggct

SEQ ID NO: 6795 - DNA, 21 bp, Artificial sequence
  SiRNA target sequence
ggatcgatacccccatggctc

SEQ ID NO: 6796 - DNA, 21 bp, Artificial sequence
  SiRNA target sequence
gatcgatacccccatggctca

SEQ ID NO: 6797 - DNA, 21 bp, Artificial sequence
  SiRNA target sequence
atcgatacccccatggctcag

SEQ ID NO: 6798 - DNA, 21 bp, Artificial sequence
  SiRNA target sequence
tcgatacccccatggctcagg

SEQ ID NO: 6799 - DNA, 21 bp, Artificial sequence
  SiRNA target sequence
cgatacccccatggctcagga

SEQ ID NO: 6800 - DNA, 21 bp, Artificial sequence
  SiRNA target sequence
gatacccccatggctcaggat

SEQ ID NO: 6801 - DNA, 21 bp, Artificial sequence
  SiRNA target sequence
atacccccatggctcaggata

SEQ ID NO: 6802 - DNA, 21 bp, Artificial sequence
  SiRNA target sequence
tacccccatggctcaggatac

SEQ ID NO: 6803 - DNA, 21 bp, Artificial sequence
  SiRNA target sequence
acccccatggctcaggatact

SEQ ID NO: 6804 - DNA, 21 bp, Artificial sequence
  SiRNA target sequence
cccccatggctcaggatactt

SEQ ID NO: 6805 - DNA, 21 bp, Artificial sequence
  SiRNA target sequence
ccccatggctcaggatacttc

SEQ ID NO: 6806 - DNA, 21 bp, Artificial sequence
  SiRNA target sequence
cccatggctcaggatacttca

SEQ ID NO: 6807 - DNA, 21 bp, Artificial sequence
  SiRNA target sequence
ccatggctcaggatacttcat

SEQ ID NO: 6808 - DNA, 21 bp, Artificial sequence
  SiRNA target sequence
catggctcaggatacttcatc

SEQ ID NO: 6809 - DNA, 21 bp, Artificial sequence
  SiRNA target sequence
atggctcaggatacttcatcg

SEQ ID NO: 6810 - DNA, 21 bp, Artificial sequence
  SiRNA target sequence
tggctcaggatacttcatcgg

SEQ ID NO: 6811 - DNA, 21 bp, Artificial sequence
  SiRNA target sequence
ggctcaggatacttcatcggc

SEQ ID NO: 6812 - DNA, 21 bp, Artificial sequence
  SiRNA target sequence
gctcaggatacttcatcggct

SEQ ID NO: 6813 - DNA, 21 bp, Artificial sequence
  SiRNA target sequence
ctcaggatacttcatcggcta

SEQ ID NO: 6814 - DNA, 21 bp, Artificial sequence
  SiRNA target sequence
tcaggatacttcatcggctag

SEQ ID NO: 6815 - DNA, 21 bp, Artificial sequence
  SiRNA target sequence
caggatacttcatcggctagg

SEQ ID NO: 6816 - DNA, 21 bp, Artificial sequence
  SiRNA target sequence
aggatacttcatcggctagga

SEQ ID NO: 6817 - DNA, 21 bp, Artificial sequence
  SiRNA target sequence
ggatacttcatcggctaggaa

SEQ ID NO: 6818 - DNA, 21 bp, Artificial sequence
  SiRNA target sequence
gatacttcatcggctaggaac

SEQ ID NO: 6819 - DNA, 21 bp, Artificial sequence
  SiRNA target sequence
atacttcatcggctaggaaca

SEQ ID NO: 6820 - DNA, 21 bp, Artificial sequence
  SiRNA target sequence
tacttcatcggctaggaacat

SEQ ID NO: 6821 - DNA, 21 bp, Artificial sequence
  SiRNA target sequence
acttcatcggctaggaacatg

SEQ ID NO: 6822 - DNA, 21 bp, Artificial sequence
  SiRNA target sequence
cttcatcggctaggaacatgg

SEQ ID NO: 6823 - DNA, 21 bp, Artificial sequence
  SiRNA target sequence
ttcatcggctaggaacatgga

SEQ ID NO: 6824 - DNA, 21 bp, Artificial sequence
  SiRNA target sequence
tcatcggctaggaacatggat

SEQ ID NO: 6825 - DNA, 21 bp, Artificial sequence
  SiRNA target sequence
catcggctaggaacatggatg

SEQ ID NO: 6826 - DNA, 21 bp, Artificial sequence
  SiRNA target sequence
atcggctaggaacatggatga

SEQ ID NO: 6827 - DNA, 21 bp, Artificial sequence
  SiRNA target sequence
tcggctaggaacatggatgat

SEQ ID NO: 6828 - DNA, 21 bp, Artificial sequence
  SiRNA target sequence
cggctaggaacatggatgata

SEQ ID NO: 6829 - DNA, 21 bp, Artificial sequence
  SiRNA target sequence
ggctaggaacatggatgatac

SEQ ID NO: 6830 - DNA, 21 bp, Artificial sequence
  SiRNA target sequence
gctaggaacatggatgatacg

SEQ ID NO: 6831 - DNA, 21 bp, Artificial sequence
  SiRNA target sequence
ctaggaacatggatgatacgc

SEQ ID NO: 6832 - DNA, 21 bp, Artificial sequence
  SiRNA target sequence
taggaacatggatgatacgca

SEQ ID NO: 6833 - DNA, 21 bp, Artificial sequence
  SiRNA target sequence
aggaacatggatgatacgcac

SEQ ID NO: 6834 - DNA, 21 bp, Artificial sequence
  SiRNA target sequence
ggaacatggatgatacgcaca

SEQ ID NO: 6835 - DNA, 21 bp, Artificial sequence
  SiRNA target sequence
gaacatggatgatacgcacag

SEQ ID NO: 6836 - DNA, 21 bp, Artificial sequence
  SiRNA target sequence
aacatggatgatacgcacagt

SEQ ID NO: 6837 - DNA, 21 bp, Artificial sequence
  SiRNA target sequence
acatggatgatacgcacagta

SEQ ID NO: 6838 - DNA, 21 bp, Artificial sequence
  SiRNA target sequence
catggatgatacgcacagtat

SEQ ID NO: 6839 - DNA, 21 bp, Artificial sequence
  SiRNA target sequence
atggatgatacgcacagtatt

SEQ ID NO: 6840 - DNA, 21 bp, Artificial sequence
  SiRNA target sequence
tggatgatacgcacagtatta

SEQ ID NO: 6841 - DNA, 21 bp, Artificial sequence
  SiRNA target sequence
ggatgatacgcacagtattat

SEQ ID NO: 6842 - DNA, 21 bp, Artificial sequence
  SiRNA target sequence
gatgatacgcacagtattatt

SEQ ID NO: 6843 - DNA, 21 bp, Artificial sequence
  SiRNA target sequence
atgatacgcacagtattattc

SEQ ID NO: 6844 - DNA, 21 bp, Artificial sequence
  SiRNA target sequence
tgatacgcacagtattattca

SEQ ID NO: 6845 - DNA, 21 bp, Artificial sequence
  SiRNA target sequence
gatacgcacagtattattcag

SEQ ID NO: 6846 - DNA, 21 bp, Artificial sequence
  SiRNA target sequence
atacgcacagtattattcagt

SEQ ID NO: 6847 - DNA, 21 bp, Artificial sequence
  SiRNA target sequence
tacgcacagtattattcagtt

SEQ ID NO: 6848 - DNA, 21 bp, Artificial sequence
  SiRNA target sequence
acgcacagtattattcagttt

SEQ ID NO: 6849 - DNA, 21 bp, Artificial sequence
  SiRNA target sequence
cgcacagtattattcagtttt

SEQ ID NO: 6850 - DNA, 21 bp, Artificial sequence
  SiRNA target sequence
gcacagtattattcagttttt

SEQ ID NO: 6851 - DNA, 21 bp, Artificial sequence
  SiRNA target sequence
cacagtattattcagttttta

SEQ ID NO: 6852 - DNA, 21 bp, Artificial sequence
  SiRNA target sequence
acagtattattcagtttttac

SEQ ID NO: 6853 - DNA, 21 bp, Artificial sequence
  SiRNA target sequence
cagtattattcagtttttaca

SEQ ID NO: 6854 - DNA, 21 bp, Artificial sequence
  SiRNA target sequence
agtattattcagtttttacag

SEQ ID NO: 6855 - DNA, 21 bp, Artificial sequence
  SiRNA target sequence
gtattattcagtttttacagc

SEQ ID NO: 6856 - DNA, 21 bp, Artificial sequence
  SiRNA target sequence
tattattcagtttttacagcg

SEQ ID NO: 6857 - DNA, 21 bp, Artificial sequence
  SiRNA target sequence
attattcagtttttacagcgc

SEQ ID NO: 6858 - DNA, 21 bp, Artificial sequence
  SiRNA target sequence
ttattcagtttttacagcgcc

SEQ ID NO: 6859 - DNA, 21 bp, Artificial sequence
  SiRNA target sequence
tattcagtttttacagcgccc

SEQ ID NO: 6860 - DNA, 21 bp, Artificial sequence
  SiRNA target sequence
attcagtttttacagcgcccc

SEQ ID NO: 6861 - DNA, 21 bp, Artificial sequence
  SiRNA target sequence
ttcagtttttacagcgccccg

SEQ ID NO: 6862 - DNA, 21 bp, Artificial sequence
  SiRNA target sequence
tcagtttttacagcgccccgt

SEQ ID NO: 6863 - DNA, 21 bp, Artificial sequence
  SiRNA target sequence
cagtttttacagcgccccgtt

SEQ ID NO: 6864 - DNA, 21 bp, Artificial sequence
  SiRNA target sequence
agtttttacagcgccccgttc

SEQ ID NO: 6865 - DNA, 21 bp, Artificial sequence
  SiRNA target sequence
gtttttacagcgccccgttct

SEQ ID NO: 6866 - DNA, 21 bp, Artificial sequence
  SiRNA target sequence
tttttacagcgccccgttctc

SEQ ID NO: 6867 - DNA, 21 bp, Artificial sequence
  SiRNA target sequence
ttttacagcgccccgttctca

SEQ ID NO: 6868 - DNA, 21 bp, Artificial sequence
  SiRNA target sequence
tttacagcgccccgttctcat

SEQ ID NO: 6869 - DNA, 21 bp, Artificial sequence
  SiRNA target sequence
ttacagcgccccgttctcatt

SEQ ID NO: 6870 - DNA, 21 bp, Artificial sequence
  SiRNA target sequence
tacagcgccccgttctcattg

SEQ ID NO: 6871 - DNA, 21 bp, Artificial sequence
  SiRNA target sequence
acagcgccccgttctcattga

SEQ ID NO: 6872 - DNA, 21 bp, Artificial sequence
  SiRNA target sequence
cagcgccccgttctcattgac

SEQ ID NO: 6873 - DNA, 21 bp, Artificial sequence
  SiRNA target sequence
agcgccccgttctcattgaca

SEQ ID NO: 6874 - DNA, 21 bp, Artificial sequence
  SiRNA target sequence
gcgccccgttctcattgacaa

SEQ ID NO: 6875 - DNA, 21 bp, Artificial sequence
  SiRNA target sequence
cgccccgttctcattgacaac

SEQ ID NO: 6876 - DNA, 21 bp, Artificial sequence
  SiRNA target sequence
gccccgttctcattgacaaca

SEQ ID NO: 6877 - DNA, 21 bp, Artificial sequence
  SiRNA target sequence
ccccgttctcattgacaacat

SEQ ID NO: 6878 - DNA, 21 bp, Artificial sequence
  SiRNA target sequence
cccgttctcattgacaacatt

SEQ ID NO: 6879 - DNA, 21 bp, Artificial sequence
  SiRNA target sequence
ccgttctcattgacaacattg

SEQ ID NO: 6880 - DNA, 21 bp, Artificial sequence
  SiRNA target sequence
cgttctcattgacaacattga

SEQ ID NO: 6881 - DNA, 21 bp, Artificial sequence
  SiRNA target sequence
gttctcattgacaacattgag

SEQ ID NO: 6882 - DNA, 21 bp, Artificial sequence
  SiRNA target sequence
ttctcattgacaacattgaga

SEQ ID NO: 6883 - DNA, 21 bp, Artificial sequence
  SiRNA target sequence
tctcattgacaacattgagat

SEQ ID NO: 6884 - DNA, 21 bp, Artificial sequence
  SiRNA target sequence
ctcattgacaacattgagatc

SEQ ID NO: 6885 - DNA, 21 bp, Artificial sequence
  SiRNA target sequence
tcattgacaacattgagatca

SEQ ID NO: 6886 - DNA, 21 bp, Artificial sequence
  SiRNA target sequence
cattgacaacattgagatcat

SEQ ID NO: 6887 - DNA, 21 bp, Artificial sequence
  SiRNA target sequence
attgacaacattgagatcatt

SEQ ID NO: 6888 - DNA, 21 bp, Artificial sequence
  SiRNA target sequence
ttgacaacattgagatcattg

SEQ ID NO: 6889 - DNA, 21 bp, Artificial sequence
  SiRNA target sequence
tgacaacattgagatcattgc

SEQ ID NO: 6890 - DNA, 21 bp, Artificial sequence
  SiRNA target sequence
gacaacattgagatcattgct

SEQ ID NO: 6891 - DNA, 21 bp, Artificial sequence
  SiRNA target sequence
acaacattgagatcattgctg

SEQ ID NO: 6892 - DNA, 21 bp, Artificial sequence
  SiRNA target sequence
caacattgagatcattgctgg

SEQ ID NO: 6893 - DNA, 21 bp, Artificial sequence
  SiRNA target sequence
aacattgagatcattgctgga

SEQ ID NO: 6894 - DNA, 21 bp, Artificial sequence
  SiRNA target sequence
acattgagatcattgctggaa

SEQ ID NO: 6895 - DNA, 21 bp, Artificial sequence
  SiRNA target sequence
cattgagatcattgctggaac

SEQ ID NO: 6896 - DNA, 21 bp, Artificial sequence
  SiRNA target sequence
attgagatcattgctggaaca

SEQ ID NO: 6897 - DNA, 21 bp, Artificial sequence
  SiRNA target sequence
ttgagatcattgctggaacaa

SEQ ID NO: 6898 - DNA, 21 bp, Artificial sequence
  SiRNA target sequence
tgagatcattgctggaacaac

SEQ ID NO: 6899 - DNA, 21 bp, Artificial sequence
  SiRNA target sequence
gagatcattgctggaacaacg

SEQ ID NO: 6900 - DNA, 21 bp, Artificial sequence
  SiRNA target sequence
agatcattgctggaacaacgg

SEQ ID NO: 6901 - DNA, 21 bp, Artificial sequence
  SiRNA target sequence
gatcattgctggaacaacggc

SEQ ID NO: 6902 - DNA, 21 bp, Artificial sequence
  SiRNA target sequence
atcattgctggaacaacggcc

SEQ ID NO: 6903 - DNA, 21 bp, Artificial sequence
  SiRNA target sequence
tcattgctggaacaacggccg

SEQ ID NO: 6904 - DNA, 21 bp, Artificial sequence
  SiRNA target sequence
cattgctggaacaacggccga

SEQ ID NO: 6905 - DNA, 21 bp, Artificial sequence
  SiRNA target sequence
attgctggaacaacggccgat

SEQ ID NO: 6906 - DNA, 21 bp, Artificial sequence
  SiRNA target sequence
ttgctggaacaacggccgatg

SEQ ID NO: 6907 - DNA, 21 bp, Artificial sequence
  SiRNA target sequence
tgctggaacaacggccgatgc

SEQ ID NO: 6908 - DNA, 21 bp, Artificial sequence
  SiRNA target sequence
gctggaacaacggccgatgca

SEQ ID NO: 6909 - DNA, 21 bp, Artificial sequence
  SiRNA target sequence
ctggaacaacggccgatgcaa

SEQ ID NO: 6910 - DNA, 21 bp, Artificial sequence
  SiRNA target sequence
tggaacaacggccgatgcaaa

SEQ ID NO: 6911 - DNA, 21 bp, Artificial sequence
  SiRNA target sequence
ggaacaacggccgatgcaaac

SEQ ID NO: 6912 - DNA, 21 bp, Artificial sequence
  SiRNA target sequence
gaacaacggccgatgcaaaca

SEQ ID NO: 6913 - DNA, 21 bp, Artificial sequence
  SiRNA target sequence
aacaacggccgatgcaaacaa

SEQ ID NO: 6914 - DNA, 21 bp, Artificial sequence
  SiRNA target sequence
acaacggccgatgcaaacaaa

SEQ ID NO: 6915 - DNA, 21 bp, Artificial sequence
  SiRNA target sequence
caacggccgatgcaaacaaac

SEQ ID NO: 6916 - DNA, 21 bp, Artificial sequence
  SiRNA target sequence
aacggccgatgcaaacaaacc

SEQ ID NO: 6917 - DNA, 21 bp, Artificial sequence
  SiRNA target sequence
acggccgatgcaaacaaaccc

SEQ ID NO: 6918 - DNA, 21 bp, Artificial sequence
  SiRNA target sequence
cggccgatgcaaacaaacccc

SEQ ID NO: 6919 - DNA, 21 bp, Artificial sequence
  SiRNA target sequence
ggccgatgcaaacaaacccct

SEQ ID NO: 6920 - DNA, 21 bp, Artificial sequence
  SiRNA target sequence
gccgatgcaaacaaacccctt

SEQ ID NO: 6921 - DNA, 21 bp, Artificial sequence
  SiRNA target sequence
ccgatgcaaacaaacccctta

SEQ ID NO: 6922 - DNA, 21 bp, Artificial sequence
  SiRNA target sequence
cgatgcaaacaaaccccttag

SEQ ID NO: 6923 - DNA, 21 bp, Artificial sequence
  SiRNA target sequence
gatgcaaacaaaccccttagc

SEQ ID NO: 6924 - DNA, 21 bp, Artificial sequence
  SiRNA target sequence
atgcaaacaaaccccttagcc

SEQ ID NO: 6925 - DNA, 21 bp, Artificial sequence
  SiRNA target sequence
tgcaaacaaaccccttagccg

SEQ ID NO: 6926 - DNA, 21 bp, Artificial sequence
  SiRNA target sequence
gcaaacaaaccccttagccga

SEQ ID NO: 6927 - DNA, 21 bp, Artificial sequence
  SiRNA target sequence
caaacaaaccccttagccgat

SEQ ID NO: 6928 - DNA, 21 bp, Artificial sequence
  SiRNA target sequence
aaacaaaccccttagccgata

SEQ ID NO: 6929 - DNA, 21 bp, Artificial sequence
  SiRNA target sequence
aacaaaccccttagccgatat

SEQ ID NO: 6930 - DNA, 21 bp, Artificial sequence
  SiRNA target sequence
acaaaccccttagccgatatg

SEQ ID NO: 6931 - DNA, 21 bp, Artificial sequence
  SiRNA target sequence
caaaccccttagccgatatgt

SEQ ID NO: 6932 - DNA, 21 bp, Artificial sequence
  SiRNA target sequence
aaaccccttagccgatatgtg

SEQ ID NO: 6933 - DNA, 21 bp, Artificial sequence
  SiRNA target sequence
aaccccttagccgatatgtgt

SEQ ID NO: 6934 - DNA, 21 bp, Artificial sequence
  SiRNA target sequence
accccttagccgatatgtgtt

SEQ ID NO: 6935 - DNA, 21 bp, Artificial sequence
  SiRNA target sequence
ccccttagccgatatgtgtta

SEQ ID NO: 6936 - DNA, 21 bp, Artificial sequence
  SiRNA target sequence
cccttagccgatatgtgttag

SEQ ID NO: 6937 - DNA, 21 bp, Artificial sequence
  SiRNA target sequence
ccttagccgatatgtgttaga

SEQ ID NO: 6938 - DNA, 21 bp, Artificial sequence
  SiRNA target sequence
cttagccgatatgtgttagat

SEQ ID NO: 6939 - DNA, 21 bp, Artificial sequence
  SiRNA target sequence
ttagccgatatgtgttagatc

SEQ ID NO: 6940 - DNA, 21 bp, Artificial sequence
  SiRNA target sequence
tagccgatatgtgttagatca

SEQ ID NO: 6941 - DNA, 21 bp, Artificial sequence
  SiRNA target sequence
agccgatatgtgttagatcaa

SEQ ID NO: 6942 - DNA, 21 bp, Artificial sequence
  SiRNA target sequence
gccgatatgtgttagatcaac

SEQ ID NO: 6943 - DNA, 21 bp, Artificial sequence
  SiRNA target sequence
ccgatatgtgttagatcaaca

SEQ ID NO: 6944 - DNA, 21 bp, Artificial sequence
  SiRNA target sequence
cgatatgtgttagatcaacaa

SEQ ID NO: 6945 - DNA, 21 bp, Artificial sequence
  SiRNA target sequence
gatatgtgttagatcaacaaa

SEQ ID NO: 6946 - DNA, 21 bp, Artificial sequence
  SiRNA target sequence
atatgtgttagatcaacaaaa

SEQ ID NO: 6947 - DNA, 21 bp, Artificial sequence
  SiRNA target sequence
tatgtgttagatcaacaaaat

SEQ ID NO: 6948 - DNA, 21 bp, Artificial sequence
  SiRNA target sequence
atgtgttagatcaacaaaatt

SEQ ID NO: 6949 - DNA, 21 bp, Artificial sequence
  SiRNA target sequence
tgtgttagatcaacaaaattc

SEQ ID NO: 6950 - DNA, 21 bp, Artificial sequence
  SiRNA target sequence
gtgttagatcaacaaaattcc

SEQ ID NO: 6951 - DNA, 21 bp, Artificial sequence
  SiRNA target sequence
tgttagatcaacaaaattccc

SEQ ID NO: 6952 - DNA, 21 bp, Artificial sequence
  SiRNA target sequence
gttagatcaacaaaattccca

SEQ ID NO: 6953 - DNA, 21 bp, Artificial sequence
  SiRNA target sequence
ttagatcaacaaaattcccaa

SEQ ID NO: 6954 - DNA, 21 bp, Artificial sequence
  SiRNA target sequence
tagatcaacaaaattcccaaa

SEQ ID NO: 6955 - DNA, 21 bp, Artificial sequence
  SiRNA target sequence
agatcaacaaaattcccaaaa

SEQ ID NO: 6956 - DNA, 21 bp, Artificial sequence
  SiRNA target sequence
gatcaacaaaattcccaaaag

SEQ ID NO: 6957 - DNA, 21 bp, Artificial sequence
  SiRNA target sequence
atcaacaaaattcccaaaagt

SEQ ID NO: 6958 - DNA, 21 bp, Artificial sequence
  SiRNA target sequence
tcaacaaaattcccaaaagta

SEQ ID NO: 6959 - DNA, 21 bp, Artificial sequence
  SiRNA target sequence
caacaaaattcccaaaagtat

SEQ ID NO: 6960 - DNA, 21 bp, Artificial sequence
  SiRNA target sequence
aacaaaattcccaaaagtatg

SEQ ID NO: 6961 - DNA, 21 bp, Artificial sequence
  SiRNA target sequence
acaaaattcccaaaagtatgt

SEQ ID NO: 6962 - DNA, 21 bp, Artificial sequence
  SiRNA target sequence
caaaattcccaaaagtatgta

SEQ ID NO: 6963 - DNA, 21 bp, Artificial sequence
  SiRNA target sequence
aaaattcccaaaagtatgtac

SEQ ID NO: 6964 - DNA, 21 bp, Artificial sequence
  SiRNA target sequence
aaattcccaaaagtatgtacg

SEQ ID NO: 6965 - DNA, 21 bp, Artificial sequence
  SiRNA target sequence
aattcccaaaagtatgtacga

SEQ ID NO: 6966 - DNA, 21 bp, Artificial sequence
  SiRNA target sequence
attcccaaaagtatgtacgaa

SEQ ID NO: 6967 - DNA, 21 bp, Artificial sequence
  SiRNA target sequence
ttcccaaaagtatgtacgaag

SEQ ID NO: 6968 - DNA, 21 bp, Artificial sequence
  SiRNA target sequence
tcccaaaagtatgtacgaagc

SEQ ID NO: 6969 - DNA, 21 bp, Artificial sequence
  SiRNA target sequence
cccaaaagtatgtacgaagct

SEQ ID NO: 6970 - DNA, 21 bp, Artificial sequence
  SiRNA target sequence
ccaaaagtatgtacgaagctg

SEQ ID NO: 6971 - DNA, 21 bp, Artificial sequence
  SiRNA target sequence
caaaagtatgtacgaagctgg

SEQ ID NO: 6972 - DNA, 21 bp, Artificial sequence
  SiRNA target sequence
aaaagtatgtacgaagctgga

SEQ ID NO: 6973 - DNA, 21 bp, Artificial sequence
  SiRNA target sequence
aaagtatgtacgaagctggac

SEQ ID NO: 6974 - DNA, 21 bp, Artificial sequence
  SiRNA target sequence
aagtatgtacgaagctggaca

SEQ ID NO: 6975 - DNA, 21 bp, Artificial sequence
  SiRNA target sequence
agtatgtacgaagctggacat

SEQ ID NO: 6976 - DNA, 21 bp, Artificial sequence
  SiRNA target sequence
gtatgtacgaagctggacatt

SEQ ID NO: 6977 - DNA, 21 bp, Artificial sequence
  SiRNA target sequence
tatgtacgaagctggacatta

SEQ ID NO: 6978 - DNA, 21 bp, Artificial sequence
  SiRNA target sequence
atgtacgaagctggacattac

SEQ ID NO: 6979 - DNA, 21 bp, Artificial sequence
  SiRNA target sequence
tgtacgaagctggacattacc

SEQ ID NO: 6980 - DNA, 21 bp, Artificial sequence
  SiRNA target sequence
gtacgaagctggacattacca

SEQ ID NO: 6981 - DNA, 21 bp, Artificial sequence
  SiRNA target sequence
tacgaagctggacattaccat

SEQ ID NO: 6982 - DNA, 21 bp, Artificial sequence
  SiRNA target sequence
acgaagctggacattaccatc

SEQ ID NO: 6983 - DNA, 21 bp, Artificial sequence
  SiRNA target sequence
cgaagctggacattaccatca

SEQ ID NO: 6984 - DNA, 21 bp, Artificial sequence
  SiRNA target sequence
gaagctggacattaccatcaa

SEQ ID NO: 6985 - DNA, 21 bp, Artificial sequence
  SiRNA target sequence
aagctggacattaccatcaac

SEQ ID NO: 6986 - DNA, 21 bp, Artificial sequence
  SiRNA target sequence
agctggacattaccatcaacg

SEQ ID NO: 6987 - DNA, 21 bp, Artificial sequence
  SiRNA target sequence
gctggacattaccatcaacgg

SEQ ID NO: 6988 - DNA, 21 bp, Artificial sequence
  SiRNA target sequence
ctggacattaccatcaacggt

SEQ ID NO: 6989 - DNA, 21 bp, Artificial sequence
  SiRNA target sequence
tggacattaccatcaacggtg

SEQ ID NO: 6990 - DNA, 21 bp, Artificial sequence
  SiRNA target sequence
ggacattaccatcaacggtgc

SEQ ID NO: 6991 - DNA, 21 bp, Artificial sequence
  SiRNA target sequence
gacattaccatcaacggtgct

SEQ ID NO: 6992 - DNA, 21 bp, Artificial sequence
  SiRNA target sequence
acattaccatcaacggtgctt

SEQ ID NO: 6993 - DNA, 21 bp, Artificial sequence
  SiRNA target sequence
cattaccatcaacggtgctta

SEQ ID NO: 6994 - DNA, 21 bp, Artificial sequence
  SiRNA target sequence
attaccatcaacggtgcttaa

SEQ ID NO: 6995 - DNA, 21 bp, Artificial sequence
  SiRNA target sequence
ttaccatcaacggtgcttaag

SEQ ID NO: 6996 - DNA, 21 bp, Artificial sequence
  SiRNA target sequence
taccatcaacggtgcttaagg

SEQ ID NO: 6997 - DNA, 21 bp, Artificial sequence
  SiRNA target sequence
accatcaacggtgcttaaggc

SEQ ID NO: 6998 - DNA, 21 bp, Artificial sequence
  SiRNA target sequence
ccatcaacggtgcttaaggct

SEQ ID NO: 6999 - DNA, 21 bp, Artificial sequence
  SiRNA target sequence
catcaacggtgcttaaggctg

SEQ ID NO: 7000 - DNA, 21 bp, Artificial sequence
  SiRNA target sequence
atcaacggtgcttaaggctgg

SEQ ID NO: 7001 - DNA, 21 bp, Artificial sequence
  SiRNA target sequence
tcaacggtgcttaaggctggc

SEQ ID NO: 7002 - DNA, 21 bp, Artificial sequence
  SiRNA target sequence
caacggtgcttaaggctggcg

SEQ ID NO: 7003 - DNA, 21 bp, Artificial sequence
  SiRNA target sequence
aacggtgcttaaggctggcgg

SEQ ID NO: 7004 - DNA, 21 bp, Artificial sequence
  SiRNA target sequence
acggtgcttaaggctggcgga

SEQ ID NO: 7005 - DNA, 21 bp, Artificial sequence
  SiRNA target sequence
cggtgcttaaggctggcggaa

SEQ ID NO: 7006 - DNA, 21 bp, Artificial sequence
  SiRNA target sequence
ggtgcttaaggctggcggaaa

SEQ ID NO: 7007 - DNA, 21 bp, Artificial sequence
  SiRNA target sequence
gtgcttaaggctggcggaaaa

SEQ ID NO: 7008 - DNA, 21 bp, Artificial sequence
  SiRNA target sequence
tgcttaaggctggcggaaaag

SEQ ID NO: 7009 - DNA, 21 bp, Artificial sequence
  SiRNA target sequence
gcttaaggctggcggaaaagc

SEQ ID NO: 7010 - DNA, 21 bp, Artificial sequence
  SiRNA target sequence
cttaaggctggcggaaaagct

SEQ ID NO: 7011 - DNA, 21 bp, Artificial sequence
  SiRNA target sequence
ttaaggctggcggaaaagctc

SEQ ID NO: 7012 - DNA, 21 bp, Artificial sequence
  SiRNA target sequence
taaggctggcggaaaagctca

SEQ ID NO: 7013 - DNA, 21 bp, Artificial sequence
  SiRNA target sequence
aaggctggcggaaaagctcaa

SEQ ID NO: 7014 - DNA, 21 bp, Artificial sequence
  SiRNA target sequence
aggctggcggaaaagctcaaa

SEQ ID NO: 7015 - DNA, 21 bp, Artificial sequence
  SiRNA target sequence
ggctggcggaaaagctcaaaa

SEQ ID NO: 7016 - DNA, 21 bp, Artificial sequence
  SiRNA target sequence
gctggcggaaaagctcaaaag

SEQ ID NO: 7017 - DNA, 21 bp, Artificial sequence
  SiRNA target sequence
ctggcggaaaagctcaaaagc

SEQ ID NO: 7018 - DNA, 21 bp, Artificial sequence
  SiRNA target sequence
tggcggaaaagctcaaaagct

SEQ ID NO: 7019 - DNA, 21 bp, Artificial sequence
  SiRNA target sequence
ggcggaaaagctcaaaagctt

SEQ ID NO: 7020 - DNA, 21 bp, Artificial sequence
  SiRNA target sequence
gcggaaaagctcaaaagcttg

SEQ ID NO: 7021 - DNA, 21 bp, Artificial sequence
  SiRNA target sequence
cggaaaagctcaaaagcttgc

SEQ ID NO: 7022 - DNA, 21 bp, Artificial sequence
  SiRNA target sequence
ggaaaagctcaaaagcttgcc

SEQ ID NO: 7023 - DNA, 21 bp, Artificial sequence
  SiRNA target sequence
gaaaagctcaaaagcttgcca

SEQ ID NO: 7024 - DNA, 21 bp, Artificial sequence
  SiRNA target sequence
aaaagctcaaaagcttgccaa

SEQ ID NO: 7025 - DNA, 21 bp, Artificial sequence
  SiRNA target sequence
aaagctcaaaagcttgccaat

SEQ ID NO: 7026 - DNA, 21 bp, Artificial sequence
  SiRNA target sequence
aagctcaaaagcttgccaatt

SEQ ID NO: 7027 - DNA, 21 bp, Artificial sequence
  SiRNA target sequence
agctcaaaagcttgccaattt

SEQ ID NO: 7028 - DNA, 21 bp, Artificial sequence
  SiRNA target sequence
gctcaaaagcttgccaatttt

SEQ ID NO: 7029 - DNA, 21 bp, Artificial sequence
  SiRNA target sequence
ctcaaaagcttgccaatttta

SEQ ID NO: 7030 - DNA, 21 bp, Artificial sequence
  SiRNA target sequence
tcaaaagcttgccaattttaa

SEQ ID NO: 7031 - DNA, 21 bp, Artificial sequence
  SiRNA target sequence
caaaagcttgccaattttaag

SEQ ID NO: 7032 - DNA, 21 bp, Artificial sequence
  SiRNA target sequence
aaaagcttgccaattttaagt

SEQ ID NO: 7033 - DNA, 21 bp, Artificial sequence
  SiRNA target sequence
aaagcttgccaattttaagta

SEQ ID NO: 7034 - DNA, 21 bp, Artificial sequence
  SiRNA target sequence
aagcttgccaattttaagtac

SEQ ID NO: 7035 - DNA, 21 bp, Artificial sequence
  SiRNA target sequence
agcttgccaattttaagtacc

SEQ ID NO: 7036 - DNA, 21 bp, Artificial sequence
  SiRNA target sequence
gcttgccaattttaagtacct

SEQ ID NO: 7037 - DNA, 21 bp, Artificial sequence
  SiRNA target sequence
cttgccaattttaagtacctg

SEQ ID NO: 7038 - DNA, 21 bp, Artificial sequence
  SiRNA target sequence
ttgccaattttaagtacctgc

SEQ ID NO: 7039 - DNA, 21 bp, Artificial sequence
  SiRNA target sequence
tgccaattttaagtacctgcg

SEQ ID NO: 7040 - DNA, 21 bp, Artificial sequence
  SiRNA target sequence
gccaattttaagtacctgcga

SEQ ID NO: 7041 - DNA, 21 bp, Artificial sequence
  SiRNA target sequence
ccaattttaagtacctgcgat

SEQ ID NO: 7042 - DNA, 21 bp, Artificial sequence
  SiRNA target sequence
caattttaagtacctgcgatg

SEQ ID NO: 7043 - DNA, 21 bp, Artificial sequence
  SiRNA target sequence
aattttaagtacctgcgatgt

SEQ ID NO: 7044 - DNA, 21 bp, Artificial sequence
  SiRNA target sequence
attttaagtacctgcgatgtg

SEQ ID NO: 7045 - DNA, 21 bp, Artificial sequence
  SiRNA target sequence
ttttaagtacctgcgatgtga

SEQ ID NO: 7046 - DNA, 21 bp, Artificial sequence
  SiRNA target sequence
tttaagtacctgcgatgtgat

SEQ ID NO: 7047 - DNA, 21 bp, Artificial sequence
  SiRNA target sequence
ttaagtacctgcgatgtgatg

SEQ ID NO: 7048 - DNA, 21 bp, Artificial sequence
  SiRNA target sequence
taagtacctgcgatgtgatgt

SEQ ID NO: 7049 - DNA, 21 bp, Artificial sequence
  SiRNA target sequence
aagtacctgcgatgtgatgtt

SEQ ID NO: 7050 - DNA, 21 bp, Artificial sequence
  SiRNA target sequence
agtacctgcgatgtgatgttc

SEQ ID NO: 7051 - DNA, 21 bp, Artificial sequence
  SiRNA target sequence
gtacctgcgatgtgatgttca

SEQ ID NO: 7052 - DNA, 21 bp, Artificial sequence
  SiRNA target sequence
tacctgcgatgtgatgttcag

SEQ ID NO: 7053 - DNA, 21 bp, Artificial sequence
  SiRNA target sequence
acctgcgatgtgatgttcagg

SEQ ID NO: 7054 - DNA, 21 bp, Artificial sequence
  SiRNA target sequence
cctgcgatgtgatgttcaggt

SEQ ID NO: 7055 - DNA, 21 bp, Artificial sequence
  SiRNA target sequence
ctgcgatgtgatgttcaggtg

SEQ ID NO: 7056 - DNA, 21 bp, Artificial sequence
  SiRNA target sequence
tgcgatgtgatgttcaggtga

SEQ ID NO: 7057 - DNA, 21 bp, Artificial sequence
  SiRNA target sequence
gcgatgtgatgttcaggtgaa

SEQ ID NO: 7058 - DNA, 21 bp, Artificial sequence
  SiRNA target sequence
cgatgtgatgttcaggtgaag

SEQ ID NO: 7059 - DNA, 21 bp, Artificial sequence
  SiRNA target sequence
gatgtgatgttcaggtgaagt

SEQ ID NO: 7060 - DNA, 21 bp, Artificial sequence
  SiRNA target sequence
atgtgatgttcaggtgaagtt

SEQ ID NO: 7061 - DNA, 21 bp, Artificial sequence
  SiRNA target sequence
tgtgatgttcaggtgaagtta

SEQ ID NO: 7062 - DNA, 21 bp, Artificial sequence
  SiRNA target sequence
gtgatgttcaggtgaagttag

SEQ ID NO: 7063 - DNA, 21 bp, Artificial sequence
  SiRNA target sequence
tgatgttcaggtgaagttagt

SEQ ID NO: 7064 - DNA, 21 bp, Artificial sequence
  SiRNA target sequence
gatgttcaggtgaagttagta

SEQ ID NO: 7065 - DNA, 21 bp, Artificial sequence
  SiRNA target sequence
atgttcaggtgaagttagtac

SEQ ID NO: 7066 - DNA, 21 bp, Artificial sequence
  SiRNA target sequence
tgttcaggtgaagttagtact

SEQ ID NO: 7067 - DNA, 21 bp, Artificial sequence
  SiRNA target sequence
gttcaggtgaagttagtactt

SEQ ID NO: 7068 - DNA, 21 bp, Artificial sequence
  SiRNA target sequence
ttcaggtgaagttagtactta

SEQ ID NO: 7069 - DNA, 21 bp, Artificial sequence
  SiRNA target sequence
tcaggtgaagttagtacttaa

SEQ ID NO: 7070 - DNA, 21 bp, Artificial sequence
  SiRNA target sequence
caggtgaagttagtacttaat

SEQ ID NO: 7071 - DNA, 21 bp, Artificial sequence
  SiRNA target sequence
aggtgaagttagtacttaatg

SEQ ID NO: 7072 - DNA, 21 bp, Artificial sequence
  SiRNA target sequence
ggtgaagttagtacttaatgc

SEQ ID NO: 7073 - DNA, 21 bp, Artificial sequence
  SiRNA target sequence
gtgaagttagtacttaatgcg

SEQ ID NO: 7074 - DNA, 21 bp, Artificial sequence
  SiRNA target sequence
tgaagttagtacttaatgcga

SEQ ID NO: 7075 - DNA, 21 bp, Artificial sequence
  SiRNA target sequence
gaagttagtacttaatgcgaa

SEQ ID NO: 7076 - DNA, 21 bp, Artificial sequence
  SiRNA target sequence
aagttagtacttaatgcgaat

SEQ ID NO: 7077 - DNA, 21 bp, Artificial sequence
  SiRNA target sequence
agttagtacttaatgcgaatc

SEQ ID NO: 7078 - DNA, 21 bp, Artificial sequence
  SiRNA target sequence
gttagtacttaatgcgaatcc

SEQ ID NO: 7079 - DNA, 21 bp, Artificial sequence
  SiRNA target sequence
ttagtacttaatgcgaatccc

SEQ ID NO: 7080 - DNA, 21 bp, Artificial sequence
  SiRNA target sequence
tagtacttaatgcgaatccct

SEQ ID NO: 7081 - DNA, 21 bp, Artificial sequence
  SiRNA target sequence
agtacttaatgcgaatccctt

SEQ ID NO: 7082 - DNA, 21 bp, Artificial sequence
  SiRNA target sequence
gtacttaatgcgaatcccttt

SEQ ID NO: 7083 - DNA, 21 bp, Artificial sequence
  SiRNA target sequence
tacttaatgcgaatccctttg

SEQ ID NO: 7084 - DNA, 21 bp, Artificial sequence
  SiRNA target sequence
acttaatgcgaatccctttgt

SEQ ID NO: 7085 - DNA, 21 bp, Artificial sequence
  SiRNA target sequence
cttaatgcgaatccctttgta

SEQ ID NO: 7086 - DNA, 21 bp, Artificial sequence
  SiRNA target sequence
ttaatgcgaatccctttgtag

SEQ ID NO: 7087 - DNA, 21 bp, Artificial sequence
  SiRNA target sequence
taatgcgaatccctttgtagc

SEQ ID NO: 7088 - DNA, 21 bp, Artificial sequence
  SiRNA target sequence
aatgcgaatccctttgtagca

SEQ ID NO: 7089 - DNA, 21 bp, Artificial sequence
  SiRNA target sequence
atgcgaatccctttgtagcag

SEQ ID NO: 7090 - DNA, 21 bp, Artificial sequence
  SiRNA target sequence
tgcgaatccctttgtagcagg

SEQ ID NO: 7091 - DNA, 21 bp, Artificial sequence
  SiRNA target sequence
gcgaatccctttgtagcagga

SEQ ID NO: 7092 - DNA, 21 bp, Artificial sequence
  SiRNA target sequence
cgaatccctttgtagcaggaa

SEQ ID NO: 7093 - DNA, 21 bp, Artificial sequence
  SiRNA target sequence
gaatccctttgtagcaggaag

SEQ ID NO: 7094 - DNA, 21 bp, Artificial sequence
  SiRNA target sequence
aatccctttgtagcaggaaga

SEQ ID NO: 7095 - DNA, 21 bp, Artificial sequence
  SiRNA target sequence
atccctttgtagcaggaagaa

SEQ ID NO: 7096 - DNA, 21 bp, Artificial sequence
  SiRNA target sequence
tccctttgtagcaggaagaat

SEQ ID NO: 7097 - DNA, 21 bp, Artificial sequence
  SiRNA target sequence
ccctttgtagcaggaagaatg

SEQ ID NO: 7098 - DNA, 21 bp, Artificial sequence
  SiRNA target sequence
cctttgtagcaggaagaatgt

SEQ ID NO: 7099 - DNA, 21 bp, Artificial sequence
  SiRNA target sequence
ctttgtagcaggaagaatgta

SEQ ID NO: 7100 - DNA, 21 bp, Artificial sequence
  SiRNA target sequence
tttgtagcaggaagaatgtat

SEQ ID NO: 7101 - DNA, 21 bp, Artificial sequence
  SiRNA target sequence
ttgtagcaggaagaatgtatc

SEQ ID NO: 7102 - DNA, 21 bp, Artificial sequence
  SiRNA target sequence
tgtagcaggaagaatgtatct

SEQ ID NO: 7103 - DNA, 21 bp, Artificial sequence
  SiRNA target sequence
gtagcaggaagaatgtatcta

SEQ ID NO: 7104 - DNA, 21 bp, Artificial sequence
  SiRNA target sequence
tagcaggaagaatgtatctag

SEQ ID NO: 7105 - DNA, 21 bp, Artificial sequence
  SiRNA target sequence
agcaggaagaatgtatctagc

SEQ ID NO: 7106 - DNA, 21 bp, Artificial sequence
  SiRNA target sequence
gcaggaagaatgtatctagca

SEQ ID NO: 7107 - DNA, 21 bp, Artificial sequence
  SiRNA target sequence
caggaagaatgtatctagcat

SEQ ID NO: 7108 - DNA, 21 bp, Artificial sequence
  SiRNA target sequence
aggaagaatgtatctagcata

SEQ ID NO: 7109 - DNA, 21 bp, Artificial sequence
  SiRNA target sequence
ggaagaatgtatctagcatat

SEQ ID NO: 7110 - DNA, 21 bp, Artificial sequence
  SiRNA target sequence
gaagaatgtatctagcatata

SEQ ID NO: 7111 - DNA, 21 bp, Artificial sequence
  SiRNA target sequence
aagaatgtatctagcatatag

SEQ ID NO: 7112 - DNA, 21 bp, Artificial sequence
  SiRNA target sequence
agaatgtatctagcatatagt

SEQ ID NO: 7113 - DNA, 21 bp, Artificial sequence
  SiRNA target sequence
gaatgtatctagcatatagtc

SEQ ID NO: 7114 - DNA, 21 bp, Artificial sequence
  SiRNA target sequence
aatgtatctagcatatagtcc

SEQ ID NO: 7115 - DNA, 21 bp, Artificial sequence
  SiRNA target sequence
atgtatctagcatatagtcct

SEQ ID NO: 7116 - DNA, 21 bp, Artificial sequence
  SiRNA target sequence
tgtatctagcatatagtcctt

SEQ ID NO: 7117 - DNA, 21 bp, Artificial sequence
  SiRNA target sequence
gtatctagcatatagtcctta

SEQ ID NO: 7118 - DNA, 21 bp, Artificial sequence
  SiRNA target sequence
tatctagcatatagtccttac

SEQ ID NO: 7119 - DNA, 21 bp, Artificial sequence
  SiRNA target sequence
atctagcatatagtccttacg

SEQ ID NO: 7120 - DNA, 21 bp, Artificial sequence
  SiRNA target sequence
tctagcatatagtccttacga

SEQ ID NO: 7121 - DNA, 21 bp, Artificial sequence
  SiRNA target sequence
ctagcatatagtccttacgat

SEQ ID NO: 7122 - DNA, 21 bp, Artificial sequence
  SiRNA target sequence
tagcatatagtccttacgatg

SEQ ID NO: 7123 - DNA, 21 bp, Artificial sequence
  SiRNA target sequence
agcatatagtccttacgatga

SEQ ID NO: 7124 - DNA, 21 bp, Artificial sequence
  SiRNA target sequence
gcatatagtccttacgatgat

SEQ ID NO: 7125 - DNA, 21 bp, Artificial sequence
  SiRNA target sequence
catatagtccttacgatgata

SEQ ID NO: 7126 - DNA, 21 bp, Artificial sequence
  SiRNA target sequence
atatagtccttacgatgataa

SEQ ID NO: 7127 - DNA, 21 bp, Artificial sequence
  SiRNA target sequence
tatagtccttacgatgataaa

SEQ ID NO: 7128 - DNA, 21 bp, Artificial sequence
  SiRNA target sequence
atagtccttacgatgataaag

SEQ ID NO: 7129 - DNA, 21 bp, Artificial sequence
  SiRNA target sequence
tagtccttacgatgataaagt

SEQ ID NO: 7130 - DNA, 21 bp, Artificial sequence
  SiRNA target sequence
agtccttacgatgataaagtt

SEQ ID NO: 7131 - DNA, 21 bp, Artificial sequence
  SiRNA target sequence
gtccttacgatgataaagttg

SEQ ID NO: 7132 - DNA, 21 bp, Artificial sequence
  SiRNA target sequence
tccttacgatgataaagttga

SEQ ID NO: 7133 - DNA, 21 bp, Artificial sequence
  SiRNA target sequence
ccttacgatgataaagttgac

SEQ ID NO: 7134 - DNA, 21 bp, Artificial sequence
  SiRNA target sequence
cttacgatgataaagttgaca

SEQ ID NO: 7135 - DNA, 21 bp, Artificial sequence
  SiRNA target sequence
ttacgatgataaagttgacac

SEQ ID NO: 7136 - DNA, 21 bp, Artificial sequence
  SiRNA target sequence
tacgatgataaagttgacacg

SEQ ID NO: 7137 - DNA, 21 bp, Artificial sequence
  SiRNA target sequence
acgatgataaagttgacacgg

SEQ ID NO: 7138 - DNA, 21 bp, Artificial sequence
  SiRNA target sequence
cgatgataaagttgacacggc

SEQ ID NO: 7139 - DNA, 21 bp, Artificial sequence
  SiRNA target sequence
gatgataaagttgacacggcc

SEQ ID NO: 7140 - DNA, 21 bp, Artificial sequence
  SiRNA target sequence
atgataaagttgacacggccc

SEQ ID NO: 7141 - DNA, 21 bp, Artificial sequence
  SiRNA target sequence
tgataaagttgacacggcccg

SEQ ID NO: 7142 - DNA, 21 bp, Artificial sequence
  SiRNA target sequence
gataaagttgacacggcccgt

SEQ ID NO: 7143 - DNA, 21 bp, Artificial sequence
  SiRNA target sequence
ataaagttgacacggcccgta

SEQ ID NO: 7144 - DNA, 21 bp, Artificial sequence
  SiRNA target sequence
taaagttgacacggcccgtag

SEQ ID NO: 7145 - DNA, 21 bp, Artificial sequence
  SiRNA target sequence
aaagttgacacggcccgtagt

SEQ ID NO: 7146 - DNA, 21 bp, Artificial sequence
  SiRNA target sequence
aagttgacacggcccgtagtg

SEQ ID NO: 7147 - DNA, 21 bp, Artificial sequence
  SiRNA target sequence
agttgacacggcccgtagtgt

SEQ ID NO: 7148 - DNA, 21 bp, Artificial sequence
  SiRNA target sequence
gttgacacggcccgtagtgtt

SEQ ID NO: 7149 - DNA, 21 bp, Artificial sequence
  SiRNA target sequence
ttgacacggcccgtagtgttt

SEQ ID NO: 7150 - DNA, 21 bp, Artificial sequence
  SiRNA target sequence
tgacacggcccgtagtgtttt

SEQ ID NO: 7151 - DNA, 21 bp, Artificial sequence
  SiRNA target sequence
gacacggcccgtagtgtttta

SEQ ID NO: 7152 - DNA, 21 bp, Artificial sequence
  SiRNA target sequence
acacggcccgtagtgttttac

SEQ ID NO: 7153 - DNA, 21 bp, Artificial sequence
  SiRNA target sequence
cacggcccgtagtgttttaca

SEQ ID NO: 7154 - DNA, 21 bp, Artificial sequence
  SiRNA target sequence
acggcccgtagtgttttacaa

SEQ ID NO: 7155 - DNA, 21 bp, Artificial sequence
  SiRNA target sequence
cggcccgtagtgttttacaaa

SEQ ID NO: 7156 - DNA, 21 bp, Artificial sequence
  SiRNA target sequence
ggcccgtagtgttttacaaac

SEQ ID NO: 7157 - DNA, 21 bp, Artificial sequence
  SiRNA target sequence
gcccgtagtgttttacaaaca

SEQ ID NO: 7158 - DNA, 21 bp, Artificial sequence
  SiRNA target sequence
cccgtagtgttttacaaacat

SEQ ID NO: 7159 - DNA, 21 bp, Artificial sequence
  SiRNA target sequence
ccgtagtgttttacaaacatc

SEQ ID NO: 7160 - DNA, 21 bp, Artificial sequence
  SiRNA target sequence
cgtagtgttttacaaacatcg

SEQ ID NO: 7161 - DNA, 21 bp, Artificial sequence
  SiRNA target sequence
gtagtgttttacaaacatcgc

SEQ ID NO: 7162 - DNA, 21 bp, Artificial sequence
  SiRNA target sequence
tagtgttttacaaacatcgcg

SEQ ID NO: 7163 - DNA, 21 bp, Artificial sequence
  SiRNA target sequence
agtgttttacaaacatcgcga

SEQ ID NO: 7164 - DNA, 21 bp, Artificial sequence
  SiRNA target sequence
gtgttttacaaacatcgcgag

SEQ ID NO: 7165 - DNA, 21 bp, Artificial sequence
  SiRNA target sequence
tgttttacaaacatcgcgagc

SEQ ID NO: 7166 - DNA, 21 bp, Artificial sequence
  SiRNA target sequence
gttttacaaacatcgcgagct

SEQ ID NO: 7167 - DNA, 21 bp, Artificial sequence
  SiRNA target sequence
ttttacaaacatcgcgagctg

SEQ ID NO: 7168 - DNA, 21 bp, Artificial sequence
  SiRNA target sequence
tttacaaacatcgcgagctgg

SEQ ID NO: 7169 - DNA, 21 bp, Artificial sequence
  SiRNA target sequence
ttacaaacatcgcgagctggg

SEQ ID NO: 7170 - DNA, 21 bp, Artificial sequence
  SiRNA target sequence
tacaaacatcgcgagctgggg

SEQ ID NO: 7171 - DNA, 21 bp, Artificial sequence
  SiRNA target sequence
acaaacatcgcgagctggggt

SEQ ID NO: 7172 - DNA, 21 bp, Artificial sequence
  SiRNA target sequence
caaacatcgcgagctggggtc

SEQ ID NO: 7173 - DNA, 21 bp, Artificial sequence
  SiRNA target sequence
aaacatcgcgagctggggtca

SEQ ID NO: 7174 - DNA, 21 bp, Artificial sequence
  SiRNA target sequence
aacatcgcgagctggggtcac

SEQ ID NO: 7175 - DNA, 21 bp, Artificial sequence
  SiRNA target sequence
acatcgcgagctggggtcaca

SEQ ID NO: 7176 - DNA, 21 bp, Artificial sequence
  SiRNA target sequence
catcgcgagctggggtcacag

SEQ ID NO: 7177 - DNA, 21 bp, Artificial sequence
  SiRNA target sequence
atcgcgagctggggtcacagg

SEQ ID NO: 7178 - DNA, 21 bp, Artificial sequence
  SiRNA target sequence
tcgcgagctggggtcacaggc

SEQ ID NO: 7179 - DNA, 21 bp, Artificial sequence
  SiRNA target sequence
cgcgagctggggtcacaggct

SEQ ID NO: 7180 - DNA, 21 bp, Artificial sequence
  SiRNA target sequence
gcgagctggggtcacaggcta

SEQ ID NO: 7181 - DNA, 21 bp, Artificial sequence
  SiRNA target sequence
cgagctggggtcacaggctat

SEQ ID NO: 7182 - DNA, 21 bp, Artificial sequence
  SiRNA target sequence
gagctggggtcacaggctatc

SEQ ID NO: 7183 - DNA, 21 bp, Artificial sequence
  SiRNA target sequence
agctggggtcacaggctatcc

SEQ ID NO: 7184 - DNA, 21 bp, Artificial sequence
  SiRNA target sequence
gctggggtcacaggctatccg

SEQ ID NO: 7185 - DNA, 21 bp, Artificial sequence
  SiRNA target sequence
ctggggtcacaggctatccgg

SEQ ID NO: 7186 - DNA, 21 bp, Artificial sequence
  SiRNA target sequence
tggggtcacaggctatccggg

SEQ ID NO: 7187 - DNA, 21 bp, Artificial sequence
  SiRNA target sequence
ggggtcacaggctatccggga

SEQ ID NO: 7188 - DNA, 21 bp, Artificial sequence
  SiRNA target sequence
gggtcacaggctatccgggag

SEQ ID NO: 7189 - DNA, 21 bp, Artificial sequence
  SiRNA target sequence
ggtcacaggctatccgggagt

SEQ ID NO: 7190 - DNA, 21 bp, Artificial sequence
  SiRNA target sequence
gtcacaggctatccgggagtc

SEQ ID NO: 7191 - DNA, 21 bp, Artificial sequence
  SiRNA target sequence
tcacaggctatccgggagtcg

SEQ ID NO: 7192 - DNA, 21 bp, Artificial sequence
  SiRNA target sequence
cacaggctatccgggagtcga

SEQ ID NO: 7193 - DNA, 21 bp, Artificial sequence
  SiRNA target sequence
acaggctatccgggagtcgaa

SEQ ID NO: 7194 - DNA, 21 bp, Artificial sequence
  SiRNA target sequence
caggctatccgggagtcgaat

SEQ ID NO: 7195 - DNA, 21 bp, Artificial sequence
  SiRNA target sequence
aggctatccgggagtcgaatt

SEQ ID NO: 7196 - DNA, 21 bp, Artificial sequence
  SiRNA target sequence
ggctatccgggagtcgaatta

SEQ ID NO: 7197 - DNA, 21 bp, Artificial sequence
  SiRNA target sequence
gctatccgggagtcgaattag

SEQ ID NO: 7198 - DNA, 21 bp, Artificial sequence
  SiRNA target sequence
ctatccgggagtcgaattaga

SEQ ID NO: 7199 - DNA, 21 bp, Artificial sequence
  SiRNA target sequence
tatccgggagtcgaattagac

SEQ ID NO: 7200 - DNA, 21 bp, Artificial sequence
  SiRNA target sequence
atccgggagtcgaattagact

SEQ ID NO: 7201 - DNA, 21 bp, Artificial sequence
  SiRNA target sequence
tccgggagtcgaattagactt

SEQ ID NO: 7202 - DNA, 21 bp, Artificial sequence
  SiRNA target sequence
ccgggagtcgaattagacttc

SEQ ID NO: 7203 - DNA, 21 bp, Artificial sequence
  SiRNA target sequence
cgggagtcgaattagacttcc

SEQ ID NO: 7204 - DNA, 21 bp, Artificial sequence
  SiRNA target sequence
gggagtcgaattagacttcca

SEQ ID NO: 7205 - DNA, 21 bp, Artificial sequence
  SiRNA target sequence
ggagtcgaattagacttccaa

SEQ ID NO: 7206 - DNA, 21 bp, Artificial sequence
  SiRNA target sequence
gagtcgaattagacttccaat

SEQ ID NO: 7207 - DNA, 21 bp, Artificial sequence
  SiRNA target sequence
agtcgaattagacttccaatt

SEQ ID NO: 7208 - DNA, 21 bp, Artificial sequence
  SiRNA target sequence
gtcgaattagacttccaattg

SEQ ID NO: 7209 - DNA, 21 bp, Artificial sequence
  SiRNA target sequence
tcgaattagacttccaattgg

SEQ ID NO: 7210 - DNA, 21 bp, Artificial sequence
  SiRNA target sequence
cgaattagacttccaattgga

SEQ ID NO: 7211 - DNA, 21 bp, Artificial sequence
  SiRNA target sequence
gaattagacttccaattggac

SEQ ID NO: 7212 - DNA, 21 bp, Artificial sequence
  SiRNA target sequence
aattagacttccaattggaca

SEQ ID NO: 7213 - DNA, 21 bp, Artificial sequence
  SiRNA target sequence
attagacttccaattggacaa

SEQ ID NO: 7214 - DNA, 21 bp, Artificial sequence
  SiRNA target sequence
ttagacttccaattggacaac

SEQ ID NO: 7215 - DNA, 21 bp, Artificial sequence
  SiRNA target sequence
tagacttccaattggacaact

SEQ ID NO: 7216 - DNA, 21 bp, Artificial sequence
  SiRNA target sequence
agacttccaattggacaactc

SEQ ID NO: 7217 - DNA, 21 bp, Artificial sequence
  SiRNA target sequence
gacttccaattggacaactct

SEQ ID NO: 7218 - DNA, 21 bp, Artificial sequence
  SiRNA target sequence
acttccaattggacaactctg

SEQ ID NO: 7219 - DNA, 21 bp, Artificial sequence
  SiRNA target sequence
cttccaattggacaactctgt

SEQ ID NO: 7220 - DNA, 21 bp, Artificial sequence
  SiRNA target sequence
ttccaattggacaactctgta

SEQ ID NO: 7221 - DNA, 21 bp, Artificial sequence
  SiRNA target sequence
tccaattggacaactctgtag

SEQ ID NO: 7222 - DNA, 21 bp, Artificial sequence
  SiRNA target sequence
ccaattggacaactctgtaga

SEQ ID NO: 7223 - DNA, 21 bp, Artificial sequence
  SiRNA target sequence
caattggacaactctgtagaa

SEQ ID NO: 7224 - DNA, 21 bp, Artificial sequence
  SiRNA target sequence
aattggacaactctgtagaaa

SEQ ID NO: 7225 - DNA, 21 bp, Artificial sequence
  SiRNA target sequence
attggacaactctgtagaaat

SEQ ID NO: 7226 - DNA, 21 bp, Artificial sequence
  SiRNA target sequence
ttggacaactctgtagaaatg

SEQ ID NO: 7227 - DNA, 21 bp, Artificial sequence
  SiRNA target sequence
tggacaactctgtagaaatga

SEQ ID NO: 7228 - DNA, 21 bp, Artificial sequence
  SiRNA target sequence
ggacaactctgtagaaatgac

SEQ ID NO: 7229 - DNA, 21 bp, Artificial sequence
  SiRNA target sequence
gacaactctgtagaaatgact

SEQ ID NO: 7230 - DNA, 21 bp, Artificial sequence
  SiRNA target sequence
acaactctgtagaaatgacta

SEQ ID NO: 7231 - DNA, 21 bp, Artificial sequence
  SiRNA target sequence
caactctgtagaaatgactat

SEQ ID NO: 7232 - DNA, 21 bp, Artificial sequence
  SiRNA target sequence
aactctgtagaaatgactatt

SEQ ID NO: 7233 - DNA, 21 bp, Artificial sequence
  SiRNA target sequence
actctgtagaaatgactattc

SEQ ID NO: 7234 - DNA, 21 bp, Artificial sequence
  SiRNA target sequence
ctctgtagaaatgactattcc

SEQ ID NO: 7235 - DNA, 21 bp, Artificial sequence
  SiRNA target sequence
tctgtagaaatgactattcca

SEQ ID NO: 7236 - DNA, 21 bp, Artificial sequence
  SiRNA target sequence
ctgtagaaatgactattccat

SEQ ID NO: 7237 - DNA, 21 bp, Artificial sequence
  SiRNA target sequence
tgtagaaatgactattccata

SEQ ID NO: 7238 - DNA, 21 bp, Artificial sequence
  SiRNA target sequence
gtagaaatgactattccatat

SEQ ID NO: 7239 - DNA, 21 bp, Artificial sequence
  SiRNA target sequence
tagaaatgactattccatatg

SEQ ID NO: 7240 - DNA, 21 bp, Artificial sequence
  SiRNA target sequence
agaaatgactattccatatgc

SEQ ID NO: 7241 - DNA, 21 bp, Artificial sequence
  SiRNA target sequence
gaaatgactattccatatgcc

SEQ ID NO: 7242 - DNA, 21 bp, Artificial sequence
  SiRNA target sequence
aaatgactattccatatgcct

SEQ ID NO: 7243 - DNA, 21 bp, Artificial sequence
  SiRNA target sequence
aatgactattccatatgcctc

SEQ ID NO: 7244 - DNA, 21 bp, Artificial sequence
  SiRNA target sequence
atgactattccatatgcctct

SEQ ID NO: 7245 - DNA, 21 bp, Artificial sequence
  SiRNA target sequence
tgactattccatatgcctctt

SEQ ID NO: 7246 - DNA, 21 bp, Artificial sequence
  SiRNA target sequence
gactattccatatgcctcttt

SEQ ID NO: 7247 - DNA, 21 bp, Artificial sequence
  SiRNA target sequence
actattccatatgcctctttc

SEQ ID NO: 7248 - DNA, 21 bp, Artificial sequence
  SiRNA target sequence
ctattccatatgcctctttcc

SEQ ID NO: 7249 - DNA, 21 bp, Artificial sequence
  SiRNA target sequence
tattccatatgcctctttcca

SEQ ID NO: 7250 - DNA, 21 bp, Artificial sequence
  SiRNA target sequence
attccatatgcctctttccaa

SEQ ID NO: 7251 - DNA, 21 bp, Artificial sequence
  SiRNA target sequence
ttccatatgcctctttccaag

SEQ ID NO: 7252 - DNA, 21 bp, Artificial sequence
  SiRNA target sequence
tccatatgcctctttccaaga

SEQ ID NO: 7253 - DNA, 21 bp, Artificial sequence
  SiRNA target sequence
ccatatgcctctttccaagag

SEQ ID NO: 7254 - DNA, 21 bp, Artificial sequence
  SiRNA target sequence
catatgcctctttccaagagg

SEQ ID NO: 7255 - DNA, 21 bp, Artificial sequence
  SiRNA target sequence
atatgcctctttccaagaggc

SEQ ID NO: 7256 - DNA, 21 bp, Artificial sequence
  SiRNA target sequence
tatgcctctttccaagaggct

SEQ ID NO: 7257 - DNA, 21 bp, Artificial sequence
  SiRNA target sequence
atgcctctttccaagaggctt

SEQ ID NO: 7258 - DNA, 21 bp, Artificial sequence
  SiRNA target sequence
tgcctctttccaagaggctta

SEQ ID NO: 7259 - DNA, 21 bp, Artificial sequence
  SiRNA target sequence
gcctctttccaagaggcttat

SEQ ID NO: 7260 - DNA, 21 bp, Artificial sequence
  SiRNA target sequence
cctctttccaagaggcttatg

SEQ ID NO: 7261 - DNA, 21 bp, Artificial sequence
  SiRNA target sequence
ctctttccaagaggcttatga

SEQ ID NO: 7262 - DNA, 21 bp, Artificial sequence
  SiRNA target sequence
tctttccaagaggcttatgat

SEQ ID NO: 7263 - DNA, 21 bp, Artificial sequence
  SiRNA target sequence
ctttccaagaggcttatgatt

SEQ ID NO: 7264 - DNA, 21 bp, Artificial sequence
  SiRNA target sequence
tttccaagaggcttatgattt

SEQ ID NO: 7265 - DNA, 21 bp, Artificial sequence
  SiRNA target sequence
ttccaagaggcttatgattta

SEQ ID NO: 7266 - DNA, 21 bp, Artificial sequence
  SiRNA target sequence
tccaagaggcttatgatttag

SEQ ID NO: 7267 - DNA, 21 bp, Artificial sequence
  SiRNA target sequence
ccaagaggcttatgatttagt

SEQ ID NO: 7268 - DNA, 21 bp, Artificial sequence
  SiRNA target sequence
caagaggcttatgatttagtt

SEQ ID NO: 7269 - DNA, 21 bp, Artificial sequence
  SiRNA target sequence
aagaggcttatgatttagtta

SEQ ID NO: 7270 - DNA, 21 bp, Artificial sequence
  SiRNA target sequence
agaggcttatgatttagttac

SEQ ID NO: 7271 - DNA, 21 bp, Artificial sequence
  SiRNA target sequence
gaggcttatgatttagttact

SEQ ID NO: 7272 - DNA, 21 bp, Artificial sequence
  SiRNA target sequence
aggcttatgatttagttactg

SEQ ID NO: 7273 - DNA, 21 bp, Artificial sequence
  SiRNA target sequence
ggcttatgatttagttactgg

SEQ ID NO: 7274 - DNA, 21 bp, Artificial sequence
  SiRNA target sequence
gcttatgatttagttactgga

SEQ ID NO: 7275 - DNA, 21 bp, Artificial sequence
  SiRNA target sequence
cttatgatttagttactggaa

SEQ ID NO: 7276 - DNA, 21 bp, Artificial sequence
  SiRNA target sequence
ttatgatttagttactggaac

SEQ ID NO: 7277 - DNA, 21 bp, Artificial sequence
  SiRNA target sequence
tatgatttagttactggaacg

SEQ ID NO: 7278 - DNA, 21 bp, Artificial sequence
  SiRNA target sequence
atgatttagttactggaacgg

SEQ ID NO: 7279 - DNA, 21 bp, Artificial sequence
  SiRNA target sequence
tgatttagttactggaacgga

SEQ ID NO: 7280 - DNA, 21 bp, Artificial sequence
  SiRNA target sequence
gatttagttactggaacggaa

SEQ ID NO: 7281 - DNA, 21 bp, Artificial sequence
  SiRNA target sequence
atttagttactggaacggaag

SEQ ID NO: 7282 - DNA, 21 bp, Artificial sequence
  SiRNA target sequence
tttagttactggaacggaaga

SEQ ID NO: 7283 - DNA, 21 bp, Artificial sequence
  SiRNA target sequence
ttagttactggaacggaagat

SEQ ID NO: 7284 - DNA, 21 bp, Artificial sequence
  SiRNA target sequence
tagttactggaacggaagatt

SEQ ID NO: 7285 - DNA, 21 bp, Artificial sequence
  SiRNA target sequence
agttactggaacggaagattt

SEQ ID NO: 7286 - DNA, 21 bp, Artificial sequence
  SiRNA target sequence
gttactggaacggaagatttt

SEQ ID NO: 7287 - DNA, 21 bp, Artificial sequence
  SiRNA target sequence
ttactggaacggaagattttg

SEQ ID NO: 7288 - DNA, 21 bp, Artificial sequence
  SiRNA target sequence
tactggaacggaagattttgt

SEQ ID NO: 7289 - DNA, 21 bp, Artificial sequence
  SiRNA target sequence
actggaacggaagattttgta

SEQ ID NO: 7290 - DNA, 21 bp, Artificial sequence
  SiRNA target sequence
ctggaacggaagattttgtac

SEQ ID NO: 7291 - DNA, 21 bp, Artificial sequence
  SiRNA target sequence
tggaacggaagattttgtaca

SEQ ID NO: 7292 - DNA, 21 bp, Artificial sequence
  SiRNA target sequence
ggaacggaagattttgtacag

SEQ ID NO: 7293 - DNA, 21 bp, Artificial sequence
  SiRNA target sequence
gaacggaagattttgtacagt

SEQ ID NO: 7294 - DNA, 21 bp, Artificial sequence
  SiRNA target sequence
aacggaagattttgtacagtt

SEQ ID NO: 7295 - DNA, 21 bp, Artificial sequence
  SiRNA target sequence
acggaagattttgtacagttg

SEQ ID NO: 7296 - DNA, 21 bp, Artificial sequence
  SiRNA target sequence
cggaagattttgtacagttgt

SEQ ID NO: 7297 - DNA, 21 bp, Artificial sequence
  SiRNA target sequence
ggaagattttgtacagttgta

SEQ ID NO: 7298 - DNA, 21 bp, Artificial sequence
  SiRNA target sequence
gaagattttgtacagttgtat

SEQ ID NO: 7299 - DNA, 21 bp, Artificial sequence
  SiRNA target sequence
aagattttgtacagttgtatt

SEQ ID NO: 7300 - DNA, 21 bp, Artificial sequence
  SiRNA target sequence
agattttgtacagttgtattt

SEQ ID NO: 7301 - DNA, 21 bp, Artificial sequence
  SiRNA target sequence
gattttgtacagttgtatttg

SEQ ID NO: 7302 - DNA, 21 bp, Artificial sequence
  SiRNA target sequence
attttgtacagttgtatttgt

SEQ ID NO: 7303 - DNA, 21 bp, Artificial sequence
  SiRNA target sequence
ttttgtacagttgtatttgtt

SEQ ID NO: 7304 - DNA, 21 bp, Artificial sequence
  SiRNA target sequence
tttgtacagttgtatttgttc

SEQ ID NO: 7305 - DNA, 21 bp, Artificial sequence
  SiRNA target sequence
ttgtacagttgtatttgttcc

SEQ ID NO: 7306 - DNA, 21 bp, Artificial sequence
  SiRNA target sequence
tgtacagttgtatttgttccc

SEQ ID NO: 7307 - DNA, 21 bp, Artificial sequence
  SiRNA target sequence
gtacagttgtatttgttccca

SEQ ID NO: 7308 - DNA, 21 bp, Artificial sequence
  SiRNA target sequence
tacagttgtatttgttcccaa

SEQ ID NO: 7309 - DNA, 21 bp, Artificial sequence
  SiRNA target sequence
acagttgtatttgttcccaat

SEQ ID NO: 7310 - DNA, 21 bp, Artificial sequence
  SiRNA target sequence
cagttgtatttgttcccaatc

SEQ ID NO: 7311 - DNA, 21 bp, Artificial sequence
  SiRNA target sequence
agttgtatttgttcccaatca

SEQ ID NO: 7312 - DNA, 21 bp, Artificial sequence
  SiRNA target sequence
gttgtatttgttcccaatcac

SEQ ID NO: 7313 - DNA, 21 bp, Artificial sequence
  SiRNA target sequence
ttgtatttgttcccaatcaca

SEQ ID NO: 7314 - DNA, 21 bp, Artificial sequence
  SiRNA target sequence
tgtatttgttcccaatcacac

SEQ ID NO: 7315 - DNA, 21 bp, Artificial sequence
  SiRNA target sequence
gtatttgttcccaatcacacc

SEQ ID NO: 7316 - DNA, 21 bp, Artificial sequence
  SiRNA target sequence
tatttgttcccaatcacacct

SEQ ID NO: 7317 - DNA, 21 bp, Artificial sequence
  SiRNA target sequence
atttgttcccaatcacacctg

SEQ ID NO: 7318 - DNA, 21 bp, Artificial sequence
  SiRNA target sequence
tttgttcccaatcacacctgt

SEQ ID NO: 7319 - DNA, 21 bp, Artificial sequence
  SiRNA target sequence
ttgttcccaatcacacctgta

SEQ ID NO: 7320 - DNA, 21 bp, Artificial sequence
  SiRNA target sequence
tgttcccaatcacacctgtac

SEQ ID NO: 7321 - DNA, 21 bp, Artificial sequence
  SiRNA target sequence
gttcccaatcacacctgtact

SEQ ID NO: 7322 - DNA, 21 bp, Artificial sequence
  SiRNA target sequence
ttcccaatcacacctgtacta

SEQ ID NO: 7323 - DNA, 21 bp, Artificial sequence
  SiRNA target sequence
tcccaatcacacctgtactag

SEQ ID NO: 7324 - DNA, 21 bp, Artificial sequence
  SiRNA target sequence
cccaatcacacctgtactagg

SEQ ID NO: 7325 - DNA, 21 bp, Artificial sequence
  SiRNA target sequence
ccaatcacacctgtactagga

SEQ ID NO: 7326 - DNA, 21 bp, Artificial sequence
  SiRNA target sequence
caatcacacctgtactaggac

SEQ ID NO: 7327 - DNA, 21 bp, Artificial sequence
  SiRNA target sequence
aatcacacctgtactaggacc

SEQ ID NO: 7328 - DNA, 21 bp, Artificial sequence
  SiRNA target sequence
atcacacctgtactaggacct

SEQ ID NO: 7329 - DNA, 21 bp, Artificial sequence
  SiRNA target sequence
tcacacctgtactaggaccta

SEQ ID NO: 7330 - DNA, 21 bp, Artificial sequence
  SiRNA target sequence
cacacctgtactaggacctaa

SEQ ID NO: 7331 - DNA, 21 bp, Artificial sequence
  SiRNA target sequence
acacctgtactaggacctaaa

SEQ ID NO: 7332 - DNA, 21 bp, Artificial sequence
  SiRNA target sequence
cacctgtactaggacctaaat

SEQ ID NO: 7333 - DNA, 21 bp, Artificial sequence
  SiRNA target sequence
acctgtactaggacctaaatc

SEQ ID NO: 7334 - DNA, 21 bp, Artificial sequence
  SiRNA target sequence
cctgtactaggacctaaatct

SEQ ID NO: 7335 - DNA, 21 bp, Artificial sequence
  SiRNA target sequence
ctgtactaggacctaaatctg

SEQ ID NO: 7336 - DNA, 21 bp, Artificial sequence
  SiRNA target sequence
tgtactaggacctaaatctga

SEQ ID NO: 7337 - DNA, 21 bp, Artificial sequence
  SiRNA target sequence
gtactaggacctaaatctgaa

SEQ ID NO: 7338 - DNA, 21 bp, Artificial sequence
  SiRNA target sequence
tactaggacctaaatctgaat

SEQ ID NO: 7339 - DNA, 21 bp, Artificial sequence
  SiRNA target sequence
actaggacctaaatctgaatc

SEQ ID NO: 7340 - DNA, 21 bp, Artificial sequence
  SiRNA target sequence
ctaggacctaaatctgaatca

SEQ ID NO: 7341 - DNA, 21 bp, Artificial sequence
  SiRNA target sequence
taggacctaaatctgaatcag

SEQ ID NO: 7342 - DNA, 21 bp, Artificial sequence
  SiRNA target sequence
aggacctaaatctgaatcaga

SEQ ID NO: 7343 - DNA, 21 bp, Artificial sequence
  SiRNA target sequence
ggacctaaatctgaatcagaa

SEQ ID NO: 7344 - DNA, 21 bp, Artificial sequence
  SiRNA target sequence
gacctaaatctgaatcagaaa

SEQ ID NO: 7345 - DNA, 21 bp, Artificial sequence
  SiRNA target sequence
acctaaatctgaatcagaaag

SEQ ID NO: 7346 - DNA, 21 bp, Artificial sequence
  SiRNA target sequence
cctaaatctgaatcagaaagt

SEQ ID NO: 7347 - DNA, 21 bp, Artificial sequence
  SiRNA target sequence
ctaaatctgaatcagaaagtt

SEQ ID NO: 7348 - DNA, 21 bp, Artificial sequence
  SiRNA target sequence
taaatctgaatcagaaagttc

SEQ ID NO: 7349 - DNA, 21 bp, Artificial sequence
  SiRNA target sequence
aaatctgaatcagaaagttcc

SEQ ID NO: 7350 - DNA, 21 bp, Artificial sequence
  SiRNA target sequence
aatctgaatcagaaagttcca

SEQ ID NO: 7351 - DNA, 21 bp, Artificial sequence
  SiRNA target sequence
atctgaatcagaaagttccaa

SEQ ID NO: 7352 - DNA, 21 bp, Artificial sequence
  SiRNA target sequence
tctgaatcagaaagttccaaa

SEQ ID NO: 7353 - DNA, 21 bp, Artificial sequence
  SiRNA target sequence
ctgaatcagaaagttccaaag

SEQ ID NO: 7354 - DNA, 21 bp, Artificial sequence
  SiRNA target sequence
tgaatcagaaagttccaaagt

SEQ ID NO: 7355 - DNA, 21 bp, Artificial sequence
  SiRNA target sequence
gaatcagaaagttccaaagtt

SEQ ID NO: 7356 - DNA, 21 bp, Artificial sequence
  SiRNA target sequence
aatcagaaagttccaaagttg

SEQ ID NO: 7357 - DNA, 21 bp, Artificial sequence
  SiRNA target sequence
atcagaaagttccaaagttga

SEQ ID NO: 7358 - DNA, 21 bp, Artificial sequence
  SiRNA target sequence
tcagaaagttccaaagttgac

SEQ ID NO: 7359 - DNA, 21 bp, Artificial sequence
  SiRNA target sequence
cagaaagttccaaagttgaca

SEQ ID NO: 7360 - DNA, 21 bp, Artificial sequence
  SiRNA target sequence
agaaagttccaaagttgacat

SEQ ID NO: 7361 - DNA, 21 bp, Artificial sequence
  SiRNA target sequence
gaaagttccaaagttgacatt

SEQ ID NO: 7362 - DNA, 21 bp, Artificial sequence
  SiRNA target sequence
aaagttccaaagttgacattt

SEQ ID NO: 7363 - DNA, 21 bp, Artificial sequence
  SiRNA target sequence
aagttccaaagttgacatttc

SEQ ID NO: 7364 - DNA, 21 bp, Artificial sequence
  SiRNA target sequence
agttccaaagttgacatttca

SEQ ID NO: 7365 - DNA, 21 bp, Artificial sequence
  SiRNA target sequence
gttccaaagttgacatttcag

SEQ ID NO: 7366 - DNA, 21 bp, Artificial sequence
  SiRNA target sequence
ttccaaagttgacatttcagt

SEQ ID NO: 7367 - DNA, 21 bp, Artificial sequence
  SiRNA target sequence
tccaaagttgacatttcagtt

SEQ ID NO: 7368 - DNA, 21 bp, Artificial sequence
  SiRNA target sequence
ccaaagttgacatttcagttt

SEQ ID NO: 7369 - DNA, 21 bp, Artificial sequence
  SiRNA target sequence
caaagttgacatttcagttta

SEQ ID NO: 7370 - DNA, 21 bp, Artificial sequence
  SiRNA target sequence
aaagttgacatttcagtttat

SEQ ID NO: 7371 - DNA, 21 bp, Artificial sequence
  SiRNA target sequence
aagttgacatttcagtttata

SEQ ID NO: 7372 - DNA, 21 bp, Artificial sequence
  SiRNA target sequence
agttgacatttcagtttatat

SEQ ID NO: 7373 - DNA, 21 bp, Artificial sequence
  SiRNA target sequence
gttgacatttcagtttatatg

SEQ ID NO: 7374 - DNA, 21 bp, Artificial sequence
  SiRNA target sequence
ttgacatttcagtttatatgt

SEQ ID NO: 7375 - DNA, 21 bp, Artificial sequence
  SiRNA target sequence
tgacatttcagtttatatgtg

SEQ ID NO: 7376 - DNA, 21 bp, Artificial sequence
  SiRNA target sequence
gacatttcagtttatatgtgg

SEQ ID NO: 7377 - DNA, 21 bp, Artificial sequence
  SiRNA target sequence
acatttcagtttatatgtggt

SEQ ID NO: 7378 - DNA, 21 bp, Artificial sequence
  SiRNA target sequence
catttcagtttatatgtggtt

SEQ ID NO: 7379 - DNA, 21 bp, Artificial sequence
  SiRNA target sequence
atttcagtttatatgtggttg

SEQ ID NO: 7380 - DNA, 21 bp, Artificial sequence
  SiRNA target sequence
tttcagtttatatgtggttga

SEQ ID NO: 7381 - DNA, 21 bp, Artificial sequence
  SiRNA target sequence
ttcagtttatatgtggttgag

SEQ ID NO: 7382 - DNA, 21 bp, Artificial sequence
  SiRNA target sequence
tcagtttatatgtggttgagt

SEQ ID NO: 7383 - DNA, 21 bp, Artificial sequence
  SiRNA target sequence
cagtttatatgtggttgagta

SEQ ID NO: 7384 - DNA, 21 bp, Artificial sequence
  SiRNA target sequence
agtttatatgtggttgagtaa

SEQ ID NO: 7385 - DNA, 21 bp, Artificial sequence
  SiRNA target sequence
gtttatatgtggttgagtaac

SEQ ID NO: 7386 - DNA, 21 bp, Artificial sequence
  SiRNA target sequence
tttatatgtggttgagtaaca

SEQ ID NO: 7387 - DNA, 21 bp, Artificial sequence
  SiRNA target sequence
ttatatgtggttgagtaacat

SEQ ID NO: 7388 - DNA, 21 bp, Artificial sequence
  SiRNA target sequence
tatatgtggttgagtaacata

SEQ ID NO: 7389 - DNA, 21 bp, Artificial sequence
  SiRNA target sequence
atatgtggttgagtaacatat

SEQ ID NO: 7390 - DNA, 21 bp, Artificial sequence
  SiRNA target sequence
tatgtggttgagtaacatatc

SEQ ID NO: 7391 - DNA, 21 bp, Artificial sequence
  SiRNA target sequence
atgtggttgagtaacatatct

SEQ ID NO: 7392 - DNA, 21 bp, Artificial sequence
  SiRNA target sequence
tgtggttgagtaacatatctc

SEQ ID NO: 7393 - DNA, 21 bp, Artificial sequence
  SiRNA target sequence
gtggttgagtaacatatctct

SEQ ID NO: 7394 - DNA, 21 bp, Artificial sequence
  SiRNA target sequence
tggttgagtaacatatctctt

SEQ ID NO: 7395 - DNA, 21 bp, Artificial sequence
  SiRNA target sequence
ggttgagtaacatatctcttg

SEQ ID NO: 7396 - DNA, 21 bp, Artificial sequence
  SiRNA target sequence
gttgagtaacatatctcttgt

SEQ ID NO: 7397 - DNA, 21 bp, Artificial sequence
  SiRNA target sequence
ttgagtaacatatctcttgtt

SEQ ID NO: 7398 - DNA, 21 bp, Artificial sequence
  SiRNA target sequence
tgagtaacatatctcttgtta

SEQ ID NO: 7399 - DNA, 21 bp, Artificial sequence
  SiRNA target sequence
gagtaacatatctcttgttat

SEQ ID NO: 7400 - DNA, 21 bp, Artificial sequence
  SiRNA target sequence
agtaacatatctcttgttatt

SEQ ID NO: 7401 - DNA, 21 bp, Artificial sequence
  SiRNA target sequence
gtaacatatctcttgttattc

SEQ ID NO: 7402 - DNA, 21 bp, Artificial sequence
  SiRNA target sequence
taacatatctcttgttattcc

SEQ ID NO: 7403 - DNA, 21 bp, Artificial sequence
  SiRNA target sequence
aacatatctcttgttattcca

SEQ ID NO: 7404 - DNA, 21 bp, Artificial sequence
  SiRNA target sequence
acatatctcttgttattccaa

SEQ ID NO: 7405 - DNA, 21 bp, Artificial sequence
  SiRNA target sequence
catatctcttgttattccaac

SEQ ID NO: 7406 - DNA, 21 bp, Artificial sequence
  SiRNA target sequence
atatctcttgttattccaact

SEQ ID NO: 7407 - DNA, 21 bp, Artificial sequence
  SiRNA target sequence
tatctcttgttattccaactt

SEQ ID NO: 7408 - DNA, 21 bp, Artificial sequence
  SiRNA target sequence
atctcttgttattccaactta

SEQ ID NO: 7409 - DNA, 21 bp, Artificial sequence
  SiRNA target sequence
tctcttgttattccaacttat

SEQ ID NO: 7410 - DNA, 21 bp, Artificial sequence
  SiRNA target sequence
ctcttgttattccaacttatc

SEQ ID NO: 7411 - DNA, 21 bp, Artificial sequence
  SiRNA target sequence
tcttgttattccaacttatcg

SEQ ID NO: 7412 - DNA, 21 bp, Artificial sequence
  SiRNA target sequence
cttgttattccaacttatcgc

SEQ ID NO: 7413 - DNA, 21 bp, Artificial sequence
  SiRNA target sequence
ttgttattccaacttatcgca

SEQ ID NO: 7414 - DNA, 21 bp, Artificial sequence
  SiRNA target sequence
tgttattccaacttatcgcat

SEQ ID NO: 7415 - DNA, 21 bp, Artificial sequence
  SiRNA target sequence
gttattccaacttatcgcatg

SEQ ID NO: 7416 - DNA, 21 bp, Artificial sequence
  SiRNA target sequence
ttattccaacttatcgcatga

SEQ ID NO: 7417 - DNA, 21 bp, Artificial sequence
  SiRNA target sequence
tattccaacttatcgcatgaa

SEQ ID NO: 7418 - DNA, 21 bp, Artificial sequence
  SiRNA target sequence
attccaacttatcgcatgaat

SEQ ID NO: 7419 - DNA, 21 bp, Artificial sequence
  SiRNA target sequence
ttccaacttatcgcatgaatc

SEQ ID NO: 7420 - DNA, 21 bp, Artificial sequence
  SiRNA target sequence
tccaacttatcgcatgaatcc

SEQ ID NO: 7421 - DNA, 21 bp, Artificial sequence
  SiRNA target sequence
ccaacttatcgcatgaatcct

SEQ ID NO: 7422 - DNA, 21 bp, Artificial sequence
  SiRNA target sequence
caacttatcgcatgaatcctg

SEQ ID NO: 7423 - DNA, 21 bp, Artificial sequence
  SiRNA target sequence
aacttatcgcatgaatcctga

SEQ ID NO: 7424 - DNA, 21 bp, Artificial sequence
  SiRNA target sequence
acttatcgcatgaatcctgat

SEQ ID NO: 7425 - DNA, 21 bp, Artificial sequence
  SiRNA target sequence
cttatcgcatgaatcctgata

SEQ ID NO: 7426 - DNA, 21 bp, Artificial sequence
  SiRNA target sequence
ttatcgcatgaatcctgatat

SEQ ID NO: 7427 - DNA, 21 bp, Artificial sequence
  SiRNA target sequence
tatcgcatgaatcctgatatt

SEQ ID NO: 7428 - DNA, 21 bp, Artificial sequence
  SiRNA target sequence
atcgcatgaatcctgatattg

SEQ ID NO: 7429 - DNA, 21 bp, Artificial sequence
  SiRNA target sequence
tcgcatgaatcctgatattgt

SEQ ID NO: 7430 - DNA, 21 bp, Artificial sequence
  SiRNA target sequence
cgcatgaatcctgatattgtc

SEQ ID NO: 7431 - DNA, 21 bp, Artificial sequence
  SiRNA target sequence
gcatgaatcctgatattgtca

SEQ ID NO: 7432 - DNA, 21 bp, Artificial sequence
  SiRNA target sequence
catgaatcctgatattgtcaa

SEQ ID NO: 7433 - DNA, 21 bp, Artificial sequence
  SiRNA target sequence
atgaatcctgatattgtcaaa

SEQ ID NO: 7434 - DNA, 21 bp, Artificial sequence
  SiRNA target sequence
tgaatcctgatattgtcaaac

SEQ ID NO: 7435 - DNA, 21 bp, Artificial sequence
  SiRNA target sequence
gaatcctgatattgtcaaaca

SEQ ID NO: 7436 - DNA, 21 bp, Artificial sequence
  SiRNA target sequence
aatcctgatattgtcaaacaa

SEQ ID NO: 7437 - DNA, 21 bp, Artificial sequence
  SiRNA target sequence
atcctgatattgtcaaacaag

SEQ ID NO: 7438 - DNA, 21 bp, Artificial sequence
  SiRNA target sequence
tcctgatattgtcaaacaagg

SEQ ID NO: 7439 - DNA, 21 bp, Artificial sequence
  SiRNA target sequence
cctgatattgtcaaacaagga

SEQ ID NO: 7440 - DNA, 21 bp, Artificial sequence
  SiRNA target sequence
ctgatattgtcaaacaaggag

SEQ ID NO: 7441 - DNA, 21 bp, Artificial sequence
  SiRNA target sequence
tgatattgtcaaacaaggagc

SEQ ID NO: 7442 - DNA, 21 bp, Artificial sequence
  SiRNA target sequence
gatattgtcaaacaaggagct

SEQ ID NO: 7443 - DNA, 21 bp, Artificial sequence
  SiRNA target sequence
atattgtcaaacaaggagctt

SEQ ID NO: 7444 - DNA, 21 bp, Artificial sequence
  SiRNA target sequence
tattgtcaaacaaggagcttc

SEQ ID NO: 7445 - DNA, 21 bp, Artificial sequence
  SiRNA target sequence
attgtcaaacaaggagcttca

SEQ ID NO: 7446 - DNA, 21 bp, Artificial sequence
  SiRNA target sequence
ttgtcaaacaaggagcttcaa

SEQ ID NO: 7447 - DNA, 21 bp, Artificial sequence
  SiRNA target sequence
tgtcaaacaaggagcttcaag

SEQ ID NO: 7448 - DNA, 21 bp, Artificial sequence
  SiRNA target sequence
gtcaaacaaggagcttcaagg

SEQ ID NO: 7449 - DNA, 21 bp, Artificial sequence
  SiRNA target sequence
tcaaacaaggagcttcaagga

SEQ ID NO: 7450 - DNA, 21 bp, Artificial sequence
  SiRNA target sequence
caaacaaggagcttcaaggat

SEQ ID NO: 7451 - DNA, 21 bp, Artificial sequence
  SiRNA target sequence
aaacaaggagcttcaaggatg

SEQ ID NO: 7452 - DNA, 21 bp, Artificial sequence
  SiRNA target sequence
aacaaggagcttcaaggatgg

SEQ ID NO: 7453 - DNA, 21 bp, Artificial sequence
  SiRNA target sequence
acaaggagcttcaaggatggt

SEQ ID NO: 7454 - DNA, 21 bp, Artificial sequence
  SiRNA target sequence
caaggagcttcaaggatggta

SEQ ID NO: 7455 - DNA, 21 bp, Artificial sequence
  SiRNA target sequence
aaggagcttcaaggatggtaa

SEQ ID NO: 7456 - DNA, 21 bp, Artificial sequence
  SiRNA target sequence
aggagcttcaaggatggtaac

SEQ ID NO: 7457 - DNA, 21 bp, Artificial sequence
  SiRNA target sequence
ggagcttcaaggatggtaact

SEQ ID NO: 7458 - DNA, 21 bp, Artificial sequence
  SiRNA target sequence
gagcttcaaggatggtaactg

SEQ ID NO: 7459 - DNA, 21 bp, Artificial sequence
  SiRNA target sequence
agcttcaaggatggtaactga

SEQ ID NO: 7460 - DNA, 21 bp, Artificial sequence
  SiRNA target sequence
gcttcaaggatggtaactgaa

SEQ ID NO: 7461 - DNA, 21 bp, Artificial sequence
  SiRNA target sequence
cttcaaggatggtaactgaat

SEQ ID NO: 7462 - DNA, 21 bp, Artificial sequence
  SiRNA target sequence
ttcaaggatggtaactgaatt

SEQ ID NO: 7463 - DNA, 21 bp, Artificial sequence
  SiRNA target sequence
tcaaggatggtaactgaattt

SEQ ID NO: 7464 - DNA, 21 bp, Artificial sequence
  SiRNA target sequence
caaggatggtaactgaatttg

SEQ ID NO: 7465 - DNA, 21 bp, Artificial sequence
  SiRNA target sequence
aaggatggtaactgaatttgt

SEQ ID NO: 7466 - DNA, 21 bp, Artificial sequence
  SiRNA target sequence
aggatggtaactgaatttgtt

SEQ ID NO: 7467 - DNA, 21 bp, Artificial sequence
  SiRNA target sequence
ggatggtaactgaatttgttc

SEQ ID NO: 7468 - DNA, 21 bp, Artificial sequence
  SiRNA target sequence
gatggtaactgaatttgttcc

SEQ ID NO: 7469 - DNA, 21 bp, Artificial sequence
  SiRNA target sequence
atggtaactgaatttgttcca

SEQ ID NO: 7470 - DNA, 21 bp, Artificial sequence
  SiRNA target sequence
tggtaactgaatttgttccaa

SEQ ID NO: 7471 - DNA, 21 bp, Artificial sequence
  SiRNA target sequence
ggtaactgaatttgttccaaa

SEQ ID NO: 7472 - DNA, 21 bp, Artificial sequence
  SiRNA target sequence
gtaactgaatttgttccaaat

SEQ ID NO: 7473 - DNA, 21 bp, Artificial sequence
  SiRNA target sequence
taactgaatttgttccaaatc

SEQ ID NO: 7474 - DNA, 21 bp, Artificial sequence
  SiRNA target sequence
aactgaatttgttccaaatcc

SEQ ID NO: 7475 - DNA, 21 bp, Artificial sequence
  SiRNA target sequence
actgaatttgttccaaatcct

SEQ ID NO: 7476 - DNA, 21 bp, Artificial sequence
  SiRNA target sequence
ctgaatttgttccaaatcctc

SEQ ID NO: 7477 - DNA, 21 bp, Artificial sequence
  SiRNA target sequence
tgaatttgttccaaatcctct

SEQ ID NO: 7478 - DNA, 21 bp, Artificial sequence
  SiRNA target sequence
gaatttgttccaaatcctctt

SEQ ID NO: 7479 - DNA, 21 bp, Artificial sequence
  SiRNA target sequence
aatttgttccaaatcctcttg

SEQ ID NO: 7480 - DNA, 21 bp, Artificial sequence
  SiRNA target sequence
atttgttccaaatcctcttga

SEQ ID NO: 7481 - DNA, 21 bp, Artificial sequence
  SiRNA target sequence
tttgttccaaatcctcttgaa

SEQ ID NO: 7482 - DNA, 21 bp, Artificial sequence
  SiRNA target sequence
ttgttccaaatcctcttgaaa

SEQ ID NO: 7483 - DNA, 21 bp, Artificial sequence
  SiRNA target sequence
tgttccaaatcctcttgaaaa

SEQ ID NO: 7484 - DNA, 21 bp, Artificial sequence
  SiRNA target sequence
gttccaaatcctcttgaaaaa

SEQ ID NO: 7485 - DNA, 21 bp, Artificial sequence
  SiRNA target sequence
ttccaaatcctcttgaaaaag

SEQ ID NO: 7486 - DNA, 21 bp, Artificial sequence
  SiRNA target sequence
tccaaatcctcttgaaaaaga

SEQ ID NO: 7487 - DNA, 21 bp, Artificial sequence
  SiRNA target sequence
ccaaatcctcttgaaaaagat

SEQ ID NO: 7488 - DNA, 21 bp, Artificial sequence
  SiRNA target sequence
caaatcctcttgaaaaagatg

SEQ ID NO: 7489 - DNA, 21 bp, Artificial sequence
  SiRNA target sequence
aaatcctcttgaaaaagatgc

SEQ ID NO: 7490 - DNA, 21 bp, Artificial sequence
  SiRNA target sequence
aatcctcttgaaaaagatgcc

SEQ ID NO: 7491 - DNA, 21 bp, Artificial sequence
  SiRNA target sequence
atcctcttgaaaaagatgcca

SEQ ID NO: 7492 - DNA, 21 bp, Artificial sequence
  SiRNA target sequence
tcctcttgaaaaagatgccaa

SEQ ID NO: 7493 - DNA, 21 bp, Artificial sequence
  SiRNA target sequence
cctcttgaaaaagatgccaaa

SEQ ID NO: 7494 - DNA, 21 bp, Artificial sequence
  SiRNA target sequence
ctcttgaaaaagatgccaaaa

SEQ ID NO: 7495 - DNA, 21 bp, Artificial sequence
  SiRNA target sequence
tcttgaaaaagatgccaaaac

SEQ ID NO: 7496 - DNA, 21 bp, Artificial sequence
  SiRNA target sequence
cttgaaaaagatgccaaaacc

SEQ ID NO: 7497 - DNA, 21 bp, Artificial sequence
  SiRNA target sequence
ttgaaaaagatgccaaaacca

SEQ ID NO: 7498 - DNA, 21 bp, Artificial sequence
  SiRNA target sequence
tgaaaaagatgccaaaaccat

SEQ ID NO: 7499 - DNA, 21 bp, Artificial sequence
  SiRNA target sequence
gaaaaagatgccaaaaccata

SEQ ID NO: 7500 - DNA, 21 bp, Artificial sequence
  SiRNA target sequence
aaaaagatgccaaaaccatag

SEQ ID NO: 7501 - DNA, 21 bp, Artificial sequence
  SiRNA target sequence
aaaagatgccaaaaccatagc

SEQ ID NO: 7502 - DNA, 21 bp, Artificial sequence
  SiRNA target sequence
aaagatgccaaaaccatagca

SEQ ID NO: 7503 - DNA, 21 bp, Artificial sequence
  SiRNA target sequence
aagatgccaaaaccatagcag

SEQ ID NO: 7504 - DNA, 21 bp, Artificial sequence
  SiRNA target sequence
agatgccaaaaccatagcaga

SEQ ID NO: 7505 - DNA, 21 bp, Artificial sequence
  SiRNA target sequence
gatgccaaaaccatagcagat

SEQ ID NO: 7506 - DNA, 21 bp, Artificial sequence
  SiRNA target sequence
atgccaaaaccatagcagatg

SEQ ID NO: 7507 - DNA, 21 bp, Artificial sequence
  SiRNA target sequence
tgccaaaaccatagcagatgc

SEQ ID NO: 7508 - DNA, 21 bp, Artificial sequence
  SiRNA target sequence
gccaaaaccatagcagatgct

SEQ ID NO: 7509 - DNA, 21 bp, Artificial sequence
  SiRNA target sequence
ccaaaaccatagcagatgctc

SEQ ID NO: 7510 - DNA, 21 bp, Artificial sequence
  SiRNA target sequence
caaaaccatagcagatgctct

SEQ ID NO: 7511 - DNA, 21 bp, Artificial sequence
  SiRNA target sequence
aaaaccatagcagatgctctt

SEQ ID NO: 7512 - DNA, 21 bp, Artificial sequence
  SiRNA target sequence
aaaccatagcagatgctctta

SEQ ID NO: 7513 - DNA, 21 bp, Artificial sequence
  SiRNA target sequence
aaccatagcagatgctcttaa

SEQ ID NO: 7514 - DNA, 21 bp, Artificial sequence
  SiRNA target sequence
accatagcagatgctcttaag

SEQ ID NO: 7515 - DNA, 21 bp, Artificial sequence
  SiRNA target sequence
ccatagcagatgctcttaaga

SEQ ID NO: 7516 - DNA, 21 bp, Artificial sequence
  SiRNA target sequence
catagcagatgctcttaagaa

SEQ ID NO: 7517 - DNA, 21 bp, Artificial sequence
  SiRNA target sequence
atagcagatgctcttaagaaa

SEQ ID NO: 7518 - DNA, 21 bp, Artificial sequence
  SiRNA target sequence
tagcagatgctcttaagaaag

SEQ ID NO: 7519 - DNA, 21 bp, Artificial sequence
  SiRNA target sequence
agcagatgctcttaagaaagt

SEQ ID NO: 7520 - DNA, 21 bp, Artificial sequence
  SiRNA target sequence
gcagatgctcttaagaaagtt

SEQ ID NO: 7521 - DNA, 21 bp, Artificial sequence
  SiRNA target sequence
cagatgctcttaagaaagttc

SEQ ID NO: 7522 - DNA, 21 bp, Artificial sequence
  SiRNA target sequence
agatgctcttaagaaagttca

SEQ ID NO: 7523 - DNA, 21 bp, Artificial sequence
  SiRNA target sequence
gatgctcttaagaaagttcag

SEQ ID NO: 7524 - DNA, 21 bp, Artificial sequence
  SiRNA target sequence
atgctcttaagaaagttcaga

SEQ ID NO: 7525 - DNA, 21 bp, Artificial sequence
  SiRNA target sequence
tgctcttaagaaagttcagaa

SEQ ID NO: 7526 - DNA, 21 bp, Artificial sequence
  SiRNA target sequence
gctcttaagaaagttcagaaa

SEQ ID NO: 7527 - DNA, 21 bp, Artificial sequence
  SiRNA target sequence
ctcttaagaaagttcagaaaa

SEQ ID NO: 7528 - DNA, 21 bp, Artificial sequence
  SiRNA target sequence
tcttaagaaagttcagaaaaa

SEQ ID NO: 7529 - DNA, 21 bp, Artificial sequence
  SiRNA target sequence
cttaagaaagttcagaaaaat

SEQ ID NO: 7530 - DNA, 21 bp, Artificial sequence
  SiRNA target sequence
ttaagaaagttcagaaaaata

SEQ ID NO: 7531 - DNA, 21 bp, Artificial sequence
  SiRNA target sequence
taagaaagttcagaaaaataa

SEQ ID NO: 7532 - DNA, 21 bp, Artificial sequence
  SiRNA target sequence
aagaaagttcagaaaaataat

SEQ ID NO: 7533 - DNA, 21 bp, Artificial sequence
  SiRNA target sequence
agaaagttcagaaaaataatc

SEQ ID NO: 7534 - DNA, 21 bp, Artificial sequence
  SiRNA target sequence
gaaagttcagaaaaataatcc

SEQ ID NO: 7535 - DNA, 21 bp, Artificial sequence
  SiRNA target sequence
aaagttcagaaaaataatcct

SEQ ID NO: 7536 - DNA, 21 bp, Artificial sequence
  SiRNA target sequence
aagttcagaaaaataatcctt

SEQ ID NO: 7537 - DNA, 21 bp, Artificial sequence
  SiRNA target sequence
agttcagaaaaataatccttc

SEQ ID NO: 7538 - DNA, 21 bp, Artificial sequence
  SiRNA target sequence
gttcagaaaaataatccttct

SEQ ID NO: 7539 - DNA, 21 bp, Artificial sequence
  SiRNA target sequence
ttcagaaaaataatccttctg

SEQ ID NO: 7540 - DNA, 21 bp, Artificial sequence
  SiRNA target sequence
tcagaaaaataatccttctgg

SEQ ID NO: 7541 - DNA, 21 bp, Artificial sequence
  SiRNA target sequence
cagaaaaataatccttctggg

SEQ ID NO: 7542 - DNA, 21 bp, Artificial sequence
  SiRNA target sequence
agaaaaataatccttctgggt

SEQ ID NO: 7543 - DNA, 21 bp, Artificial sequence
  SiRNA target sequence
gaaaaataatccttctgggta

SEQ ID NO: 7544 - DNA, 21 bp, Artificial sequence
  SiRNA target sequence
aaaaataatccttctgggtat

SEQ ID NO: 7545 - DNA, 21 bp, Artificial sequence
  SiRNA target sequence
aaaataatccttctgggtata

SEQ ID NO: 7546 - DNA, 21 bp, Artificial sequence
  SiRNA target sequence
aaataatccttctgggtataa

SEQ ID NO: 7547 - DNA, 21 bp, Artificial sequence
  SiRNA target sequence
aataatccttctgggtataaa

SEQ ID NO: 7548 - DNA, 21 bp, Artificial sequence
  SiRNA target sequence
ataatccttctgggtataaat

SEQ ID NO: 7549 - DNA, 21 bp, Artificial sequence
  SiRNA target sequence
taatccttctgggtataaata

SEQ ID NO: 7550 - DNA, 21 bp, Artificial sequence
  SiRNA target sequence
aatccttctgggtataaatat

SEQ ID NO: 7551 - DNA, 21 bp, Artificial sequence
  SiRNA target sequence
atccttctgggtataaatata

SEQ ID NO: 7552 - DNA, 21 bp, Artificial sequence
  SiRNA target sequence
tccttctgggtataaatatat

SEQ ID NO: 7553 - DNA, 21 bp, Artificial sequence
  SiRNA target sequence
ccttctgggtataaatatatt

SEQ ID NO: 7554 - DNA, 21 bp, Artificial sequence
  SiRNA target sequence
cttctgggtataaatatatta

SEQ ID NO: 7555 - DNA, 21 bp, Artificial sequence
  SiRNA target sequence
ttctgggtataaatatattat

SEQ ID NO: 7556 - DNA, 21 bp, Artificial sequence
  SiRNA target sequence
tctgggtataaatatattatg

SEQ ID NO: 7557 - DNA, 21 bp, Artificial sequence
  SiRNA target sequence
ctgggtataaatatattatgc

SEQ ID NO: 7558 - DNA, 21 bp, Artificial sequence
  SiRNA target sequence
tgggtataaatatattatgca

SEQ ID NO: 7559 - DNA, 21 bp, Artificial sequence
  SiRNA target sequence
gggtataaatatattatgcat

SEQ ID NO: 7560 - DNA, 21 bp, Artificial sequence
  SiRNA target sequence
ggtataaatatattatgcatg

SEQ ID NO: 7561 - DNA, 21 bp, Artificial sequence
  SiRNA target sequence
gtataaatatattatgcatgt

SEQ ID NO: 7562 - DNA, 21 bp, Artificial sequence
  SiRNA target sequence
tataaatatattatgcatgtc

SEQ ID NO: 7563 - DNA, 21 bp, Artificial sequence
  SiRNA target sequence
ataaatatattatgcatgtct

SEQ ID NO: 7564 - DNA, 21 bp, Artificial sequence
  SiRNA target sequence
taaatatattatgcatgtctt

SEQ ID NO: 7565 - DNA, 21 bp, Artificial sequence
  SiRNA target sequence
aaatatattatgcatgtcttg

SEQ ID NO: 7566 - DNA, 21 bp, Artificial sequence
  SiRNA target sequence
aatatattatgcatgtcttga

SEQ ID NO: 7567 - DNA, 21 bp, Artificial sequence
  SiRNA target sequence
atatattatgcatgtcttgac

SEQ ID NO: 7568 - DNA, 21 bp, Artificial sequence
  SiRNA target sequence
tatattatgcatgtcttgact

SEQ ID NO: 7569 - DNA, 21 bp, Artificial sequence
  SiRNA target sequence
atattatgcatgtcttgactg

SEQ ID NO: 7570 - DNA, 21 bp, Artificial sequence
  SiRNA target sequence
tattatgcatgtcttgactgg

SEQ ID NO: 7571 - DNA, 21 bp, Artificial sequence
  SiRNA target sequence
attatgcatgtcttgactggc

SEQ ID NO: 7572 - DNA, 21 bp, Artificial sequence
  SiRNA target sequence
ttatgcatgtcttgactggct

SEQ ID NO: 7573 - DNA, 21 bp, Artificial sequence
  SiRNA target sequence
tatgcatgtcttgactggcta

SEQ ID NO: 7574 - DNA, 21 bp, Artificial sequence
  SiRNA target sequence
atgcatgtcttgactggctat

SEQ ID NO: 7575 - DNA, 21 bp, Artificial sequence
  SiRNA target sequence
tgcatgtcttgactggctatg

SEQ ID NO: 7576 - DNA, 21 bp, Artificial sequence
  SiRNA target sequence
gcatgtcttgactggctatga

SEQ ID NO: 7577 - DNA, 21 bp, Artificial sequence
  SiRNA target sequence
catgtcttgactggctatgaa

SEQ ID NO: 7578 - DNA, 21 bp, Artificial sequence
  SiRNA target sequence
atgtcttgactggctatgaac

SEQ ID NO: 7579 - DNA, 21 bp, Artificial sequence
  SiRNA target sequence
tgtcttgactggctatgaacc

SEQ ID NO: 7580 - DNA, 21 bp, Artificial sequence
  SiRNA target sequence
gtcttgactggctatgaacct

SEQ ID NO: 7581 - DNA, 21 bp, Artificial sequence
  SiRNA target sequence
tcttgactggctatgaacctg

SEQ ID NO: 7582 - DNA, 21 bp, Artificial sequence
  SiRNA target sequence
cttgactggctatgaacctga

SEQ ID NO: 7583 - DNA, 21 bp, Artificial sequence
  SiRNA target sequence
ttgactggctatgaacctgaa

SEQ ID NO: 7584 - DNA, 21 bp, Artificial sequence
  SiRNA target sequence
tgactggctatgaacctgaag

SEQ ID NO: 7585 - DNA, 21 bp, Artificial sequence
  SiRNA target sequence
gactggctatgaacctgaagt

SEQ ID NO: 7586 - DNA, 21 bp, Artificial sequence
  SiRNA target sequence
actggctatgaacctgaagta

SEQ ID NO: 7587 - DNA, 21 bp, Artificial sequence
  SiRNA target sequence
ctggctatgaacctgaagtaa

SEQ ID NO: 7588 - DNA, 21 bp, Artificial sequence
  SiRNA target sequence
tggctatgaacctgaagtaaa

SEQ ID NO: 7589 - DNA, 21 bp, Artificial sequence
  SiRNA target sequence
ggctatgaacctgaagtaaag

SEQ ID NO: 7590 - DNA, 21 bp, Artificial sequence
  SiRNA target sequence
gctatgaacctgaagtaaaga

SEQ ID NO: 7591 - DNA, 21 bp, Artificial sequence
  SiRNA target sequence
ctatgaacctgaagtaaagaa

SEQ ID NO: 7592 - DNA, 21 bp, Artificial sequence
  SiRNA target sequence
tatgaacctgaagtaaagaat

SEQ ID NO: 7593 - DNA, 21 bp, Artificial sequence
  SiRNA target sequence
atgaacctgaagtaaagaatg

SEQ ID NO: 7594 - DNA, 21 bp, Artificial sequence
  SiRNA target sequence
tgaacctgaagtaaagaatgt

SEQ ID NO: 7595 - DNA, 21 bp, Artificial sequence
  SiRNA target sequence
gaacctgaagtaaagaatgta

SEQ ID NO: 7596 - DNA, 21 bp, Artificial sequence
  SiRNA target sequence
aacctgaagtaaagaatgtaa

SEQ ID NO: 7597 - DNA, 21 bp, Artificial sequence
  SiRNA target sequence
acctgaagtaaagaatgtaac

SEQ ID NO: 7598 - DNA, 21 bp, Artificial sequence
  SiRNA target sequence
cctgaagtaaagaatgtaaca

SEQ ID NO: 7599 - DNA, 21 bp, Artificial sequence
  SiRNA target sequence
ctgaagtaaagaatgtaacaa

SEQ ID NO: 7600 - DNA, 21 bp, Artificial sequence
  SiRNA target sequence
tgaagtaaagaatgtaacaat

SEQ ID NO: 7601 - DNA, 21 bp, Artificial sequence
  SiRNA target sequence
gaagtaaagaatgtaacaatg

SEQ ID NO: 7602 - DNA, 21 bp, Artificial sequence
  SiRNA target sequence
aagtaaagaatgtaacaatgc

SEQ ID NO: 7603 - DNA, 21 bp, Artificial sequence
  SiRNA target sequence
agtaaagaatgtaacaatgca

SEQ ID NO: 7604 - DNA, 21 bp, Artificial sequence
  SiRNA target sequence
gtaaagaatgtaacaatgcaa

SEQ ID NO: 7605 - DNA, 21 bp, Artificial sequence
  SiRNA target sequence
taaagaatgtaacaatgcaag

SEQ ID NO: 7606 - DNA, 21 bp, Artificial sequence
  SiRNA target sequence
aaagaatgtaacaatgcaagt

SEQ ID NO: 7607 - DNA, 21 bp, Artificial sequence
  SiRNA target sequence
aagaatgtaacaatgcaagtg

SEQ ID NO: 7608 - DNA, 21 bp, Artificial sequence
  SiRNA target sequence
agaatgtaacaatgcaagtga

SEQ ID NO: 7609 - DNA, 21 bp, Artificial sequence
  SiRNA target sequence
gaatgtaacaatgcaagtgaa

SEQ ID NO: 7610 - DNA, 21 bp, Artificial sequence
  SiRNA target sequence
aatgtaacaatgcaagtgaac

SEQ ID NO: 7611 - DNA, 21 bp, Artificial sequence
  SiRNA target sequence
atgtaacaatgcaagtgaacg

SEQ ID NO: 7612 - DNA, 21 bp, Artificial sequence
  SiRNA target sequence
tgtaacaatgcaagtgaacgc

SEQ ID NO: 7613 - DNA, 21 bp, Artificial sequence
  SiRNA target sequence
gtaacaatgcaagtgaacgct

SEQ ID NO: 7614 - DNA, 21 bp, Artificial sequence
  SiRNA target sequence
taacaatgcaagtgaacgctc

SEQ ID NO: 7615 - DNA, 21 bp, Artificial sequence
  SiRNA target sequence
aacaatgcaagtgaacgctcc

SEQ ID NO: 7616 - DNA, 21 bp, Artificial sequence
  SiRNA target sequence
acaatgcaagtgaacgctcca

SEQ ID NO: 7617 - DNA, 21 bp, Artificial sequence
  SiRNA target sequence
caatgcaagtgaacgctccaa

SEQ ID NO: 7618 - DNA, 21 bp, Artificial sequence
  SiRNA target sequence
aatgcaagtgaacgctccaaa

SEQ ID NO: 7619 - DNA, 21 bp, Artificial sequence
  SiRNA target sequence
atgcaagtgaacgctccaaaa

SEQ ID NO: 7620 - DNA, 21 bp, Artificial sequence
  SiRNA target sequence
tgcaagtgaacgctccaaaaa

SEQ ID NO: 7621 - DNA, 21 bp, Artificial sequence
  SiRNA target sequence
gcaagtgaacgctccaaaaac

SEQ ID NO: 7622 - DNA, 21 bp, Artificial sequence
  SiRNA target sequence
caagtgaacgctccaaaaacg

SEQ ID NO: 7623 - DNA, 21 bp, Artificial sequence
  SiRNA target sequence
aagtgaacgctccaaaaacga

SEQ ID NO: 7624 - DNA, 21 bp, Artificial sequence
  SiRNA target sequence
agtgaacgctccaaaaacgaa

SEQ ID NO: 7625 - DNA, 21 bp, Artificial sequence
  SiRNA target sequence
gtgaacgctccaaaaacgaaa

SEQ ID NO: 7626 - DNA, 21 bp, Artificial sequence
  SiRNA target sequence
tgaacgctccaaaaacgaaaa

SEQ ID NO: 7627 - DNA, 21 bp, Artificial sequence
  SiRNA target sequence
gaacgctccaaaaacgaaaac

SEQ ID NO: 7628 - DNA, 21 bp, Artificial sequence
  SiRNA target sequence
aacgctccaaaaacgaaaaca

SEQ ID NO: 7629 - DNA, 21 bp, Artificial sequence
  SiRNA target sequence
acgctccaaaaacgaaaacaa

SEQ ID NO: 7630 - DNA, 21 bp, Artificial sequence
  SiRNA target sequence
cgctccaaaaacgaaaacaag

SEQ ID NO: 7631 - DNA, 21 bp, Artificial sequence
  SiRNA target sequence
gctccaaaaacgaaaacaagt

SEQ ID NO: 7632 - DNA, 21 bp, Artificial sequence
  SiRNA target sequence
ctccaaaaacgaaaacaagtc

SEQ ID NO: 7633 - DNA, 21 bp, Artificial sequence
  SiRNA target sequence
tccaaaaacgaaaacaagtca

SEQ ID NO: 7634 - DNA, 21 bp, Artificial sequence
  SiRNA target sequence
ccaaaaacgaaaacaagtcaa

SEQ ID NO: 7635 - DNA, 21 bp, Artificial sequence
  SiRNA target sequence
caaaaacgaaaacaagtcaaa

SEQ ID NO: 7636 - DNA, 21 bp, Artificial sequence
  SiRNA target sequence
aaaaacgaaaacaagtcaaaa

SEQ ID NO: 7637 - DNA, 21 bp, Artificial sequence
  SiRNA target sequence
aaaacgaaaacaagtcaaaaa

SEQ ID NO: 7638 - DNA, 21 bp, Artificial sequence
  SiRNA target sequence
aaacgaaaacaagtcaaaaat

SEQ ID NO: 7639 - DNA, 21 bp, Artificial sequence
  SiRNA target sequence
aacgaaaacaagtcaaaaatc

SEQ ID NO: 7640 - DNA, 21 bp, Artificial sequence
  SiRNA target sequence
acgaaaacaagtcaaaaatct

SEQ ID NO: 7641 - DNA, 21 bp, Artificial sequence
  SiRNA target sequence
cgaaaacaagtcaaaaatcta

SEQ ID NO: 7642 - DNA, 21 bp, Artificial sequence
  SiRNA target sequence
gaaaacaagtcaaaaatctac

SEQ ID NO: 7643 - DNA, 21 bp, Artificial sequence
  SiRNA target sequence
aaaacaagtcaaaaatctacc

SEQ ID NO: 7644 - DNA, 21 bp, Artificial sequence
  SiRNA target sequence
aaacaagtcaaaaatctacct

SEQ ID NO: 7645 - DNA, 21 bp, Artificial sequence
  SiRNA target sequence
aacaagtcaaaaatctacctc

SEQ ID NO: 7646 - DNA, 21 bp, Artificial sequence
  SiRNA target sequence
acaagtcaaaaatctacctca

SEQ ID NO: 7647 - DNA, 21 bp, Artificial sequence
  SiRNA target sequence
caagtcaaaaatctacctcag

SEQ ID NO: 7648 - DNA, 21 bp, Artificial sequence
  SiRNA target sequence
aagtcaaaaatctacctcaga

SEQ ID NO: 7649 - DNA, 21 bp, Artificial sequence
  SiRNA target sequence
agtcaaaaatctacctcagaa

SEQ ID NO: 7650 - DNA, 21 bp, Artificial sequence
  SiRNA target sequence
gtcaaaaatctacctcagaaa

SEQ ID NO: 7651 - DNA, 21 bp, Artificial sequence
  SiRNA target sequence
tcaaaaatctacctcagaaaa

SEQ ID NO: 7652 - DNA, 21 bp, Artificial sequence
  SiRNA target sequence
caaaaatctacctcagaaaat

SEQ ID NO: 7653 - DNA, 21 bp, Artificial sequence
  SiRNA target sequence
aaaaatctacctcagaaaatc

SEQ ID NO: 7654 - DNA, 21 bp, Artificial sequence
  SiRNA target sequence
aaaatctacctcagaaaatcc

SEQ ID NO: 7655 - DNA, 21 bp, Artificial sequence
  SiRNA target sequence
aaatctacctcagaaaatccc

SEQ ID NO: 7656 - DNA, 21 bp, Artificial sequence
  SiRNA target sequence
aatctacctcagaaaatccca

SEQ ID NO: 7657 - DNA, 21 bp, Artificial sequence
  SiRNA target sequence
atctacctcagaaaatcccaa

SEQ ID NO: 7658 - DNA, 21 bp, Artificial sequence
  SiRNA target sequence
tctacctcagaaaatcccaaa

SEQ ID NO: 7659 - DNA, 21 bp, Artificial sequence
  SiRNA target sequence
ctacctcagaaaatcccaaag

SEQ ID NO: 7660 - DNA, 21 bp, Artificial sequence
  SiRNA target sequence
tacctcagaaaatcccaaagt

SEQ ID NO: 7661 - DNA, 21 bp, Artificial sequence
  SiRNA target sequence
acctcagaaaatcccaaagtt

SEQ ID NO: 7662 - DNA, 21 bp, Artificial sequence
  SiRNA target sequence
cctcagaaaatcccaaagttg

SEQ ID NO: 7663 - DNA, 21 bp, Artificial sequence
  SiRNA target sequence
ctcagaaaatcccaaagttgg

SEQ ID NO: 7664 - DNA, 21 bp, Artificial sequence
  SiRNA target sequence
tcagaaaatcccaaagttgga

SEQ ID NO: 7665 - DNA, 21 bp, Artificial sequence
  SiRNA target sequence
cagaaaatcccaaagttggac

SEQ ID NO: 7666 - DNA, 21 bp, Artificial sequence
  SiRNA target sequence
agaaaatcccaaagttggacc

SEQ ID NO: 7667 - DNA, 21 bp, Artificial sequence
  SiRNA target sequence
gaaaatcccaaagttggacca

SEQ ID NO: 7668 - DNA, 21 bp, Artificial sequence
  SiRNA target sequence
aaaatcccaaagttggaccaa

SEQ ID NO: 7669 - DNA, 21 bp, Artificial sequence
  SiRNA target sequence
aaatcccaaagttggaccaat

SEQ ID NO: 7670 - DNA, 21 bp, Artificial sequence
  SiRNA target sequence
aatcccaaagttggaccaata

SEQ ID NO: 7671 - DNA, 21 bp, Artificial sequence
  SiRNA target sequence
atcccaaagttggaccaatat

SEQ ID NO: 7672 - DNA, 21 bp, Artificial sequence
  SiRNA target sequence
tcccaaagttggaccaatatc

SEQ ID NO: 7673 - DNA, 21 bp, Artificial sequence
  SiRNA target sequence
cccaaagttggaccaatatct

SEQ ID NO: 7674 - DNA, 21 bp, Artificial sequence
  SiRNA target sequence
ccaaagttggaccaatatctg

SEQ ID NO: 7675 - DNA, 21 bp, Artificial sequence
  SiRNA target sequence
caaagttggaccaatatctga

SEQ ID NO: 7676 - DNA, 21 bp, Artificial sequence
  SiRNA target sequence
aaagttggaccaatatctgaa

SEQ ID NO: 7677 - DNA, 21 bp, Artificial sequence
  SiRNA target sequence
aagttggaccaatatctgaag

SEQ ID NO: 7678 - DNA, 21 bp, Artificial sequence
  SiRNA target sequence
agttggaccaatatctgaagt

SEQ ID NO: 7679 - DNA, 21 bp, Artificial sequence
  SiRNA target sequence
gttggaccaatatctgaagtg

SEQ ID NO: 7680 - DNA, 21 bp, Artificial sequence
  SiRNA target sequence
ttggaccaatatctgaagtgg

SEQ ID NO: 7681 - DNA, 21 bp, Artificial sequence
  SiRNA target sequence
tggaccaatatctgaagtggc

SEQ ID NO: 7682 - DNA, 21 bp, Artificial sequence
  SiRNA target sequence
ggaccaatatctgaagtggct

SEQ ID NO: 7683 - DNA, 21 bp, Artificial sequence
  SiRNA target sequence
gaccaatatctgaagtggctt

SEQ ID NO: 7684 - DNA, 21 bp, Artificial sequence
  SiRNA target sequence
accaatatctgaagtggcttc

SEQ ID NO: 7685 - DNA, 21 bp, Artificial sequence
  SiRNA target sequence
ccaatatctgaagtggcttct

SEQ ID NO: 7686 - DNA, 21 bp, Artificial sequence
  SiRNA target sequence
caatatctgaagtggcttctg

SEQ ID NO: 7687 - DNA, 21 bp, Artificial sequence
  SiRNA target sequence
aatatctgaagtggcttctgg

SEQ ID NO: 7688 - DNA, 21 bp, Artificial sequence
  SiRNA target sequence
atatctgaagtggcttctgga

SEQ ID NO: 7689 - DNA, 21 bp, Artificial sequence
  SiRNA target sequence
tatctgaagtggcttctggag

SEQ ID NO: 7690 - DNA, 21 bp, Artificial sequence
  SiRNA target sequence
atctgaagtggcttctggagt

SEQ ID NO: 7691 - DNA, 21 bp, Artificial sequence
  SiRNA target sequence
tctgaagtggcttctggagtg

SEQ ID NO: 7692 - DNA, 21 bp, Artificial sequence
  SiRNA target sequence
ctgaagtggcttctggagtga

SEQ ID NO: 7693 - DNA, 21 bp, Artificial sequence
  SiRNA target sequence
tgaagtggcttctggagtgaa

SEQ ID NO: 7694 - DNA, 21 bp, Artificial sequence
  SiRNA target sequence
gaagtggcttctggagtgaag

SEQ ID NO: 7695 - DNA, 21 bp, Artificial sequence
  SiRNA target sequence
aagtggcttctggagtgaaga

SEQ ID NO: 7696 - DNA, 21 bp, Artificial sequence
  SiRNA target sequence
agtggcttctggagtgaagac

SEQ ID NO: 7697 - DNA, 21 bp, Artificial sequence
  SiRNA target sequence
gtggcttctggagtgaagaca

SEQ ID NO: 7698 - DNA, 21 bp, Artificial sequence
  SiRNA target sequence
tggcttctggagtgaagacaa

SEQ ID NO: 7699 - DNA, 21 bp, Artificial sequence
  SiRNA target sequence
ggcttctggagtgaagacaac

SEQ ID NO: 7700 - DNA, 21 bp, Artificial sequence
  SiRNA target sequence
gcttctggagtgaagacaaca

SEQ ID NO: 7701 - DNA, 21 bp, Artificial sequence
  SiRNA target sequence
cttctggagtgaagacaacag

SEQ ID NO: 7702 - DNA, 21 bp, Artificial sequence
  SiRNA target sequence
ttctggagtgaagacaacagc

SEQ ID NO: 7703 - DNA, 21 bp, Artificial sequence
  SiRNA target sequence
tctggagtgaagacaacagct

SEQ ID NO: 7704 - DNA, 21 bp, Artificial sequence
  SiRNA target sequence
ctggagtgaagacaacagcta

SEQ ID NO: 7705 - DNA, 21 bp, Artificial sequence
  SiRNA target sequence
tggagtgaagacaacagctaa

SEQ ID NO: 7706 - DNA, 21 bp, Artificial sequence
  SiRNA target sequence
ggagtgaagacaacagctaat

SEQ ID NO: 7707 - DNA, 21 bp, Artificial sequence
  SiRNA target sequence
gagtgaagacaacagctaatg

SEQ ID NO: 7708 - DNA, 21 bp, Artificial sequence
  SiRNA target sequence
agtgaagacaacagctaatgg

SEQ ID NO: 7709 - DNA, 21 bp, Artificial sequence
  SiRNA target sequence
gtgaagacaacagctaatgga

SEQ ID NO: 7710 - DNA, 21 bp, Artificial sequence
  SiRNA target sequence
tgaagacaacagctaatggaa

SEQ ID NO: 7711 - DNA, 21 bp, Artificial sequence
  SiRNA target sequence
gaagacaacagctaatggaat

SEQ ID NO: 7712 - DNA, 21 bp, Artificial sequence
  SiRNA target sequence
aagacaacagctaatggaatt

SEQ ID NO: 7713 - DNA, 21 bp, Artificial sequence
  SiRNA target sequence
agacaacagctaatggaattg

SEQ ID NO: 7714 - DNA, 21 bp, Artificial sequence
  SiRNA target sequence
gacaacagctaatggaattga

SEQ ID NO: 7715 - DNA, 21 bp, Artificial sequence
  SiRNA target sequence
acaacagctaatggaattgag

SEQ ID NO: 7716 - DNA, 21 bp, Artificial sequence
  SiRNA target sequence
caacagctaatggaattgagc

SEQ ID NO: 7717 - DNA, 21 bp, Artificial sequence
  SiRNA target sequence
aacagctaatggaattgagcg

SEQ ID NO: 7718 - DNA, 21 bp, Artificial sequence
  SiRNA target sequence
acagctaatggaattgagcgt

SEQ ID NO: 7719 - DNA, 21 bp, Artificial sequence
  SiRNA target sequence
cagctaatggaattgagcgta

SEQ ID NO: 7720 - DNA, 21 bp, Artificial sequence
  SiRNA target sequence
agctaatggaattgagcgtat

SEQ ID NO: 7721 - DNA, 21 bp, Artificial sequence
  SiRNA target sequence
gctaatggaattgagcgtatc

SEQ ID NO: 7722 - DNA, 21 bp, Artificial sequence
  SiRNA target sequence
ctaatggaattgagcgtatcc

SEQ ID NO: 7723 - DNA, 21 bp, Artificial sequence
  SiRNA target sequence
taatggaattgagcgtatccc

SEQ ID NO: 7724 - DNA, 21 bp, Artificial sequence
  SiRNA target sequence
aatggaattgagcgtatccct

SEQ ID NO: 7725 - DNA, 21 bp, Artificial sequence
  SiRNA target sequence
atggaattgagcgtatccctg

SEQ ID NO: 7726 - DNA, 21 bp, Artificial sequence
  SiRNA target sequence
tggaattgagcgtatccctgt

SEQ ID NO: 7727 - DNA, 21 bp, Artificial sequence
  SiRNA target sequence
ggaattgagcgtatccctgtg

SEQ ID NO: 7728 - DNA, 21 bp, Artificial sequence
  SiRNA target sequence
gaattgagcgtatccctgtga

SEQ ID NO: 7729 - DNA, 21 bp, Artificial sequence
  SiRNA target sequence
aattgagcgtatccctgtgat

SEQ ID NO: 7730 - DNA, 21 bp, Artificial sequence
  SiRNA target sequence
attgagcgtatccctgtgata

SEQ ID NO: 7731 - DNA, 21 bp, Artificial sequence
  SiRNA target sequence
ttgagcgtatccctgtgatag

SEQ ID NO: 7732 - DNA, 21 bp, Artificial sequence
  SiRNA target sequence
tgagcgtatccctgtgatagg

SEQ ID NO: 7733 - DNA, 21 bp, Artificial sequence
  SiRNA target sequence
gagcgtatccctgtgataggt

SEQ ID NO: 7734 - DNA, 21 bp, Artificial sequence
  SiRNA target sequence
agcgtatccctgtgataggtg

SEQ ID NO: 7735 - DNA, 21 bp, Artificial sequence
  SiRNA target sequence
gcgtatccctgtgataggtga

SEQ ID NO: 7736 - DNA, 21 bp, Artificial sequence
  SiRNA target sequence
cgtatccctgtgataggtgaa

SEQ ID NO: 7737 - DNA, 21 bp, Artificial sequence
  SiRNA target sequence
gtatccctgtgataggtgaaa

SEQ ID NO: 7738 - DNA, 21 bp, Artificial sequence
  SiRNA target sequence
tatccctgtgataggtgaaat

SEQ ID NO: 7739 - DNA, 21 bp, Artificial sequence
  SiRNA target sequence
atccctgtgataggtgaaatt

SEQ ID NO: 7740 - DNA, 21 bp, Artificial sequence
  SiRNA target sequence
tccctgtgataggtgaaattg

SEQ ID NO: 7741 - DNA, 21 bp, Artificial sequence
  SiRNA target sequence
ccctgtgataggtgaaattgc

SEQ ID NO: 7742 - DNA, 21 bp, Artificial sequence
  SiRNA target sequence
cctgtgataggtgaaattgca

SEQ ID NO: 7743 - DNA, 21 bp, Artificial sequence
  SiRNA target sequence
ctgtgataggtgaaattgcaa

SEQ ID NO: 7744 - DNA, 21 bp, Artificial sequence
  SiRNA target sequence
tgtgataggtgaaattgcaaa

SEQ ID NO: 7745 - DNA, 21 bp, Artificial sequence
  SiRNA target sequence
gtgataggtgaaattgcaaag

SEQ ID NO: 7746 - DNA, 21 bp, Artificial sequence
  SiRNA target sequence
tgataggtgaaattgcaaagc

SEQ ID NO: 7747 - DNA, 21 bp, Artificial sequence
  SiRNA target sequence
gataggtgaaattgcaaagcc

SEQ ID NO: 7748 - DNA, 21 bp, Artificial sequence
  SiRNA target sequence
ataggtgaaattgcaaagcct

SEQ ID NO: 7749 - DNA, 21 bp, Artificial sequence
  SiRNA target sequence
taggtgaaattgcaaagcctg

SEQ ID NO: 7750 - DNA, 21 bp, Artificial sequence
  SiRNA target sequence
aggtgaaattgcaaagcctgt

SEQ ID NO: 7751 - DNA, 21 bp, Artificial sequence
  SiRNA target sequence
ggtgaaattgcaaagcctgta

SEQ ID NO: 7752 - DNA, 21 bp, Artificial sequence
  SiRNA target sequence
gtgaaattgcaaagcctgtaa

SEQ ID NO: 7753 - DNA, 21 bp, Artificial sequence
  SiRNA target sequence
tgaaattgcaaagcctgtaac

SEQ ID NO: 7754 - DNA, 21 bp, Artificial sequence
  SiRNA target sequence
gaaattgcaaagcctgtaaca

SEQ ID NO: 7755 - DNA, 21 bp, Artificial sequence
  SiRNA target sequence
aaattgcaaagcctgtaacaa

SEQ ID NO: 7756 - DNA, 21 bp, Artificial sequence
  SiRNA target sequence
aattgcaaagcctgtaacaac

SEQ ID NO: 7757 - DNA, 21 bp, Artificial sequence
  SiRNA target sequence
attgcaaagcctgtaacaact

SEQ ID NO: 7758 - DNA, 21 bp, Artificial sequence
  SiRNA target sequence
ttgcaaagcctgtaacaactg

SEQ ID NO: 7759 - DNA, 21 bp, Artificial sequence
  SiRNA target sequence
tgcaaagcctgtaacaactgc

SEQ ID NO: 7760 - DNA, 21 bp, Artificial sequence
  SiRNA target sequence
gcaaagcctgtaacaactgct

SEQ ID NO: 7761 - DNA, 21 bp, Artificial sequence
  SiRNA target sequence
caaagcctgtaacaactgctg

SEQ ID NO: 7762 - DNA, 21 bp, Artificial sequence
  SiRNA target sequence
aaagcctgtaacaactgctgt

SEQ ID NO: 7763 - DNA, 21 bp, Artificial sequence
  SiRNA target sequence
aagcctgtaacaactgctgta

SEQ ID NO: 7764 - DNA, 21 bp, Artificial sequence
  SiRNA target sequence
agcctgtaacaactgctgtaa

SEQ ID NO: 7765 - DNA, 21 bp, Artificial sequence
  SiRNA target sequence
gcctgtaacaactgctgtaaa

SEQ ID NO: 7766 - DNA, 21 bp, Artificial sequence
  SiRNA target sequence
cctgtaacaactgctgtaaag

SEQ ID NO: 7767 - DNA, 21 bp, Artificial sequence
  SiRNA target sequence
ctgtaacaactgctgtaaagt

SEQ ID NO: 7768 - DNA, 21 bp, Artificial sequence
  SiRNA target sequence
tgtaacaactgctgtaaagtg

SEQ ID NO: 7769 - DNA, 21 bp, Artificial sequence
  SiRNA target sequence
gtaacaactgctgtaaagtgg

SEQ ID NO: 7770 - DNA, 21 bp, Artificial sequence
  SiRNA target sequence
taacaactgctgtaaagtggt

SEQ ID NO: 7771 - DNA, 21 bp, Artificial sequence
  SiRNA target sequence
aacaactgctgtaaagtggtt

SEQ ID NO: 7772 - DNA, 21 bp, Artificial sequence
  SiRNA target sequence
acaactgctgtaaagtggttt

SEQ ID NO: 7773 - DNA, 21 bp, Artificial sequence
  SiRNA target sequence
caactgctgtaaagtggtttg

SEQ ID NO: 7774 - DNA, 21 bp, Artificial sequence
  SiRNA target sequence
aactgctgtaaagtggtttgc

SEQ ID NO: 7775 - DNA, 21 bp, Artificial sequence
  SiRNA target sequence
actgctgtaaagtggtttgca

SEQ ID NO: 7776 - DNA, 21 bp, Artificial sequence
  SiRNA target sequence
ctgctgtaaagtggtttgcag

SEQ ID NO: 7777 - DNA, 21 bp, Artificial sequence
  SiRNA target sequence
tgctgtaaagtggtttgcaga

SEQ ID NO: 7778 - DNA, 21 bp, Artificial sequence
  SiRNA target sequence
gctgtaaagtggtttgcagat

SEQ ID NO: 7779 - DNA, 21 bp, Artificial sequence
  SiRNA target sequence
ctgtaaagtggtttgcagatg

SEQ ID NO: 7780 - DNA, 21 bp, Artificial sequence
  SiRNA target sequence
tgtaaagtggtttgcagatgt

SEQ ID NO: 7781 - DNA, 21 bp, Artificial sequence
  SiRNA target sequence
gtaaagtggtttgcagatgtt

SEQ ID NO: 7782 - DNA, 21 bp, Artificial sequence
  SiRNA target sequence
taaagtggtttgcagatgttg

SEQ ID NO: 7783 - DNA, 21 bp, Artificial sequence
  SiRNA target sequence
aaagtggtttgcagatgttgt

SEQ ID NO: 7784 - DNA, 21 bp, Artificial sequence
  SiRNA target sequence
aagtggtttgcagatgttgtc

SEQ ID NO: 7785 - DNA, 21 bp, Artificial sequence
  SiRNA target sequence
agtggtttgcagatgttgtcg

SEQ ID NO: 7786 - DNA, 21 bp, Artificial sequence
  SiRNA target sequence
gtggtttgcagatgttgtcgg

SEQ ID NO: 7787 - DNA, 21 bp, Artificial sequence
  SiRNA target sequence
tggtttgcagatgttgtcgga

SEQ ID NO: 7788 - DNA, 21 bp, Artificial sequence
  SiRNA target sequence
ggtttgcagatgttgtcggaa

SEQ ID NO: 7789 - DNA, 21 bp, Artificial sequence
  SiRNA target sequence
gtttgcagatgttgtcggaac

SEQ ID NO: 7790 - DNA, 21 bp, Artificial sequence
  SiRNA target sequence
tttgcagatgttgtcggaact

SEQ ID NO: 7791 - DNA, 21 bp, Artificial sequence
  SiRNA target sequence
ttgcagatgttgtcggaactg

SEQ ID NO: 7792 - DNA, 21 bp, Artificial sequence
  SiRNA target sequence
tgcagatgttgtcggaactgt

SEQ ID NO: 7793 - DNA, 21 bp, Artificial sequence
  SiRNA target sequence
gcagatgttgtcggaactgtg

SEQ ID NO: 7794 - DNA, 21 bp, Artificial sequence
  SiRNA target sequence
cagatgttgtcggaactgtgg

SEQ ID NO: 7795 - DNA, 21 bp, Artificial sequence
  SiRNA target sequence
agatgttgtcggaactgtggc

SEQ ID NO: 7796 - DNA, 21 bp, Artificial sequence
  SiRNA target sequence
gatgttgtcggaactgtggca

SEQ ID NO: 7797 - DNA, 21 bp, Artificial sequence
  SiRNA target sequence
atgttgtcggaactgtggcag

SEQ ID NO: 7798 - DNA, 21 bp, Artificial sequence
  SiRNA target sequence
tgttgtcggaactgtggcagc

SEQ ID NO: 7799 - DNA, 21 bp, Artificial sequence
  SiRNA target sequence
gttgtcggaactgtggcagct

SEQ ID NO: 7800 - DNA, 21 bp, Artificial sequence
  SiRNA target sequence
ttgtcggaactgtggcagcta

SEQ ID NO: 7801 - DNA, 21 bp, Artificial sequence
  SiRNA target sequence
tgtcggaactgtggcagctat

SEQ ID NO: 7802 - DNA, 21 bp, Artificial sequence
  SiRNA target sequence
gtcggaactgtggcagctatt

SEQ ID NO: 7803 - DNA, 21 bp, Artificial sequence
  SiRNA target sequence
tcggaactgtggcagctattt

SEQ ID NO: 7804 - DNA, 21 bp, Artificial sequence
  SiRNA target sequence
cggaactgtggcagctatttt

SEQ ID NO: 7805 - DNA, 21 bp, Artificial sequence
  SiRNA target sequence
ggaactgtggcagctattttt

SEQ ID NO: 7806 - DNA, 21 bp, Artificial sequence
  SiRNA target sequence
gaactgtggcagctatttttg

SEQ ID NO: 7807 - DNA, 21 bp, Artificial sequence
  SiRNA target sequence
aactgtggcagctatttttgg

SEQ ID NO: 7808 - DNA, 21 bp, Artificial sequence
  SiRNA target sequence
actgtggcagctatttttggc

SEQ ID NO: 7809 - DNA, 21 bp, Artificial sequence
  SiRNA target sequence
ctgtggcagctatttttggct

SEQ ID NO: 7810 - DNA, 21 bp, Artificial sequence
  SiRNA target sequence
tgtggcagctatttttggctg

SEQ ID NO: 7811 - DNA, 21 bp, Artificial sequence
  SiRNA target sequence
gtggcagctatttttggctgg

SEQ ID NO: 7812 - DNA, 21 bp, Artificial sequence
  SiRNA target sequence
tggcagctatttttggctggt

SEQ ID NO: 7813 - DNA, 21 bp, Artificial sequence
  SiRNA target sequence
ggcagctatttttggctggtc

SEQ ID NO: 7814 - DNA, 21 bp, Artificial sequence
  SiRNA target sequence
gcagctatttttggctggtcc

SEQ ID NO: 7815 - DNA, 21 bp, Artificial sequence
  SiRNA target sequence
cagctatttttggctggtcca

SEQ ID NO: 7816 - DNA, 21 bp, Artificial sequence
  SiRNA target sequence
agctatttttggctggtccaa

SEQ ID NO: 7817 - DNA, 21 bp, Artificial sequence
  SiRNA target sequence
gctatttttggctggtccaaa

SEQ ID NO: 7818 - DNA, 21 bp, Artificial sequence
  SiRNA target sequence
ctatttttggctggtccaaac

SEQ ID NO: 7819 - DNA, 21 bp, Artificial sequence
  SiRNA target sequence
tatttttggctggtccaaacc

SEQ ID NO: 7820 - DNA, 21 bp, Artificial sequence
  SiRNA target sequence
atttttggctggtccaaacct

SEQ ID NO: 7821 - DNA, 21 bp, Artificial sequence
  SiRNA target sequence
tttttggctggtccaaacctc

SEQ ID NO: 7822 - DNA, 21 bp, Artificial sequence
  SiRNA target sequence
ttttggctggtccaaacctcg

SEQ ID NO: 7823 - DNA, 21 bp, Artificial sequence
  SiRNA target sequence
tttggctggtccaaacctcga

SEQ ID NO: 7824 - DNA, 21 bp, Artificial sequence
  SiRNA target sequence
ttggctggtccaaacctcgaa

SEQ ID NO: 7825 - DNA, 21 bp, Artificial sequence
  SiRNA target sequence
tggctggtccaaacctcgaaa

SEQ ID NO: 7826 - DNA, 21 bp, Artificial sequence
  SiRNA target sequence
ggctggtccaaacctcgaaat

SEQ ID NO: 7827 - DNA, 21 bp, Artificial sequence
  SiRNA target sequence
gctggtccaaacctcgaaatc

SEQ ID NO: 7828 - DNA, 21 bp, Artificial sequence
  SiRNA target sequence
ctggtccaaacctcgaaatca

SEQ ID NO: 7829 - DNA, 21 bp, Artificial sequence
  SiRNA target sequence
tggtccaaacctcgaaatcaa

SEQ ID NO: 7830 - DNA, 21 bp, Artificial sequence
  SiRNA target sequence
ggtccaaacctcgaaatcaac

SEQ ID NO: 7831 - DNA, 21 bp, Artificial sequence
  SiRNA target sequence
gtccaaacctcgaaatcaaca

SEQ ID NO: 7832 - DNA, 21 bp, Artificial sequence
  SiRNA target sequence
tccaaacctcgaaatcaacaa

SEQ ID NO: 7833 - DNA, 21 bp, Artificial sequence
  SiRNA target sequence
ccaaacctcgaaatcaacaac

SEQ ID NO: 7834 - DNA, 21 bp, Artificial sequence
  SiRNA target sequence
caaacctcgaaatcaacaaca

SEQ ID NO: 7835 - DNA, 21 bp, Artificial sequence
  SiRNA target sequence
aaacctcgaaatcaacaacag

SEQ ID NO: 7836 - DNA, 21 bp, Artificial sequence
  SiRNA target sequence
aacctcgaaatcaacaacagg

SEQ ID NO: 7837 - DNA, 21 bp, Artificial sequence
  SiRNA target sequence
acctcgaaatcaacaacaggt

SEQ ID NO: 7838 - DNA, 21 bp, Artificial sequence
  SiRNA target sequence
cctcgaaatcaacaacaggta

SEQ ID NO: 7839 - DNA, 21 bp, Artificial sequence
  SiRNA target sequence
ctcgaaatcaacaacaggtat

SEQ ID NO: 7840 - DNA, 21 bp, Artificial sequence
  SiRNA target sequence
tcgaaatcaacaacaggtatg

SEQ ID NO: 7841 - DNA, 21 bp, Artificial sequence
  SiRNA target sequence
cgaaatcaacaacaggtatgt

SEQ ID NO: 7842 - DNA, 21 bp, Artificial sequence
  SiRNA target sequence
gaaatcaacaacaggtatgtc

SEQ ID NO: 7843 - DNA, 21 bp, Artificial sequence
  SiRNA target sequence
aaatcaacaacaggtatgtcc

SEQ ID NO: 7844 - DNA, 21 bp, Artificial sequence
  SiRNA target sequence
aatcaacaacaggtatgtcca

SEQ ID NO: 7845 - DNA, 21 bp, Artificial sequence
  SiRNA target sequence
atcaacaacaggtatgtccat

SEQ ID NO: 7846 - DNA, 21 bp, Artificial sequence
  SiRNA target sequence
tcaacaacaggtatgtccatt

SEQ ID NO: 7847 - DNA, 21 bp, Artificial sequence
  SiRNA target sequence
caacaacaggtatgtccattc

SEQ ID NO: 7848 - DNA, 21 bp, Artificial sequence
  SiRNA target sequence
aacaacaggtatgtccattca

SEQ ID NO: 7849 - DNA, 21 bp, Artificial sequence
  SiRNA target sequence
acaacaggtatgtccattcaa

SEQ ID NO: 7850 - DNA, 21 bp, Artificial sequence
  SiRNA target sequence
caacaggtatgtccattcaaa

SEQ ID NO: 7851 - DNA, 21 bp, Artificial sequence
  SiRNA target sequence
aacaggtatgtccattcaaaa

SEQ ID NO: 7852 - DNA, 21 bp, Artificial sequence
  SiRNA target sequence
acaggtatgtccattcaaaat

SEQ ID NO: 7853 - DNA, 21 bp, Artificial sequence
  SiRNA target sequence
caggtatgtccattcaaaatg

SEQ ID NO: 7854 - DNA, 21 bp, Artificial sequence
  SiRNA target sequence
aggtatgtccattcaaaatgt

SEQ ID NO: 7855 - DNA, 21 bp, Artificial sequence
  SiRNA target sequence
ggtatgtccattcaaaatgtg

SEQ ID NO: 7856 - DNA, 21 bp, Artificial sequence
  SiRNA target sequence
gtatgtccattcaaaatgtgc

SEQ ID NO: 7857 - DNA, 21 bp, Artificial sequence
  SiRNA target sequence
tatgtccattcaaaatgtgcc

SEQ ID NO: 7858 - DNA, 21 bp, Artificial sequence
  SiRNA target sequence
atgtccattcaaaatgtgcct

SEQ ID NO: 7859 - DNA, 21 bp, Artificial sequence
  SiRNA target sequence
tgtccattcaaaatgtgcctg

SEQ ID NO: 7860 - DNA, 21 bp, Artificial sequence
  SiRNA target sequence
gtccattcaaaatgtgcctgc

SEQ ID NO: 7861 - DNA, 21 bp, Artificial sequence
  SiRNA target sequence
tccattcaaaatgtgcctgca

SEQ ID NO: 7862 - DNA, 21 bp, Artificial sequence
  SiRNA target sequence
ccattcaaaatgtgcctgcat

SEQ ID NO: 7863 - DNA, 21 bp, Artificial sequence
  SiRNA target sequence
cattcaaaatgtgcctgcatg

SEQ ID NO: 7864 - DNA, 21 bp, Artificial sequence
  SiRNA target sequence
attcaaaatgtgcctgcatgg

SEQ ID NO: 7865 - DNA, 21 bp, Artificial sequence
  SiRNA target sequence
ttcaaaatgtgcctgcatggg

SEQ ID NO: 7866 - DNA, 21 bp, Artificial sequence
  SiRNA target sequence
tcaaaatgtgcctgcatgggg

SEQ ID NO: 7867 - DNA, 21 bp, Artificial sequence
  SiRNA target sequence
caaaatgtgcctgcatgggga

SEQ ID NO: 7868 - DNA, 21 bp, Artificial sequence
  SiRNA target sequence
aaaatgtgcctgcatggggat

SEQ ID NO: 7869 - DNA, 21 bp, Artificial sequence
  SiRNA target sequence
aaatgtgcctgcatggggata

SEQ ID NO: 7870 - DNA, 21 bp, Artificial sequence
  SiRNA target sequence
aatgtgcctgcatggggatat

SEQ ID NO: 7871 - DNA, 21 bp, Artificial sequence
  SiRNA target sequence
atgtgcctgcatggggatatt

SEQ ID NO: 7872 - DNA, 21 bp, Artificial sequence
  SiRNA target sequence
tgtgcctgcatggggatattc

SEQ ID NO: 7873 - DNA, 21 bp, Artificial sequence
  SiRNA target sequence
gtgcctgcatggggatattct

SEQ ID NO: 7874 - DNA, 21 bp, Artificial sequence
  SiRNA target sequence
tgcctgcatggggatattctc

SEQ ID NO: 7875 - DNA, 21 bp, Artificial sequence
  SiRNA target sequence
gcctgcatggggatattctct

SEQ ID NO: 7876 - DNA, 21 bp, Artificial sequence
  SiRNA target sequence
cctgcatggggatattctctc

SEQ ID NO: 7877 - DNA, 21 bp, Artificial sequence
  SiRNA target sequence
ctgcatggggatattctctct

SEQ ID NO: 7878 - DNA, 21 bp, Artificial sequence
  SiRNA target sequence
tgcatggggatattctctcta

SEQ ID NO: 7879 - DNA, 21 bp, Artificial sequence
  SiRNA target sequence
gcatggggatattctctctat

SEQ ID NO: 7880 - DNA, 21 bp, Artificial sequence
  SiRNA target sequence
catggggatattctctctata

SEQ ID NO: 7881 - DNA, 21 bp, Artificial sequence
  SiRNA target sequence
atggggatattctctctataa

SEQ ID NO: 7882 - DNA, 21 bp, Artificial sequence
  SiRNA target sequence
tggggatattctctctataaa

SEQ ID NO: 7883 - DNA, 21 bp, Artificial sequence
  SiRNA target sequence
ggggatattctctctataaag

SEQ ID NO: 7884 - DNA, 21 bp, Artificial sequence
  SiRNA target sequence
gggatattctctctataaagg

SEQ ID NO: 7885 - DNA, 21 bp, Artificial sequence
  SiRNA target sequence
ggatattctctctataaaggc

SEQ ID NO: 7886 - DNA, 21 bp, Artificial sequence
  SiRNA target sequence
gatattctctctataaaggca

SEQ ID NO: 7887 - DNA, 21 bp, Artificial sequence
  SiRNA target sequence
atattctctctataaaggcat

SEQ ID NO: 7888 - DNA, 21 bp, Artificial sequence
  SiRNA target sequence
tattctctctataaaggcata

SEQ ID NO: 7889 - DNA, 21 bp, Artificial sequence
  SiRNA target sequence
attctctctataaaggcatac

SEQ ID NO: 7890 - DNA, 21 bp, Artificial sequence
  SiRNA target sequence
ttctctctataaaggcatacg

SEQ ID NO: 7891 - DNA, 21 bp, Artificial sequence
  SiRNA target sequence
tctctctataaaggcatacga

SEQ ID NO: 7892 - DNA, 21 bp, Artificial sequence
  SiRNA target sequence
ctctctataaaggcatacgat

SEQ ID NO: 7893 - DNA, 21 bp, Artificial sequence
  SiRNA target sequence
tctctataaaggcatacgata

SEQ ID NO: 7894 - DNA, 21 bp, Artificial sequence
  SiRNA target sequence
ctctataaaggcatacgatat

SEQ ID NO: 7895 - DNA, 21 bp, Artificial sequence
  SiRNA target sequence
tctataaaggcatacgatatg

SEQ ID NO: 7896 - DNA, 21 bp, Artificial sequence
  SiRNA target sequence
ctataaaggcatacgatatga

SEQ ID NO: 7897 - DNA, 21 bp, Artificial sequence
  SiRNA target sequence
tataaaggcatacgatatgag

SEQ ID NO: 7898 - DNA, 21 bp, Artificial sequence
  SiRNA target sequence
ataaaggcatacgatatgagc

SEQ ID NO: 7899 - DNA, 21 bp, Artificial sequence
  SiRNA target sequence
taaaggcatacgatatgagcg

SEQ ID NO: 7900 - DNA, 21 bp, Artificial sequence
  SiRNA target sequence
aaaggcatacgatatgagcgt

SEQ ID NO: 7901 - DNA, 21 bp, Artificial sequence
  SiRNA target sequence
aaggcatacgatatgagcgta

SEQ ID NO: 7902 - DNA, 21 bp, Artificial sequence
  SiRNA target sequence
aggcatacgatatgagcgtac

SEQ ID NO: 7903 - DNA, 21 bp, Artificial sequence
  SiRNA target sequence
ggcatacgatatgagcgtacc

SEQ ID NO: 7904 - DNA, 21 bp, Artificial sequence
  SiRNA target sequence
gcatacgatatgagcgtacca

SEQ ID NO: 7905 - DNA, 21 bp, Artificial sequence
  SiRNA target sequence
catacgatatgagcgtaccat

SEQ ID NO: 7906 - DNA, 21 bp, Artificial sequence
  SiRNA target sequence
atacgatatgagcgtaccatt

SEQ ID NO: 7907 - DNA, 21 bp, Artificial sequence
  SiRNA target sequence
tacgatatgagcgtaccattg

SEQ ID NO: 7908 - DNA, 21 bp, Artificial sequence
  SiRNA target sequence
acgatatgagcgtaccattgg

SEQ ID NO: 7909 - DNA, 21 bp, Artificial sequence
  SiRNA target sequence
cgatatgagcgtaccattggc

SEQ ID NO: 7910 - DNA, 21 bp, Artificial sequence
  SiRNA target sequence
gatatgagcgtaccattggct

SEQ ID NO: 7911 - DNA, 21 bp, Artificial sequence
  SiRNA target sequence
atatgagcgtaccattggctt

SEQ ID NO: 7912 - DNA, 21 bp, Artificial sequence
  SiRNA target sequence
tatgagcgtaccattggctta

SEQ ID NO: 7913 - DNA, 21 bp, Artificial sequence
  SiRNA target sequence
atgagcgtaccattggcttat

SEQ ID NO: 7914 - DNA, 21 bp, Artificial sequence
  SiRNA target sequence
tgagcgtaccattggcttatg

SEQ ID NO: 7915 - DNA, 21 bp, Artificial sequence
  SiRNA target sequence
gagcgtaccattggcttatga

SEQ ID NO: 7916 - DNA, 21 bp, Artificial sequence
  SiRNA target sequence
agcgtaccattggcttatgat

SEQ ID NO: 7917 - DNA, 21 bp, Artificial sequence
  SiRNA target sequence
gcgtaccattggcttatgatc

SEQ ID NO: 7918 - DNA, 21 bp, Artificial sequence
  SiRNA target sequence
cgtaccattggcttatgatcc

SEQ ID NO: 7919 - DNA, 21 bp, Artificial sequence
  SiRNA target sequence
gtaccattggcttatgatcct

SEQ ID NO: 7920 - DNA, 21 bp, Artificial sequence
  SiRNA target sequence
taccattggcttatgatccta

SEQ ID NO: 7921 - DNA, 21 bp, Artificial sequence
  SiRNA target sequence
accattggcttatgatcctaa

SEQ ID NO: 7922 - DNA, 21 bp, Artificial sequence
  SiRNA target sequence
ccattggcttatgatcctaat

SEQ ID NO: 7923 - DNA, 21 bp, Artificial sequence
  SiRNA target sequence
cattggcttatgatcctaata

SEQ ID NO: 7924 - DNA, 21 bp, Artificial sequence
  SiRNA target sequence
attggcttatgatcctaataa

SEQ ID NO: 7925 - DNA, 21 bp, Artificial sequence
  SiRNA target sequence
ttggcttatgatcctaataac

SEQ ID NO: 7926 - DNA, 21 bp, Artificial sequence
  SiRNA target sequence
tggcttatgatcctaataacg

SEQ ID NO: 7927 - DNA, 21 bp, Artificial sequence
  SiRNA target sequence
ggcttatgatcctaataacga

SEQ ID NO: 7928 - DNA, 21 bp, Artificial sequence
  SiRNA target sequence
gcttatgatcctaataacgaa

SEQ ID NO: 7929 - DNA, 21 bp, Artificial sequence
  SiRNA target sequence
cttatgatcctaataacgaac

SEQ ID NO: 7930 - DNA, 21 bp, Artificial sequence
  SiRNA target sequence
ttatgatcctaataacgaact

SEQ ID NO: 7931 - DNA, 21 bp, Artificial sequence
  SiRNA target sequence
tatgatcctaataacgaactt

SEQ ID NO: 7932 - DNA, 21 bp, Artificial sequence
  SiRNA target sequence
atgatcctaataacgaacttg

SEQ ID NO: 7933 - DNA, 21 bp, Artificial sequence
  SiRNA target sequence
tgatcctaataacgaacttgg

SEQ ID NO: 7934 - DNA, 21 bp, Artificial sequence
  SiRNA target sequence
gatcctaataacgaacttggt

SEQ ID NO: 7935 - DNA, 21 bp, Artificial sequence
  SiRNA target sequence
atcctaataacgaacttggtg

SEQ ID NO: 7936 - DNA, 21 bp, Artificial sequence
  SiRNA target sequence
tcctaataacgaacttggtga

SEQ ID NO: 7937 - DNA, 21 bp, Artificial sequence
  SiRNA target sequence
cctaataacgaacttggtgac

SEQ ID NO: 7938 - DNA, 21 bp, Artificial sequence
  SiRNA target sequence
ctaataacgaacttggtgact

SEQ ID NO: 7939 - DNA, 21 bp, Artificial sequence
  SiRNA target sequence
taataacgaacttggtgactt

SEQ ID NO: 7940 - DNA, 21 bp, Artificial sequence
  SiRNA target sequence
aataacgaacttggtgacttg

SEQ ID NO: 7941 - DNA, 21 bp, Artificial sequence
  SiRNA target sequence
ataacgaacttggtgacttga

SEQ ID NO: 7942 - DNA, 21 bp, Artificial sequence
  SiRNA target sequence
taacgaacttggtgacttgaa

SEQ ID NO: 7943 - DNA, 21 bp, Artificial sequence
  SiRNA target sequence
aacgaacttggtgacttgaag

SEQ ID NO: 7944 - DNA, 21 bp, Artificial sequence
  SiRNA target sequence
acgaacttggtgacttgaagg

SEQ ID NO: 7945 - DNA, 21 bp, Artificial sequence
  SiRNA target sequence
cgaacttggtgacttgaagga

SEQ ID NO: 7946 - DNA, 21 bp, Artificial sequence
  SiRNA target sequence
gaacttggtgacttgaaggat

SEQ ID NO: 7947 - DNA, 21 bp, Artificial sequence
  SiRNA target sequence
aacttggtgacttgaaggatg

SEQ ID NO: 7948 - DNA, 21 bp, Artificial sequence
  SiRNA target sequence
acttggtgacttgaaggatgt

SEQ ID NO: 7949 - DNA, 21 bp, Artificial sequence
  SiRNA target sequence
cttggtgacttgaaggatgtt

SEQ ID NO: 7950 - DNA, 21 bp, Artificial sequence
  SiRNA target sequence
ttggtgacttgaaggatgttt

SEQ ID NO: 7951 - DNA, 21 bp, Artificial sequence
  SiRNA target sequence
tggtgacttgaaggatgtttt

SEQ ID NO: 7952 - DNA, 21 bp, Artificial sequence
  SiRNA target sequence
ggtgacttgaaggatgttttt

SEQ ID NO: 7953 - DNA, 21 bp, Artificial sequence
  SiRNA target sequence
gtgacttgaaggatgtttttc

SEQ ID NO: 7954 - DNA, 21 bp, Artificial sequence
  SiRNA target sequence
tgacttgaaggatgtttttcc

SEQ ID NO: 7955 - DNA, 21 bp, Artificial sequence
  SiRNA target sequence
gacttgaaggatgtttttcct

SEQ ID NO: 7956 - DNA, 21 bp, Artificial sequence
  SiRNA target sequence
acttgaaggatgtttttcctt

SEQ ID NO: 7957 - DNA, 21 bp, Artificial sequence
  SiRNA target sequence
cttgaaggatgtttttccttc

SEQ ID NO: 7958 - DNA, 21 bp, Artificial sequence
  SiRNA target sequence
ttgaaggatgtttttccttct

SEQ ID NO: 7959 - DNA, 21 bp, Artificial sequence
  SiRNA target sequence
tgaaggatgtttttccttctg

SEQ ID NO: 7960 - DNA, 21 bp, Artificial sequence
  SiRNA target sequence
gaaggatgtttttccttctgc

SEQ ID NO: 7961 - DNA, 21 bp, Artificial sequence
  SiRNA target sequence
aaggatgtttttccttctgcg

SEQ ID NO: 7962 - DNA, 21 bp, Artificial sequence
  SiRNA target sequence
aggatgtttttccttctgcgg

SEQ ID NO: 7963 - DNA, 21 bp, Artificial sequence
  SiRNA target sequence
ggatgtttttccttctgcggt

SEQ ID NO: 7964 - DNA, 21 bp, Artificial sequence
  SiRNA target sequence
gatgtttttccttctgcggtt

SEQ ID NO: 7965 - DNA, 21 bp, Artificial sequence
  SiRNA target sequence
atgtttttccttctgcggttg

SEQ ID NO: 7966 - DNA, 21 bp, Artificial sequence
  SiRNA target sequence
tgtttttccttctgcggttga

SEQ ID NO: 7967 - DNA, 21 bp, Artificial sequence
  SiRNA target sequence
gtttttccttctgcggttgac

SEQ ID NO: 7968 - DNA, 21 bp, Artificial sequence
  SiRNA target sequence
tttttccttctgcggttgacg

SEQ ID NO: 7969 - DNA, 21 bp, Artificial sequence
  SiRNA target sequence
ttttccttctgcggttgacga

SEQ ID NO: 7970 - DNA, 21 bp, Artificial sequence
  SiRNA target sequence
tttccttctgcggttgacgaa

SEQ ID NO: 7971 - DNA, 21 bp, Artificial sequence
  SiRNA target sequence
ttccttctgcggttgacgaaa

SEQ ID NO: 7972 - DNA, 21 bp, Artificial sequence
  SiRNA target sequence
tccttctgcggttgacgaaat

SEQ ID NO: 7973 - DNA, 21 bp, Artificial sequence
  SiRNA target sequence
ccttctgcggttgacgaaatg

SEQ ID NO: 7974 - DNA, 21 bp, Artificial sequence
  SiRNA target sequence
cttctgcggttgacgaaatgg

SEQ ID NO: 7975 - DNA, 21 bp, Artificial sequence
  SiRNA target sequence
ttctgcggttgacgaaatggc

SEQ ID NO: 7976 - DNA, 21 bp, Artificial sequence
  SiRNA target sequence
tctgcggttgacgaaatggct

SEQ ID NO: 7977 - DNA, 21 bp, Artificial sequence
  SiRNA target sequence
ctgcggttgacgaaatggcta

SEQ ID NO: 7978 - DNA, 21 bp, Artificial sequence
  SiRNA target sequence
tgcggttgacgaaatggctac

SEQ ID NO: 7979 - DNA, 21 bp, Artificial sequence
  SiRNA target sequence
gcggttgacgaaatggctaca

SEQ ID NO: 7980 - DNA, 21 bp, Artificial sequence
  SiRNA target sequence
cggttgacgaaatggctacag

SEQ ID NO: 7981 - DNA, 21 bp, Artificial sequence
  SiRNA target sequence
ggttgacgaaatggctacagg

SEQ ID NO: 7982 - DNA, 21 bp, Artificial sequence
  SiRNA target sequence
gttgacgaaatggctacaggg

SEQ ID NO: 7983 - DNA, 21 bp, Artificial sequence
  SiRNA target sequence
ttgacgaaatggctacagggt

SEQ ID NO: 7984 - DNA, 21 bp, Artificial sequence
  SiRNA target sequence
tgacgaaatggctacagggta

SEQ ID NO: 7985 - DNA, 21 bp, Artificial sequence
  SiRNA target sequence
gacgaaatggctacagggtat

SEQ ID NO: 7986 - DNA, 21 bp, Artificial sequence
  SiRNA target sequence
acgaaatggctacagggtatg

SEQ ID NO: 7987 - DNA, 21 bp, Artificial sequence
  SiRNA target sequence
cgaaatggctacagggtatgt

SEQ ID NO: 7988 - DNA, 21 bp, Artificial sequence
  SiRNA target sequence
gaaatggctacagggtatgtt

SEQ ID NO: 7989 - DNA, 21 bp, Artificial sequence
  SiRNA target sequence
aaatggctacagggtatgttt

SEQ ID NO: 7990 - DNA, 21 bp, Artificial sequence
  SiRNA target sequence
aatggctacagggtatgtttg

SEQ ID NO: 7991 - DNA, 21 bp, Artificial sequence
  SiRNA target sequence
atggctacagggtatgtttgc

SEQ ID NO: 7992 - DNA, 21 bp, Artificial sequence
  SiRNA target sequence
tggctacagggtatgtttgcg

SEQ ID NO: 7993 - DNA, 21 bp, Artificial sequence
  SiRNA target sequence
ggctacagggtatgtttgcgg

SEQ ID NO: 7994 - DNA, 21 bp, Artificial sequence
  SiRNA target sequence
gctacagggtatgtttgcggc

SEQ ID NO: 7995 - DNA, 21 bp, Artificial sequence
  SiRNA target sequence
ctacagggtatgtttgcggca

SEQ ID NO: 7996 - DNA, 21 bp, Artificial sequence
  SiRNA target sequence
tacagggtatgtttgcggcaa

SEQ ID NO: 7997 - DNA, 21 bp, Artificial sequence
  SiRNA target sequence
acagggtatgtttgcggcaat

SEQ ID NO: 7998 - DNA, 21 bp, Artificial sequence
  SiRNA target sequence
cagggtatgtttgcggcaatc

SEQ ID NO: 7999 - DNA, 21 bp, Artificial sequence
  SiRNA target sequence
agggtatgtttgcggcaatcc

SEQ ID NO: 8000 - DNA, 21 bp, Artificial sequence
  SiRNA target sequence
gggtatgtttgcggcaatcca

SEQ ID NO: 8001 - DNA, 21 bp, Artificial sequence
  SiRNA target sequence
ggtatgtttgcggcaatccag

SEQ ID NO: 8002 - DNA, 21 bp, Artificial sequence
  SiRNA target sequence
gtatgtttgcggcaatccagc

SEQ ID NO: 8003 - DNA, 21 bp, Artificial sequence
  SiRNA target sequence
tatgtttgcggcaatccagcc

SEQ ID NO: 8004 - DNA, 21 bp, Artificial sequence
  SiRNA target sequence
atgtttgcggcaatccagccg

SEQ ID NO: 8005 - DNA, 21 bp, Artificial sequence
  SiRNA target sequence
tgtttgcggcaatccagccgt

SEQ ID NO: 8006 - DNA, 21 bp, Artificial sequence
  SiRNA target sequence
gtttgcggcaatccagccgtg

SEQ ID NO: 8007 - DNA, 21 bp, Artificial sequence
  SiRNA target sequence
tttgcggcaatccagccgtga

SEQ ID NO: 8008 - DNA, 21 bp, Artificial sequence
  SiRNA target sequence
ttgcggcaatccagccgtgaa

SEQ ID NO: 8009 - DNA, 21 bp, Artificial sequence
  SiRNA target sequence
tgcggcaatccagccgtgaaa

SEQ ID NO: 8010 - DNA, 21 bp, Artificial sequence
  SiRNA target sequence
gcggcaatccagccgtgaaac

SEQ ID NO: 8011 - DNA, 21 bp, Artificial sequence
  SiRNA target sequence
cggcaatccagccgtgaaaca

SEQ ID NO: 8012 - DNA, 21 bp, Artificial sequence
  SiRNA target sequence
ggcaatccagccgtgaaacat

SEQ ID NO: 8013 - DNA, 21 bp, Artificial sequence
  SiRNA target sequence
gcaatccagccgtgaaacatg

SEQ ID NO: 8014 - DNA, 21 bp, Artificial sequence
  SiRNA target sequence
caatccagccgtgaaacatgt

SEQ ID NO: 8015 - DNA, 21 bp, Artificial sequence
  SiRNA target sequence
aatccagccgtgaaacatgtt

SEQ ID NO: 8016 - DNA, 21 bp, Artificial sequence
  SiRNA target sequence
atccagccgtgaaacatgttc

SEQ ID NO: 8017 - DNA, 21 bp, Artificial sequence
  SiRNA target sequence
tccagccgtgaaacatgttct

SEQ ID NO: 8018 - DNA, 21 bp, Artificial sequence
  SiRNA target sequence
ccagccgtgaaacatgttctt

SEQ ID NO: 8019 - DNA, 21 bp, Artificial sequence
  SiRNA target sequence
cagccgtgaaacatgttctta

SEQ ID NO: 8020 - DNA, 21 bp, Artificial sequence
  SiRNA target sequence
agccgtgaaacatgttcttac

SEQ ID NO: 8021 - DNA, 21 bp, Artificial sequence
  SiRNA target sequence
gccgtgaaacatgttcttacc

SEQ ID NO: 8022 - DNA, 21 bp, Artificial sequence
  SiRNA target sequence
ccgtgaaacatgttcttacct

SEQ ID NO: 8023 - DNA, 21 bp, Artificial sequence
  SiRNA target sequence
cgtgaaacatgttcttacctg

SEQ ID NO: 8024 - DNA, 21 bp, Artificial sequence
  SiRNA target sequence
gtgaaacatgttcttacctgg

SEQ ID NO: 8025 - DNA, 21 bp, Artificial sequence
  SiRNA target sequence
tgaaacatgttcttacctgga

SEQ ID NO: 8026 - DNA, 21 bp, Artificial sequence
  SiRNA target sequence
gaaacatgttcttacctggaa

SEQ ID NO: 8027 - DNA, 21 bp, Artificial sequence
  SiRNA target sequence
aaacatgttcttacctggaag

SEQ ID NO: 8028 - DNA, 21 bp, Artificial sequence
  SiRNA target sequence
aacatgttcttacctggaaga

SEQ ID NO: 8029 - DNA, 21 bp, Artificial sequence
  SiRNA target sequence
acatgttcttacctggaagac

SEQ ID NO: 8030 - DNA, 21 bp, Artificial sequence
  SiRNA target sequence
catgttcttacctggaagacg

SEQ ID NO: 8031 - DNA, 21 bp, Artificial sequence
  SiRNA target sequence
atgttcttacctggaagacga

SEQ ID NO: 8032 - DNA, 21 bp, Artificial sequence
  SiRNA target sequence
tgttcttacctggaagacgac

SEQ ID NO: 8033 - DNA, 21 bp, Artificial sequence
  SiRNA target sequence
gttcttacctggaagacgact

SEQ ID NO: 8034 - DNA, 21 bp, Artificial sequence
  SiRNA target sequence
ttcttacctggaagacgactg

SEQ ID NO: 8035 - DNA, 21 bp, Artificial sequence
  SiRNA target sequence
tcttacctggaagacgactga

SEQ ID NO: 8036 - DNA, 21 bp, Artificial sequence
  SiRNA target sequence
cttacctggaagacgactgac

SEQ ID NO: 8037 - DNA, 21 bp, Artificial sequence
  SiRNA target sequence
ttacctggaagacgactgacg

SEQ ID NO: 8038 - DNA, 21 bp, Artificial sequence
  SiRNA target sequence
tacctggaagacgactgacgt

SEQ ID NO: 8039 - DNA, 21 bp, Artificial sequence
  SiRNA target sequence
acctggaagacgactgacgta

SEQ ID NO: 8040 - DNA, 21 bp, Artificial sequence
  SiRNA target sequence
cctggaagacgactgacgtaa

SEQ ID NO: 8041 - DNA, 21 bp, Artificial sequence
  SiRNA target sequence
ctggaagacgactgacgtaat

SEQ ID NO: 8042 - DNA, 21 bp, Artificial sequence
  SiRNA target sequence
tggaagacgactgacgtaatt

SEQ ID NO: 8043 - DNA, 21 bp, Artificial sequence
  SiRNA target sequence
ggaagacgactgacgtaattc

SEQ ID NO: 8044 - DNA, 21 bp, Artificial sequence
  SiRNA target sequence
gaagacgactgacgtaattca

SEQ ID NO: 8045 - DNA, 21 bp, Artificial sequence
  SiRNA target sequence
aagacgactgacgtaattcag

SEQ ID NO: 8046 - DNA, 21 bp, Artificial sequence
  SiRNA target sequence
agacgactgacgtaattcaga

SEQ ID NO: 8047 - DNA, 21 bp, Artificial sequence
  SiRNA target sequence
gacgactgacgtaattcagaa

SEQ ID NO: 8048 - DNA, 21 bp, Artificial sequence
  SiRNA target sequence
acgactgacgtaattcagaaa

SEQ ID NO: 8049 - DNA, 21 bp, Artificial sequence
  SiRNA target sequence
cgactgacgtaattcagaaac

SEQ ID NO: 8050 - DNA, 21 bp, Artificial sequence
  SiRNA target sequence
gactgacgtaattcagaaacc

SEQ ID NO: 8051 - DNA, 21 bp, Artificial sequence
  SiRNA target sequence
actgacgtaattcagaaacca

SEQ ID NO: 8052 - DNA, 21 bp, Artificial sequence
  SiRNA target sequence
ctgacgtaattcagaaaccaa

SEQ ID NO: 8053 - DNA, 21 bp, Artificial sequence
  SiRNA target sequence
tgacgtaattcagaaaccaat

SEQ ID NO: 8054 - DNA, 21 bp, Artificial sequence
  SiRNA target sequence
gacgtaattcagaaaccaata

SEQ ID NO: 8055 - DNA, 21 bp, Artificial sequence
  SiRNA target sequence
acgtaattcagaaaccaatag

SEQ ID NO: 8056 - DNA, 21 bp, Artificial sequence
  SiRNA target sequence
cgtaattcagaaaccaatagc

SEQ ID NO: 8057 - DNA, 21 bp, Artificial sequence
  SiRNA target sequence
gtaattcagaaaccaatagca

SEQ ID NO: 8058 - DNA, 21 bp, Artificial sequence
  SiRNA target sequence
taattcagaaaccaatagcaa

SEQ ID NO: 8059 - DNA, 21 bp, Artificial sequence
  SiRNA target sequence
aattcagaaaccaatagcaaa

SEQ ID NO: 8060 - DNA, 21 bp, Artificial sequence
  SiRNA target sequence
attcagaaaccaatagcaaac

SEQ ID NO: 8061 - DNA, 21 bp, Artificial sequence
  SiRNA target sequence
ttcagaaaccaatagcaaacg

SEQ ID NO: 8062 - DNA, 21 bp, Artificial sequence
  SiRNA target sequence
tcagaaaccaatagcaaacgg

SEQ ID NO: 8063 - DNA, 21 bp, Artificial sequence
  SiRNA target sequence
cagaaaccaatagcaaacgga

SEQ ID NO: 8064 - DNA, 21 bp, Artificial sequence
  SiRNA target sequence
agaaaccaatagcaaacggag

SEQ ID NO: 8065 - DNA, 21 bp, Artificial sequence
  SiRNA target sequence
gaaaccaatagcaaacggaga

SEQ ID NO: 8066 - DNA, 21 bp, Artificial sequence
  SiRNA target sequence
aaaccaatagcaaacggagat

SEQ ID NO: 8067 - DNA, 21 bp, Artificial sequence
  SiRNA target sequence
aaccaatagcaaacggagatg

SEQ ID NO: 8068 - DNA, 21 bp, Artificial sequence
  SiRNA target sequence
accaatagcaaacggagatga

SEQ ID NO: 8069 - DNA, 21 bp, Artificial sequence
  SiRNA target sequence
ccaatagcaaacggagatgat

SEQ ID NO: 8070 - DNA, 21 bp, Artificial sequence
  SiRNA target sequence
caatagcaaacggagatgatt

SEQ ID NO: 8071 - DNA, 21 bp, Artificial sequence
  SiRNA target sequence
aatagcaaacggagatgattg

SEQ ID NO: 8072 - DNA, 21 bp, Artificial sequence
  SiRNA target sequence
atagcaaacggagatgattgg

SEQ ID NO: 8073 - DNA, 21 bp, Artificial sequence
  SiRNA target sequence
tagcaaacggagatgattggg

SEQ ID NO: 8074 - DNA, 21 bp, Artificial sequence
  SiRNA target sequence
agcaaacggagatgattgggg

SEQ ID NO: 8075 - DNA, 21 bp, Artificial sequence
  SiRNA target sequence
gcaaacggagatgattggggt

SEQ ID NO: 8076 - DNA, 21 bp, Artificial sequence
  SiRNA target sequence
caaacggagatgattggggtg

SEQ ID NO: 8077 - DNA, 21 bp, Artificial sequence
  SiRNA target sequence
aaacggagatgattggggtgg

SEQ ID NO: 8078 - DNA, 21 bp, Artificial sequence
  SiRNA target sequence
aacggagatgattggggtgga

SEQ ID NO: 8079 - DNA, 21 bp, Artificial sequence
  SiRNA target sequence
acggagatgattggggtggag

SEQ ID NO: 8080 - DNA, 21 bp, Artificial sequence
  SiRNA target sequence
cggagatgattggggtggagt

SEQ ID NO: 8081 - DNA, 21 bp, Artificial sequence
  SiRNA target sequence
ggagatgattggggtggagtt

SEQ ID NO: 8082 - DNA, 21 bp, Artificial sequence
  SiRNA target sequence
gagatgattggggtggagtta

SEQ ID NO: 8083 - DNA, 21 bp, Artificial sequence
  SiRNA target sequence
agatgattggggtggagttat

SEQ ID NO: 8084 - DNA, 21 bp, Artificial sequence
  SiRNA target sequence
gatgattggggtggagttata

SEQ ID NO: 8085 - DNA, 21 bp, Artificial sequence
  SiRNA target sequence
atgattggggtggagttatac

SEQ ID NO: 8086 - DNA, 21 bp, Artificial sequence
  SiRNA target sequence
tgattggggtggagttatacc

SEQ ID NO: 8087 - DNA, 21 bp, Artificial sequence
  SiRNA target sequence
gattggggtggagttatacca

SEQ ID NO: 8088 - DNA, 21 bp, Artificial sequence
  SiRNA target sequence
attggggtggagttataccag

SEQ ID NO: 8089 - DNA, 21 bp, Artificial sequence
  SiRNA target sequence
ttggggtggagttataccagt

SEQ ID NO: 8090 - DNA, 21 bp, Artificial sequence
  SiRNA target sequence
tggggtggagttataccagtg

SEQ ID NO: 8091 - DNA, 21 bp, Artificial sequence
  SiRNA target sequence
ggggtggagttataccagtgg

SEQ ID NO: 8092 - DNA, 21 bp, Artificial sequence
  SiRNA target sequence
gggtggagttataccagtggg

SEQ ID NO: 8093 - DNA, 21 bp, Artificial sequence
  SiRNA target sequence
ggtggagttataccagtggga

SEQ ID NO: 8094 - DNA, 21 bp, Artificial sequence
  SiRNA target sequence
gtggagttataccagtgggaa

SEQ ID NO: 8095 - DNA, 21 bp, Artificial sequence
  SiRNA target sequence
tggagttataccagtgggaat

SEQ ID NO: 8096 - DNA, 21 bp, Artificial sequence
  SiRNA target sequence
ggagttataccagtgggaatg

SEQ ID NO: 8097 - DNA, 21 bp, Artificial sequence
  SiRNA target sequence
gagttataccagtgggaatgc

SEQ ID NO: 8098 - DNA, 21 bp, Artificial sequence
  SiRNA target sequence
agttataccagtgggaatgcc

SEQ ID NO: 8099 - DNA, 21 bp, Artificial sequence
  SiRNA target sequence
gttataccagtgggaatgcct

SEQ ID NO: 8100 - DNA, 21 bp, Artificial sequence
  SiRNA target sequence
ttataccagtgggaatgcctt

SEQ ID NO: 8101 - DNA, 21 bp, Artificial sequence
  SiRNA target sequence
tataccagtgggaatgccttg

SEQ ID NO: 8102 - DNA, 21 bp, Artificial sequence
  SiRNA target sequence
ataccagtgggaatgccttgt

SEQ ID NO: 8103 - DNA, 21 bp, Artificial sequence
  SiRNA target sequence
taccagtgggaatgccttgtt

SEQ ID NO: 8104 - DNA, 21 bp, Artificial sequence
  SiRNA target sequence
accagtgggaatgccttgtta

SEQ ID NO: 8105 - DNA, 21 bp, Artificial sequence
  SiRNA target sequence
ccagtgggaatgccttgttat

SEQ ID NO: 8106 - DNA, 21 bp, Artificial sequence
  SiRNA target sequence
cagtgggaatgccttgttatt

SEQ ID NO: 8107 - DNA, 21 bp, Artificial sequence
  SiRNA target sequence
agtgggaatgccttgttattc

SEQ ID NO: 8108 - DNA, 21 bp, Artificial sequence
  SiRNA target sequence
gtgggaatgccttgttattct

SEQ ID NO: 8109 - DNA, 21 bp, Artificial sequence
  SiRNA target sequence
tgggaatgccttgttattcta

SEQ ID NO: 8110 - DNA, 21 bp, Artificial sequence
  SiRNA target sequence
gggaatgccttgttattctaa

SEQ ID NO: 8111 - DNA, 21 bp, Artificial sequence
  SiRNA target sequence
ggaatgccttgttattctaaa

SEQ ID NO: 8112 - DNA, 21 bp, Artificial sequence
  SiRNA target sequence
gaatgccttgttattctaaat

SEQ ID NO: 8113 - DNA, 21 bp, Artificial sequence
  SiRNA target sequence
aatgccttgttattctaaatc

SEQ ID NO: 8114 - DNA, 21 bp, Artificial sequence
  SiRNA target sequence
atgccttgttattctaaatcc

SEQ ID NO: 8115 - DNA, 21 bp, Artificial sequence
  SiRNA target sequence
tgccttgttattctaaatcca

SEQ ID NO: 8116 - DNA, 21 bp, Artificial sequence
  SiRNA target sequence
gccttgttattctaaatccat

SEQ ID NO: 8117 - DNA, 21 bp, Artificial sequence
  SiRNA target sequence
ccttgttattctaaatccatt

SEQ ID NO: 8118 - DNA, 21 bp, Artificial sequence
  SiRNA target sequence
cttgttattctaaatccatta

SEQ ID NO: 8119 - DNA, 21 bp, Artificial sequence
  SiRNA target sequence
ttgttattctaaatccattag

SEQ ID NO: 8120 - DNA, 21 bp, Artificial sequence
  SiRNA target sequence
tgttattctaaatccattaga

SEQ ID NO: 8121 - DNA, 21 bp, Artificial sequence
  SiRNA target sequence
gttattctaaatccattagaa

SEQ ID NO: 8122 - DNA, 21 bp, Artificial sequence
  SiRNA target sequence
ttattctaaatccattagaat

SEQ ID NO: 8123 - DNA, 21 bp, Artificial sequence
  SiRNA target sequence
tattctaaatccattagaatt

SEQ ID NO: 8124 - DNA, 21 bp, Artificial sequence
  SiRNA target sequence
attctaaatccattagaatta

SEQ ID NO: 8125 - DNA, 21 bp, Artificial sequence
  SiRNA target sequence
ttctaaatccattagaattac

SEQ ID NO: 8126 - DNA, 21 bp, Artificial sequence
  SiRNA target sequence
tctaaatccattagaattaca

SEQ ID NO: 8127 - DNA, 21 bp, Artificial sequence
  SiRNA target sequence
ctaaatccattagaattacaa

SEQ ID NO: 8128 - DNA, 21 bp, Artificial sequence
  SiRNA target sequence
taaatccattagaattacaag

SEQ ID NO: 8129 - DNA, 21 bp, Artificial sequence
  SiRNA target sequence
aaatccattagaattacaagt

SEQ ID NO: 8130 - DNA, 21 bp, Artificial sequence
  SiRNA target sequence
aatccattagaattacaagta

SEQ ID NO: 8131 - DNA, 21 bp, Artificial sequence
  SiRNA target sequence
atccattagaattacaagtat

SEQ ID NO: 8132 - DNA, 21 bp, Artificial sequence
  SiRNA target sequence
tccattagaattacaagtatt

SEQ ID NO: 8133 - DNA, 21 bp, Artificial sequence
  SiRNA target sequence
ccattagaattacaagtattt

SEQ ID NO: 8134 - DNA, 21 bp, Artificial sequence
  SiRNA target sequence
cattagaattacaagtatttc

SEQ ID NO: 8135 - DNA, 21 bp, Artificial sequence
  SiRNA target sequence
attagaattacaagtatttca

SEQ ID NO: 8136 - DNA, 21 bp, Artificial sequence
  SiRNA target sequence
ttagaattacaagtatttcag

SEQ ID NO: 8137 - DNA, 21 bp, Artificial sequence
  SiRNA target sequence
tagaattacaagtatttcaga

SEQ ID NO: 8138 - DNA, 21 bp, Artificial sequence
  SiRNA target sequence
agaattacaagtatttcagaa

SEQ ID NO: 8139 - DNA, 21 bp, Artificial sequence
  SiRNA target sequence
gaattacaagtatttcagaaa

SEQ ID NO: 8140 - DNA, 21 bp, Artificial sequence
  SiRNA target sequence
aattacaagtatttcagaaac

SEQ ID NO: 8141 - DNA, 21 bp, Artificial sequence
  SiRNA target sequence
attacaagtatttcagaaacg

SEQ ID NO: 8142 - DNA, 21 bp, Artificial sequence
  SiRNA target sequence
ttacaagtatttcagaaacgg

SEQ ID NO: 8143 - DNA, 21 bp, Artificial sequence
  SiRNA target sequence
tacaagtatttcagaaacgga

SEQ ID NO: 8144 - DNA, 21 bp, Artificial sequence
  SiRNA target sequence
acaagtatttcagaaacggaa

SEQ ID NO: 8145 - DNA, 21 bp, Artificial sequence
  SiRNA target sequence
caagtatttcagaaacggaaa

SEQ ID NO: 8146 - DNA, 21 bp, Artificial sequence
  SiRNA target sequence
aagtatttcagaaacggaaaa

SEQ ID NO: 8147 - DNA, 21 bp, Artificial sequence
  SiRNA target sequence
agtatttcagaaacggaaaat

SEQ ID NO: 8148 - DNA, 21 bp, Artificial sequence
  SiRNA target sequence
gtatttcagaaacggaaaatc

SEQ ID NO: 8149 - DNA, 21 bp, Artificial sequence
  SiRNA target sequence
tatttcagaaacggaaaatcg

SEQ ID NO: 8150 - DNA, 21 bp, Artificial sequence
  SiRNA target sequence
atttcagaaacggaaaatcgt

SEQ ID NO: 8151 - DNA, 21 bp, Artificial sequence
  SiRNA target sequence
tttcagaaacggaaaatcgtg

SEQ ID NO: 8152 - DNA, 21 bp, Artificial sequence
  SiRNA target sequence
ttcagaaacggaaaatcgtga

SEQ ID NO: 8153 - DNA, 21 bp, Artificial sequence
  SiRNA target sequence
tcagaaacggaaaatcgtgaa

SEQ ID NO: 8154 - DNA, 21 bp, Artificial sequence
  SiRNA target sequence
cagaaacggaaaatcgtgaaa

SEQ ID NO: 8155 - DNA, 21 bp, Artificial sequence
  SiRNA target sequence
agaaacggaaaatcgtgaaac

SEQ ID NO: 8156 - DNA, 21 bp, Artificial sequence
  SiRNA target sequence
gaaacggaaaatcgtgaaact

SEQ ID NO: 8157 - DNA, 21 bp, Artificial sequence
  SiRNA target sequence
aaacggaaaatcgtgaaactg

SEQ ID NO: 8158 - DNA, 21 bp, Artificial sequence
  SiRNA target sequence
aacggaaaatcgtgaaactga

SEQ ID NO: 8159 - DNA, 21 bp, Artificial sequence
  SiRNA target sequence
acggaaaatcgtgaaactgaa

SEQ ID NO: 8160 - DNA, 21 bp, Artificial sequence
  SiRNA target sequence
cggaaaatcgtgaaactgaag

SEQ ID NO: 8161 - DNA, 21 bp, Artificial sequence
  SiRNA target sequence
ggaaaatcgtgaaactgaagt

SEQ ID NO: 8162 - DNA, 21 bp, Artificial sequence
  SiRNA target sequence
gaaaatcgtgaaactgaagtc

SEQ ID NO: 8163 - DNA, 21 bp, Artificial sequence
  SiRNA target sequence
aaaatcgtgaaactgaagtca

SEQ ID NO: 8164 - DNA, 21 bp, Artificial sequence
  SiRNA target sequence
aaatcgtgaaactgaagtcat

SEQ ID NO: 8165 - DNA, 21 bp, Artificial sequence
  SiRNA target sequence
aatcgtgaaactgaagtcata

SEQ ID NO: 8166 - DNA, 21 bp, Artificial sequence
  SiRNA target sequence
atcgtgaaactgaagtcatag

SEQ ID NO: 8167 - DNA, 21 bp, Artificial sequence
  SiRNA target sequence
tcgtgaaactgaagtcataga

SEQ ID NO: 8168 - DNA, 21 bp, Artificial sequence
  SiRNA target sequence
cgtgaaactgaagtcatagat

SEQ ID NO: 8169 - DNA, 21 bp, Artificial sequence
  SiRNA target sequence
gtgaaactgaagtcatagatg

SEQ ID NO: 8170 - DNA, 21 bp, Artificial sequence
  SiRNA target sequence
tgaaactgaagtcatagatgc

SEQ ID NO: 8171 - DNA, 21 bp, Artificial sequence
  SiRNA target sequence
gaaactgaagtcatagatgcc

SEQ ID NO: 8172 - DNA, 21 bp, Artificial sequence
  SiRNA target sequence
aaactgaagtcatagatgccg

SEQ ID NO: 8173 - DNA, 21 bp, Artificial sequence
  SiRNA target sequence
aactgaagtcatagatgccgc

SEQ ID NO: 8174 - DNA, 21 bp, Artificial sequence
  SiRNA target sequence
actgaagtcatagatgccgct

SEQ ID NO: 8175 - DNA, 21 bp, Artificial sequence
  SiRNA target sequence
ctgaagtcatagatgccgctc

SEQ ID NO: 8176 - DNA, 21 bp, Artificial sequence
  SiRNA target sequence
tgaagtcatagatgccgctcc

SEQ ID NO: 8177 - DNA, 21 bp, Artificial sequence
  SiRNA target sequence
gaagtcatagatgccgctcca

SEQ ID NO: 8178 - DNA, 21 bp, Artificial sequence
  SiRNA target sequence
aagtcatagatgccgctccat

SEQ ID NO: 8179 - DNA, 21 bp, Artificial sequence
  SiRNA target sequence
agtcatagatgccgctccatg

SEQ ID NO: 8180 - DNA, 21 bp, Artificial sequence
  SiRNA target sequence
gtcatagatgccgctccatgt

SEQ ID NO: 8181 - DNA, 21 bp, Artificial sequence
  SiRNA target sequence
tcatagatgccgctccatgtg

SEQ ID NO: 8182 - DNA, 21 bp, Artificial sequence
  SiRNA target sequence
catagatgccgctccatgtga

SEQ ID NO: 8183 - DNA, 21 bp, Artificial sequence
  SiRNA target sequence
atagatgccgctccatgtgaa

SEQ ID NO: 8184 - DNA, 21 bp, Artificial sequence
  SiRNA target sequence
tagatgccgctccatgtgaat

SEQ ID NO: 8185 - DNA, 21 bp, Artificial sequence
  SiRNA target sequence
agatgccgctccatgtgaata

SEQ ID NO: 8186 - DNA, 21 bp, Artificial sequence
  SiRNA target sequence
gatgccgctccatgtgaatat

SEQ ID NO: 8187 - DNA, 21 bp, Artificial sequence
  SiRNA target sequence
atgccgctccatgtgaatatg

SEQ ID NO: 8188 - DNA, 21 bp, Artificial sequence
  SiRNA target sequence
tgccgctccatgtgaatatgt

SEQ ID NO: 8189 - DNA, 21 bp, Artificial sequence
  SiRNA target sequence
gccgctccatgtgaatatgtt

SEQ ID NO: 8190 - DNA, 21 bp, Artificial sequence
  SiRNA target sequence
ccgctccatgtgaatatgttg

SEQ ID NO: 8191 - DNA, 21 bp, Artificial sequence
  SiRNA target sequence
cgctccatgtgaatatgttgc

SEQ ID NO: 8192 - DNA, 21 bp, Artificial sequence
  SiRNA target sequence
gctccatgtgaatatgttgct

SEQ ID NO: 8193 - DNA, 21 bp, Artificial sequence
  SiRNA target sequence
ctccatgtgaatatgttgcta

SEQ ID NO: 8194 - DNA, 21 bp, Artificial sequence
  SiRNA target sequence
tccatgtgaatatgttgctaa

SEQ ID NO: 8195 - DNA, 21 bp, Artificial sequence
  SiRNA target sequence
ccatgtgaatatgttgctaac

SEQ ID NO: 8196 - DNA, 21 bp, Artificial sequence
  SiRNA target sequence
catgtgaatatgttgctaaca

SEQ ID NO: 8197 - DNA, 21 bp, Artificial sequence
  SiRNA target sequence
atgtgaatatgttgctaacat

SEQ ID NO: 8198 - DNA, 21 bp, Artificial sequence
  SiRNA target sequence
tgtgaatatgttgctaacatg

SEQ ID NO: 8199 - DNA, 21 bp, Artificial sequence
  SiRNA target sequence
gtgaatatgttgctaacatgt

SEQ ID NO: 8200 - DNA, 21 bp, Artificial sequence
  SiRNA target sequence
tgaatatgttgctaacatgtt

SEQ ID NO: 8201 - DNA, 21 bp, Artificial sequence
  SiRNA target sequence
gaatatgttgctaacatgttc

SEQ ID NO: 8202 - DNA, 21 bp, Artificial sequence
  SiRNA target sequence
aatatgttgctaacatgttct

SEQ ID NO: 8203 - DNA, 21 bp, Artificial sequence
  SiRNA target sequence
atatgttgctaacatgttctc

SEQ ID NO: 8204 - DNA, 21 bp, Artificial sequence
  SiRNA target sequence
tatgttgctaacatgttctcg

SEQ ID NO: 8205 - DNA, 21 bp, Artificial sequence
  SiRNA target sequence
atgttgctaacatgttctcgt

SEQ ID NO: 8206 - DNA, 21 bp, Artificial sequence
  SiRNA target sequence
tgttgctaacatgttctcgta

SEQ ID NO: 8207 - DNA, 21 bp, Artificial sequence
  SiRNA target sequence
gttgctaacatgttctcgtat

SEQ ID NO: 8208 - DNA, 21 bp, Artificial sequence
  SiRNA target sequence
ttgctaacatgttctcgtatt

SEQ ID NO: 8209 - DNA, 21 bp, Artificial sequence
  SiRNA target sequence
tgctaacatgttctcgtattg

SEQ ID NO: 8210 - DNA, 21 bp, Artificial sequence
  SiRNA target sequence
gctaacatgttctcgtattgg

SEQ ID NO: 8211 - DNA, 21 bp, Artificial sequence
  SiRNA target sequence
ctaacatgttctcgtattggc

SEQ ID NO: 8212 - DNA, 21 bp, Artificial sequence
  SiRNA target sequence
taacatgttctcgtattggcg

SEQ ID NO: 8213 - DNA, 21 bp, Artificial sequence
  SiRNA target sequence
aacatgttctcgtattggcgt

SEQ ID NO: 8214 - DNA, 21 bp, Artificial sequence
  SiRNA target sequence
acatgttctcgtattggcgtg

SEQ ID NO: 8215 - DNA, 21 bp, Artificial sequence
  SiRNA target sequence
catgttctcgtattggcgtgc

SEQ ID NO: 8216 - DNA, 21 bp, Artificial sequence
  SiRNA target sequence
atgttctcgtattggcgtgca

SEQ ID NO: 8217 - DNA, 21 bp, Artificial sequence
  SiRNA target sequence
tgttctcgtattggcgtgcaa

SEQ ID NO: 8218 - DNA, 21 bp, Artificial sequence
  SiRNA target sequence
gttctcgtattggcgtgcaac

SEQ ID NO: 8219 - DNA, 21 bp, Artificial sequence
  SiRNA target sequence
ttctcgtattggcgtgcaact

SEQ ID NO: 8220 - DNA, 21 bp, Artificial sequence
  SiRNA target sequence
tctcgtattggcgtgcaacta

SEQ ID NO: 8221 - DNA, 21 bp, Artificial sequence
  SiRNA target sequence
ctcgtattggcgtgcaactat

SEQ ID NO: 8222 - DNA, 21 bp, Artificial sequence
  SiRNA target sequence
tcgtattggcgtgcaactatg

SEQ ID NO: 8223 - DNA, 21 bp, Artificial sequence
  SiRNA target sequence
cgtattggcgtgcaactatgt

SEQ ID NO: 8224 - DNA, 21 bp, Artificial sequence
  SiRNA target sequence
gtattggcgtgcaactatgtg

SEQ ID NO: 8225 - DNA, 21 bp, Artificial sequence
  SiRNA target sequence
tattggcgtgcaactatgtgt

SEQ ID NO: 8226 - DNA, 21 bp, Artificial sequence
  SiRNA target sequence
attggcgtgcaactatgtgtt

SEQ ID NO: 8227 - DNA, 21 bp, Artificial sequence
  SiRNA target sequence
ttggcgtgcaactatgtgtta

SEQ ID NO: 8228 - DNA, 21 bp, Artificial sequence
  SiRNA target sequence
tggcgtgcaactatgtgttat

SEQ ID NO: 8229 - DNA, 21 bp, Artificial sequence
  SiRNA target sequence
ggcgtgcaactatgtgttata

SEQ ID NO: 8230 - DNA, 21 bp, Artificial sequence
  SiRNA target sequence
gcgtgcaactatgtgttatag

SEQ ID NO: 8231 - DNA, 21 bp, Artificial sequence
  SiRNA target sequence
cgtgcaactatgtgttatagg

SEQ ID NO: 8232 - DNA, 21 bp, Artificial sequence
  SiRNA target sequence
gtgcaactatgtgttatagga

SEQ ID NO: 8233 - DNA, 21 bp, Artificial sequence
  SiRNA target sequence
tgcaactatgtgttataggat

SEQ ID NO: 8234 - DNA, 21 bp, Artificial sequence
  SiRNA target sequence
gcaactatgtgttataggatt

SEQ ID NO: 8235 - DNA, 21 bp, Artificial sequence
  SiRNA target sequence
caactatgtgttataggatta

SEQ ID NO: 8236 - DNA, 21 bp, Artificial sequence
  SiRNA target sequence
aactatgtgttataggattac

SEQ ID NO: 8237 - DNA, 21 bp, Artificial sequence
  SiRNA target sequence
actatgtgttataggattacc

SEQ ID NO: 8238 - DNA, 21 bp, Artificial sequence
  SiRNA target sequence
ctatgtgttataggattaccg

SEQ ID NO: 8239 - DNA, 21 bp, Artificial sequence
  SiRNA target sequence
tatgtgttataggattaccgt

SEQ ID NO: 8240 - DNA, 21 bp, Artificial sequence
  SiRNA target sequence
atgtgttataggattaccgtg

SEQ ID NO: 8241 - DNA, 21 bp, Artificial sequence
  SiRNA target sequence
tgtgttataggattaccgtgg

SEQ ID NO: 8242 - DNA, 21 bp, Artificial sequence
  SiRNA target sequence
gtgttataggattaccgtggt

SEQ ID NO: 8243 - DNA, 21 bp, Artificial sequence
  SiRNA target sequence
tgttataggattaccgtggtg

SEQ ID NO: 8244 - DNA, 21 bp, Artificial sequence
  SiRNA target sequence
gttataggattaccgtggtga

SEQ ID NO: 8245 - DNA, 21 bp, Artificial sequence
  SiRNA target sequence
ttataggattaccgtggtgaa

SEQ ID NO: 8246 - DNA, 21 bp, Artificial sequence
  SiRNA target sequence
tataggattaccgtggtgaaa

SEQ ID NO: 8247 - DNA, 21 bp, Artificial sequence
  SiRNA target sequence
ataggattaccgtggtgaaaa

SEQ ID NO: 8248 - DNA, 21 bp, Artificial sequence
  SiRNA target sequence
taggattaccgtggtgaaaac

SEQ ID NO: 8249 - DNA, 21 bp, Artificial sequence
  SiRNA target sequence
aggattaccgtggtgaaaaca

SEQ ID NO: 8250 - DNA, 21 bp, Artificial sequence
  SiRNA target sequence
ggattaccgtggtgaaaacag

SEQ ID NO: 8251 - DNA, 21 bp, Artificial sequence
  SiRNA target sequence
gattaccgtggtgaaaacagc

SEQ ID NO: 8252 - DNA, 21 bp, Artificial sequence
  SiRNA target sequence
attaccgtggtgaaaacagct

SEQ ID NO: 8253 - DNA, 21 bp, Artificial sequence
  SiRNA target sequence
ttaccgtggtgaaaacagctt

SEQ ID NO: 8254 - DNA, 21 bp, Artificial sequence
  SiRNA target sequence
taccgtggtgaaaacagcttt

SEQ ID NO: 8255 - DNA, 21 bp, Artificial sequence
  SiRNA target sequence
accgtggtgaaaacagctttt

SEQ ID NO: 8256 - DNA, 21 bp, Artificial sequence
  SiRNA target sequence
ccgtggtgaaaacagcttttc

SEQ ID NO: 8257 - DNA, 21 bp, Artificial sequence
  SiRNA target sequence
cgtggtgaaaacagcttttca

SEQ ID NO: 8258 - DNA, 21 bp, Artificial sequence
  SiRNA target sequence
gtggtgaaaacagcttttcat

SEQ ID NO: 8259 - DNA, 21 bp, Artificial sequence
  SiRNA target sequence
tggtgaaaacagcttttcata

SEQ ID NO: 8260 - DNA, 21 bp, Artificial sequence
  SiRNA target sequence
ggtgaaaacagcttttcatac

SEQ ID NO: 8261 - DNA, 21 bp, Artificial sequence
  SiRNA target sequence
gtgaaaacagcttttcatact

SEQ ID NO: 8262 - DNA, 21 bp, Artificial sequence
  SiRNA target sequence
tgaaaacagcttttcatactg

SEQ ID NO: 8263 - DNA, 21 bp, Artificial sequence
  SiRNA target sequence
gaaaacagcttttcatactgg

SEQ ID NO: 8264 - DNA, 21 bp, Artificial sequence
  SiRNA target sequence
aaaacagcttttcatactggc

SEQ ID NO: 8265 - DNA, 21 bp, Artificial sequence
  SiRNA target sequence
aaacagcttttcatactggca

SEQ ID NO: 8266 - DNA, 21 bp, Artificial sequence
  SiRNA target sequence
aacagcttttcatactggcag

SEQ ID NO: 8267 - DNA, 21 bp, Artificial sequence
  SiRNA target sequence
acagcttttcatactggcaga

SEQ ID NO: 8268 - DNA, 21 bp, Artificial sequence
  SiRNA target sequence
cagcttttcatactggcagac

SEQ ID NO: 8269 - DNA, 21 bp, Artificial sequence
  SiRNA target sequence
agcttttcatactggcagact

SEQ ID NO: 8270 - DNA, 21 bp, Artificial sequence
  SiRNA target sequence
gcttttcatactggcagactt

SEQ ID NO: 8271 - DNA, 21 bp, Artificial sequence
  SiRNA target sequence
cttttcatactggcagacttg

SEQ ID NO: 8272 - DNA, 21 bp, Artificial sequence
  SiRNA target sequence
ttttcatactggcagacttga

SEQ ID NO: 8273 - DNA, 21 bp, Artificial sequence
  SiRNA target sequence
tttcatactggcagacttgag

SEQ ID NO: 8274 - DNA, 21 bp, Artificial sequence
  SiRNA target sequence
ttcatactggcagacttgaga

SEQ ID NO: 8275 - DNA, 21 bp, Artificial sequence
  SiRNA target sequence
tcatactggcagacttgagat

SEQ ID NO: 8276 - DNA, 21 bp, Artificial sequence
  SiRNA target sequence
catactggcagacttgagatt

SEQ ID NO: 8277 - DNA, 21 bp, Artificial sequence
  SiRNA target sequence
atactggcagacttgagattt

SEQ ID NO: 8278 - DNA, 21 bp, Artificial sequence
  SiRNA target sequence
tactggcagacttgagatttt

SEQ ID NO: 8279 - DNA, 21 bp, Artificial sequence
  SiRNA target sequence
actggcagacttgagattttc

SEQ ID NO: 8280 - DNA, 21 bp, Artificial sequence
  SiRNA target sequence
ctggcagacttgagattttct

SEQ ID NO: 8281 - DNA, 21 bp, Artificial sequence
  SiRNA target sequence
tggcagacttgagattttctt

SEQ ID NO: 8282 - DNA, 21 bp, Artificial sequence
  SiRNA target sequence
ggcagacttgagattttcttt

SEQ ID NO: 8283 - DNA, 21 bp, Artificial sequence
  SiRNA target sequence
gcagacttgagattttctttg

SEQ ID NO: 8284 - DNA, 21 bp, Artificial sequence
  SiRNA target sequence
cagacttgagattttctttga

SEQ ID NO: 8285 - DNA, 21 bp, Artificial sequence
  SiRNA target sequence
agacttgagattttctttgaa

SEQ ID NO: 8286 - DNA, 21 bp, Artificial sequence
  SiRNA target sequence
gacttgagattttctttgaac

SEQ ID NO: 8287 - DNA, 21 bp, Artificial sequence
  SiRNA target sequence
acttgagattttctttgaacc

SEQ ID NO: 8288 - DNA, 21 bp, Artificial sequence
  SiRNA target sequence
cttgagattttctttgaacca

SEQ ID NO: 8289 - DNA, 21 bp, Artificial sequence
  SiRNA target sequence
ttgagattttctttgaaccag

SEQ ID NO: 8290 - DNA, 21 bp, Artificial sequence
  SiRNA target sequence
tgagattttctttgaaccagg

SEQ ID NO: 8291 - DNA, 21 bp, Artificial sequence
  SiRNA target sequence
gagattttctttgaaccagga

SEQ ID NO: 8292 - DNA, 21 bp, Artificial sequence
  SiRNA target sequence
agattttctttgaaccaggag

SEQ ID NO: 8293 - DNA, 21 bp, Artificial sequence
  SiRNA target sequence
gattttctttgaaccaggagt

SEQ ID NO: 8294 - DNA, 21 bp, Artificial sequence
  SiRNA target sequence
attttctttgaaccaggagtg

SEQ ID NO: 8295 - DNA, 21 bp, Artificial sequence
  SiRNA target sequence
ttttctttgaaccaggagtga

SEQ ID NO: 8296 - DNA, 21 bp, Artificial sequence
  SiRNA target sequence
tttctttgaaccaggagtgat

SEQ ID NO: 8297 - DNA, 21 bp, Artificial sequence
  SiRNA target sequence
ttctttgaaccaggagtgata

SEQ ID NO: 8298 - DNA, 21 bp, Artificial sequence
  SiRNA target sequence
tctttgaaccaggagtgatac

SEQ ID NO: 8299 - DNA, 21 bp, Artificial sequence
  SiRNA target sequence
ctttgaaccaggagtgatacc

SEQ ID NO: 8300 - DNA, 21 bp, Artificial sequence
  SiRNA target sequence
tttgaaccaggagtgataccc

SEQ ID NO: 8301 - DNA, 21 bp, Artificial sequence
  SiRNA target sequence
ttgaaccaggagtgatacccg

SEQ ID NO: 8302 - DNA, 21 bp, Artificial sequence
  SiRNA target sequence
tgaaccaggagtgatacccgt

SEQ ID NO: 8303 - DNA, 21 bp, Artificial sequence
  SiRNA target sequence
gaaccaggagtgatacccgtt

SEQ ID NO: 8304 - DNA, 21 bp, Artificial sequence
  SiRNA target sequence
aaccaggagtgatacccgtta

SEQ ID NO: 8305 - DNA, 21 bp, Artificial sequence
  SiRNA target sequence
accaggagtgatacccgttaa

SEQ ID NO: 8306 - DNA, 21 bp, Artificial sequence
  SiRNA target sequence
ccaggagtgatacccgttaaa

SEQ ID NO: 8307 - DNA, 21 bp, Artificial sequence
  SiRNA target sequence
caggagtgatacccgttaaac

SEQ ID NO: 8308 - DNA, 21 bp, Artificial sequence
  SiRNA target sequence
aggagtgatacccgttaaacc

SEQ ID NO: 8309 - DNA, 21 bp, Artificial sequence
  SiRNA target sequence
ggagtgatacccgttaaaccc

SEQ ID NO: 8310 - DNA, 21 bp, Artificial sequence
  SiRNA target sequence
gagtgatacccgttaaaccca

SEQ ID NO: 8311 - DNA, 21 bp, Artificial sequence
  SiRNA target sequence
agtgatacccgttaaacccac

SEQ ID NO: 8312 - DNA, 21 bp, Artificial sequence
  SiRNA target sequence
gtgatacccgttaaacccact

SEQ ID NO: 8313 - DNA, 21 bp, Artificial sequence
  SiRNA target sequence
tgatacccgttaaacccactg

SEQ ID NO: 8314 - DNA, 21 bp, Artificial sequence
  SiRNA target sequence
gatacccgttaaacccactgt

SEQ ID NO: 8315 - DNA, 21 bp, Artificial sequence
  SiRNA target sequence
atacccgttaaacccactgtt

SEQ ID NO: 8316 - DNA, 21 bp, Artificial sequence
  SiRNA target sequence
tacccgttaaacccactgtta

SEQ ID NO: 8317 - DNA, 21 bp, Artificial sequence
  SiRNA target sequence
acccgttaaacccactgttaa

SEQ ID NO: 8318 - DNA, 21 bp, Artificial sequence
  SiRNA target sequence
cccgttaaacccactgttaat

SEQ ID NO: 8319 - DNA, 21 bp, Artificial sequence
  SiRNA target sequence
ccgttaaacccactgttaata

SEQ ID NO: 8320 - DNA, 21 bp, Artificial sequence
  SiRNA target sequence
cgttaaacccactgttaataa

SEQ ID NO: 8321 - DNA, 21 bp, Artificial sequence
  SiRNA target sequence
gttaaacccactgttaataac

SEQ ID NO: 8322 - DNA, 21 bp, Artificial sequence
  SiRNA target sequence
ttaaacccactgttaataaca

SEQ ID NO: 8323 - DNA, 21 bp, Artificial sequence
  SiRNA target sequence
taaacccactgttaataacat

SEQ ID NO: 8324 - DNA, 21 bp, Artificial sequence
  SiRNA target sequence
aaacccactgttaataacatt

SEQ ID NO: 8325 - DNA, 21 bp, Artificial sequence
  SiRNA target sequence
aacccactgttaataacattg

SEQ ID NO: 8326 - DNA, 21 bp, Artificial sequence
  SiRNA target sequence
acccactgttaataacattgg

SEQ ID NO: 8327 - DNA, 21 bp, Artificial sequence
  SiRNA target sequence
cccactgttaataacattggg

SEQ ID NO: 8328 - DNA, 21 bp, Artificial sequence
  SiRNA target sequence
ccactgttaataacattgggc

SEQ ID NO: 8329 - DNA, 21 bp, Artificial sequence
  SiRNA target sequence
cactgttaataacattgggcc

SEQ ID NO: 8330 - DNA, 21 bp, Artificial sequence
  SiRNA target sequence
actgttaataacattgggcct

SEQ ID NO: 8331 - DNA, 21 bp, Artificial sequence
  SiRNA target sequence
ctgttaataacattgggcctg

SEQ ID NO: 8332 - DNA, 21 bp, Artificial sequence
  SiRNA target sequence
tgttaataacattgggcctga

SEQ ID NO: 8333 - DNA, 21 bp, Artificial sequence
  SiRNA target sequence
gttaataacattgggcctgat

SEQ ID NO: 8334 - DNA, 21 bp, Artificial sequence
  SiRNA target sequence
ttaataacattgggcctgatc

SEQ ID NO: 8335 - DNA, 21 bp, Artificial sequence
  SiRNA target sequence
taataacattgggcctgatca

SEQ ID NO: 8336 - DNA, 21 bp, Artificial sequence
  SiRNA target sequence
aataacattgggcctgatcag

SEQ ID NO: 8337 - DNA, 21 bp, Artificial sequence
  SiRNA target sequence
ataacattgggcctgatcagg

SEQ ID NO: 8338 - DNA, 21 bp, Artificial sequence
  SiRNA target sequence
taacattgggcctgatcagga

SEQ ID NO: 8339 - DNA, 21 bp, Artificial sequence
  SiRNA target sequence
aacattgggcctgatcaggat

SEQ ID NO: 8340 - DNA, 21 bp, Artificial sequence
  SiRNA target sequence
acattgggcctgatcaggatc

SEQ ID NO: 8341 - DNA, 21 bp, Artificial sequence
  SiRNA target sequence
cattgggcctgatcaggatca

SEQ ID NO: 8342 - DNA, 21 bp, Artificial sequence
  SiRNA target sequence
attgggcctgatcaggatcaa

SEQ ID NO: 8343 - DNA, 21 bp, Artificial sequence
  SiRNA target sequence
ttgggcctgatcaggatcaac

SEQ ID NO: 8344 - DNA, 21 bp, Artificial sequence
  SiRNA target sequence
tgggcctgatcaggatcaact

SEQ ID NO: 8345 - DNA, 21 bp, Artificial sequence
  SiRNA target sequence
gggcctgatcaggatcaactc

SEQ ID NO: 8346 - DNA, 21 bp, Artificial sequence
  SiRNA target sequence
ggcctgatcaggatcaactca

SEQ ID NO: 8347 - DNA, 21 bp, Artificial sequence
  SiRNA target sequence
gcctgatcaggatcaactcac

SEQ ID NO: 8348 - DNA, 21 bp, Artificial sequence
  SiRNA target sequence
cctgatcaggatcaactcaca

SEQ ID NO: 8349 - DNA, 21 bp, Artificial sequence
  SiRNA target sequence
ctgatcaggatcaactcacag

SEQ ID NO: 8350 - DNA, 21 bp, Artificial sequence
  SiRNA target sequence
tgatcaggatcaactcacagg

SEQ ID NO: 8351 - DNA, 21 bp, Artificial sequence
  SiRNA target sequence
gatcaggatcaactcacagga

SEQ ID NO: 8352 - DNA, 21 bp, Artificial sequence
  SiRNA target sequence
atcaggatcaactcacaggaa

SEQ ID NO: 8353 - DNA, 21 bp, Artificial sequence
  SiRNA target sequence
tcaggatcaactcacaggaac

SEQ ID NO: 8354 - DNA, 21 bp, Artificial sequence
  SiRNA target sequence
caggatcaactcacaggaacg

SEQ ID NO: 8355 - DNA, 21 bp, Artificial sequence
  SiRNA target sequence
aggatcaactcacaggaacgg

SEQ ID NO: 8356 - DNA, 21 bp, Artificial sequence
  SiRNA target sequence
ggatcaactcacaggaacggc

SEQ ID NO: 8357 - DNA, 21 bp, Artificial sequence
  SiRNA target sequence
gatcaactcacaggaacggcg

SEQ ID NO: 8358 - DNA, 21 bp, Artificial sequence
  SiRNA target sequence
atcaactcacaggaacggcgg

SEQ ID NO: 8359 - DNA, 21 bp, Artificial sequence
  SiRNA target sequence
tcaactcacaggaacggcggc

SEQ ID NO: 8360 - DNA, 21 bp, Artificial sequence
  SiRNA target sequence
caactcacaggaacggcggct

SEQ ID NO: 8361 - DNA, 21 bp, Artificial sequence
  SiRNA target sequence
aactcacaggaacggcggctc

SEQ ID NO: 8362 - DNA, 21 bp, Artificial sequence
  SiRNA target sequence
actcacaggaacggcggctcc

SEQ ID NO: 8363 - DNA, 21 bp, Artificial sequence
  SiRNA target sequence
ctcacaggaacggcggctcct

SEQ ID NO: 8364 - DNA, 21 bp, Artificial sequence
  SiRNA target sequence
tcacaggaacggcggctcctt

SEQ ID NO: 8365 - DNA, 21 bp, Artificial sequence
  SiRNA target sequence
cacaggaacggcggctccttc

SEQ ID NO: 8366 - DNA, 21 bp, Artificial sequence
  SiRNA target sequence
acaggaacggcggctccttcc

SEQ ID NO: 8367 - DNA, 21 bp, Artificial sequence
  SiRNA target sequence
caggaacggcggctccttccg

SEQ ID NO: 8368 - DNA, 21 bp, Artificial sequence
  SiRNA target sequence
aggaacggcggctccttccga

SEQ ID NO: 8369 - DNA, 21 bp, Artificial sequence
  SiRNA target sequence
ggaacggcggctccttccgat

SEQ ID NO: 8370 - DNA, 21 bp, Artificial sequence
  SiRNA target sequence
gaacggcggctccttccgata

SEQ ID NO: 8371 - DNA, 21 bp, Artificial sequence
  SiRNA target sequence
aacggcggctccttccgataa

SEQ ID NO: 8372 - DNA, 21 bp, Artificial sequence
  SiRNA target sequence
acggcggctccttccgataat

SEQ ID NO: 8373 - DNA, 21 bp, Artificial sequence
  SiRNA target sequence
cggcggctccttccgataata

SEQ ID NO: 8374 - DNA, 21 bp, Artificial sequence
  SiRNA target sequence
ggcggctccttccgataataa

SEQ ID NO: 8375 - DNA, 21 bp, Artificial sequence
  SiRNA target sequence
gcggctccttccgataataac

SEQ ID NO: 8376 - DNA, 21 bp, Artificial sequence
  SiRNA target sequence
cggctccttccgataataact

SEQ ID NO: 8377 - DNA, 21 bp, Artificial sequence
  SiRNA target sequence
ggctccttccgataataacta

SEQ ID NO: 8378 - DNA, 21 bp, Artificial sequence
  SiRNA target sequence
gctccttccgataataactat

SEQ ID NO: 8379 - DNA, 21 bp, Artificial sequence
  SiRNA target sequence
ctccttccgataataactata

SEQ ID NO: 8380 - DNA, 21 bp, Artificial sequence
  SiRNA target sequence
tccttccgataataactataa

SEQ ID NO: 8381 - DNA, 21 bp, Artificial sequence
  SiRNA target sequence
ccttccgataataactataag

SEQ ID NO: 8382 - DNA, 21 bp, Artificial sequence
  SiRNA target sequence
cttccgataataactataagt

SEQ ID NO: 8383 - DNA, 21 bp, Artificial sequence
  SiRNA target sequence
ttccgataataactataagta

SEQ ID NO: 8384 - DNA, 21 bp, Artificial sequence
  SiRNA target sequence
tccgataataactataagtac

SEQ ID NO: 8385 - DNA, 21 bp, Artificial sequence
  SiRNA target sequence
ccgataataactataagtaca

SEQ ID NO: 8386 - DNA, 21 bp, Artificial sequence
  SiRNA target sequence
cgataataactataagtacat

SEQ ID NO: 8387 - DNA, 21 bp, Artificial sequence
  SiRNA target sequence
gataataactataagtacatt

SEQ ID NO: 8388 - DNA, 21 bp, Artificial sequence
  SiRNA target sequence
ataataactataagtacattt

SEQ ID NO: 8389 - DNA, 21 bp, Artificial sequence
  SiRNA target sequence
taataactataagtacatttt

SEQ ID NO: 8390 - DNA, 21 bp, Artificial sequence
  SiRNA target sequence
aataactataagtacattttg

SEQ ID NO: 8391 - DNA, 21 bp, Artificial sequence
  SiRNA target sequence
ataactataagtacattttgg

SEQ ID NO: 8392 - DNA, 21 bp, Artificial sequence
  SiRNA target sequence
taactataagtacattttgga

SEQ ID NO: 8393 - DNA, 21 bp, Artificial sequence
  SiRNA target sequence
aactataagtacattttggac

SEQ ID NO: 8394 - DNA, 21 bp, Artificial sequence
  SiRNA target sequence
actataagtacattttggacc

SEQ ID NO: 8395 - DNA, 21 bp, Artificial sequence
  SiRNA target sequence
ctataagtacattttggacct

SEQ ID NO: 8396 - DNA, 21 bp, Artificial sequence
  SiRNA target sequence
tataagtacattttggacctg

SEQ ID NO: 8397 - DNA, 21 bp, Artificial sequence
  SiRNA target sequence
ataagtacattttggacctga

SEQ ID NO: 8398 - DNA, 21 bp, Artificial sequence
  SiRNA target sequence
taagtacattttggacctgac

SEQ ID NO: 8399 - DNA, 21 bp, Artificial sequence
  SiRNA target sequence
aagtacattttggacctgact

SEQ ID NO: 8400 - DNA, 21 bp, Artificial sequence
  SiRNA target sequence
agtacattttggacctgacta

SEQ ID NO: 8401 - DNA, 21 bp, Artificial sequence
  SiRNA target sequence
gtacattttggacctgactaa

SEQ ID NO: 8402 - DNA, 21 bp, Artificial sequence
  SiRNA target sequence
tacattttggacctgactaat

SEQ ID NO: 8403 - DNA, 21 bp, Artificial sequence
  SiRNA target sequence
acattttggacctgactaatg

SEQ ID NO: 8404 - DNA, 21 bp, Artificial sequence
  SiRNA target sequence
cattttggacctgactaatga

SEQ ID NO: 8405 - DNA, 21 bp, Artificial sequence
  SiRNA target sequence
attttggacctgactaatgat

SEQ ID NO: 8406 - DNA, 21 bp, Artificial sequence
  SiRNA target sequence
ttttggacctgactaatgata

SEQ ID NO: 8407 - DNA, 21 bp, Artificial sequence
  SiRNA target sequence
tttggacctgactaatgatac

SEQ ID NO: 8408 - DNA, 21 bp, Artificial sequence
  SiRNA target sequence
ttggacctgactaatgataca

SEQ ID NO: 8409 - DNA, 21 bp, Artificial sequence
  SiRNA target sequence
tggacctgactaatgatacag

SEQ ID NO: 8410 - DNA, 21 bp, Artificial sequence
  SiRNA target sequence
ggacctgactaatgatacaga

SEQ ID NO: 8411 - DNA, 21 bp, Artificial sequence
  SiRNA target sequence
gacctgactaatgatacagaa

SEQ ID NO: 8412 - DNA, 21 bp, Artificial sequence
  SiRNA target sequence
acctgactaatgatacagaag

SEQ ID NO: 8413 - DNA, 21 bp, Artificial sequence
  SiRNA target sequence
cctgactaatgatacagaagt

SEQ ID NO: 8414 - DNA, 21 bp, Artificial sequence
  SiRNA target sequence
ctgactaatgatacagaagtt

SEQ ID NO: 8415 - DNA, 21 bp, Artificial sequence
  SiRNA target sequence
tgactaatgatacagaagtta

SEQ ID NO: 8416 - DNA, 21 bp, Artificial sequence
  SiRNA target sequence
gactaatgatacagaagttac

SEQ ID NO: 8417 - DNA, 21 bp, Artificial sequence
  SiRNA target sequence
actaatgatacagaagttaca

SEQ ID NO: 8418 - DNA, 21 bp, Artificial sequence
  SiRNA target sequence
ctaatgatacagaagttacag

SEQ ID NO: 8419 - DNA, 21 bp, Artificial sequence
  SiRNA target sequence
taatgatacagaagttacagt

SEQ ID NO: 8420 - DNA, 21 bp, Artificial sequence
  SiRNA target sequence
aatgatacagaagttacagta

SEQ ID NO: 8421 - DNA, 21 bp, Artificial sequence
  SiRNA target sequence
atgatacagaagttacagtac

SEQ ID NO: 8422 - DNA, 21 bp, Artificial sequence
  SiRNA target sequence
tgatacagaagttacagtacg

SEQ ID NO: 8423 - DNA, 21 bp, Artificial sequence
  SiRNA target sequence
gatacagaagttacagtacgt

SEQ ID NO: 8424 - DNA, 21 bp, Artificial sequence
  SiRNA target sequence
atacagaagttacagtacgtg

SEQ ID NO: 8425 - DNA, 21 bp, Artificial sequence
  SiRNA target sequence
tacagaagttacagtacgtgt

SEQ ID NO: 8426 - DNA, 21 bp, Artificial sequence
  SiRNA target sequence
acagaagttacagtacgtgtt

SEQ ID NO: 8427 - DNA, 21 bp, Artificial sequence
  SiRNA target sequence
cagaagttacagtacgtgttc

SEQ ID NO: 8428 - DNA, 21 bp, Artificial sequence
  SiRNA target sequence
agaagttacagtacgtgttcc

SEQ ID NO: 8429 - DNA, 21 bp, Artificial sequence
  SiRNA target sequence
gaagttacagtacgtgttcct

SEQ ID NO: 8430 - DNA, 21 bp, Artificial sequence
  SiRNA target sequence
aagttacagtacgtgttcctt

SEQ ID NO: 8431 - DNA, 21 bp, Artificial sequence
  SiRNA target sequence
agttacagtacgtgttccttt

SEQ ID NO: 8432 - DNA, 21 bp, Artificial sequence
  SiRNA target sequence
gttacagtacgtgttcctttt

SEQ ID NO: 8433 - DNA, 21 bp, Artificial sequence
  SiRNA target sequence
ttacagtacgtgttccttttg

SEQ ID NO: 8434 - DNA, 21 bp, Artificial sequence
  SiRNA target sequence
tacagtacgtgttccttttgt

SEQ ID NO: 8435 - DNA, 21 bp, Artificial sequence
  SiRNA target sequence
acagtacgtgttccttttgtt

SEQ ID NO: 8436 - DNA, 21 bp, Artificial sequence
  SiRNA target sequence
cagtacgtgttccttttgttt

SEQ ID NO: 8437 - DNA, 21 bp, Artificial sequence
  SiRNA target sequence
agtacgtgttccttttgtttc

SEQ ID NO: 8438 - DNA, 21 bp, Artificial sequence
  SiRNA target sequence
gtacgtgttccttttgtttca

SEQ ID NO: 8439 - DNA, 21 bp, Artificial sequence
  SiRNA target sequence
tacgtgttccttttgtttcaa

SEQ ID NO: 8440 - DNA, 21 bp, Artificial sequence
  SiRNA target sequence
acgtgttccttttgtttcaaa

SEQ ID NO: 8441 - DNA, 21 bp, Artificial sequence
  SiRNA target sequence
cgtgttccttttgtttcaaat

SEQ ID NO: 8442 - DNA, 21 bp, Artificial sequence
  SiRNA target sequence
gtgttccttttgtttcaaata

SEQ ID NO: 8443 - DNA, 21 bp, Artificial sequence
  SiRNA target sequence
tgttccttttgtttcaaataa

SEQ ID NO: 8444 - DNA, 21 bp, Artificial sequence
  SiRNA target sequence
gttccttttgtttcaaataag

SEQ ID NO: 8445 - DNA, 21 bp, Artificial sequence
  SiRNA target sequence
ttccttttgtttcaaataaga

SEQ ID NO: 8446 - DNA, 21 bp, Artificial sequence
  SiRNA target sequence
tccttttgtttcaaataagat

SEQ ID NO: 8447 - DNA, 21 bp, Artificial sequence
  SiRNA target sequence
ccttttgtttcaaataagatg

SEQ ID NO: 8448 - DNA, 21 bp, Artificial sequence
  SiRNA target sequence
cttttgtttcaaataagatgt

SEQ ID NO: 8449 - DNA, 21 bp, Artificial sequence
  SiRNA target sequence
ttttgtttcaaataagatgtt

SEQ ID NO: 8450 - DNA, 21 bp, Artificial sequence
  SiRNA target sequence
tttgtttcaaataagatgttc

SEQ ID NO: 8451 - DNA, 21 bp, Artificial sequence
  SiRNA target sequence
ttgtttcaaataagatgttcc

SEQ ID NO: 8452 - DNA, 21 bp, Artificial sequence
  SiRNA target sequence
tgtttcaaataagatgttcct

SEQ ID NO: 8453 - DNA, 21 bp, Artificial sequence
  SiRNA target sequence
gtttcaaataagatgttcctt

SEQ ID NO: 8454 - DNA, 21 bp, Artificial sequence
  SiRNA target sequence
tttcaaataagatgttcctta

SEQ ID NO: 8455 - DNA, 21 bp, Artificial sequence
  SiRNA target sequence
ttcaaataagatgttccttaa

SEQ ID NO: 8456 - DNA, 21 bp, Artificial sequence
  SiRNA target sequence
tcaaataagatgttccttaag

SEQ ID NO: 8457 - DNA, 21 bp, Artificial sequence
  SiRNA target sequence
caaataagatgttccttaaga

SEQ ID NO: 8458 - DNA, 21 bp, Artificial sequence
  SiRNA target sequence
aaataagatgttccttaagac

SEQ ID NO: 8459 - DNA, 21 bp, Artificial sequence
  SiRNA target sequence
aataagatgttccttaagact

SEQ ID NO: 8460 - DNA, 21 bp, Artificial sequence
  SiRNA target sequence
ataagatgttccttaagactg

SEQ ID NO: 8461 - DNA, 21 bp, Artificial sequence
  SiRNA target sequence
taagatgttccttaagactgc

SEQ ID NO: 8462 - DNA, 21 bp, Artificial sequence
  SiRNA target sequence
aagatgttccttaagactgct

SEQ ID NO: 8463 - DNA, 21 bp, Artificial sequence
  SiRNA target sequence
agatgttccttaagactgctg

SEQ ID NO: 8464 - DNA, 21 bp, Artificial sequence
  SiRNA target sequence
gatgttccttaagactgctgg

SEQ ID NO: 8465 - DNA, 21 bp, Artificial sequence
  SiRNA target sequence
atgttccttaagactgctgga

SEQ ID NO: 8466 - DNA, 21 bp, Artificial sequence
  SiRNA target sequence
tgttccttaagactgctggaa

SEQ ID NO: 8467 - DNA, 21 bp, Artificial sequence
  SiRNA target sequence
gttccttaagactgctggaat

SEQ ID NO: 8468 - DNA, 21 bp, Artificial sequence
  SiRNA target sequence
ttccttaagactgctggaatc

SEQ ID NO: 8469 - DNA, 21 bp, Artificial sequence
  SiRNA target sequence
tccttaagactgctggaatct

SEQ ID NO: 8470 - DNA, 21 bp, Artificial sequence
  SiRNA target sequence
ccttaagactgctggaatcta

SEQ ID NO: 8471 - DNA, 21 bp, Artificial sequence
  SiRNA target sequence
cttaagactgctggaatctat

SEQ ID NO: 8472 - DNA, 21 bp, Artificial sequence
  SiRNA target sequence
ttaagactgctggaatctatg

SEQ ID NO: 8473 - DNA, 21 bp, Artificial sequence
  SiRNA target sequence
taagactgctggaatctatgg

SEQ ID NO: 8474 - DNA, 21 bp, Artificial sequence
  SiRNA target sequence
aagactgctggaatctatggt

SEQ ID NO: 8475 - DNA, 21 bp, Artificial sequence
  SiRNA target sequence
agactgctggaatctatggtg

SEQ ID NO: 8476 - DNA, 21 bp, Artificial sequence
  SiRNA target sequence
gactgctggaatctatggtgc

SEQ ID NO: 8477 - DNA, 21 bp, Artificial sequence
  SiRNA target sequence
actgctggaatctatggtgct

SEQ ID NO: 8478 - DNA, 21 bp, Artificial sequence
  SiRNA target sequence
ctgctggaatctatggtgcta

SEQ ID NO: 8479 - DNA, 21 bp, Artificial sequence
  SiRNA target sequence
tgctggaatctatggtgctaa

SEQ ID NO: 8480 - DNA, 21 bp, Artificial sequence
  SiRNA target sequence
gctggaatctatggtgctaac

SEQ ID NO: 8481 - DNA, 21 bp, Artificial sequence
  SiRNA target sequence
ctggaatctatggtgctaaca

SEQ ID NO: 8482 - DNA, 21 bp, Artificial sequence
  SiRNA target sequence
tggaatctatggtgctaacag

SEQ ID NO: 8483 - DNA, 21 bp, Artificial sequence
  SiRNA target sequence
ggaatctatggtgctaacagt

SEQ ID NO: 8484 - DNA, 21 bp, Artificial sequence
  SiRNA target sequence
gaatctatggtgctaacagtg

SEQ ID NO: 8485 - DNA, 21 bp, Artificial sequence
  SiRNA target sequence
aatctatggtgctaacagtga

SEQ ID NO: 8486 - DNA, 21 bp, Artificial sequence
  SiRNA target sequence
atctatggtgctaacagtgaa

SEQ ID NO: 8487 - DNA, 21 bp, Artificial sequence
  SiRNA target sequence
tctatggtgctaacagtgaaa

SEQ ID NO: 8488 - DNA, 21 bp, Artificial sequence
  SiRNA target sequence
ctatggtgctaacagtgaaaa

SEQ ID NO: 8489 - DNA, 21 bp, Artificial sequence
  SiRNA target sequence
tatggtgctaacagtgaaaat

SEQ ID NO: 8490 - DNA, 21 bp, Artificial sequence
  SiRNA target sequence
atggtgctaacagtgaaaata

SEQ ID NO: 8491 - DNA, 21 bp, Artificial sequence
  SiRNA target sequence
tggtgctaacagtgaaaataa

SEQ ID NO: 8492 - DNA, 21 bp, Artificial sequence
  SiRNA target sequence
ggtgctaacagtgaaaataac

SEQ ID NO: 8493 - DNA, 21 bp, Artificial sequence
  SiRNA target sequence
gtgctaacagtgaaaataact

SEQ ID NO: 8494 - DNA, 21 bp, Artificial sequence
  SiRNA target sequence
tgctaacagtgaaaataactg

SEQ ID NO: 8495 - DNA, 21 bp, Artificial sequence
  SiRNA target sequence
gctaacagtgaaaataactgg

SEQ ID NO: 8496 - DNA, 21 bp, Artificial sequence
  SiRNA target sequence
ctaacagtgaaaataactgga

SEQ ID NO: 8497 - DNA, 21 bp, Artificial sequence
  SiRNA target sequence
taacagtgaaaataactggaa

SEQ ID NO: 8498 - DNA, 21 bp, Artificial sequence
  SiRNA target sequence
aacagtgaaaataactggaac

SEQ ID NO: 8499 - DNA, 21 bp, Artificial sequence
  SiRNA target sequence
acagtgaaaataactggaact

SEQ ID NO: 8500 - DNA, 21 bp, Artificial sequence
  SiRNA target sequence
cagtgaaaataactggaactt

SEQ ID NO: 8501 - DNA, 21 bp, Artificial sequence
  SiRNA target sequence
agtgaaaataactggaacttt

SEQ ID NO: 8502 - DNA, 21 bp, Artificial sequence
  SiRNA target sequence
gtgaaaataactggaactttc

SEQ ID NO: 8503 - DNA, 21 bp, Artificial sequence
  SiRNA target sequence
tgaaaataactggaactttca

SEQ ID NO: 8504 - DNA, 21 bp, Artificial sequence
  SiRNA target sequence
gaaaataactggaactttcat

SEQ ID NO: 8505 - DNA, 21 bp, Artificial sequence
  SiRNA target sequence
aaaataactggaactttcatg

SEQ ID NO: 8506 - DNA, 21 bp, Artificial sequence
  SiRNA target sequence
aaataactggaactttcatga

SEQ ID NO: 8507 - DNA, 21 bp, Artificial sequence
  SiRNA target sequence
aataactggaactttcatgaa

SEQ ID NO: 8508 - DNA, 21 bp, Artificial sequence
  SiRNA target sequence
ataactggaactttcatgaat

SEQ ID NO: 8509 - DNA, 21 bp, Artificial sequence
  SiRNA target sequence
taactggaactttcatgaatc

SEQ ID NO: 8510 - DNA, 21 bp, Artificial sequence
  SiRNA target sequence
aactggaactttcatgaatcc

SEQ ID NO: 8511 - DNA, 21 bp, Artificial sequence
  SiRNA target sequence
actggaactttcatgaatcct

SEQ ID NO: 8512 - DNA, 21 bp, Artificial sequence
  SiRNA target sequence
ctggaactttcatgaatcctt

SEQ ID NO: 8513 - DNA, 21 bp, Artificial sequence
  SiRNA target sequence
tggaactttcatgaatccttt

SEQ ID NO: 8514 - DNA, 21 bp, Artificial sequence
  SiRNA target sequence
ggaactttcatgaatccttta

SEQ ID NO: 8515 - DNA, 21 bp, Artificial sequence
  SiRNA target sequence
gaactttcatgaatcctttag

SEQ ID NO: 8516 - DNA, 21 bp, Artificial sequence
  SiRNA target sequence
aactttcatgaatcctttagt

SEQ ID NO: 8517 - DNA, 21 bp, Artificial sequence
  SiRNA target sequence
actttcatgaatcctttagtg

SEQ ID NO: 8518 - DNA, 21 bp, Artificial sequence
  SiRNA target sequence
ctttcatgaatcctttagtgg

SEQ ID NO: 8519 - DNA, 21 bp, Artificial sequence
  SiRNA target sequence
tttcatgaatcctttagtgga

SEQ ID NO: 8520 - DNA, 21 bp, Artificial sequence
  SiRNA target sequence
ttcatgaatcctttagtggat

SEQ ID NO: 8521 - DNA, 21 bp, Artificial sequence
  SiRNA target sequence
tcatgaatcctttagtggatt

SEQ ID NO: 8522 - DNA, 21 bp, Artificial sequence
  SiRNA target sequence
catgaatcctttagtggattc

SEQ ID NO: 8523 - DNA, 21 bp, Artificial sequence
  SiRNA target sequence
atgaatcctttagtggattct

SEQ ID NO: 8524 - DNA, 21 bp, Artificial sequence
  SiRNA target sequence
tgaatcctttagtggattctt

SEQ ID NO: 8525 - DNA, 21 bp, Artificial sequence
  SiRNA target sequence
gaatcctttagtggattcttg

SEQ ID NO: 8526 - DNA, 21 bp, Artificial sequence
  SiRNA target sequence
aatcctttagtggattcttgt

SEQ ID NO: 8527 - DNA, 21 bp, Artificial sequence
  SiRNA target sequence
atcctttagtggattcttgtg

SEQ ID NO: 8528 - DNA, 21 bp, Artificial sequence
  SiRNA target sequence
tcctttagtggattcttgtgt

SEQ ID NO: 8529 - DNA, 21 bp, Artificial sequence
  SiRNA target sequence
cctttagtggattcttgtgta

SEQ ID NO: 8530 - DNA, 21 bp, Artificial sequence
  SiRNA target sequence
ctttagtggattcttgtgtat

SEQ ID NO: 8531 - DNA, 21 bp, Artificial sequence
  SiRNA target sequence
tttagtggattcttgtgtata

SEQ ID NO: 8532 - DNA, 21 bp, Artificial sequence
  SiRNA target sequence
ttagtggattcttgtgtataa

SEQ ID NO: 8533 - DNA, 21 bp, Artificial sequence
  SiRNA target sequence
tagtggattcttgtgtataag

SEQ ID NO: 8534 - DNA, 21 bp, Artificial sequence
  SiRNA target sequence
agtggattcttgtgtataaga

SEQ ID NO: 8535 - DNA, 21 bp, Artificial sequence
  SiRNA target sequence
gtggattcttgtgtataagac

SEQ ID NO: 8536 - DNA, 21 bp, Artificial sequence
  SiRNA target sequence
tggattcttgtgtataagacc

SEQ ID NO: 8537 - DNA, 21 bp, Artificial sequence
  SiRNA target sequence
ggattcttgtgtataagacca

SEQ ID NO: 8538 - DNA, 21 bp, Artificial sequence
  SiRNA target sequence
gattcttgtgtataagaccag

SEQ ID NO: 8539 - DNA, 21 bp, Artificial sequence
  SiRNA target sequence
attcttgtgtataagaccagt

SEQ ID NO: 8540 - DNA, 21 bp, Artificial sequence
  SiRNA target sequence
ttcttgtgtataagaccagtc

SEQ ID NO: 8541 - DNA, 21 bp, Artificial sequence
  SiRNA target sequence
tcttgtgtataagaccagtca

SEQ ID NO: 8542 - DNA, 21 bp, Artificial sequence
  SiRNA target sequence
cttgtgtataagaccagtcac

SEQ ID NO: 8543 - DNA, 21 bp, Artificial sequence
  SiRNA target sequence
ttgtgtataagaccagtcact

SEQ ID NO: 8544 - DNA, 21 bp, Artificial sequence
  SiRNA target sequence
tgtgtataagaccagtcacta

SEQ ID NO: 8545 - DNA, 21 bp, Artificial sequence
  SiRNA target sequence
gtgtataagaccagtcactaa

SEQ ID NO: 8546 - DNA, 21 bp, Artificial sequence
  SiRNA target sequence
tgtataagaccagtcactaaa

SEQ ID NO: 8547 - DNA, 21 bp, Artificial sequence
  SiRNA target sequence
gtataagaccagtcactaaat

SEQ ID NO: 8548 - DNA, 21 bp, Artificial sequence
  SiRNA target sequence
tataagaccagtcactaaatt

SEQ ID NO: 8549 - DNA, 21 bp, Artificial sequence
  SiRNA target sequence
ataagaccagtcactaaattg

SEQ ID NO: 8550 - DNA, 21 bp, Artificial sequence
  SiRNA target sequence
taagaccagtcactaaattga

SEQ ID NO: 8551 - DNA, 21 bp, Artificial sequence
  SiRNA target sequence
aagaccagtcactaaattgat

SEQ ID NO: 8552 - DNA, 21 bp, Artificial sequence
  SiRNA target sequence
agaccagtcactaaattgatg

SEQ ID NO: 8553 - DNA, 21 bp, Artificial sequence
  SiRNA target sequence
gaccagtcactaaattgatgg

SEQ ID NO: 8554 - DNA, 21 bp, Artificial sequence
  SiRNA target sequence
accagtcactaaattgatggc

SEQ ID NO: 8555 - DNA, 21 bp, Artificial sequence
  SiRNA target sequence
ccagtcactaaattgatggct

SEQ ID NO: 8556 - DNA, 21 bp, Artificial sequence
  SiRNA target sequence
cagtcactaaattgatggctc

SEQ ID NO: 8557 - DNA, 21 bp, Artificial sequence
  SiRNA target sequence
agtcactaaattgatggctcc

SEQ ID NO: 8558 - DNA, 21 bp, Artificial sequence
  SiRNA target sequence
gtcactaaattgatggctcct

SEQ ID NO: 8559 - DNA, 21 bp, Artificial sequence
  SiRNA target sequence
tcactaaattgatggctcctg

SEQ ID NO: 8560 - DNA, 21 bp, Artificial sequence
  SiRNA target sequence
cactaaattgatggctcctga

SEQ ID NO: 8561 - DNA, 21 bp, Artificial sequence
  SiRNA target sequence
actaaattgatggctcctgat

SEQ ID NO: 8562 - DNA, 21 bp, Artificial sequence
  SiRNA target sequence
ctaaattgatggctcctgata

SEQ ID NO: 8563 - DNA, 21 bp, Artificial sequence
  SiRNA target sequence
taaattgatggctcctgatac

SEQ ID NO: 8564 - DNA, 21 bp, Artificial sequence
  SiRNA target sequence
aaattgatggctcctgatact

SEQ ID NO: 8565 - DNA, 21 bp, Artificial sequence
  SiRNA target sequence
aattgatggctcctgatactg

SEQ ID NO: 8566 - DNA, 21 bp, Artificial sequence
  SiRNA target sequence
attgatggctcctgatactgt

SEQ ID NO: 8567 - DNA, 21 bp, Artificial sequence
  SiRNA target sequence
ttgatggctcctgatactgtg

SEQ ID NO: 8568 - DNA, 21 bp, Artificial sequence
  SiRNA target sequence
tgatggctcctgatactgtgt

SEQ ID NO: 8569 - DNA, 21 bp, Artificial sequence
  SiRNA target sequence
gatggctcctgatactgtgtc

SEQ ID NO: 8570 - DNA, 21 bp, Artificial sequence
  SiRNA target sequence
atggctcctgatactgtgtct

SEQ ID NO: 8571 - DNA, 21 bp, Artificial sequence
  SiRNA target sequence
tggctcctgatactgtgtctg

SEQ ID NO: 8572 - DNA, 21 bp, Artificial sequence
  SiRNA target sequence
ggctcctgatactgtgtctga

SEQ ID NO: 8573 - DNA, 21 bp, Artificial sequence
  SiRNA target sequence
gctcctgatactgtgtctgac

SEQ ID NO: 8574 - DNA, 21 bp, Artificial sequence
  SiRNA target sequence
ctcctgatactgtgtctgaca

SEQ ID NO: 8575 - DNA, 21 bp, Artificial sequence
  SiRNA target sequence
tcctgatactgtgtctgacaa

SEQ ID NO: 8576 - DNA, 21 bp, Artificial sequence
  SiRNA target sequence
cctgatactgtgtctgacaat

SEQ ID NO: 8577 - DNA, 21 bp, Artificial sequence
  SiRNA target sequence
ctgatactgtgtctgacaatg

SEQ ID NO: 8578 - DNA, 21 bp, Artificial sequence
  SiRNA target sequence
tgatactgtgtctgacaatgt

SEQ ID NO: 8579 - DNA, 21 bp, Artificial sequence
  SiRNA target sequence
gatactgtgtctgacaatgta

SEQ ID NO: 8580 - DNA, 21 bp, Artificial sequence
  SiRNA target sequence
atactgtgtctgacaatgtat

SEQ ID NO: 8581 - DNA, 21 bp, Artificial sequence
  SiRNA target sequence
tactgtgtctgacaatgtatc

SEQ ID NO: 8582 - DNA, 21 bp, Artificial sequence
  SiRNA target sequence
actgtgtctgacaatgtatct

SEQ ID NO: 8583 - DNA, 21 bp, Artificial sequence
  SiRNA target sequence
ctgtgtctgacaatgtatcta

SEQ ID NO: 8584 - DNA, 21 bp, Artificial sequence
  SiRNA target sequence
tgtgtctgacaatgtatctat

SEQ ID NO: 8585 - DNA, 21 bp, Artificial sequence
  SiRNA target sequence
gtgtctgacaatgtatctata

SEQ ID NO: 8586 - DNA, 21 bp, Artificial sequence
  SiRNA target sequence
tgtctgacaatgtatctatag

SEQ ID NO: 8587 - DNA, 21 bp, Artificial sequence
  SiRNA target sequence
gtctgacaatgtatctatagt

SEQ ID NO: 8588 - DNA, 21 bp, Artificial sequence
  SiRNA target sequence
tctgacaatgtatctatagtt

SEQ ID NO: 8589 - DNA, 21 bp, Artificial sequence
  SiRNA target sequence
ctgacaatgtatctatagttg

SEQ ID NO: 8590 - DNA, 21 bp, Artificial sequence
  SiRNA target sequence
tgacaatgtatctatagttgt

SEQ ID NO: 8591 - DNA, 21 bp, Artificial sequence
  SiRNA target sequence
gacaatgtatctatagttgtt

SEQ ID NO: 8592 - DNA, 21 bp, Artificial sequence
  SiRNA target sequence
acaatgtatctatagttgttt

SEQ ID NO: 8593 - DNA, 21 bp, Artificial sequence
  SiRNA target sequence
caatgtatctatagttgtttg

SEQ ID NO: 8594 - DNA, 21 bp, Artificial sequence
  SiRNA target sequence
aatgtatctatagttgtttgg

SEQ ID NO: 8595 - DNA, 21 bp, Artificial sequence
  SiRNA target sequence
atgtatctatagttgtttgga

SEQ ID NO: 8596 - DNA, 21 bp, Artificial sequence
  SiRNA target sequence
tgtatctatagttgtttggaa

SEQ ID NO: 8597 - DNA, 21 bp, Artificial sequence
  SiRNA target sequence
gtatctatagttgtttggaag

SEQ ID NO: 8598 - DNA, 21 bp, Artificial sequence
  SiRNA target sequence
tatctatagttgtttggaagt

SEQ ID NO: 8599 - DNA, 21 bp, Artificial sequence
  SiRNA target sequence
atctatagttgtttggaagtg

SEQ ID NO: 8600 - DNA, 21 bp, Artificial sequence
  SiRNA target sequence
tctatagttgtttggaagtgg

SEQ ID NO: 8601 - DNA, 21 bp, Artificial sequence
  SiRNA target sequence
ctatagttgtttggaagtggg

SEQ ID NO: 8602 - DNA, 21 bp, Artificial sequence
  SiRNA target sequence
tatagttgtttggaagtgggc

SEQ ID NO: 8603 - DNA, 21 bp, Artificial sequence
  SiRNA target sequence
atagttgtttggaagtgggca

SEQ ID NO: 8604 - DNA, 21 bp, Artificial sequence
  SiRNA target sequence
tagttgtttggaagtgggcag

SEQ ID NO: 8605 - DNA, 21 bp, Artificial sequence
  SiRNA target sequence
agttgtttggaagtgggcaga

SEQ ID NO: 8606 - DNA, 21 bp, Artificial sequence
  SiRNA target sequence
gttgtttggaagtgggcagaa

SEQ ID NO: 8607 - DNA, 21 bp, Artificial sequence
  SiRNA target sequence
ttgtttggaagtgggcagaag

SEQ ID NO: 8608 - DNA, 21 bp, Artificial sequence
  SiRNA target sequence
tgtttggaagtgggcagaaga

SEQ ID NO: 8609 - DNA, 21 bp, Artificial sequence
  SiRNA target sequence
gtttggaagtgggcagaagat

SEQ ID NO: 8610 - DNA, 21 bp, Artificial sequence
  SiRNA target sequence
tttggaagtgggcagaagatg

SEQ ID NO: 8611 - DNA, 21 bp, Artificial sequence
  SiRNA target sequence
ttggaagtgggcagaagatgt

SEQ ID NO: 8612 - DNA, 21 bp, Artificial sequence
  SiRNA target sequence
tggaagtgggcagaagatgta

SEQ ID NO: 8613 - DNA, 21 bp, Artificial sequence
  SiRNA target sequence
ggaagtgggcagaagatgtag

SEQ ID NO: 8614 - DNA, 21 bp, Artificial sequence
  SiRNA target sequence
gaagtgggcagaagatgtagt

SEQ ID NO: 8615 - DNA, 21 bp, Artificial sequence
  SiRNA target sequence
aagtgggcagaagatgtagta

SEQ ID NO: 8616 - DNA, 21 bp, Artificial sequence
  SiRNA target sequence
agtgggcagaagatgtagtag

SEQ ID NO: 8617 - DNA, 21 bp, Artificial sequence
  SiRNA target sequence
gtgggcagaagatgtagtagt

SEQ ID NO: 8618 - DNA, 21 bp, Artificial sequence
  SiRNA target sequence
tgggcagaagatgtagtagta

SEQ ID NO: 8619 - DNA, 21 bp, Artificial sequence
  SiRNA target sequence
gggcagaagatgtagtagtag

SEQ ID NO: 8620 - DNA, 21 bp, Artificial sequence
  SiRNA target sequence
ggcagaagatgtagtagtagt

SEQ ID NO: 8621 - DNA, 21 bp, Artificial sequence
  SiRNA target sequence
gcagaagatgtagtagtagta

SEQ ID NO: 8622 - DNA, 21 bp, Artificial sequence
  SiRNA target sequence
cagaagatgtagtagtagtag

SEQ ID NO: 8623 - DNA, 21 bp, Artificial sequence
  SiRNA target sequence
agaagatgtagtagtagtaga

SEQ ID NO: 8624 - DNA, 21 bp, Artificial sequence
  SiRNA target sequence
gaagatgtagtagtagtagaa

SEQ ID NO: 8625 - DNA, 21 bp, Artificial sequence
  SiRNA target sequence
aagatgtagtagtagtagaac

SEQ ID NO: 8626 - DNA, 21 bp, Artificial sequence
  SiRNA target sequence
agatgtagtagtagtagaacc

SEQ ID NO: 8627 - DNA, 21 bp, Artificial sequence
  SiRNA target sequence
gatgtagtagtagtagaaccg

SEQ ID NO: 8628 - DNA, 21 bp, Artificial sequence
  SiRNA target sequence
atgtagtagtagtagaaccga

SEQ ID NO: 8629 - DNA, 21 bp, Artificial sequence
  SiRNA target sequence
tgtagtagtagtagaaccgaa

SEQ ID NO: 8630 - DNA, 21 bp, Artificial sequence
  SiRNA target sequence
gtagtagtagtagaaccgaaa

SEQ ID NO: 8631 - DNA, 21 bp, Artificial sequence
  SiRNA target sequence
tagtagtagtagaaccgaaac

SEQ ID NO: 8632 - DNA, 21 bp, Artificial sequence
  SiRNA target sequence
agtagtagtagaaccgaaacc

SEQ ID NO: 8633 - DNA, 21 bp, Artificial sequence
  SiRNA target sequence
gtagtagtagaaccgaaacca

SEQ ID NO: 8634 - DNA, 21 bp, Artificial sequence
  SiRNA target sequence
tagtagtagaaccgaaaccat

SEQ ID NO: 8635 - DNA, 21 bp, Artificial sequence
  SiRNA target sequence
agtagtagaaccgaaaccatt

SEQ ID NO: 8636 - DNA, 21 bp, Artificial sequence
  SiRNA target sequence
gtagtagaaccgaaaccatta

SEQ ID NO: 8637 - DNA, 21 bp, Artificial sequence
  SiRNA target sequence
tagtagaaccgaaaccattaa

SEQ ID NO: 8638 - DNA, 21 bp, Artificial sequence
  SiRNA target sequence
agtagaaccgaaaccattaac

SEQ ID NO: 8639 - DNA, 21 bp, Artificial sequence
  SiRNA target sequence
gtagaaccgaaaccattaaca

SEQ ID NO: 8640 - DNA, 21 bp, Artificial sequence
  SiRNA target sequence
tagaaccgaaaccattaacat

SEQ ID NO: 8641 - DNA, 21 bp, Artificial sequence
  SiRNA target sequence
agaaccgaaaccattaacatc

SEQ ID NO: 8642 - DNA, 21 bp, Artificial sequence
  SiRNA target sequence
gaaccgaaaccattaacatcc

SEQ ID NO: 8643 - DNA, 21 bp, Artificial sequence
  SiRNA target sequence
aaccgaaaccattaacatccg

SEQ ID NO: 8644 - DNA, 21 bp, Artificial sequence
  SiRNA target sequence
accgaaaccattaacatccgg

SEQ ID NO: 8645 - DNA, 21 bp, Artificial sequence
  SiRNA target sequence
ccgaaaccattaacatccgga

SEQ ID NO: 8646 - DNA, 21 bp, Artificial sequence
  SiRNA target sequence
cgaaaccattaacatccggac

SEQ ID NO: 8647 - DNA, 21 bp, Artificial sequence
  SiRNA target sequence
gaaaccattaacatccggacc

SEQ ID NO: 8648 - DNA, 21 bp, Artificial sequence
  SiRNA target sequence
aaaccattaacatccggacca

SEQ ID NO: 8649 - DNA, 21 bp, Artificial sequence
  SiRNA target sequence
aaccattaacatccggaccaa

SEQ ID NO: 8650 - DNA, 21 bp, Artificial sequence
  SiRNA target sequence
accattaacatccggaccaac

SEQ ID NO: 8651 - DNA, 21 bp, Artificial sequence
  SiRNA target sequence
ccattaacatccggaccaacg

SEQ ID NO: 8652 - DNA, 21 bp, Artificial sequence
  SiRNA target sequence
cattaacatccggaccaacgc

SEQ ID NO: 8653 - DNA, 21 bp, Artificial sequence
  SiRNA target sequence
attaacatccggaccaacgca

SEQ ID NO: 8654 - DNA, 21 bp, Artificial sequence
  SiRNA target sequence
ttaacatccggaccaacgcaa

SEQ ID NO: 8655 - DNA, 21 bp, Artificial sequence
  SiRNA target sequence
taacatccggaccaacgcaag

SEQ ID NO: 8656 - DNA, 21 bp, Artificial sequence
  SiRNA target sequence
aacatccggaccaacgcaagt

SEQ ID NO: 8657 - DNA, 21 bp, Artificial sequence
  SiRNA target sequence
acatccggaccaacgcaagta

SEQ ID NO: 8658 - DNA, 21 bp, Artificial sequence
  SiRNA target sequence
catccggaccaacgcaagtat

SEQ ID NO: 8659 - DNA, 21 bp, Artificial sequence
  SiRNA target sequence
atccggaccaacgcaagtata

SEQ ID NO: 8660 - DNA, 21 bp, Artificial sequence
  SiRNA target sequence
tccggaccaacgcaagtatat

SEQ ID NO: 8661 - DNA, 21 bp, Artificial sequence
  SiRNA target sequence
ccggaccaacgcaagtatatc

SEQ ID NO: 8662 - DNA, 21 bp, Artificial sequence
  SiRNA target sequence
cggaccaacgcaagtatatcg

SEQ ID NO: 8663 - DNA, 21 bp, Artificial sequence
  SiRNA target sequence
ggaccaacgcaagtatatcga

SEQ ID NO: 8664 - DNA, 21 bp, Artificial sequence
  SiRNA target sequence
gaccaacgcaagtatatcgac

SEQ ID NO: 8665 - DNA, 21 bp, Artificial sequence
  SiRNA target sequence
accaacgcaagtatatcgacc

SEQ ID NO: 8666 - DNA, 21 bp, Artificial sequence
  SiRNA target sequence
ccaacgcaagtatatcgacca

SEQ ID NO: 8667 - DNA, 21 bp, Artificial sequence
  SiRNA target sequence
caacgcaagtatatcgaccac

SEQ ID NO: 8668 - DNA, 21 bp, Artificial sequence
  SiRNA target sequence
aacgcaagtatatcgaccacc

SEQ ID NO: 8669 - DNA, 21 bp, Artificial sequence
  SiRNA target sequence
acgcaagtatatcgaccaccc

SEQ ID NO: 8670 - DNA, 21 bp, Artificial sequence
  SiRNA target sequence
cgcaagtatatcgaccacccc

SEQ ID NO: 8671 - DNA, 21 bp, Artificial sequence
  SiRNA target sequence
gcaagtatatcgaccaccccc

SEQ ID NO: 8672 - DNA, 21 bp, Artificial sequence
  SiRNA target sequence
caagtatatcgaccaccccca

SEQ ID NO: 8673 - DNA, 21 bp, Artificial sequence
  SiRNA target sequence
aagtatatcgaccacccccaa

SEQ ID NO: 8674 - DNA, 21 bp, Artificial sequence
  SiRNA target sequence
agtatatcgaccacccccaac

SEQ ID NO: 8675 - DNA, 21 bp, Artificial sequence
  SiRNA target sequence
gtatatcgaccacccccaact

SEQ ID NO: 8676 - DNA, 21 bp, Artificial sequence
  SiRNA target sequence
tatatcgaccacccccaactg

SEQ ID NO: 8677 - DNA, 21 bp, Artificial sequence
  SiRNA target sequence
atatcgaccacccccaactgc

SEQ ID NO: 8678 - DNA, 21 bp, Artificial sequence
  SiRNA target sequence
tatcgaccacccccaactgct

SEQ ID NO: 8679 - DNA, 21 bp, Artificial sequence
  SiRNA target sequence
atcgaccacccccaactgctt

SEQ ID NO: 8680 - DNA, 21 bp, Artificial sequence
  SiRNA target sequence
tcgaccacccccaactgcttc

SEQ ID NO: 8681 - DNA, 21 bp, Artificial sequence
  SiRNA target sequence
cgaccacccccaactgcttca

SEQ ID NO: 8682 - DNA, 21 bp, Artificial sequence
  SiRNA target sequence
gaccacccccaactgcttcaa

SEQ ID NO: 8683 - DNA, 21 bp, Artificial sequence
  SiRNA target sequence
accacccccaactgcttcaac

SEQ ID NO: 8684 - DNA, 21 bp, Artificial sequence
  SiRNA target sequence
ccacccccaactgcttcaaca

SEQ ID NO: 8685 - DNA, 21 bp, Artificial sequence
  SiRNA target sequence
cacccccaactgcttcaacag

SEQ ID NO: 8686 - DNA, 21 bp, Artificial sequence
  SiRNA target sequence
acccccaactgcttcaacagc

SEQ ID NO: 8687 - DNA, 21 bp, Artificial sequence
  SiRNA target sequence
cccccaactgcttcaacagct

SEQ ID NO: 8688 - DNA, 21 bp, Artificial sequence
  SiRNA target sequence
ccccaactgcttcaacagctg

SEQ ID NO: 8689 - DNA, 21 bp, Artificial sequence
  SiRNA target sequence
cccaactgcttcaacagctgt

SEQ ID NO: 8690 - DNA, 21 bp, Artificial sequence
  SiRNA target sequence
ccaactgcttcaacagctgtt

SEQ ID NO: 8691 - DNA, 21 bp, Artificial sequence
  SiRNA target sequence
caactgcttcaacagctgttg

SEQ ID NO: 8692 - DNA, 21 bp, Artificial sequence
  SiRNA target sequence
aactgcttcaacagctgttga

SEQ ID NO: 8693 - DNA, 21 bp, Artificial sequence
  SiRNA target sequence
actgcttcaacagctgttgaa

SEQ ID NO: 8694 - DNA, 21 bp, Artificial sequence
  SiRNA target sequence
ctgcttcaacagctgttgaag

SEQ ID NO: 8695 - DNA, 21 bp, Artificial sequence
  SiRNA target sequence
tgcttcaacagctgttgaagt

SEQ ID NO: 8696 - DNA, 21 bp, Artificial sequence
  SiRNA target sequence
gcttcaacagctgttgaagtc

SEQ ID NO: 8697 - DNA, 21 bp, Artificial sequence
  SiRNA target sequence
cttcaacagctgttgaagtct

SEQ ID NO: 8698 - DNA, 21 bp, Artificial sequence
  SiRNA target sequence
ttcaacagctgttgaagtctt

SEQ ID NO: 8699 - DNA, 21 bp, Artificial sequence
  SiRNA target sequence
tcaacagctgttgaagtctta

SEQ ID NO: 8700 - DNA, 21 bp, Artificial sequence
  SiRNA target sequence
caacagctgttgaagtcttaa

SEQ ID NO: 8701 - DNA, 21 bp, Artificial sequence
  SiRNA target sequence
aacagctgttgaagtcttaaa

SEQ ID NO: 8702 - DNA, 21 bp, Artificial sequence
  SiRNA target sequence
acagctgttgaagtcttaaat

SEQ ID NO: 8703 - DNA, 21 bp, Artificial sequence
  SiRNA target sequence
cagctgttgaagtcttaaatg

SEQ ID NO: 8704 - DNA, 21 bp, Artificial sequence
  SiRNA target sequence
agctgttgaagtcttaaatgt

SEQ ID NO: 8705 - DNA, 21 bp, Artificial sequence
  SiRNA target sequence
gctgttgaagtcttaaatgta

SEQ ID NO: 8706 - DNA, 21 bp, Artificial sequence
  SiRNA target sequence
ctgttgaagtcttaaatgtag

SEQ ID NO: 8707 - DNA, 21 bp, Artificial sequence
  SiRNA target sequence
tgttgaagtcttaaatgtaga

SEQ ID NO: 8708 - DNA, 21 bp, Artificial sequence
  SiRNA target sequence
gttgaagtcttaaatgtagaa

SEQ ID NO: 8709 - DNA, 21 bp, Artificial sequence
  SiRNA target sequence
ttgaagtcttaaatgtagaac

SEQ ID NO: 8710 - DNA, 21 bp, Artificial sequence
  SiRNA target sequence
tgaagtcttaaatgtagaact

SEQ ID NO: 8711 - DNA, 21 bp, Artificial sequence
  SiRNA target sequence
gaagtcttaaatgtagaactt

SEQ ID NO: 8712 - DNA, 21 bp, Artificial sequence
  SiRNA target sequence
aagtcttaaatgtagaacttc

SEQ ID NO: 8713 - DNA, 21 bp, Artificial sequence
  SiRNA target sequence
agtcttaaatgtagaacttca

SEQ ID NO: 8714 - DNA, 21 bp, Artificial sequence
  SiRNA target sequence
gtcttaaatgtagaacttcaa

SEQ ID NO: 8715 - DNA, 21 bp, Artificial sequence
  SiRNA target sequence
tcttaaatgtagaacttcaaa

SEQ ID NO: 8716 - DNA, 21 bp, Artificial sequence
  SiRNA target sequence
cttaaatgtagaacttcaaat

SEQ ID NO: 8717 - DNA, 21 bp, Artificial sequence
  SiRNA target sequence
ttaaatgtagaacttcaaatt

SEQ ID NO: 8718 - DNA, 21 bp, Artificial sequence
  SiRNA target sequence
taaatgtagaacttcaaatta

SEQ ID NO: 8719 - DNA, 21 bp, Artificial sequence
  SiRNA target sequence
aaatgtagaacttcaaattaa

SEQ ID NO: 8720 - DNA, 21 bp, Artificial sequence
  SiRNA target sequence
aatgtagaacttcaaattaat

SEQ ID NO: 8721 - DNA, 21 bp, Artificial sequence
  SiRNA target sequence
atgtagaacttcaaattaata

SEQ ID NO: 8722 - DNA, 21 bp, Artificial sequence
  SiRNA target sequence
tgtagaacttcaaattaatat

SEQ ID NO: 8723 - DNA, 21 bp, Artificial sequence
  SiRNA target sequence
gtagaacttcaaattaatata

SEQ ID NO: 8724 - DNA, 21 bp, Artificial sequence
  SiRNA target sequence
tagaacttcaaattaatatag

SEQ ID NO: 8725 - DNA, 21 bp, Artificial sequence
  SiRNA target sequence
agaacttcaaattaatatagg

SEQ ID NO: 8726 - DNA, 21 bp, Artificial sequence
  SiRNA target sequence
gaacttcaaattaatataggt

SEQ ID NO: 8727 - DNA, 21 bp, Artificial sequence
  SiRNA target sequence
aacttcaaattaatataggta

SEQ ID NO: 8728 - DNA, 21 bp, Artificial sequence
  SiRNA target sequence
acttcaaattaatataggtaa

SEQ ID NO: 8729 - DNA, 21 bp, Artificial sequence
  SiRNA target sequence
cttcaaattaatataggtaat

SEQ ID NO: 8730 - DNA, 21 bp, Artificial sequence
  SiRNA target sequence
ttcaaattaatataggtaata

SEQ ID NO: 8731 - DNA, 21 bp, Artificial sequence
  SiRNA target sequence
tcaaattaatataggtaataa

SEQ ID NO: 8732 - DNA, 21 bp, Artificial sequence
  SiRNA target sequence
caaattaatataggtaataag

SEQ ID NO: 8733 - DNA, 21 bp, Artificial sequence
  SiRNA target sequence
aaattaatataggtaataaga

SEQ ID NO: 8734 - DNA, 21 bp, Artificial sequence
  SiRNA target sequence
aattaatataggtaataagac

SEQ ID NO: 8735 - DNA, 21 bp, Artificial sequence
  SiRNA target sequence
attaatataggtaataagact

SEQ ID NO: 8736 - DNA, 21 bp, Artificial sequence
  SiRNA target sequence
ttaatataggtaataagacta

SEQ ID NO: 8737 - DNA, 21 bp, Artificial sequence
  SiRNA target sequence
taatataggtaataagactaa

SEQ ID NO: 8738 - DNA, 21 bp, Artificial sequence
  SiRNA target sequence
aatataggtaataagactaac

SEQ ID NO: 8739 - DNA, 21 bp, Artificial sequence
  SiRNA target sequence
atataggtaataagactaacg

SEQ ID NO: 8740 - DNA, 21 bp, Artificial sequence
  SiRNA target sequence
tataggtaataagactaacga

SEQ ID NO: 8741 - DNA, 21 bp, Artificial sequence
  SiRNA target sequence
ataggtaataagactaacgaa

SEQ ID NO: 8742 - DNA, 21 bp, Artificial sequence
  SiRNA target sequence
taggtaataagactaacgaaa

SEQ ID NO: 8743 - DNA, 21 bp, Artificial sequence
  SiRNA target sequence
aggtaataagactaacgaaaa

SEQ ID NO: 8744 - DNA, 21 bp, Artificial sequence
  SiRNA target sequence
ggtaataagactaacgaaaat

SEQ ID NO: 8745 - DNA, 21 bp, Artificial sequence
  SiRNA target sequence
gtaataagactaacgaaaatg

SEQ ID NO: 8746 - DNA, 21 bp, Artificial sequence
  SiRNA target sequence
taataagactaacgaaaatgt

SEQ ID NO: 8747 - DNA, 21 bp, Artificial sequence
  SiRNA target sequence
aataagactaacgaaaatgta

SEQ ID NO: 8748 - DNA, 21 bp, Artificial sequence
  SiRNA target sequence
ataagactaacgaaaatgtaa

SEQ ID NO: 8749 - DNA, 21 bp, Artificial sequence
  SiRNA target sequence
taagactaacgaaaatgtaat

SEQ ID NO: 8750 - DNA, 21 bp, Artificial sequence
  SiRNA target sequence
aagactaacgaaaatgtaatc

SEQ ID NO: 8751 - DNA, 21 bp, Artificial sequence
  SiRNA target sequence
agactaacgaaaatgtaatct

SEQ ID NO: 8752 - DNA, 21 bp, Artificial sequence
  SiRNA target sequence
gactaacgaaaatgtaatctc

SEQ ID NO: 8753 - DNA, 21 bp, Artificial sequence
  SiRNA target sequence
actaacgaaaatgtaatctca

SEQ ID NO: 8754 - DNA, 21 bp, Artificial sequence
  SiRNA target sequence
ctaacgaaaatgtaatctcat

SEQ ID NO: 8755 - DNA, 21 bp, Artificial sequence
  SiRNA target sequence
taacgaaaatgtaatctcatt

SEQ ID NO: 8756 - DNA, 21 bp, Artificial sequence
  SiRNA target sequence
aacgaaaatgtaatctcattt

SEQ ID NO: 8757 - DNA, 21 bp, Artificial sequence
  SiRNA target sequence
acgaaaatgtaatctcatttt

SEQ ID NO: 8758 - DNA, 21 bp, Artificial sequence
  SiRNA target sequence
cgaaaatgtaatctcattttt

SEQ ID NO: 8759 - DNA, 21 bp, Artificial sequence
  SiRNA target sequence
gaaaatgtaatctcatttttt

SEQ ID NO: 8760 - DNA, 21 bp, Artificial sequence
  SiRNA target sequence
aaaatgtaatctcattttttg

SEQ ID NO: 8761 - DNA, 21 bp, Artificial sequence
  SiRNA target sequence
aaatgtaatctcattttttga

SEQ ID NO: 8762 - DNA, 21 bp, Artificial sequence
  SiRNA target sequence
aatgtaatctcattttttgac

SEQ ID NO: 8763 - DNA, 21 bp, Artificial sequence
  SiRNA target sequence
atgtaatctcattttttgact

SEQ ID NO: 8764 - DNA, 21 bp, Artificial sequence
  SiRNA target sequence
tgtaatctcattttttgactc

SEQ ID NO: 8765 - DNA, 21 bp, Artificial sequence
  SiRNA target sequence
gtaatctcattttttgactct

SEQ ID NO: 8766 - DNA, 21 bp, Artificial sequence
  SiRNA target sequence
taatctcattttttgactcta

SEQ ID NO: 8767 - DNA, 21 bp, Artificial sequence
  SiRNA target sequence
aatctcattttttgactctac

SEQ ID NO: 8768 - DNA, 21 bp, Artificial sequence
  SiRNA target sequence
atctcattttttgactctaca

SEQ ID NO: 8769 - DNA, 21 bp, Artificial sequence
  SiRNA target sequence
tctcattttttgactctacag

SEQ ID NO: 8770 - DNA, 21 bp, Artificial sequence
  SiRNA target sequence
ctcattttttgactctacaga

SEQ ID NO: 8771 - DNA, 21 bp, Artificial sequence
  SiRNA target sequence
tcattttttgactctacagat

SEQ ID NO: 8772 - DNA, 21 bp, Artificial sequence
  SiRNA target sequence
cattttttgactctacagatg

SEQ ID NO: 8773 - DNA, 21 bp, Artificial sequence
  SiRNA target sequence
attttttgactctacagatgc

SEQ ID NO: 8774 - DNA, 21 bp, Artificial sequence
  SiRNA target sequence
ttttttgactctacagatgct

SEQ ID NO: 8775 - DNA, 21 bp, Artificial sequence
  SiRNA target sequence
tttttgactctacagatgctg

SEQ ID NO: 8776 - DNA, 21 bp, Artificial sequence
  SiRNA target sequence
ttttgactctacagatgctga

SEQ ID NO: 8777 - DNA, 21 bp, Artificial sequence
  SiRNA target sequence
tttgactctacagatgctgaa

SEQ ID NO: 8778 - DNA, 21 bp, Artificial sequence
  SiRNA target sequence
ttgactctacagatgctgaaa

SEQ ID NO: 8779 - DNA, 21 bp, Artificial sequence
  SiRNA target sequence
tgactctacagatgctgaaac

SEQ ID NO: 8780 - DNA, 21 bp, Artificial sequence
  SiRNA target sequence
gactctacagatgctgaaaca

SEQ ID NO: 8781 - DNA, 21 bp, Artificial sequence
  SiRNA target sequence
actctacagatgctgaaacac

SEQ ID NO: 8782 - DNA, 21 bp, Artificial sequence
  SiRNA target sequence
ctctacagatgctgaaacaca

SEQ ID NO: 8783 - DNA, 21 bp, Artificial sequence
  SiRNA target sequence
tctacagatgctgaaacacaa

SEQ ID NO: 8784 - DNA, 21 bp, Artificial sequence
  SiRNA target sequence
ctacagatgctgaaacacaaa

SEQ ID NO: 8785 - DNA, 21 bp, Artificial sequence
  SiRNA target sequence
tacagatgctgaaacacaaaa

SEQ ID NO: 8786 - DNA, 21 bp, Artificial sequence
  SiRNA target sequence
acagatgctgaaacacaaaat

SEQ ID NO: 8787 - DNA, 21 bp, Artificial sequence
  SiRNA target sequence
cagatgctgaaacacaaaatc

SEQ ID NO: 8788 - DNA, 21 bp, Artificial sequence
  SiRNA target sequence
agatgctgaaacacaaaatca

SEQ ID NO: 8789 - DNA, 21 bp, Artificial sequence
  SiRNA target sequence
gatgctgaaacacaaaatcac

SEQ ID NO: 8790 - DNA, 21 bp, Artificial sequence
  SiRNA target sequence
atgctgaaacacaaaatcaca

SEQ ID NO: 8791 - DNA, 21 bp, Artificial sequence
  SiRNA target sequence
tgctgaaacacaaaatcacaa

SEQ ID NO: 8792 - DNA, 21 bp, Artificial sequence
  SiRNA target sequence
gctgaaacacaaaatcacaac

SEQ ID NO: 8793 - DNA, 21 bp, Artificial sequence
  SiRNA target sequence
ctgaaacacaaaatcacaacg

SEQ ID NO: 8794 - DNA, 21 bp, Artificial sequence
  SiRNA target sequence
tgaaacacaaaatcacaacgc

SEQ ID NO: 8795 - DNA, 21 bp, Artificial sequence
  SiRNA target sequence
gaaacacaaaatcacaacgct

SEQ ID NO: 8796 - DNA, 21 bp, Artificial sequence
  SiRNA target sequence
aaacacaaaatcacaacgctt

SEQ ID NO: 8797 - DNA, 21 bp, Artificial sequence
  SiRNA target sequence
aacacaaaatcacaacgcttt

SEQ ID NO: 8798 - DNA, 21 bp, Artificial sequence
  SiRNA target sequence
acacaaaatcacaacgcttta

SEQ ID NO: 8799 - DNA, 21 bp, Artificial sequence
  SiRNA target sequence
cacaaaatcacaacgctttaa

SEQ ID NO: 8800 - DNA, 21 bp, Artificial sequence
  SiRNA target sequence
acaaaatcacaacgctttaat

SEQ ID NO: 8801 - DNA, 21 bp, Artificial sequence
  SiRNA target sequence
caaaatcacaacgctttaatg

SEQ ID NO: 8802 - DNA, 21 bp, Artificial sequence
  SiRNA target sequence
aaaatcacaacgctttaatga

SEQ ID NO: 8803 - DNA, 21 bp, Artificial sequence
  SiRNA target sequence
aaatcacaacgctttaatgaa

SEQ ID NO: 8804 - DNA, 21 bp, Artificial sequence
  SiRNA target sequence
aatcacaacgctttaatgaaa

SEQ ID NO: 8805 - DNA, 21 bp, Artificial sequence
  SiRNA target sequence
atcacaacgctttaatgaaag

SEQ ID NO: 8806 - DNA, 21 bp, Artificial sequence
  SiRNA target sequence
tcacaacgctttaatgaaagg

SEQ ID NO: 8807 - DNA, 21 bp, Artificial sequence
  SiRNA target sequence
cacaacgctttaatgaaagga

SEQ ID NO: 8808 - DNA, 21 bp, Artificial sequence
  SiRNA target sequence
acaacgctttaatgaaaggat

SEQ ID NO: 8809 - DNA, 21 bp, Artificial sequence
  SiRNA target sequence
caacgctttaatgaaaggatg

SEQ ID NO: 8810 - DNA, 21 bp, Artificial sequence
  SiRNA target sequence
aacgctttaatgaaaggatgt

SEQ ID NO: 8811 - DNA, 21 bp, Artificial sequence
  SiRNA target sequence
acgctttaatgaaaggatgtg

SEQ ID NO: 8812 - DNA, 21 bp, Artificial sequence
  SiRNA target sequence
cgctttaatgaaaggatgtgg

SEQ ID NO: 8813 - DNA, 21 bp, Artificial sequence
  SiRNA target sequence
gctttaatgaaaggatgtggt

SEQ ID NO: 8814 - DNA, 21 bp, Artificial sequence
  SiRNA target sequence
ctttaatgaaaggatgtggtg

SEQ ID NO: 8815 - DNA, 21 bp, Artificial sequence
  SiRNA target sequence
tttaatgaaaggatgtggtga

SEQ ID NO: 8816 - DNA, 21 bp, Artificial sequence
  SiRNA target sequence
ttaatgaaaggatgtggtgag

SEQ ID NO: 8817 - DNA, 21 bp, Artificial sequence
  SiRNA target sequence
taatgaaaggatgtggtgagt

SEQ ID NO: 8818 - DNA, 21 bp, Artificial sequence
  SiRNA target sequence
aatgaaaggatgtggtgagtt

SEQ ID NO: 8819 - DNA, 21 bp, Artificial sequence
  SiRNA target sequence
atgaaaggatgtggtgagttt

SEQ ID NO: 8820 - DNA, 21 bp, Artificial sequence
  SiRNA target sequence
tgaaaggatgtggtgagttta

SEQ ID NO: 8821 - DNA, 21 bp, Artificial sequence
  SiRNA target sequence
gaaaggatgtggtgagtttat

SEQ ID NO: 8822 - DNA, 21 bp, Artificial sequence
  SiRNA target sequence
aaaggatgtggtgagtttatt

SEQ ID NO: 8823 - DNA, 21 bp, Artificial sequence
  SiRNA target sequence
aaggatgtggtgagtttattg

SEQ ID NO: 8824 - DNA, 21 bp, Artificial sequence
  SiRNA target sequence
aggatgtggtgagtttattgt

SEQ ID NO: 8825 - DNA, 21 bp, Artificial sequence
  SiRNA target sequence
ggatgtggtgagtttattgta

SEQ ID NO: 8826 - DNA, 21 bp, Artificial sequence
  SiRNA target sequence
gatgtggtgagtttattgtaa

SEQ ID NO: 8827 - DNA, 21 bp, Artificial sequence
  SiRNA target sequence
atgtggtgagtttattgtaaa

SEQ ID NO: 8828 - DNA, 21 bp, Artificial sequence
  SiRNA target sequence
tgtggtgagtttattgtaaac

SEQ ID NO: 8829 - DNA, 21 bp, Artificial sequence
  SiRNA target sequence
gtggtgagtttattgtaaact

SEQ ID NO: 8830 - DNA, 21 bp, Artificial sequence
  SiRNA target sequence
tggtgagtttattgtaaactt

SEQ ID NO: 8831 - DNA, 21 bp, Artificial sequence
  SiRNA target sequence
ggtgagtttattgtaaacttg

SEQ ID NO: 8832 - DNA, 21 bp, Artificial sequence
  SiRNA target sequence
gtgagtttattgtaaacttgc

SEQ ID NO: 8833 - DNA, 21 bp, Artificial sequence
  SiRNA target sequence
tgagtttattgtaaacttgcg

SEQ ID NO: 8834 - DNA, 21 bp, Artificial sequence
  SiRNA target sequence
gagtttattgtaaacttgcga

SEQ ID NO: 8835 - DNA, 21 bp, Artificial sequence
  SiRNA target sequence
agtttattgtaaacttgcgaa

SEQ ID NO: 8836 - DNA, 21 bp, Artificial sequence
  SiRNA target sequence
gtttattgtaaacttgcgaac

SEQ ID NO: 8837 - DNA, 21 bp, Artificial sequence
  SiRNA target sequence
tttattgtaaacttgcgaact

SEQ ID NO: 8838 - DNA, 21 bp, Artificial sequence
  SiRNA target sequence
ttattgtaaacttgcgaactc

SEQ ID NO: 8839 - DNA, 21 bp, Artificial sequence
  SiRNA target sequence
tattgtaaacttgcgaactct

SEQ ID NO: 8840 - DNA, 21 bp, Artificial sequence
  SiRNA target sequence
attgtaaacttgcgaactctt

SEQ ID NO: 8841 - DNA, 21 bp, Artificial sequence
  SiRNA target sequence
ttgtaaacttgcgaactcttc

SEQ ID NO: 8842 - DNA, 21 bp, Artificial sequence
  SiRNA target sequence
tgtaaacttgcgaactcttct

SEQ ID NO: 8843 - DNA, 21 bp, Artificial sequence
  SiRNA target sequence
gtaaacttgcgaactcttctc

SEQ ID NO: 8844 - DNA, 21 bp, Artificial sequence
  SiRNA target sequence
taaacttgcgaactcttctca

SEQ ID NO: 8845 - DNA, 21 bp, Artificial sequence
  SiRNA target sequence
aaacttgcgaactcttctcag

SEQ ID NO: 8846 - DNA, 21 bp, Artificial sequence
  SiRNA target sequence
aacttgcgaactcttctcaga

SEQ ID NO: 8847 - DNA, 21 bp, Artificial sequence
  SiRNA target sequence
acttgcgaactcttctcagaa

SEQ ID NO: 8848 - DNA, 21 bp, Artificial sequence
  SiRNA target sequence
cttgcgaactcttctcagaac

SEQ ID NO: 8849 - DNA, 21 bp, Artificial sequence
  SiRNA target sequence
ttgcgaactcttctcagaacc

SEQ ID NO: 8850 - DNA, 21 bp, Artificial sequence
  SiRNA target sequence
tgcgaactcttctcagaacct

SEQ ID NO: 8851 - DNA, 21 bp, Artificial sequence
  SiRNA target sequence
gcgaactcttctcagaacctt

SEQ ID NO: 8852 - DNA, 21 bp, Artificial sequence
  SiRNA target sequence
cgaactcttctcagaaccttt

SEQ ID NO: 8853 - DNA, 21 bp, Artificial sequence
  SiRNA target sequence
gaactcttctcagaaccttta

SEQ ID NO: 8854 - DNA, 21 bp, Artificial sequence
  SiRNA target sequence
aactcttctcagaacctttag

SEQ ID NO: 8855 - DNA, 21 bp, Artificial sequence
  SiRNA target sequence
actcttctcagaacctttaga

SEQ ID NO: 8856 - DNA, 21 bp, Artificial sequence
  SiRNA target sequence
ctcttctcagaacctttagaa

SEQ ID NO: 8857 - DNA, 21 bp, Artificial sequence
  SiRNA target sequence
tcttctcagaacctttagaac

SEQ ID NO: 8858 - DNA, 21 bp, Artificial sequence
  SiRNA target sequence
cttctcagaacctttagaaca

SEQ ID NO: 8859 - DNA, 21 bp, Artificial sequence
  SiRNA target sequence
ttctcagaacctttagaacaa

SEQ ID NO: 8860 - DNA, 21 bp, Artificial sequence
  SiRNA target sequence
tctcagaacctttagaacaat

SEQ ID NO: 8861 - DNA, 21 bp, Artificial sequence
  SiRNA target sequence
ctcagaacctttagaacaata

SEQ ID NO: 8862 - DNA, 21 bp, Artificial sequence
  SiRNA target sequence
tcagaacctttagaacaataa

SEQ ID NO: 8863 - DNA, 21 bp, Artificial sequence
  SiRNA target sequence
cagaacctttagaacaataac

SEQ ID NO: 8864 - DNA, 21 bp, Artificial sequence
  SiRNA target sequence
agaacctttagaacaataaca

SEQ ID NO: 8865 - DNA, 21 bp, Artificial sequence
  SiRNA target sequence
gaacctttagaacaataacag

SEQ ID NO: 8866 - DNA, 21 bp, Artificial sequence
  SiRNA target sequence
aacctttagaacaataacaga

SEQ ID NO: 8867 - DNA, 21 bp, Artificial sequence
  SiRNA target sequence
acctttagaacaataacagat

SEQ ID NO: 8868 - DNA, 21 bp, Artificial sequence
  SiRNA target sequence
cctttagaacaataacagata

SEQ ID NO: 8869 - DNA, 21 bp, Artificial sequence
  SiRNA target sequence
ctttagaacaataacagataa

SEQ ID NO: 8870 - DNA, 21 bp, Artificial sequence
  SiRNA target sequence
tttagaacaataacagataat

SEQ ID NO: 8871 - DNA, 21 bp, Artificial sequence
  SiRNA target sequence
ttagaacaataacagataatt

SEQ ID NO: 8872 - DNA, 21 bp, Artificial sequence
  SiRNA target sequence
tagaacaataacagataattg

SEQ ID NO: 8873 - DNA, 21 bp, Artificial sequence
  SiRNA target sequence
agaacaataacagataattgg

SEQ ID NO: 8874 - DNA, 21 bp, Artificial sequence
  SiRNA target sequence
gaacaataacagataattgga

SEQ ID NO: 8875 - DNA, 21 bp, Artificial sequence
  SiRNA target sequence
aacaataacagataattggat

SEQ ID NO: 8876 - DNA, 21 bp, Artificial sequence
  SiRNA target sequence
acaataacagataattggata

SEQ ID NO: 8877 - DNA, 21 bp, Artificial sequence
  SiRNA target sequence
caataacagataattggatat

SEQ ID NO: 8878 - DNA, 21 bp, Artificial sequence
  SiRNA target sequence
aataacagataattggatatt

SEQ ID NO: 8879 - DNA, 21 bp, Artificial sequence
  SiRNA target sequence
ataacagataattggatatta

SEQ ID NO: 8880 - DNA, 21 bp, Artificial sequence
  SiRNA target sequence
taacagataattggatattac

SEQ ID NO: 8881 - DNA, 21 bp, Artificial sequence
  SiRNA target sequence
aacagataattggatattaca

SEQ ID NO: 8882 - DNA, 21 bp, Artificial sequence
  SiRNA target sequence
acagataattggatattacaa

SEQ ID NO: 8883 - DNA, 21 bp, Artificial sequence
  SiRNA target sequence
cagataattggatattacaag

SEQ ID NO: 8884 - DNA, 21 bp, Artificial sequence
  SiRNA target sequence
agataattggatattacaagc

SEQ ID NO: 8885 - DNA, 21 bp, Artificial sequence
  SiRNA target sequence
gataattggatattacaagct

SEQ ID NO: 8886 - DNA, 21 bp, Artificial sequence
  SiRNA target sequence
ataattggatattacaagcta

SEQ ID NO: 8887 - DNA, 21 bp, Artificial sequence
  SiRNA target sequence
taattggatattacaagctaa

SEQ ID NO: 8888 - DNA, 21 bp, Artificial sequence
  SiRNA target sequence
aattggatattacaagctaat

SEQ ID NO: 8889 - DNA, 21 bp, Artificial sequence
  SiRNA target sequence
attggatattacaagctaata

SEQ ID NO: 8890 - DNA, 21 bp, Artificial sequence
  SiRNA target sequence
ttggatattacaagctaatac

SEQ ID NO: 8891 - DNA, 21 bp, Artificial sequence
  SiRNA target sequence
tggatattacaagctaatacc

SEQ ID NO: 8892 - DNA, 21 bp, Artificial sequence
  SiRNA target sequence
ggatattacaagctaatacca

SEQ ID NO: 8893 - DNA, 21 bp, Artificial sequence
  SiRNA target sequence
gatattacaagctaataccaa

SEQ ID NO: 8894 - DNA, 21 bp, Artificial sequence
  SiRNA target sequence
atattacaagctaataccaag

SEQ ID NO: 8895 - DNA, 21 bp, Artificial sequence
  SiRNA target sequence
tattacaagctaataccaaga

SEQ ID NO: 8896 - DNA, 21 bp, Artificial sequence
  SiRNA target sequence
attacaagctaataccaagac

SEQ ID NO: 8897 - DNA, 21 bp, Artificial sequence
  SiRNA target sequence
ttacaagctaataccaagaca

SEQ ID NO: 8898 - DNA, 21 bp, Artificial sequence
  SiRNA target sequence
tacaagctaataccaagacac

SEQ ID NO: 8899 - DNA, 21 bp, Artificial sequence
  SiRNA target sequence
acaagctaataccaagacacc

SEQ ID NO: 8900 - DNA, 21 bp, Artificial sequence
  SiRNA target sequence
caagctaataccaagacacca

SEQ ID NO: 8901 - DNA, 21 bp, Artificial sequence
  SiRNA target sequence
aagctaataccaagacaccaa

SEQ ID NO: 8902 - DNA, 21 bp, Artificial sequence
  SiRNA target sequence
agctaataccaagacaccaat

SEQ ID NO: 8903 - DNA, 21 bp, Artificial sequence
  SiRNA target sequence
gctaataccaagacaccaatc

SEQ ID NO: 8904 - DNA, 21 bp, Artificial sequence
  SiRNA target sequence
ctaataccaagacaccaatca

SEQ ID NO: 8905 - DNA, 21 bp, Artificial sequence
  SiRNA target sequence
taataccaagacaccaatcac

SEQ ID NO: 8906 - DNA, 21 bp, Artificial sequence
  SiRNA target sequence
aataccaagacaccaatcacg

SEQ ID NO: 8907 - DNA, 21 bp, Artificial sequence
  SiRNA target sequence
ataccaagacaccaatcacgg

SEQ ID NO: 8908 - DNA, 21 bp, Artificial sequence
  SiRNA target sequence
taccaagacaccaatcacgga

SEQ ID NO: 8909 - DNA, 21 bp, Artificial sequence
  SiRNA target sequence
accaagacaccaatcacggac

SEQ ID NO: 8910 - DNA, 21 bp, Artificial sequence
  SiRNA target sequence
ccaagacaccaatcacggacc

SEQ ID NO: 8911 - DNA, 21 bp, Artificial sequence
  SiRNA target sequence
caagacaccaatcacggacct

SEQ ID NO: 8912 - DNA, 21 bp, Artificial sequence
  SiRNA target sequence
aagacaccaatcacggacctc

SEQ ID NO: 8913 - DNA, 21 bp, Artificial sequence
  SiRNA target sequence
agacaccaatcacggacctca

SEQ ID NO: 8914 - DNA, 21 bp, Artificial sequence
  SiRNA target sequence
gacaccaatcacggacctcac

SEQ ID NO: 8915 - DNA, 21 bp, Artificial sequence
  SiRNA target sequence
acaccaatcacggacctcaca

SEQ ID NO: 8916 - DNA, 21 bp, Artificial sequence
  SiRNA target sequence
caccaatcacggacctcacaa

SEQ ID NO: 8917 - DNA, 21 bp, Artificial sequence
  SiRNA target sequence
accaatcacggacctcacaaa

SEQ ID NO: 8918 - DNA, 21 bp, Artificial sequence
  SiRNA target sequence
ccaatcacggacctcacaaac

SEQ ID NO: 8919 - DNA, 21 bp, Artificial sequence
  SiRNA target sequence
caatcacggacctcacaaaca

SEQ ID NO: 8920 - DNA, 21 bp, Artificial sequence
  SiRNA target sequence
aatcacggacctcacaaacac

SEQ ID NO: 8921 - DNA, 21 bp, Artificial sequence
  SiRNA target sequence
atcacggacctcacaaacacc

SEQ ID NO: 8922 - DNA, 21 bp, Artificial sequence
  SiRNA target sequence
tcacggacctcacaaacacca

SEQ ID NO: 8923 - DNA, 21 bp, Artificial sequence
  SiRNA target sequence
cacggacctcacaaacaccac

SEQ ID NO: 8924 - DNA, 21 bp, Artificial sequence
  SiRNA target sequence
acggacctcacaaacaccaca

SEQ ID NO: 8925 - DNA, 21 bp, Artificial sequence
  SiRNA target sequence
cggacctcacaaacaccacag

SEQ ID NO: 8926 - DNA, 21 bp, Artificial sequence
  SiRNA target sequence
ggacctcacaaacaccacaga

SEQ ID NO: 8927 - DNA, 21 bp, Artificial sequence
  SiRNA target sequence
gacctcacaaacaccacagat

SEQ ID NO: 8928 - DNA, 21 bp, Artificial sequence
  SiRNA target sequence
acctcacaaacaccacagatg

SEQ ID NO: 8929 - DNA, 21 bp, Artificial sequence
  SiRNA target sequence
cctcacaaacaccacagatgc

SEQ ID NO: 8930 - DNA, 21 bp, Artificial sequence
  SiRNA target sequence
ctcacaaacaccacagatgct

SEQ ID NO: 8931 - DNA, 21 bp, Artificial sequence
  SiRNA target sequence
tcacaaacaccacagatgctc

SEQ ID NO: 8932 - DNA, 21 bp, Artificial sequence
  SiRNA target sequence
cacaaacaccacagatgctca

SEQ ID NO: 8933 - DNA, 21 bp, Artificial sequence
  SiRNA target sequence
acaaacaccacagatgctcag

SEQ ID NO: 8934 - DNA, 21 bp, Artificial sequence
  SiRNA target sequence
caaacaccacagatgctcagg

SEQ ID NO: 8935 - DNA, 21 bp, Artificial sequence
  SiRNA target sequence
aaacaccacagatgctcaggg

SEQ ID NO: 8936 - DNA, 21 bp, Artificial sequence
  SiRNA target sequence
aacaccacagatgctcagggt

SEQ ID NO: 8937 - DNA, 21 bp, Artificial sequence
  SiRNA target sequence
acaccacagatgctcagggtc

SEQ ID NO: 8938 - DNA, 21 bp, Artificial sequence
  SiRNA target sequence
caccacagatgctcagggtcg

SEQ ID NO: 8939 - DNA, 21 bp, Artificial sequence
  SiRNA target sequence
accacagatgctcagggtcga

SEQ ID NO: 8940 - DNA, 21 bp, Artificial sequence
  SiRNA target sequence
ccacagatgctcagggtcgag

SEQ ID NO: 8941 - DNA, 21 bp, Artificial sequence
  SiRNA target sequence
cacagatgctcagggtcgaga

SEQ ID NO: 8942 - DNA, 21 bp, Artificial sequence
  SiRNA target sequence
acagatgctcagggtcgagac

SEQ ID NO: 8943 - DNA, 21 bp, Artificial sequence
  SiRNA target sequence
cagatgctcagggtcgagact

SEQ ID NO: 8944 - DNA, 21 bp, Artificial sequence
  SiRNA target sequence
agatgctcagggtcgagacta

SEQ ID NO: 8945 - DNA, 21 bp, Artificial sequence
  SiRNA target sequence
gatgctcagggtcgagactat

SEQ ID NO: 8946 - DNA, 21 bp, Artificial sequence
  SiRNA target sequence
atgctcagggtcgagactata

SEQ ID NO: 8947 - DNA, 21 bp, Artificial sequence
  SiRNA target sequence
tgctcagggtcgagactatat

SEQ ID NO: 8948 - DNA, 21 bp, Artificial sequence
  SiRNA target sequence
gctcagggtcgagactatatg

SEQ ID NO: 8949 - DNA, 21 bp, Artificial sequence
  SiRNA target sequence
ctcagggtcgagactatatgt

SEQ ID NO: 8950 - DNA, 21 bp, Artificial sequence
  SiRNA target sequence
tcagggtcgagactatatgtc

SEQ ID NO: 8951 - DNA, 21 bp, Artificial sequence
  SiRNA target sequence
cagggtcgagactatatgtct

SEQ ID NO: 8952 - DNA, 21 bp, Artificial sequence
  SiRNA target sequence
agggtcgagactatatgtctt

SEQ ID NO: 8953 - DNA, 21 bp, Artificial sequence
  SiRNA target sequence
gggtcgagactatatgtctta

SEQ ID NO: 8954 - DNA, 21 bp, Artificial sequence
  SiRNA target sequence
ggtcgagactatatgtcttac

SEQ ID NO: 8955 - DNA, 21 bp, Artificial sequence
  SiRNA target sequence
gtcgagactatatgtcttacc

SEQ ID NO: 8956 - DNA, 21 bp, Artificial sequence
  SiRNA target sequence
tcgagactatatgtcttacct

SEQ ID NO: 8957 - DNA, 21 bp, Artificial sequence
  SiRNA target sequence
cgagactatatgtcttacctg

SEQ ID NO: 8958 - DNA, 21 bp, Artificial sequence
  SiRNA target sequence
gagactatatgtcttacctgt

SEQ ID NO: 8959 - DNA, 21 bp, Artificial sequence
  SiRNA target sequence
agactatatgtcttacctgtc

SEQ ID NO: 8960 - DNA, 21 bp, Artificial sequence
  SiRNA target sequence
gactatatgtcttacctgtcc

SEQ ID NO: 8961 - DNA, 21 bp, Artificial sequence
  SiRNA target sequence
actatatgtcttacctgtcct

SEQ ID NO: 8962 - DNA, 21 bp, Artificial sequence
  SiRNA target sequence
ctatatgtcttacctgtccta

SEQ ID NO: 8963 - DNA, 21 bp, Artificial sequence
  SiRNA target sequence
tatatgtcttacctgtcctat

SEQ ID NO: 8964 - DNA, 21 bp, Artificial sequence
  SiRNA target sequence
atatgtcttacctgtcctatt

SEQ ID NO: 8965 - DNA, 21 bp, Artificial sequence
  SiRNA target sequence
tatgtcttacctgtcctattt

SEQ ID NO: 8966 - DNA, 21 bp, Artificial sequence
  SiRNA target sequence
atgtcttacctgtcctattta

SEQ ID NO: 8967 - DNA, 21 bp, Artificial sequence
  SiRNA target sequence
tgtcttacctgtcctatttat

SEQ ID NO: 8968 - DNA, 21 bp, Artificial sequence
  SiRNA target sequence
gtcttacctgtcctatttata

SEQ ID NO: 8969 - DNA, 21 bp, Artificial sequence
  SiRNA target sequence
tcttacctgtcctatttatac

SEQ ID NO: 8970 - DNA, 21 bp, Artificial sequence
  SiRNA target sequence
cttacctgtcctatttatacc

SEQ ID NO: 8971 - DNA, 21 bp, Artificial sequence
  SiRNA target sequence
ttacctgtcctatttataccg

SEQ ID NO: 8972 - DNA, 21 bp, Artificial sequence
  SiRNA target sequence
tacctgtcctatttataccga

SEQ ID NO: 8973 - DNA, 21 bp, Artificial sequence
  SiRNA target sequence
acctgtcctatttataccgat

SEQ ID NO: 8974 - DNA, 21 bp, Artificial sequence
  SiRNA target sequence
cctgtcctatttataccgatt

SEQ ID NO: 8975 - DNA, 21 bp, Artificial sequence
  SiRNA target sequence
ctgtcctatttataccgattt

SEQ ID NO: 8976 - DNA, 21 bp, Artificial sequence
  SiRNA target sequence
tgtcctatttataccgatttt

SEQ ID NO: 8977 - DNA, 21 bp, Artificial sequence
  SiRNA target sequence
gtcctatttataccgatttta

SEQ ID NO: 8978 - DNA, 21 bp, Artificial sequence
  SiRNA target sequence
tcctatttataccgattttat

SEQ ID NO: 8979 - DNA, 21 bp, Artificial sequence
  SiRNA target sequence
cctatttataccgattttatc

SEQ ID NO: 8980 - DNA, 21 bp, Artificial sequence
  SiRNA target sequence
ctatttataccgattttatcg

SEQ ID NO: 8981 - DNA, 21 bp, Artificial sequence
  SiRNA target sequence
tatttataccgattttatcga

SEQ ID NO: 8982 - DNA, 21 bp, Artificial sequence
  SiRNA target sequence
atttataccgattttatcgag

SEQ ID NO: 8983 - DNA, 21 bp, Artificial sequence
  SiRNA target sequence
tttataccgattttatcgagg

SEQ ID NO: 8984 - DNA, 21 bp, Artificial sequence
  SiRNA target sequence
ttataccgattttatcgagga

SEQ ID NO: 8985 - DNA, 21 bp, Artificial sequence
  SiRNA target sequence
tataccgattttatcgaggag

SEQ ID NO: 8986 - DNA, 21 bp, Artificial sequence
  SiRNA target sequence
ataccgattttatcgaggagg

SEQ ID NO: 8987 - DNA, 21 bp, Artificial sequence
  SiRNA target sequence
taccgattttatcgaggaggt

SEQ ID NO: 8988 - DNA, 21 bp, Artificial sequence
  SiRNA target sequence
accgattttatcgaggaggtc

SEQ ID NO: 8989 - DNA, 21 bp, Artificial sequence
  SiRNA target sequence
ccgattttatcgaggaggtcg

SEQ ID NO: 8990 - DNA, 21 bp, Artificial sequence
  SiRNA target sequence
cgattttatcgaggaggtcgg

SEQ ID NO: 8991 - DNA, 21 bp, Artificial sequence
  SiRNA target sequence
gattttatcgaggaggtcggc

SEQ ID NO: 8992 - DNA, 21 bp, Artificial sequence
  SiRNA target sequence
attttatcgaggaggtcggcg

SEQ ID NO: 8993 - DNA, 21 bp, Artificial sequence
  SiRNA target sequence
ttttatcgaggaggtcggcgt

SEQ ID NO: 8994 - DNA, 21 bp, Artificial sequence
  SiRNA target sequence
tttatcgaggaggtcggcgtt

SEQ ID NO: 8995 - DNA, 21 bp, Artificial sequence
  SiRNA target sequence
ttatcgaggaggtcggcgtta

SEQ ID NO: 8996 - DNA, 21 bp, Artificial sequence
  SiRNA target sequence
tatcgaggaggtcggcgttat

SEQ ID NO: 8997 - DNA, 21 bp, Artificial sequence
  SiRNA target sequence
atcgaggaggtcggcgttata

SEQ ID NO: 8998 - DNA, 21 bp, Artificial sequence
  SiRNA target sequence
tcgaggaggtcggcgttataa

SEQ ID NO: 8999 - DNA, 21 bp, Artificial sequence
  SiRNA target sequence
cgaggaggtcggcgttataaa

SEQ ID NO: 9000 - DNA, 21 bp, Artificial sequence
  SiRNA target sequence
gaggaggtcggcgttataaat

SEQ ID NO: 9001 - DNA, 21 bp, Artificial sequence
  SiRNA target sequence
aggaggtcggcgttataaatt

SEQ ID NO: 9002 - DNA, 21 bp, Artificial sequence
  SiRNA target sequence
ggaggtcggcgttataaattc

SEQ ID NO: 9003 - DNA, 21 bp, Artificial sequence
  SiRNA target sequence
gaggtcggcgttataaattct

SEQ ID NO: 9004 - DNA, 21 bp, Artificial sequence
  SiRNA target sequence
aggtcggcgttataaattctt

SEQ ID NO: 9005 - DNA, 21 bp, Artificial sequence
  SiRNA target sequence
ggtcggcgttataaattcttt

SEQ ID NO: 9006 - DNA, 21 bp, Artificial sequence
  SiRNA target sequence
gtcggcgttataaattcttta

SEQ ID NO: 9007 - DNA, 21 bp, Artificial sequence
  SiRNA target sequence
tcggcgttataaattctttaa

SEQ ID NO: 9008 - DNA, 21 bp, Artificial sequence
  SiRNA target sequence
cggcgttataaattctttaat

SEQ ID NO: 9009 - DNA, 21 bp, Artificial sequence
  SiRNA target sequence
ggcgttataaattctttaata

SEQ ID NO: 9010 - DNA, 21 bp, Artificial sequence
  SiRNA target sequence
gcgttataaattctttaatac

SEQ ID NO: 9011 - DNA, 21 bp, Artificial sequence
  SiRNA target sequence
cgttataaattctttaatacc

SEQ ID NO: 9012 - DNA, 21 bp, Artificial sequence
  SiRNA target sequence
gttataaattctttaatacca

SEQ ID NO: 9013 - DNA, 21 bp, Artificial sequence
  SiRNA target sequence
ttataaattctttaataccac

SEQ ID NO: 9014 - DNA, 21 bp, Artificial sequence
  SiRNA target sequence
tataaattctttaataccacc

SEQ ID NO: 9015 - DNA, 21 bp, Artificial sequence
  SiRNA target sequence
ataaattctttaataccaccc

SEQ ID NO: 9016 - DNA, 21 bp, Artificial sequence
  SiRNA target sequence
taaattctttaataccacccc

SEQ ID NO: 9017 - DNA, 21 bp, Artificial sequence
  SiRNA target sequence
aaattctttaataccacccct

SEQ ID NO: 9018 - DNA, 21 bp, Artificial sequence
  SiRNA target sequence
aattctttaataccacccctc

SEQ ID NO: 9019 - DNA, 21 bp, Artificial sequence
  SiRNA target sequence
attctttaataccacccctct

SEQ ID NO: 9020 - DNA, 21 bp, Artificial sequence
  SiRNA target sequence
ttctttaataccacccctctc

SEQ ID NO: 9021 - DNA, 21 bp, Artificial sequence
  SiRNA target sequence
tctttaataccacccctctca

SEQ ID NO: 9022 - DNA, 21 bp, Artificial sequence
  SiRNA target sequence
ctttaataccacccctctcaa

SEQ ID NO: 9023 - DNA, 21 bp, Artificial sequence
  SiRNA target sequence
tttaataccacccctctcaaa

SEQ ID NO: 9024 - DNA, 21 bp, Artificial sequence
  SiRNA target sequence
ttaataccacccctctcaaac

SEQ ID NO: 9025 - DNA, 21 bp, Artificial sequence
  SiRNA target sequence
taataccacccctctcaaaca

SEQ ID NO: 9026 - DNA, 21 bp, Artificial sequence
  SiRNA target sequence
aataccacccctctcaaacaa

SEQ ID NO: 9027 - DNA, 21 bp, Artificial sequence
  SiRNA target sequence
ataccacccctctcaaacaat

SEQ ID NO: 9028 - DNA, 21 bp, Artificial sequence
  SiRNA target sequence
taccacccctctcaaacaatc

SEQ ID NO: 9029 - DNA, 21 bp, Artificial sequence
  SiRNA target sequence
accacccctctcaaacaatct

SEQ ID NO: 9030 - DNA, 21 bp, Artificial sequence
  SiRNA target sequence
ccacccctctcaaacaatctc

SEQ ID NO: 9031 - DNA, 21 bp, Artificial sequence
  SiRNA target sequence
cacccctctcaaacaatctca

SEQ ID NO: 9032 - DNA, 21 bp, Artificial sequence
  SiRNA target sequence
acccctctcaaacaatctcaa

SEQ ID NO: 9033 - DNA, 21 bp, Artificial sequence
  SiRNA target sequence
cccctctcaaacaatctcaaa

SEQ ID NO: 9034 - DNA, 21 bp, Artificial sequence
  SiRNA target sequence
ccctctcaaacaatctcaaac

SEQ ID NO: 9035 - DNA, 21 bp, Artificial sequence
  SiRNA target sequence
cctctcaaacaatctcaaaca

SEQ ID NO: 9036 - DNA, 21 bp, Artificial sequence
  SiRNA target sequence
ctctcaaacaatctcaaacat

SEQ ID NO: 9037 - DNA, 21 bp, Artificial sequence
  SiRNA target sequence
tctcaaacaatctcaaacatg

SEQ ID NO: 9038 - DNA, 21 bp, Artificial sequence
  SiRNA target sequence
ctcaaacaatctcaaacatgc

SEQ ID NO: 9039 - DNA, 21 bp, Artificial sequence
  SiRNA target sequence
tcaaacaatctcaaacatgct

SEQ ID NO: 9040 - DNA, 21 bp, Artificial sequence
  SiRNA target sequence
caaacaatctcaaacatgcta

SEQ ID NO: 9041 - DNA, 21 bp, Artificial sequence
  SiRNA target sequence
aaacaatctcaaacatgctat

SEQ ID NO: 9042 - DNA, 21 bp, Artificial sequence
  SiRNA target sequence
aacaatctcaaacatgctata

SEQ ID NO: 9043 - DNA, 21 bp, Artificial sequence
  SiRNA target sequence
acaatctcaaacatgctatat

SEQ ID NO: 9044 - DNA, 21 bp, Artificial sequence
  SiRNA target sequence
caatctcaaacatgctatata

SEQ ID NO: 9045 - DNA, 21 bp, Artificial sequence
  SiRNA target sequence
aatctcaaacatgctatataa

SEQ ID NO: 9046 - DNA, 21 bp, Artificial sequence
  SiRNA target sequence
atctcaaacatgctatataag

SEQ ID NO: 9047 - DNA, 21 bp, Artificial sequence
  SiRNA target sequence
tctcaaacatgctatataaga

SEQ ID NO: 9048 - DNA, 21 bp, Artificial sequence
  SiRNA target sequence
ctcaaacatgctatataagaa

SEQ ID NO: 9049 - DNA, 21 bp, Artificial sequence
  SiRNA target sequence
tcaaacatgctatataagaag

SEQ ID NO: 9050 - DNA, 21 bp, Artificial sequence
  SiRNA target sequence
caaacatgctatataagaagc

SEQ ID NO: 9051 - DNA, 21 bp, Artificial sequence
  SiRNA target sequence
aaacatgctatataagaagct

SEQ ID NO: 9052 - DNA, 21 bp, Artificial sequence
  SiRNA target sequence
aacatgctatataagaagctt

SEQ ID NO: 9053 - DNA, 21 bp, Artificial sequence
  SiRNA target sequence
acatgctatataagaagcttt

SEQ ID NO: 9054 - DNA, 21 bp, Artificial sequence
  SiRNA target sequence
catgctatataagaagctttc

SEQ ID NO: 9055 - DNA, 21 bp, Artificial sequence
  SiRNA target sequence
atgctatataagaagctttct

SEQ ID NO: 9056 - DNA, 21 bp, Artificial sequence
  SiRNA target sequence
tgctatataagaagctttctt

SEQ ID NO: 9057 - DNA, 21 bp, Artificial sequence
  SiRNA target sequence
gctatataagaagctttctta

SEQ ID NO: 9058 - DNA, 21 bp, Artificial sequence
  SiRNA target sequence
ctatataagaagctttcttat

SEQ ID NO: 9059 - DNA, 21 bp, Artificial sequence
  SiRNA target sequence
tatataagaagctttcttata

SEQ ID NO: 9060 - DNA, 21 bp, Artificial sequence
  SiRNA target sequence
atataagaagctttcttatac

SEQ ID NO: 9061 - DNA, 21 bp, Artificial sequence
  SiRNA target sequence
tataagaagctttcttatacc

SEQ ID NO: 9062 - DNA, 21 bp, Artificial sequence
  SiRNA target sequence
ataagaagctttcttatacca

SEQ ID NO: 9063 - DNA, 21 bp, Artificial sequence
  SiRNA target sequence
taagaagctttcttataccac

SEQ ID NO: 9064 - DNA, 21 bp, Artificial sequence
  SiRNA target sequence
aagaagctttcttataccacg

SEQ ID NO: 9065 - DNA, 21 bp, Artificial sequence
  SiRNA target sequence
agaagctttcttataccacgt

SEQ ID NO: 9066 - DNA, 21 bp, Artificial sequence
  SiRNA target sequence
gaagctttcttataccacgta

SEQ ID NO: 9067 - DNA, 21 bp, Artificial sequence
  SiRNA target sequence
aagctttcttataccacgtaa

SEQ ID NO: 9068 - DNA, 21 bp, Artificial sequence
  SiRNA target sequence
agctttcttataccacgtaat

SEQ ID NO: 9069 - DNA, 21 bp, Artificial sequence
  SiRNA target sequence
gctttcttataccacgtaatt

SEQ ID NO: 9070 - DNA, 21 bp, Artificial sequence
  SiRNA target sequence
ctttcttataccacgtaatta

SEQ ID NO: 9071 - DNA, 21 bp, Artificial sequence
  SiRNA target sequence
tttcttataccacgtaattac

SEQ ID NO: 9072 - DNA, 21 bp, Artificial sequence
  SiRNA target sequence
ttcttataccacgtaattact

SEQ ID NO: 9073 - DNA, 21 bp, Artificial sequence
  SiRNA target sequence
tcttataccacgtaattactc

SEQ ID NO: 9074 - DNA, 21 bp, Artificial sequence
  SiRNA target sequence
cttataccacgtaattactca

SEQ ID NO: 9075 - DNA, 21 bp, Artificial sequence
  SiRNA target sequence
ttataccacgtaattactcag

SEQ ID NO: 9076 - DNA, 21 bp, Artificial sequence
  SiRNA target sequence
tataccacgtaattactcagc

SEQ ID NO: 9077 - DNA, 21 bp, Artificial sequence
  SiRNA target sequence
ataccacgtaattactcagct

SEQ ID NO: 9078 - DNA, 21 bp, Artificial sequence
  SiRNA target sequence
taccacgtaattactcagctg

SEQ ID NO: 9079 - DNA, 21 bp, Artificial sequence
  SiRNA target sequence
accacgtaattactcagctga

SEQ ID NO: 9080 - DNA, 21 bp, Artificial sequence
  SiRNA target sequence
ccacgtaattactcagctgat

SEQ ID NO: 9081 - DNA, 21 bp, Artificial sequence
  SiRNA target sequence
cacgtaattactcagctgatg

SEQ ID NO: 9082 - DNA, 21 bp, Artificial sequence
  SiRNA target sequence
acgtaattactcagctgatga

SEQ ID NO: 9083 - DNA, 21 bp, Artificial sequence
  SiRNA target sequence
cgtaattactcagctgatgaa

SEQ ID NO: 9084 - DNA, 21 bp, Artificial sequence
  SiRNA target sequence
gtaattactcagctgatgaaa

SEQ ID NO: 9085 - DNA, 21 bp, Artificial sequence
  SiRNA target sequence
taattactcagctgatgaaat

SEQ ID NO: 9086 - DNA, 21 bp, Artificial sequence
  SiRNA target sequence
aattactcagctgatgaaatt

SEQ ID NO: 9087 - DNA, 21 bp, Artificial sequence
  SiRNA target sequence
attactcagctgatgaaatta

SEQ ID NO: 9088 - DNA, 21 bp, Artificial sequence
  SiRNA target sequence
ttactcagctgatgaaattaa

SEQ ID NO: 9089 - DNA, 21 bp, Artificial sequence
  SiRNA target sequence
tactcagctgatgaaattaac

SEQ ID NO: 9090 - DNA, 21 bp, Artificial sequence
  SiRNA target sequence
actcagctgatgaaattaacg

SEQ ID NO: 9091 - DNA, 21 bp, Artificial sequence
  SiRNA target sequence
ctcagctgatgaaattaacgt

SEQ ID NO: 9092 - DNA, 21 bp, Artificial sequence
  SiRNA target sequence
tcagctgatgaaattaacgta

SEQ ID NO: 9093 - DNA, 21 bp, Artificial sequence
  SiRNA target sequence
cagctgatgaaattaacgtag

SEQ ID NO: 9094 - DNA, 21 bp, Artificial sequence
  SiRNA target sequence
agctgatgaaattaacgtaga

SEQ ID NO: 9095 - DNA, 21 bp, Artificial sequence
  SiRNA target sequence
gctgatgaaattaacgtagac

SEQ ID NO: 9096 - DNA, 21 bp, Artificial sequence
  SiRNA target sequence
ctgatgaaattaacgtagacg

SEQ ID NO: 9097 - DNA, 21 bp, Artificial sequence
  SiRNA target sequence
tgatgaaattaacgtagacgg

SEQ ID NO: 9098 - DNA, 21 bp, Artificial sequence
  SiRNA target sequence
gatgaaattaacgtagacgga

SEQ ID NO: 9099 - DNA, 21 bp, Artificial sequence
  SiRNA target sequence
atgaaattaacgtagacggac

SEQ ID NO: 9100 - DNA, 21 bp, Artificial sequence
  SiRNA target sequence
tgaaattaacgtagacggacc

SEQ ID NO: 9101 - DNA, 21 bp, Artificial sequence
  SiRNA target sequence
gaaattaacgtagacggacct

SEQ ID NO: 9102 - DNA, 21 bp, Artificial sequence
  SiRNA target sequence
aaattaacgtagacggacctt

SEQ ID NO: 9103 - DNA, 21 bp, Artificial sequence
  SiRNA target sequence
aattaacgtagacggaccttc

SEQ ID NO: 9104 - DNA, 21 bp, Artificial sequence
  SiRNA target sequence
attaacgtagacggaccttca

SEQ ID NO: 9105 - DNA, 21 bp, Artificial sequence
  SiRNA target sequence
ttaacgtagacggaccttcac

SEQ ID NO: 9106 - DNA, 21 bp, Artificial sequence
  SiRNA target sequence
taacgtagacggaccttcaca

SEQ ID NO: 9107 - DNA, 21 bp, Artificial sequence
  SiRNA target sequence
aacgtagacggaccttcacat

SEQ ID NO: 9108 - DNA, 21 bp, Artificial sequence
  SiRNA target sequence
acgtagacggaccttcacata

SEQ ID NO: 9109 - DNA, 21 bp, Artificial sequence
  SiRNA target sequence
cgtagacggaccttcacatat

SEQ ID NO: 9110 - DNA, 21 bp, Artificial sequence
  SiRNA target sequence
gtagacggaccttcacatata

SEQ ID NO: 9111 - DNA, 21 bp, Artificial sequence
  SiRNA target sequence
tagacggaccttcacatataa

SEQ ID NO: 9112 - DNA, 21 bp, Artificial sequence
  SiRNA target sequence
agacggaccttcacatataac

SEQ ID NO: 9113 - DNA, 21 bp, Artificial sequence
  SiRNA target sequence
gacggaccttcacatataaca

SEQ ID NO: 9114 - DNA, 21 bp, Artificial sequence
  SiRNA target sequence
acggaccttcacatataacat

SEQ ID NO: 9115 - DNA, 21 bp, Artificial sequence
  SiRNA target sequence
cggaccttcacatataacata

SEQ ID NO: 9116 - DNA, 21 bp, Artificial sequence
  SiRNA target sequence
ggaccttcacatataacatac

SEQ ID NO: 9117 - DNA, 21 bp, Artificial sequence
  SiRNA target sequence
gaccttcacatataacatacc

SEQ ID NO: 9118 - DNA, 21 bp, Artificial sequence
  SiRNA target sequence
accttcacatataacataccc

SEQ ID NO: 9119 - DNA, 21 bp, Artificial sequence
  SiRNA target sequence
ccttcacatataacatacccc

SEQ ID NO: 9120 - DNA, 21 bp, Artificial sequence
  SiRNA target sequence
cttcacatataacataccccg

SEQ ID NO: 9121 - DNA, 21 bp, Artificial sequence
  SiRNA target sequence
ttcacatataacataccccgt

SEQ ID NO: 9122 - DNA, 21 bp, Artificial sequence
  SiRNA target sequence
tcacatataacataccccgta

SEQ ID NO: 9123 - DNA, 21 bp, Artificial sequence
  SiRNA target sequence
cacatataacataccccgtaa

SEQ ID NO: 9124 - DNA, 21 bp, Artificial sequence
  SiRNA target sequence
acatataacataccccgtaat

SEQ ID NO: 9125 - DNA, 21 bp, Artificial sequence
  SiRNA target sequence
catataacataccccgtaatc

SEQ ID NO: 9126 - DNA, 21 bp, Artificial sequence
  SiRNA target sequence
atataacataccccgtaatca

SEQ ID NO: 9127 - DNA, 21 bp, Artificial sequence
  SiRNA target sequence
tataacataccccgtaatcaa

SEQ ID NO: 9128 - DNA, 21 bp, Artificial sequence
  SiRNA target sequence
ataacataccccgtaatcaat

SEQ ID NO: 9129 - DNA, 21 bp, Artificial sequence
  SiRNA target sequence
taacataccccgtaatcaatc

SEQ ID NO: 9130 - DNA, 21 bp, Artificial sequence
  SiRNA target sequence
aacataccccgtaatcaatcc

SEQ ID NO: 9131 - DNA, 21 bp, Artificial sequence
  SiRNA target sequence
acataccccgtaatcaatcct

SEQ ID NO: 9132 - DNA, 21 bp, Artificial sequence
  SiRNA target sequence
cataccccgtaatcaatcctg

SEQ ID NO: 9133 - DNA, 21 bp, Artificial sequence
  SiRNA target sequence
ataccccgtaatcaatcctgt

SEQ ID NO: 9134 - DNA, 21 bp, Artificial sequence
  SiRNA target sequence
taccccgtaatcaatcctgtg

SEQ ID NO: 9135 - DNA, 21 bp, Artificial sequence
  SiRNA target sequence
accccgtaatcaatcctgtgc

SEQ ID NO: 9136 - DNA, 21 bp, Artificial sequence
  SiRNA target sequence
ccccgtaatcaatcctgtgca

SEQ ID NO: 9137 - DNA, 21 bp, Artificial sequence
  SiRNA target sequence
cccgtaatcaatcctgtgcat

SEQ ID NO: 9138 - DNA, 21 bp, Artificial sequence
  SiRNA target sequence
ccgtaatcaatcctgtgcatg

SEQ ID NO: 9139 - DNA, 21 bp, Artificial sequence
  SiRNA target sequence
cgtaatcaatcctgtgcatga

SEQ ID NO: 9140 - DNA, 21 bp, Artificial sequence
  SiRNA target sequence
gtaatcaatcctgtgcatgaa

SEQ ID NO: 9141 - DNA, 21 bp, Artificial sequence
  SiRNA target sequence
taatcaatcctgtgcatgaag

SEQ ID NO: 9142 - DNA, 21 bp, Artificial sequence
  SiRNA target sequence
aatcaatcctgtgcatgaagt

SEQ ID NO: 9143 - DNA, 21 bp, Artificial sequence
  SiRNA target sequence
atcaatcctgtgcatgaagta

SEQ ID NO: 9144 - DNA, 21 bp, Artificial sequence
  SiRNA target sequence
tcaatcctgtgcatgaagtag

SEQ ID NO: 9145 - DNA, 21 bp, Artificial sequence
  SiRNA target sequence
caatcctgtgcatgaagtaga

SEQ ID NO: 9146 - DNA, 21 bp, Artificial sequence
  SiRNA target sequence
aatcctgtgcatgaagtagaa

SEQ ID NO: 9147 - DNA, 21 bp, Artificial sequence
  SiRNA target sequence
atcctgtgcatgaagtagaag

SEQ ID NO: 9148 - DNA, 21 bp, Artificial sequence
  SiRNA target sequence
tcctgtgcatgaagtagaagt

SEQ ID NO: 9149 - DNA, 21 bp, Artificial sequence
  SiRNA target sequence
cctgtgcatgaagtagaagtt

SEQ ID NO: 9150 - DNA, 21 bp, Artificial sequence
  SiRNA target sequence
ctgtgcatgaagtagaagttc

SEQ ID NO: 9151 - DNA, 21 bp, Artificial sequence
  SiRNA target sequence
tgtgcatgaagtagaagttcc

SEQ ID NO: 9152 - DNA, 21 bp, Artificial sequence
  SiRNA target sequence
gtgcatgaagtagaagttcca

SEQ ID NO: 9153 - DNA, 21 bp, Artificial sequence
  SiRNA target sequence
tgcatgaagtagaagttccat

SEQ ID NO: 9154 - DNA, 21 bp, Artificial sequence
  SiRNA target sequence
gcatgaagtagaagttccatt

SEQ ID NO: 9155 - DNA, 21 bp, Artificial sequence
  SiRNA target sequence
catgaagtagaagttccattc

SEQ ID NO: 9156 - DNA, 21 bp, Artificial sequence
  SiRNA target sequence
atgaagtagaagttccattct

SEQ ID NO: 9157 - DNA, 21 bp, Artificial sequence
  SiRNA target sequence
tgaagtagaagttccattcta

SEQ ID NO: 9158 - DNA, 21 bp, Artificial sequence
  SiRNA target sequence
gaagtagaagttccattctat

SEQ ID NO: 9159 - DNA, 21 bp, Artificial sequence
  SiRNA target sequence
aagtagaagttccattctatt

SEQ ID NO: 9160 - DNA, 21 bp, Artificial sequence
  SiRNA target sequence
agtagaagttccattctattc

SEQ ID NO: 9161 - DNA, 21 bp, Artificial sequence
  SiRNA target sequence
gtagaagttccattctattct

SEQ ID NO: 9162 - DNA, 21 bp, Artificial sequence
  SiRNA target sequence
tagaagttccattctattctc

SEQ ID NO: 9163 - DNA, 21 bp, Artificial sequence
  SiRNA target sequence
agaagttccattctattctca

SEQ ID NO: 9164 - DNA, 21 bp, Artificial sequence
  SiRNA target sequence
gaagttccattctattctcag

SEQ ID NO: 9165 - DNA, 21 bp, Artificial sequence
  SiRNA target sequence
aagttccattctattctcagt

SEQ ID NO: 9166 - DNA, 21 bp, Artificial sequence
  SiRNA target sequence
agttccattctattctcagta

SEQ ID NO: 9167 - DNA, 21 bp, Artificial sequence
  SiRNA target sequence
gttccattctattctcagtat

SEQ ID NO: 9168 - DNA, 21 bp, Artificial sequence
  SiRNA target sequence
ttccattctattctcagtata

SEQ ID NO: 9169 - DNA, 21 bp, Artificial sequence
  SiRNA target sequence
tccattctattctcagtatag

SEQ ID NO: 9170 - DNA, 21 bp, Artificial sequence
  SiRNA target sequence
ccattctattctcagtatagg

SEQ ID NO: 9171 - DNA, 21 bp, Artificial sequence
  SiRNA target sequence
cattctattctcagtatagga

SEQ ID NO: 9172 - DNA, 21 bp, Artificial sequence
  SiRNA target sequence
attctattctcagtataggaa

SEQ ID NO: 9173 - DNA, 21 bp, Artificial sequence
  SiRNA target sequence
ttctattctcagtataggaaa

SEQ ID NO: 9174 - DNA, 21 bp, Artificial sequence
  SiRNA target sequence
tctattctcagtataggaaaa

SEQ ID NO: 9175 - DNA, 21 bp, Artificial sequence
  SiRNA target sequence
ctattctcagtataggaaaat

SEQ ID NO: 9176 - DNA, 21 bp, Artificial sequence
  SiRNA target sequence
tattctcagtataggaaaata

SEQ ID NO: 9177 - DNA, 21 bp, Artificial sequence
  SiRNA target sequence
attctcagtataggaaaatac

SEQ ID NO: 9178 - DNA, 21 bp, Artificial sequence
  SiRNA target sequence
ttctcagtataggaaaatacc

SEQ ID NO: 9179 - DNA, 21 bp, Artificial sequence
  SiRNA target sequence
tctcagtataggaaaatacct

SEQ ID NO: 9180 - DNA, 21 bp, Artificial sequence
  SiRNA target sequence
ctcagtataggaaaataccta

SEQ ID NO: 9181 - DNA, 21 bp, Artificial sequence
  SiRNA target sequence
tcagtataggaaaatacctat

SEQ ID NO: 9182 - DNA, 21 bp, Artificial sequence
  SiRNA target sequence
cagtataggaaaatacctatc

SEQ ID NO: 9183 - DNA, 21 bp, Artificial sequence
  SiRNA target sequence
agtataggaaaatacctatcg

SEQ ID NO: 9184 - DNA, 21 bp, Artificial sequence
  SiRNA target sequence
gtataggaaaatacctatcgc

SEQ ID NO: 9185 - DNA, 21 bp, Artificial sequence
  SiRNA target sequence
tataggaaaatacctatcgct

SEQ ID NO: 9186 - DNA, 21 bp, Artificial sequence
  SiRNA target sequence
ataggaaaatacctatcgctt

SEQ ID NO: 9187 - DNA, 21 bp, Artificial sequence
  SiRNA target sequence
taggaaaatacctatcgcttc

SEQ ID NO: 9188 - DNA, 21 bp, Artificial sequence
  SiRNA target sequence
aggaaaatacctatcgcttca

SEQ ID NO: 9189 - DNA, 21 bp, Artificial sequence
  SiRNA target sequence
ggaaaatacctatcgcttcaa

SEQ ID NO: 9190 - DNA, 21 bp, Artificial sequence
  SiRNA target sequence
gaaaatacctatcgcttcaac

SEQ ID NO: 9191 - DNA, 21 bp, Artificial sequence
  SiRNA target sequence
aaaatacctatcgcttcaaca

SEQ ID NO: 9192 - DNA, 21 bp, Artificial sequence
  SiRNA target sequence
aaatacctatcgcttcaacat

SEQ ID NO: 9193 - DNA, 21 bp, Artificial sequence
  SiRNA target sequence
aatacctatcgcttcaacatc

SEQ ID NO: 9194 - DNA, 21 bp, Artificial sequence
  SiRNA target sequence
atacctatcgcttcaacatcg

SEQ ID NO: 9195 - DNA, 21 bp, Artificial sequence
  SiRNA target sequence
tacctatcgcttcaacatcgg

SEQ ID NO: 9196 - DNA, 21 bp, Artificial sequence
  SiRNA target sequence
acctatcgcttcaacatcgga

SEQ ID NO: 9197 - DNA, 21 bp, Artificial sequence
  SiRNA target sequence
cctatcgcttcaacatcggat

SEQ ID NO: 9198 - DNA, 21 bp, Artificial sequence
  SiRNA target sequence
ctatcgcttcaacatcggata

SEQ ID NO: 9199 - DNA, 21 bp, Artificial sequence
  SiRNA target sequence
tatcgcttcaacatcggataa

SEQ ID NO: 9200 - DNA, 21 bp, Artificial sequence
  SiRNA target sequence
atcgcttcaacatcggataaa

SEQ ID NO: 9201 - DNA, 21 bp, Artificial sequence
  SiRNA target sequence
tcgcttcaacatcggataaag

SEQ ID NO: 9202 - DNA, 21 bp, Artificial sequence
  SiRNA target sequence
cgcttcaacatcggataaagg

SEQ ID NO: 9203 - DNA, 21 bp, Artificial sequence
  SiRNA target sequence
gcttcaacatcggataaaggt

SEQ ID NO: 9204 - DNA, 21 bp, Artificial sequence
  SiRNA target sequence
cttcaacatcggataaaggtt

SEQ ID NO: 9205 - DNA, 21 bp, Artificial sequence
  SiRNA target sequence
ttcaacatcggataaaggtta

SEQ ID NO: 9206 - DNA, 21 bp, Artificial sequence
  SiRNA target sequence
tcaacatcggataaaggttat

SEQ ID NO: 9207 - DNA, 21 bp, Artificial sequence
  SiRNA target sequence
caacatcggataaaggttatg

SEQ ID NO: 9208 - DNA, 21 bp, Artificial sequence
  SiRNA target sequence
aacatcggataaaggttatga

SEQ ID NO: 9209 - DNA, 21 bp, Artificial sequence
  SiRNA target sequence
acatcggataaaggttatgat

SEQ ID NO: 9210 - DNA, 21 bp, Artificial sequence
  SiRNA target sequence
catcggataaaggttatgatt

SEQ ID NO: 9211 - DNA, 21 bp, Artificial sequence
  SiRNA target sequence
atcggataaaggttatgattc

SEQ ID NO: 9212 - DNA, 21 bp, Artificial sequence
  SiRNA target sequence
tcggataaaggttatgattcc

SEQ ID NO: 9213 - DNA, 21 bp, Artificial sequence
  SiRNA target sequence
cggataaaggttatgattcct

SEQ ID NO: 9214 - DNA, 21 bp, Artificial sequence
  SiRNA target sequence
ggataaaggttatgattcctc

SEQ ID NO: 9215 - DNA, 21 bp, Artificial sequence
  SiRNA target sequence
gataaaggttatgattcctct

SEQ ID NO: 9216 - DNA, 21 bp, Artificial sequence
  SiRNA target sequence
ataaaggttatgattcctctc

SEQ ID NO: 9217 - DNA, 21 bp, Artificial sequence
  SiRNA target sequence
taaaggttatgattcctctct

SEQ ID NO: 9218 - DNA, 21 bp, Artificial sequence
  SiRNA target sequence
aaaggttatgattcctctcta

SEQ ID NO: 9219 - DNA, 21 bp, Artificial sequence
  SiRNA target sequence
aaggttatgattcctctctaa

SEQ ID NO: 9220 - DNA, 21 bp, Artificial sequence
  SiRNA target sequence
aggttatgattcctctctaat

SEQ ID NO: 9221 - DNA, 21 bp, Artificial sequence
  SiRNA target sequence
ggttatgattcctctctaatg

SEQ ID NO: 9222 - DNA, 21 bp, Artificial sequence
  SiRNA target sequence
gttatgattcctctctaatgt

SEQ ID NO: 9223 - DNA, 21 bp, Artificial sequence
  SiRNA target sequence
ttatgattcctctctaatgta

SEQ ID NO: 9224 - DNA, 21 bp, Artificial sequence
  SiRNA target sequence
tatgattcctctctaatgtat

SEQ ID NO: 9225 - DNA, 21 bp, Artificial sequence
  SiRNA target sequence
atgattcctctctaatgtatt

SEQ ID NO: 9226 - DNA, 21 bp, Artificial sequence
  SiRNA target sequence
tgattcctctctaatgtattt

SEQ ID NO: 9227 - DNA, 21 bp, Artificial sequence
  SiRNA target sequence
gattcctctctaatgtatttt

SEQ ID NO: 9228 - DNA, 21 bp, Artificial sequence
  SiRNA target sequence
attcctctctaatgtattttt

SEQ ID NO: 9229 - DNA, 21 bp, Artificial sequence
  SiRNA target sequence
ttcctctctaatgtatttttc

SEQ ID NO: 9230 - DNA, 21 bp, Artificial sequence
  SiRNA target sequence
tcctctctaatgtatttttca

SEQ ID NO: 9231 - DNA, 21 bp, Artificial sequence
  SiRNA target sequence
cctctctaatgtatttttcaa

SEQ ID NO: 9232 - DNA, 21 bp, Artificial sequence
  SiRNA target sequence
ctctctaatgtatttttcaaa

SEQ ID NO: 9233 - DNA, 21 bp, Artificial sequence
  SiRNA target sequence
tctctaatgtatttttcaaat

SEQ ID NO: 9234 - DNA, 21 bp, Artificial sequence
  SiRNA target sequence
ctctaatgtatttttcaaata

SEQ ID NO: 9235 - DNA, 21 bp, Artificial sequence
  SiRNA target sequence
tctaatgtatttttcaaatac

SEQ ID NO: 9236 - DNA, 21 bp, Artificial sequence
  SiRNA target sequence
ctaatgtatttttcaaataca

SEQ ID NO: 9237 - DNA, 21 bp, Artificial sequence
  SiRNA target sequence
taatgtatttttcaaatacag

SEQ ID NO: 9238 - DNA, 21 bp, Artificial sequence
  SiRNA target sequence
aatgtatttttcaaatacagc

SEQ ID NO: 9239 - DNA, 21 bp, Artificial sequence
  SiRNA target sequence
atgtatttttcaaatacagca

SEQ ID NO: 9240 - DNA, 21 bp, Artificial sequence
  SiRNA target sequence
tgtatttttcaaatacagcaa

SEQ ID NO: 9241 - DNA, 21 bp, Artificial sequence
  SiRNA target sequence
gtatttttcaaatacagcaac

SEQ ID NO: 9242 - DNA, 21 bp, Artificial sequence
  SiRNA target sequence
tatttttcaaatacagcaaca

SEQ ID NO: 9243 - DNA, 21 bp, Artificial sequence
  SiRNA target sequence
atttttcaaatacagcaacaa

SEQ ID NO: 9244 - DNA, 21 bp, Artificial sequence
  SiRNA target sequence
tttttcaaatacagcaacaac

SEQ ID NO: 9245 - DNA, 21 bp, Artificial sequence
  SiRNA target sequence
ttttcaaatacagcaacaact

SEQ ID NO: 9246 - DNA, 21 bp, Artificial sequence
  SiRNA target sequence
tttcaaatacagcaacaactc

SEQ ID NO: 9247 - DNA, 21 bp, Artificial sequence
  SiRNA target sequence
ttcaaatacagcaacaactca

SEQ ID NO: 9248 - DNA, 21 bp, Artificial sequence
  SiRNA target sequence
tcaaatacagcaacaactcaa

SEQ ID NO: 9249 - DNA, 21 bp, Artificial sequence
  SiRNA target sequence
caaatacagcaacaactcaaa

SEQ ID NO: 9250 - DNA, 21 bp, Artificial sequence
  SiRNA target sequence
aaatacagcaacaactcaaat

SEQ ID NO: 9251 - DNA, 21 bp, Artificial sequence
  SiRNA target sequence
aatacagcaacaactcaaatt

SEQ ID NO: 9252 - DNA, 21 bp, Artificial sequence
  SiRNA target sequence
atacagcaacaactcaaattg

SEQ ID NO: 9253 - DNA, 21 bp, Artificial sequence
  SiRNA target sequence
tacagcaacaactcaaattgt

SEQ ID NO: 9254 - DNA, 21 bp, Artificial sequence
  SiRNA target sequence
acagcaacaactcaaattgtt

SEQ ID NO: 9255 - DNA, 21 bp, Artificial sequence
  SiRNA target sequence
cagcaacaactcaaattgttg

SEQ ID NO: 9256 - DNA, 21 bp, Artificial sequence
  SiRNA target sequence
agcaacaactcaaattgttgc

SEQ ID NO: 9257 - DNA, 21 bp, Artificial sequence
  SiRNA target sequence
gcaacaactcaaattgttgcc

SEQ ID NO: 9258 - DNA, 21 bp, Artificial sequence
  SiRNA target sequence
caacaactcaaattgttgcca

SEQ ID NO: 9259 - DNA, 21 bp, Artificial sequence
  SiRNA target sequence
aacaactcaaattgttgccag

SEQ ID NO: 9260 - DNA, 21 bp, Artificial sequence
  SiRNA target sequence
acaactcaaattgttgccaga

SEQ ID NO: 9261 - DNA, 21 bp, Artificial sequence
  SiRNA target sequence
caactcaaattgttgccagag

SEQ ID NO: 9262 - DNA, 21 bp, Artificial sequence
  SiRNA target sequence
aactcaaattgttgccagagc

SEQ ID NO: 9263 - DNA, 21 bp, Artificial sequence
  SiRNA target sequence
actcaaattgttgccagagca

SEQ ID NO: 9264 - DNA, 21 bp, Artificial sequence
  SiRNA target sequence
ctcaaattgttgccagagcag

SEQ ID NO: 9265 - DNA, 21 bp, Artificial sequence
  SiRNA target sequence
tcaaattgttgccagagcagg

SEQ ID NO: 9266 - DNA, 21 bp, Artificial sequence
  SiRNA target sequence
caaattgttgccagagcagga

SEQ ID NO: 9267 - DNA, 21 bp, Artificial sequence
  SiRNA target sequence
aaattgttgccagagcaggaa

SEQ ID NO: 9268 - DNA, 21 bp, Artificial sequence
  SiRNA target sequence
aattgttgccagagcaggaaa

SEQ ID NO: 9269 - DNA, 21 bp, Artificial sequence
  SiRNA target sequence
attgttgccagagcaggaaac

SEQ ID NO: 9270 - DNA, 21 bp, Artificial sequence
  SiRNA target sequence
ttgttgccagagcaggaaacg

SEQ ID NO: 9271 - DNA, 21 bp, Artificial sequence
  SiRNA target sequence
tgttgccagagcaggaaacga

SEQ ID NO: 9272 - DNA, 21 bp, Artificial sequence
  SiRNA target sequence
gttgccagagcaggaaacgat

SEQ ID NO: 9273 - DNA, 21 bp, Artificial sequence
  SiRNA target sequence
ttgccagagcaggaaacgatg

SEQ ID NO: 9274 - DNA, 21 bp, Artificial sequence
  SiRNA target sequence
tgccagagcaggaaacgatga

SEQ ID NO: 9275 - DNA, 21 bp, Artificial sequence
  SiRNA target sequence
gccagagcaggaaacgatgac

SEQ ID NO: 9276 - DNA, 21 bp, Artificial sequence
  SiRNA target sequence
ccagagcaggaaacgatgact

SEQ ID NO: 9277 - DNA, 21 bp, Artificial sequence
  SiRNA target sequence
cagagcaggaaacgatgactt

SEQ ID NO: 9278 - DNA, 21 bp, Artificial sequence
  SiRNA target sequence
agagcaggaaacgatgacttt

SEQ ID NO: 9279 - DNA, 21 bp, Artificial sequence
  SiRNA target sequence
gagcaggaaacgatgacttta

SEQ ID NO: 9280 - DNA, 21 bp, Artificial sequence
  SiRNA target sequence
agcaggaaacgatgactttac

SEQ ID NO: 9281 - DNA, 21 bp, Artificial sequence
  SiRNA target sequence
gcaggaaacgatgactttacc

SEQ ID NO: 9282 - DNA, 21 bp, Artificial sequence
  SiRNA target sequence
caggaaacgatgactttacct

SEQ ID NO: 9283 - DNA, 21 bp, Artificial sequence
  SiRNA target sequence
aggaaacgatgactttacctt

SEQ ID NO: 9284 - DNA, 21 bp, Artificial sequence
  SiRNA target sequence
ggaaacgatgactttaccttt

SEQ ID NO: 9285 - DNA, 21 bp, Artificial sequence
  SiRNA target sequence
gaaacgatgactttacctttg

SEQ ID NO: 9286 - DNA, 21 bp, Artificial sequence
  SiRNA target sequence
aaacgatgactttacctttgg

SEQ ID NO: 9287 - DNA, 21 bp, Artificial sequence
  SiRNA target sequence
aacgatgactttacctttggt

SEQ ID NO: 9288 - DNA, 21 bp, Artificial sequence
  SiRNA target sequence
acgatgactttacctttggtt

SEQ ID NO: 9289 - DNA, 21 bp, Artificial sequence
  SiRNA target sequence
cgatgactttacctttggttg

SEQ ID NO: 9290 - DNA, 21 bp, Artificial sequence
  SiRNA target sequence
gatgactttacctttggttgg

SEQ ID NO: 9291 - DNA, 21 bp, Artificial sequence
  SiRNA target sequence
atgactttacctttggttgga

SEQ ID NO: 9292 - DNA, 21 bp, Artificial sequence
  SiRNA target sequence
tgactttacctttggttggat

SEQ ID NO: 9293 - DNA, 21 bp, Artificial sequence
  SiRNA target sequence
gactttacctttggttggatg

SEQ ID NO: 9294 - DNA, 21 bp, Artificial sequence
  SiRNA target sequence
actttacctttggttggatga

SEQ ID NO: 9295 - DNA, 21 bp, Artificial sequence
  SiRNA target sequence
ctttacctttggttggatgat

SEQ ID NO: 9296 - DNA, 21 bp, Artificial sequence
  SiRNA target sequence
tttacctttggttggatgata

SEQ ID NO: 9297 - DNA, 21 bp, Artificial sequence
  SiRNA target sequence
ttacctttggttggatgatag

SEQ ID NO: 9298 - DNA, 21 bp, Artificial sequence
  SiRNA target sequence
tacctttggttggatgatagg

SEQ ID NO: 9299 - DNA, 21 bp, Artificial sequence
  SiRNA target sequence
acctttggttggatgataggt

SEQ ID NO: 9300 - DNA, 21 bp, Artificial sequence
  SiRNA target sequence
cctttggttggatgataggtc

SEQ ID NO: 9301 - DNA, 21 bp, Artificial sequence
  SiRNA target sequence
ctttggttggatgataggtcc

SEQ ID NO: 9302 - DNA, 21 bp, Artificial sequence
  SiRNA target sequence
tttggttggatgataggtcca

SEQ ID NO: 9303 - DNA, 21 bp, Artificial sequence
  SiRNA target sequence
ttggttggatgataggtccac

SEQ ID NO: 9304 - DNA, 21 bp, Artificial sequence
  SiRNA target sequence
tggttggatgataggtccacc

SEQ ID NO: 9305 - DNA, 21 bp, Artificial sequence
  SiRNA target sequence
ggttggatgataggtccaccc

SEQ ID NO: 9306 - DNA, 21 bp, Artificial sequence
  SiRNA target sequence
gttggatgataggtccacccc

SEQ ID NO: 9307 - DNA, 21 bp, Artificial sequence
  SiRNA target sequence
ttggatgataggtccacccca

SEQ ID NO: 9308 - DNA, 21 bp, Artificial sequence
  SiRNA target sequence
tggatgataggtccaccccag

SEQ ID NO: 9309 - DNA, 21 bp, Artificial sequence
  SiRNA target sequence
ggatgataggtccaccccagc

SEQ ID NO: 9310 - DNA, 21 bp, Artificial sequence
  SiRNA target sequence
gatgataggtccaccccagct

SEQ ID NO: 9311 - DNA, 21 bp, Artificial sequence
  SiRNA target sequence
atgataggtccaccccagcta

SEQ ID NO: 9312 - DNA, 21 bp, Artificial sequence
  SiRNA target sequence
tgataggtccaccccagctac

SEQ ID NO: 9313 - DNA, 21 bp, Artificial sequence
  SiRNA target sequence
gataggtccaccccagctaca

SEQ ID NO: 9314 - DNA, 21 bp, Artificial sequence
  SiRNA target sequence
ataggtccaccccagctacaa

SEQ ID NO: 9315 - DNA, 21 bp, Artificial sequence
  SiRNA target sequence
taggtccaccccagctacaag

SEQ ID NO: 9316 - DNA, 21 bp, Artificial sequence
  SiRNA target sequence
aggtccaccccagctacaagg

SEQ ID NO: 9317 - DNA, 21 bp, Artificial sequence
  SiRNA target sequence
ggtccaccccagctacaaggc

SEQ ID NO: 9318 - DNA, 21 bp, Artificial sequence
  SiRNA target sequence
gtccaccccagctacaaggcg

SEQ ID NO: 9319 - DNA, 21 bp, Artificial sequence
  SiRNA target sequence
tccaccccagctacaaggcga

SEQ ID NO: 9320 - DNA, 21 bp, Artificial sequence
  SiRNA target sequence
ccaccccagctacaaggcgaa

SEQ ID NO: 9321 - DNA, 21 bp, Artificial sequence
  SiRNA target sequence
caccccagctacaaggcgaat

SEQ ID NO: 9322 - DNA, 21 bp, Artificial sequence
  SiRNA target sequence
accccagctacaaggcgaatc

SEQ ID NO: 9323 - DNA, 21 bp, Artificial sequence
  SiRNA target sequence
ccccagctacaaggcgaatca

SEQ ID NO: 9324 - DNA, 21 bp, Artificial sequence
  SiRNA target sequence
cccagctacaaggcgaatcac

SEQ ID NO: 9325 - DNA, 21 bp, Artificial sequence
  SiRNA target sequence
ccagctacaaggcgaatcacg

SEQ ID NO: 9326 - DNA, 21 bp, Artificial sequence
  SiRNA target sequence
cagctacaaggcgaatcacgc

SEQ ID NO: 9327 - DNA, 21 bp, Artificial sequence
  SiRNA target sequence
agctacaaggcgaatcacgct

SEQ ID NO: 9328 - DNA, 21 bp, Artificial sequence
  SiRNA target sequence
gctacaaggcgaatcacgctc

SEQ ID NO: 9329 - DNA, 21 bp, Artificial sequence
  SiRNA target sequence
ctacaaggcgaatcacgctcc

SEQ ID NO: 9330 - DNA, 21 bp, Artificial sequence
  SiRNA target sequence
tacaaggcgaatcacgctccg

SEQ ID NO: 9331 - DNA, 21 bp, Artificial sequence
  SiRNA target sequence
acaaggcgaatcacgctccgt

SEQ ID NO: 9332 - DNA, 21 bp, Artificial sequence
  SiRNA target sequence
caaggcgaatcacgctccgta

SEQ ID NO: 9333 - DNA, 21 bp, Artificial sequence
  SiRNA target sequence
aaggcgaatcacgctccgtag

SEQ ID NO: 9334 - DNA, 21 bp, Artificial sequence
  SiRNA target sequence
aggcgaatcacgctccgtagc

SEQ ID NO: 9335 - DNA, 21 bp, Artificial sequence
  SiRNA target sequence
ggcgaatcacgctccgtagcc

SEQ ID NO: 9336 - DNA, 21 bp, Artificial sequence
  SiRNA target sequence
gcgaatcacgctccgtagccc

SEQ ID NO: 9337 - DNA, 21 bp, Artificial sequence
  SiRNA target sequence
cgaatcacgctccgtagcccc

SEQ ID NO: 9338 - DNA, 21 bp, Artificial sequence
  SiRNA target sequence
gaatcacgctccgtagccccc

SEQ ID NO: 9339 - DNA, 21 bp, Artificial sequence
  SiRNA target sequence
aatcacgctccgtagccccct

SEQ ID NO: 9340 - DNA, 21 bp, Artificial sequence
  SiRNA target sequence
atcacgctccgtagcccccta

SEQ ID NO: 9341 - DNA, 21 bp, Artificial sequence
  SiRNA target sequence
tcacgctccgtagccccctag

SEQ ID NO: 9342 - DNA, 21 bp, Artificial sequence
  SiRNA target sequence
cacgctccgtagccccctaga

SEQ ID NO: 9343 - DNA, 21 bp, Artificial sequence
  SiRNA target sequence
acgctccgtagccccctagat

SEQ ID NO: 9344 - DNA, 21 bp, Artificial sequence
  SiRNA target sequence
cgctccgtagccccctagatg

SEQ ID NO: 9345 - DNA, 21 bp, Artificial sequence
  SiRNA target sequence
gctccgtagccccctagatgt

SEQ ID NO: 9346 - DNA, 21 bp, Artificial sequence
  SiRNA target sequence
ctccgtagccccctagatgtg

SEQ ID NO: 9347 - DNA, 21 bp, Artificial sequence
  SiRNA target sequence
tccgtagccccctagatgtgc

SEQ ID NO: 9348 - DNA, 21 bp, Artificial sequence
  SiRNA target sequence
ccgtagccccctagatgtgca

SEQ ID NO: 9349 - DNA, 21 bp, Artificial sequence
  SiRNA target sequence
cgtagccccctagatgtgcac

SEQ ID NO: 9350 - DNA, 21 bp, Artificial sequence
  SiRNA target sequence
gtagccccctagatgtgcact

SEQ ID NO: 9351 - DNA, 21 bp, Artificial sequence
  SiRNA target sequence
tagccccctagatgtgcactg

SEQ ID NO: 9352 - DNA, 21 bp, Artificial sequence
  SiRNA target sequence
agccccctagatgtgcactgg

SEQ ID NO: 9353 - DNA, 21 bp, Artificial sequence
  SiRNA target sequence
gccccctagatgtgcactggg

SEQ ID NO: 9354 - DNA, 21 bp, Artificial sequence
  SiRNA target sequence
ccccctagatgtgcactggga

SEQ ID NO: 9355 - DNA, 21 bp, Artificial sequence
  SiRNA target sequence
cccctagatgtgcactgggag

SEQ ID NO: 9356 - DNA, 21 bp, Artificial sequence
  SiRNA target sequence
ccctagatgtgcactgggaga

SEQ ID NO: 9357 - DNA, 21 bp, Artificial sequence
  SiRNA target sequence
cctagatgtgcactgggagac

SEQ ID NO: 9358 - DNA, 21 bp, Artificial sequence
  SiRNA target sequence
ctagatgtgcactgggagaca

SEQ ID NO: 9359 - DNA, 21 bp, Artificial sequence
  SiRNA target sequence
tagatgtgcactgggagacag

SEQ ID NO: 9360 - DNA, 21 bp, Artificial sequence
  SiRNA target sequence
agatgtgcactgggagacaga

SEQ ID NO: 9361 - DNA, 21 bp, Artificial sequence
  SiRNA target sequence
gatgtgcactgggagacagac

SEQ ID NO: 9362 - DNA, 21 bp, Artificial sequence
  SiRNA target sequence
atgtgcactgggagacagaca

SEQ ID NO: 9363 - DNA, 21 bp, Artificial sequence
  SiRNA target sequence
tgtgcactgggagacagacaa

SEQ ID NO: 9364 - DNA, 21 bp, Artificial sequence
  SiRNA target sequence
gtgcactgggagacagacaaa

SEQ ID NO: 9365 - DNA, 21 bp, Artificial sequence
  SiRNA target sequence
tgcactgggagacagacaaat

SEQ ID NO: 9366 - DNA, 21 bp, Artificial sequence
  SiRNA target sequence
gcactgggagacagacaaatc

SEQ ID NO: 9367 - DNA, 21 bp, Artificial sequence
  SiRNA target sequence
cactgggagacagacaaatct

SEQ ID NO: 9368 - DNA, 21 bp, Artificial sequence
  SiRNA target sequence
actgggagacagacaaatctc

SEQ ID NO: 9369 - DNA, 21 bp, Artificial sequence
  SiRNA target sequence
ctgggagacagacaaatctcc

SEQ ID NO: 9370 - DNA, 21 bp, Artificial sequence
  SiRNA target sequence
tgggagacagacaaatctccc

SEQ ID NO: 9371 - DNA, 21 bp, Artificial sequence
  SiRNA target sequence
gggagacagacaaatctccct

SEQ ID NO: 9372 - DNA, 21 bp, Artificial sequence
  SiRNA target sequence
ggagacagacaaatctcccta

SEQ ID NO: 9373 - DNA, 21 bp, Artificial sequence
  SiRNA target sequence
gagacagacaaatctccctat

SEQ ID NO: 9374 - DNA, 21 bp, Artificial sequence
  SiRNA target sequence
agacagacaaatctccctatg

SEQ ID NO: 9375 - DNA, 21 bp, Artificial sequence
  SiRNA target sequence
gacagacaaatctccctatgt

SEQ ID NO: 9376 - DNA, 21 bp, Artificial sequence
  SiRNA target sequence
acagacaaatctccctatgta

SEQ ID NO: 9377 - DNA, 21 bp, Artificial sequence
  SiRNA target sequence
cagacaaatctccctatgtat

SEQ ID NO: 9378 - DNA, 21 bp, Artificial sequence
  SiRNA target sequence
agacaaatctccctatgtatg

SEQ ID NO: 9379 - DNA, 21 bp, Artificial sequence
  SiRNA target sequence
gacaaatctccctatgtatgg

SEQ ID NO: 9380 - DNA, 21 bp, Artificial sequence
  SiRNA target sequence
acaaatctccctatgtatggc

SEQ ID NO: 9381 - DNA, 21 bp, Artificial sequence
  SiRNA target sequence
caaatctccctatgtatggct

SEQ ID NO: 9382 - DNA, 21 bp, Artificial sequence
  SiRNA target sequence
aaatctccctatgtatggcta

SEQ ID NO: 9383 - DNA, 21 bp, Artificial sequence
  SiRNA target sequence
aatctccctatgtatggctat

SEQ ID NO: 9384 - DNA, 21 bp, Artificial sequence
  SiRNA target sequence
atctccctatgtatggctata

SEQ ID NO: 9385 - DNA, 21 bp, Artificial sequence
  SiRNA target sequence
tctccctatgtatggctatag

SEQ ID NO: 9386 - DNA, 21 bp, Artificial sequence
  SiRNA target sequence
ctccctatgtatggctatagt

SEQ ID NO: 9387 - DNA, 21 bp, Artificial sequence
  SiRNA target sequence
tccctatgtatggctatagtc

SEQ ID NO: 9388 - DNA, 21 bp, Artificial sequence
  SiRNA target sequence
ccctatgtatggctatagtct

SEQ ID NO: 9389 - DNA, 21 bp, Artificial sequence
  SiRNA target sequence
cctatgtatggctatagtcta

SEQ ID NO: 9390 - DNA, 21 bp, Artificial sequence
  SiRNA target sequence
ctatgtatggctatagtctaa

SEQ ID NO: 9391 - DNA, 21 bp, Artificial sequence
  SiRNA target sequence
tatgtatggctatagtctaaa

SEQ ID NO: 9392 - DNA, 21 bp, Artificial sequence
  SiRNA target sequence
atgtatggctatagtctaaat

SEQ ID NO: 9393 - DNA, 21 bp, Artificial sequence
  SiRNA target sequence
tgtatggctatagtctaaatt

SEQ ID NO: 9394 - DNA, 21 bp, Artificial sequence
  SiRNA target sequence
gtatggctatagtctaaattt

SEQ ID NO: 9395 - DNA, 21 bp, Artificial sequence
  SiRNA target sequence
tatggctatagtctaaatttt

SEQ ID NO: 9396 - DNA, 21 bp, Artificial sequence
  SiRNA target sequence
atggctatagtctaaattttt

SEQ ID NO: 9397 - DNA, 21 bp, Artificial sequence
  SiRNA target sequence
tggctatagtctaaatttttc

SEQ ID NO: 9398 - DNA, 21 bp, Artificial sequence
  SiRNA target sequence
ggctatagtctaaatttttca

SEQ ID NO: 9399 - DNA, 21 bp, Artificial sequence
  SiRNA target sequence
gctatagtctaaatttttcac

SEQ ID NO: 9400 - DNA, 21 bp, Artificial sequence
  SiRNA target sequence
ctatagtctaaatttttcaca

SEQ ID NO: 9401 - DNA, 21 bp, Artificial sequence
  SiRNA target sequence
tatagtctaaatttttcacaa

SEQ ID NO: 9402 - DNA, 21 bp, Artificial sequence
  SiRNA target sequence
atagtctaaatttttcacaaa

SEQ ID NO: 9403 - DNA, 21 bp, Artificial sequence
  SiRNA target sequence
tagtctaaatttttcacaaaa

SEQ ID NO: 9404 - DNA, 21 bp, Artificial sequence
  SiRNA target sequence
agtctaaatttttcacaaaat

SEQ ID NO: 9405 - DNA, 21 bp, Artificial sequence
  SiRNA target sequence
gtctaaatttttcacaaaatt

SEQ ID NO: 9406 - DNA, 21 bp, Artificial sequence
  SiRNA target sequence
tctaaatttttcacaaaattt

SEQ ID NO: 9407 - DNA, 21 bp, Artificial sequence
  SiRNA target sequence
ctaaatttttcacaaaatttc

SEQ ID NO: 9408 - DNA, 21 bp, Artificial sequence
  SiRNA target sequence
taaatttttcacaaaatttca

SEQ ID NO: 9409 - DNA, 21 bp, Artificial sequence
  SiRNA target sequence
aaatttttcacaaaatttcag

SEQ ID NO: 9410 - DNA, 21 bp, Artificial sequence
  SiRNA target sequence
aatttttcacaaaatttcagt

SEQ ID NO: 9411 - DNA, 21 bp, Artificial sequence
  SiRNA target sequence
atttttcacaaaatttcagtt

SEQ ID NO: 9412 - DNA, 21 bp, Artificial sequence
  SiRNA target sequence
tttttcacaaaatttcagttt

SEQ ID NO: 9413 - DNA, 21 bp, Artificial sequence
  SiRNA target sequence
ttttcacaaaatttcagttta

SEQ ID NO: 9414 - DNA, 21 bp, Artificial sequence
  SiRNA target sequence
tttcacaaaatttcagtttag

SEQ ID NO: 9415 - DNA, 21 bp, Artificial sequence
  SiRNA target sequence
ttcacaaaatttcagtttaga

SEQ ID NO: 9416 - DNA, 21 bp, Artificial sequence
  SiRNA target sequence
tcacaaaatttcagtttagac

SEQ ID NO: 9417 - DNA, 21 bp, Artificial sequence
  SiRNA target sequence
cacaaaatttcagtttagacc

SEQ ID NO: 9418 - DNA, 21 bp, Artificial sequence
  SiRNA target sequence
acaaaatttcagtttagaccg

SEQ ID NO: 9419 - DNA, 21 bp, Artificial sequence
  SiRNA target sequence
caaaatttcagtttagaccga

SEQ ID NO: 9420 - DNA, 21 bp, Artificial sequence
  SiRNA target sequence
aaaatttcagtttagaccgaa

SEQ ID NO: 9421 - DNA, 21 bp, Artificial sequence
  SiRNA target sequence
aaatttcagtttagaccgaaa

SEQ ID NO: 9422 - DNA, 21 bp, Artificial sequence
  SiRNA target sequence
aatttcagtttagaccgaaaa

SEQ ID NO: 9423 - DNA, 21 bp, Artificial sequence
  SiRNA target sequence
atttcagtttagaccgaaaac

SEQ ID NO: 9424 - DNA, 21 bp, Artificial sequence
  SiRNA target sequence
tttcagtttagaccgaaaacc

SEQ ID NO: 9425 - DNA, 21 bp, Artificial sequence
  SiRNA target sequence
ttcagtttagaccgaaaaccg

SEQ ID NO: 9426 - DNA, 21 bp, Artificial sequence
  SiRNA target sequence
tcagtttagaccgaaaaccga

SEQ ID NO: 9427 - DNA, 21 bp, Artificial sequence
  SiRNA target sequence
cagtttagaccgaaaaccgac

SEQ ID NO: 9428 - DNA, 21 bp, Artificial sequence
  SiRNA target sequence
agtttagaccgaaaaccgaca

SEQ ID NO: 9429 - DNA, 21 bp, Artificial sequence
  SiRNA target sequence
gtttagaccgaaaaccgacac

SEQ ID NO: 9430 - DNA, 21 bp, Artificial sequence
  SiRNA target sequence
tttagaccgaaaaccgacact

SEQ ID NO: 9431 - DNA, 21 bp, Artificial sequence
  SiRNA target sequence
ttagaccgaaaaccgacactt

SEQ ID NO: 9432 - DNA, 21 bp, Artificial sequence
  SiRNA target sequence
tagaccgaaaaccgacacttg

SEQ ID NO: 9433 - DNA, 21 bp, Artificial sequence
  SiRNA target sequence
agaccgaaaaccgacacttga

SEQ ID NO: 9434 - DNA, 21 bp, Artificial sequence
  SiRNA target sequence
gaccgaaaaccgacacttgaa

SEQ ID NO: 9435 - DNA, 21 bp, Artificial sequence
  SiRNA target sequence
accgaaaaccgacacttgaac

SEQ ID NO: 9436 - DNA, 21 bp, Artificial sequence
  SiRNA target sequence
ccgaaaaccgacacttgaact

SEQ ID NO: 9437 - DNA, 21 bp, Artificial sequence
  SiRNA target sequence
cgaaaaccgacacttgaactg

SEQ ID NO: 9438 - DNA, 21 bp, Artificial sequence
  SiRNA target sequence
gaaaaccgacacttgaactgg

SEQ ID NO: 9439 - DNA, 21 bp, Artificial sequence
  SiRNA target sequence
aaaaccgacacttgaactgga

SEQ ID NO: 9440 - DNA, 21 bp, Artificial sequence
  SiRNA target sequence
aaaccgacacttgaactggat

SEQ ID NO: 9441 - DNA, 21 bp, Artificial sequence
  SiRNA target sequence
aaccgacacttgaactggata

SEQ ID NO: 9442 - DNA, 21 bp, Artificial sequence
  SiRNA target sequence
accgacacttgaactggatat

SEQ ID NO: 9443 - DNA, 21 bp, Artificial sequence
  SiRNA target sequence
ccgacacttgaactggatata

SEQ ID NO: 9444 - DNA, 21 bp, Artificial sequence
  SiRNA target sequence
cgacacttgaactggatatag

SEQ ID NO: 9445 - DNA, 21 bp, Artificial sequence
  SiRNA target sequence
gacacttgaactggatatagt

SEQ ID NO: 9446 - DNA, 21 bp, Artificial sequence
  SiRNA target sequence
acacttgaactggatatagta

SEQ ID NO: 9447 - DNA, 21 bp, Artificial sequence
  SiRNA target sequence
cacttgaactggatatagtac

SEQ ID NO: 9448 - DNA, 21 bp, Artificial sequence
  SiRNA target sequence
acttgaactggatatagtaca

SEQ ID NO: 9449 - DNA, 21 bp, Artificial sequence
  SiRNA target sequence
cttgaactggatatagtacat

SEQ ID NO: 9450 - DNA, 21 bp, Artificial sequence
  SiRNA target sequence
ttgaactggatatagtacatt

SEQ ID NO: 9451 - DNA, 21 bp, Artificial sequence
  SiRNA target sequence
tgaactggatatagtacatta

SEQ ID NO: 9452 - DNA, 21 bp, Artificial sequence
  SiRNA target sequence
gaactggatatagtacattaa

SEQ ID NO: 9453 - DNA, 21 bp, Artificial sequence
  SiRNA target sequence
aactggatatagtacattaat

SEQ ID NO: 9454 - DNA, 21 bp, Artificial sequence
  SiRNA target sequence
actggatatagtacattaatg

SEQ ID NO: 9455 - DNA, 21 bp, Artificial sequence
  SiRNA target sequence
ctggatatagtacattaatgt

SEQ ID NO: 9456 - DNA, 21 bp, Artificial sequence
  SiRNA target sequence
tggatatagtacattaatgtc

SEQ ID NO: 9457 - DNA, 21 bp, Artificial sequence
  SiRNA target sequence
ggatatagtacattaatgtcc

SEQ ID NO: 9458 - DNA, 21 bp, Artificial sequence
  SiRNA target sequence
gatatagtacattaatgtcct

SEQ ID NO: 9459 - DNA, 21 bp, Artificial sequence
  SiRNA target sequence
atatagtacattaatgtcctg

SEQ ID NO: 9460 - DNA, 21 bp, Artificial sequence
  SiRNA target sequence
tatagtacattaatgtcctgc

SEQ ID NO: 9461 - DNA, 21 bp, Artificial sequence
  SiRNA target sequence
atagtacattaatgtcctgca

SEQ ID NO: 9462 - DNA, 21 bp, Artificial sequence
  SiRNA target sequence
tagtacattaatgtcctgcag

SEQ ID NO: 9463 - DNA, 21 bp, Artificial sequence
  SiRNA target sequence
agtacattaatgtcctgcagc

SEQ ID NO: 9464 - DNA, 21 bp, Artificial sequence
  SiRNA target sequence
gtacattaatgtcctgcagct

SEQ ID NO: 9465 - DNA, 21 bp, Artificial sequence
  SiRNA target sequence
tacattaatgtcctgcagcta

SEQ ID NO: 9466 - DNA, 21 bp, Artificial sequence
  SiRNA target sequence
acattaatgtcctgcagctaa

SEQ ID NO: 9467 - DNA, 21 bp, Artificial sequence
  SiRNA target sequence
cattaatgtcctgcagctaac

SEQ ID NO: 9468 - DNA, 21 bp, Artificial sequence
  SiRNA target sequence
attaatgtcctgcagctaaca

SEQ ID NO: 9469 - DNA, 21 bp, Artificial sequence
  SiRNA target sequence
ttaatgtcctgcagctaacac

SEQ ID NO: 9470 - DNA, 21 bp, Artificial sequence
  SiRNA target sequence
taatgtcctgcagctaacact

SEQ ID NO: 9471 - DNA, 21 bp, Artificial sequence
  SiRNA target sequence
aatgtcctgcagctaacactg

SEQ ID NO: 9472 - DNA, 21 bp, Artificial sequence
  SiRNA target sequence
atgtcctgcagctaacactgt

SEQ ID NO: 9473 - DNA, 21 bp, Artificial sequence
  SiRNA target sequence
tgtcctgcagctaacactgta

SEQ ID NO: 9474 - DNA, 21 bp, Artificial sequence
  SiRNA target sequence
gtcctgcagctaacactgtag

SEQ ID NO: 9475 - DNA, 21 bp, Artificial sequence
  SiRNA target sequence
tcctgcagctaacactgtagt

SEQ ID NO: 9476 - DNA, 21 bp, Artificial sequence
  SiRNA target sequence
cctgcagctaacactgtagtt

SEQ ID NO: 9477 - DNA, 21 bp, Artificial sequence
  SiRNA target sequence
ctgcagctaacactgtagttt

SEQ ID NO: 9478 - DNA, 21 bp, Artificial sequence
  SiRNA target sequence
tgcagctaacactgtagttta

SEQ ID NO: 9479 - DNA, 21 bp, Artificial sequence
  SiRNA target sequence
gcagctaacactgtagtttat

SEQ ID NO: 9480 - DNA, 21 bp, Artificial sequence
  SiRNA target sequence
cagctaacactgtagtttata

SEQ ID NO: 9481 - DNA, 21 bp, Artificial sequence
  SiRNA target sequence
agctaacactgtagtttatat

SEQ ID NO: 9482 - DNA, 21 bp, Artificial sequence
  SiRNA target sequence
gctaacactgtagtttatatc

SEQ ID NO: 9483 - DNA, 21 bp, Artificial sequence
  SiRNA target sequence
ctaacactgtagtttatatct

SEQ ID NO: 9484 - DNA, 21 bp, Artificial sequence
  SiRNA target sequence
taacactgtagtttatatcta

SEQ ID NO: 9485 - DNA, 21 bp, Artificial sequence
  SiRNA target sequence
aacactgtagtttatatctag

SEQ ID NO: 9486 - DNA, 21 bp, Artificial sequence
  SiRNA target sequence
acactgtagtttatatctagg

SEQ ID NO: 9487 - DNA, 21 bp, Artificial sequence
  SiRNA target sequence
cactgtagtttatatctaggt

SEQ ID NO: 9488 - DNA, 21 bp, Artificial sequence
  SiRNA target sequence
actgtagtttatatctaggta

SEQ ID NO: 9489 - DNA, 21 bp, Artificial sequence
  SiRNA target sequence
ctgtagtttatatctaggtag

SEQ ID NO: 9490 - DNA, 21 bp, Artificial sequence
  SiRNA target sequence
tgtagtttatatctaggtaga

SEQ ID NO: 9491 - DNA, 21 bp, Artificial sequence
  SiRNA target sequence
gtagtttatatctaggtagag

SEQ ID NO: 9492 - DNA, 21 bp, Artificial sequence
  SiRNA target sequence
tagtttatatctaggtagagt

SEQ ID NO: 9493 - DNA, 21 bp, Artificial sequence
  SiRNA target sequence
agtttatatctaggtagagtg

SEQ ID NO: 9494 - DNA, 21 bp, Artificial sequence
  SiRNA target sequence
gtttatatctaggtagagtgg

SEQ ID NO: 9495 - DNA, 21 bp, Artificial sequence
  SiRNA target sequence
tttatatctaggtagagtggg

SEQ ID NO: 9496 - DNA, 21 bp, Artificial sequence
  SiRNA target sequence
ttatatctaggtagagtgggc

SEQ ID NO: 9497 - DNA, 21 bp, Artificial sequence
  SiRNA target sequence
tatatctaggtagagtgggca

SEQ ID NO: 9498 - DNA, 21 bp, Artificial sequence
  SiRNA target sequence
atatctaggtagagtgggcaa

SEQ ID NO: 9499 - DNA, 21 bp, Artificial sequence
  SiRNA target sequence
tatctaggtagagtgggcaaa

SEQ ID NO: 9500 - DNA, 21 bp, Artificial sequence
  SiRNA target sequence
atctaggtagagtgggcaaaa

SEQ ID NO: 9501 - DNA, 21 bp, Artificial sequence
  SiRNA target sequence
tctaggtagagtgggcaaaat

SEQ ID NO: 9502 - DNA, 21 bp, Artificial sequence
  SiRNA target sequence
ctaggtagagtgggcaaaatt

SEQ ID NO: 9503 - DNA, 21 bp, Artificial sequence
  SiRNA target sequence
taggtagagtgggcaaaattt

SEQ ID NO: 9504 - DNA, 21 bp, Artificial sequence
  SiRNA target sequence
aggtagagtgggcaaaatttt

SEQ ID NO: 9505 - DNA, 21 bp, Artificial sequence
  SiRNA target sequence
ggtagagtgggcaaaattttc

SEQ ID NO: 9506 - DNA, 21 bp, Artificial sequence
  SiRNA target sequence
gtagagtgggcaaaattttcg

SEQ ID NO: 9507 - DNA, 21 bp, Artificial sequence
  SiRNA target sequence
tagagtgggcaaaattttcga

SEQ ID NO: 9508 - DNA, 21 bp, Artificial sequence
  SiRNA target sequence
agagtgggcaaaattttcgaa

SEQ ID NO: 9509 - DNA, 21 bp, Artificial sequence
  SiRNA target sequence
gagtgggcaaaattttcgaat

SEQ ID NO: 9510 - DNA, 21 bp, Artificial sequence
  SiRNA target sequence
agtgggcaaaattttcgaatt

SEQ ID NO: 9511 - DNA, 21 bp, Artificial sequence
  SiRNA target sequence
gtgggcaaaattttcgaatta

SEQ ID NO: 9512 - DNA, 21 bp, Artificial sequence
  SiRNA target sequence
tgggcaaaattttcgaattag

SEQ ID NO: 9513 - DNA, 21 bp, Artificial sequence
  SiRNA target sequence
gggcaaaattttcgaattagg

SEQ ID NO: 9514 - DNA, 21 bp, Artificial sequence
  SiRNA target sequence
ggcaaaattttcgaattaggt

SEQ ID NO: 9515 - DNA, 21 bp, Artificial sequence
  SiRNA target sequence
gcaaaattttcgaattaggta

SEQ ID NO: 9516 - DNA, 21 bp, Artificial sequence
  SiRNA target sequence
caaaattttcgaattaggtaa

SEQ ID NO: 9517 - DNA, 21 bp, Artificial sequence
  SiRNA target sequence
aaaattttcgaattaggtaaa

SEQ ID NO: 9518 - DNA, 21 bp, Artificial sequence
  SiRNA target sequence
aaattttcgaattaggtaaat

SEQ ID NO: 9519 - DNA, 21 bp, Artificial sequence
  SiRNA target sequence
aattttcgaattaggtaaatt

SEQ ID NO: 9520 - DNA, 21 bp, Artificial sequence
  SiRNA target sequence
attttcgaattaggtaaattt

SEQ ID NO: 9521 - DNA, 21 bp, Artificial sequence
  SiRNA target sequence
ttttcgaattaggtaaattta

SEQ ID NO: 9522 - DNA, 21 bp, Artificial sequence
  SiRNA target sequence
tttcgaattaggtaaatttaa

SEQ ID NO: 9523 - DNA, 21 bp, Artificial sequence
  SiRNA target sequence
ttcgaattaggtaaatttaaa

SEQ ID NO: 9524 - DNA, 21 bp, Artificial sequence
  SiRNA target sequence
tcgaattaggtaaatttaaaa

SEQ ID NO: 9525 - DNA, 21 bp, Artificial sequence
  SiRNA target sequence
cgaattaggtaaatttaaaaa

SEQ ID NO: 9526 - DNA, 21 bp, Artificial sequence
  SiRNA target sequence
gaattaggtaaatttaaaaaa

SEQ ID NO: 9527 - DNA, 21 bp, Artificial sequence
  SiRNA target sequence
aattaggtaaatttaaaaaaa

SEQ ID NO: 9528 - DNA, 21 bp, Artificial sequence
  SiRNA target sequence
attaggtaaatttaaaaaaaa

SEQ ID NO: 9529 - DNA, 21 bp, Artificial sequence
  SiRNA target sequence
ttaggtaaatttaaaaaaaaa

SEQ ID NO: 9530 - DNA, 21 bp, Artificial sequence
  SiRNA target sequence
taggtaaatttaaaaaaaaaa

SEQ ID NO: 9531 - DNA, 21 bp, Artificial sequence
  SiRNA target sequence
aggtaaatttaaaaaaaaaaa

SEQ ID NO: 9532 - DNA, 21 bp, Artificial sequence
  SiRNA target sequence
ggtaaatttaaaaaaaaaaaa

SEQ ID NO: 9533 - DNA, 21 bp, Artificial sequence
  SiRNA target sequence
cgatttatgccttccatagcg

SEQ ID NO: 9534 - DNA, 21 bp, Artificial sequence
  SiRNA target sequence
gatttatgccttccatagcga

SEQ ID NO: 9535 - DNA, 21 bp, Artificial sequence
  SiRNA target sequence
atttatgccttccatagcgaa

SEQ ID NO: 9536 - DNA, 21 bp, Artificial sequence
  SiRNA target sequence
tttatgccttccatagcgaat

SEQ ID NO: 9537 - DNA, 21 bp, Artificial sequence
  SiRNA target sequence
ttatgccttccatagcgaatt

SEQ ID NO: 9538 - DNA, 21 bp, Artificial sequence
  SiRNA target sequence
tatgccttccatagcgaatta

SEQ ID NO: 9539 - DNA, 21 bp, Artificial sequence
  SiRNA target sequence
atgccttccatagcgaattac

SEQ ID NO: 9540 - DNA, 21 bp, Artificial sequence
  SiRNA target sequence
tgccttccatagcgaattacg

SEQ ID NO: 9541 - DNA, 21 bp, Artificial sequence
  SiRNA target sequence
gccttccatagcgaattacgg

SEQ ID NO: 9542 - DNA, 21 bp, Artificial sequence
  SiRNA target sequence
ccttccatagcgaattacggt

SEQ ID NO: 9543 - DNA, 21 bp, Artificial sequence
  SiRNA target sequence
cttccatagcgaattacggtg

SEQ ID NO: 9544 - DNA, 21 bp, Artificial sequence
  SiRNA target sequence
ttccatagcgaattacggtgc

SEQ ID NO: 9545 - DNA, 21 bp, Artificial sequence
  SiRNA target sequence
tccatagcgaattacggtgca

SEQ ID NO: 9546 - DNA, 21 bp, Artificial sequence
  SiRNA target sequence
ccatagcgaattacggtgcaa

SEQ ID NO: 9547 - DNA, 21 bp, Artificial sequence
  SiRNA target sequence
catagcgaattacggtgcaac

SEQ ID NO: 9548 - DNA, 21 bp, Artificial sequence
  SiRNA target sequence
atagcgaattacggtgcaact

SEQ ID NO: 9549 - DNA, 21 bp, Artificial sequence
  SiRNA target sequence
tagcgaattacggtgcaacta

SEQ ID NO: 9550 - DNA, 21 bp, Artificial sequence
  SiRNA target sequence
agcgaattacggtgcaactaa

SEQ ID NO: 9551 - DNA, 21 bp, Artificial sequence
  SiRNA target sequence
gcgaattacggtgcaactaac

SEQ ID NO: 9552 - DNA, 21 bp, Artificial sequence
  SiRNA target sequence
cgaattacggtgcaactaaca

SEQ ID NO: 9553 - DNA, 21 bp, Artificial sequence
  SiRNA target sequence
gaattacggtgcaactaacaa

SEQ ID NO: 9554 - DNA, 21 bp, Artificial sequence
  SiRNA target sequence
aattacggtgcaactaacaat

SEQ ID NO: 9555 - DNA, 21 bp, Artificial sequence
  SiRNA target sequence
attacggtgcaactaacaatt

SEQ ID NO: 9556 - DNA, 21 bp, Artificial sequence
  SiRNA target sequence
ttacggtgcaactaacaattt

SEQ ID NO: 9557 - DNA, 21 bp, Artificial sequence
  SiRNA target sequence
tacggtgcaactaacaatttt

SEQ ID NO: 9558 - DNA, 21 bp, Artificial sequence
  SiRNA target sequence
acggtgcaactaacaatttta

SEQ ID NO: 9559 - DNA, 21 bp, Artificial sequence
  SiRNA target sequence
cggtgcaactaacaattttag

SEQ ID NO: 9560 - DNA, 21 bp, Artificial sequence
  SiRNA target sequence
ggtgcaactaacaattttaga

SEQ ID NO: 9561 - DNA, 21 bp, Artificial sequence
  SiRNA target sequence
gtgcaactaacaattttagat

SEQ ID NO: 9562 - DNA, 21 bp, Artificial sequence
  SiRNA target sequence
tgcaactaacaattttagata

SEQ ID NO: 9563 - DNA, 21 bp, Artificial sequence
  SiRNA target sequence
gcaactaacaattttagatag

SEQ ID NO: 9564 - DNA, 21 bp, Artificial sequence
  SiRNA target sequence
caactaacaattttagatagt

SEQ ID NO: 9565 - DNA, 21 bp, Artificial sequence
  SiRNA target sequence
aactaacaattttagatagta

SEQ ID NO: 9566 - DNA, 21 bp, Artificial sequence
  SiRNA target sequence
actaacaattttagatagtag

SEQ ID NO: 9567 - DNA, 21 bp, Artificial sequence
  SiRNA target sequence
ctaacaattttagatagtagc

SEQ ID NO: 9568 - DNA, 21 bp, Artificial sequence
  SiRNA target sequence
taacaattttagatagtagcc

SEQ ID NO: 9569 - DNA, 21 bp, Artificial sequence
  SiRNA target sequence
aacaattttagatagtagcca

SEQ ID NO: 9570 - DNA, 21 bp, Artificial sequence
  SiRNA target sequence
acaattttagatagtagccat

SEQ ID NO: 9571 - DNA, 21 bp, Artificial sequence
  SiRNA target sequence
caattttagatagtagccatg

SEQ ID NO: 9572 - DNA, 21 bp, Artificial sequence
  SiRNA target sequence
aattttagatagtagccatga

SEQ ID NO: 9573 - DNA, 21 bp, Artificial sequence
  SiRNA target sequence
attttagatagtagccatgaa

SEQ ID NO: 9574 - DNA, 21 bp, Artificial sequence
  SiRNA target sequence
ttttagatagtagccatgaac

SEQ ID NO: 9575 - DNA, 21 bp, Artificial sequence
  SiRNA target sequence
tttagatagtagccatgaaca

SEQ ID NO: 9576 - DNA, 21 bp, Artificial sequence
  SiRNA target sequence
ttagatagtagccatgaacaa

SEQ ID NO: 9577 - DNA, 21 bp, Artificial sequence
  SiRNA target sequence
tagatagtagccatgaacaaa

SEQ ID NO: 9578 - DNA, 21 bp, Artificial sequence
  SiRNA target sequence
agatagtagccatgaacaaac

SEQ ID NO: 9579 - DNA, 21 bp, Artificial sequence
  SiRNA target sequence
gatagtagccatgaacaaaca

SEQ ID NO: 9580 - DNA, 21 bp, Artificial sequence
  SiRNA target sequence
atagtagccatgaacaaacat

SEQ ID NO: 9581 - DNA, 21 bp, Artificial sequence
  SiRNA target sequence
tagtagccatgaacaaacatt

SEQ ID NO: 9582 - DNA, 21 bp, Artificial sequence
  SiRNA target sequence
agtagccatgaacaaacatta

SEQ ID NO: 9583 - DNA, 21 bp, Artificial sequence
  SiRNA target sequence
gtagccatgaacaaacattat

SEQ ID NO: 9584 - DNA, 21 bp, Artificial sequence
  SiRNA target sequence
tagccatgaacaaacattata

SEQ ID NO: 9585 - DNA, 21 bp, Artificial sequence
  SiRNA target sequence
agccatgaacaaacattatag

SEQ ID NO: 9586 - DNA, 21 bp, Artificial sequence
  SiRNA target sequence
gccatgaacaaacattatagt

SEQ ID NO: 9587 - DNA, 21 bp, Artificial sequence
  SiRNA target sequence
ccatgaacaaacattatagta

SEQ ID NO: 9588 - DNA, 21 bp, Artificial sequence
  SiRNA target sequence
catgaacaaacattatagtag

SEQ ID NO: 9589 - DNA, 21 bp, Artificial sequence
  SiRNA target sequence
atgaacaaacattatagtagc

SEQ ID NO: 9590 - DNA, 21 bp, Artificial sequence
  SiRNA target sequence
tgaacaaacattatagtagct

SEQ ID NO: 9591 - DNA, 21 bp, Artificial sequence
  SiRNA target sequence
gaacaaacattatagtagctc

SEQ ID NO: 9592 - DNA, 21 bp, Artificial sequence
  SiRNA target sequence
aacaaacattatagtagctca

SEQ ID NO: 9593 - DNA, 21 bp, Artificial sequence
  SiRNA target sequence
acaaacattatagtagctcac

SEQ ID NO: 9594 - DNA, 21 bp, Artificial sequence
  SiRNA target sequence
caaacattatagtagctcact

SEQ ID NO: 9595 - DNA, 21 bp, Artificial sequence
  SiRNA target sequence
aaacattatagtagctcacta

SEQ ID NO: 9596 - DNA, 21 bp, Artificial sequence
  SiRNA target sequence
aacattatagtagctcactac

SEQ ID NO: 9597 - DNA, 21 bp, Artificial sequence
  SiRNA target sequence
acattatagtagctcactacg

SEQ ID NO: 9598 - DNA, 21 bp, Artificial sequence
  SiRNA target sequence
cattatagtagctcactacgt

SEQ ID NO: 9599 - DNA, 21 bp, Artificial sequence
  SiRNA target sequence
attatagtagctcactacgta

SEQ ID NO: 9600 - DNA, 21 bp, Artificial sequence
  SiRNA target sequence
ttatagtagctcactacgtat

SEQ ID NO: 9601 - DNA, 21 bp, Artificial sequence
  SiRNA target sequence
tatagtagctcactacgtatt

SEQ ID NO: 9602 - DNA, 21 bp, Artificial sequence
  SiRNA target sequence
atagtagctcactacgtattg

SEQ ID NO: 9603 - DNA, 21 bp, Artificial sequence
  SiRNA target sequence
tagtagctcactacgtattga

SEQ ID NO: 9604 - DNA, 21 bp, Artificial sequence
  SiRNA target sequence
agtagctcactacgtattgat

SEQ ID NO: 9605 - DNA, 21 bp, Artificial sequence
  SiRNA target sequence
gtagctcactacgtattgatc

SEQ ID NO: 9606 - DNA, 21 bp, Artificial sequence
  SiRNA target sequence
tagctcactacgtattgatca

SEQ ID NO: 9607 - DNA, 21 bp, Artificial sequence
  SiRNA target sequence
agctcactacgtattgatcat

SEQ ID NO: 9608 - DNA, 21 bp, Artificial sequence
  SiRNA target sequence
gctcactacgtattgatcatt

SEQ ID NO: 9609 - DNA, 21 bp, Artificial sequence
  SiRNA target sequence
ctcactacgtattgatcattt

SEQ ID NO: 9610 - DNA, 21 bp, Artificial sequence
  SiRNA target sequence
tcactacgtattgatcatttt

SEQ ID NO: 9611 - DNA, 21 bp, Artificial sequence
  SiRNA target sequence
cactacgtattgatcattttt

SEQ ID NO: 9612 - DNA, 21 bp, Artificial sequence
  SiRNA target sequence
actacgtattgatcattttta

SEQ ID NO: 9613 - DNA, 21 bp, Artificial sequence
  SiRNA target sequence
ctacgtattgatcatttttat

SEQ ID NO: 9614 - DNA, 21 bp, Artificial sequence
  SiRNA target sequence
tacgtattgatcatttttata

SEQ ID NO: 9615 - DNA, 21 bp, Artificial sequence
  SiRNA target sequence
acgtattgatcatttttataa

SEQ ID NO: 9616 - DNA, 21 bp, Artificial sequence
  SiRNA target sequence
cgtattgatcatttttataat

SEQ ID NO: 9617 - DNA, 21 bp, Artificial sequence
  SiRNA target sequence
gtattgatcatttttataatg

SEQ ID NO: 9618 - DNA, 21 bp, Artificial sequence
  SiRNA target sequence
tattgatcatttttataatga

SEQ ID NO: 9619 - DNA, 21 bp, Artificial sequence
  SiRNA target sequence
attgatcatttttataatgac

SEQ ID NO: 9620 - DNA, 21 bp, Artificial sequence
  SiRNA target sequence
ttgatcatttttataatgact

SEQ ID NO: 9621 - DNA, 21 bp, Artificial sequence
  SiRNA target sequence
tgatcatttttataatgactt

SEQ ID NO: 9622 - DNA, 21 bp, Artificial sequence
  SiRNA target sequence
gatcatttttataatgacttg

SEQ ID NO: 9623 - DNA, 21 bp, Artificial sequence
  SiRNA target sequence
atcatttttataatgacttgc

SEQ ID NO: 9624 - DNA, 21 bp, Artificial sequence
  SiRNA target sequence
tcatttttataatgacttgcg

SEQ ID NO: 9625 - DNA, 21 bp, Artificial sequence
  SiRNA target sequence
catttttataatgacttgcgt

SEQ ID NO: 9626 - DNA, 21 bp, Artificial sequence
  SiRNA target sequence
atttttataatgacttgcgta

SEQ ID NO: 9627 - DNA, 21 bp, Artificial sequence
  SiRNA target sequence
tttttataatgacttgcgtag

SEQ ID NO: 9628 - DNA, 21 bp, Artificial sequence
  SiRNA target sequence
ttttataatgacttgcgtagc

SEQ ID NO: 9629 - DNA, 21 bp, Artificial sequence
  SiRNA target sequence
tttataatgacttgcgtagca

SEQ ID NO: 9630 - DNA, 21 bp, Artificial sequence
  SiRNA target sequence
ttataatgacttgcgtagcat

SEQ ID NO: 9631 - DNA, 21 bp, Artificial sequence
  SiRNA target sequence
tataatgacttgcgtagcatg

SEQ ID NO: 9632 - DNA, 21 bp, Artificial sequence
  SiRNA target sequence
ataatgacttgcgtagcatga

SEQ ID NO: 9633 - DNA, 21 bp, Artificial sequence
  SiRNA target sequence
taatgacttgcgtagcatgaa

SEQ ID NO: 9634 - DNA, 21 bp, Artificial sequence
  SiRNA target sequence
aatgacttgcgtagcatgaag

SEQ ID NO: 9635 - DNA, 21 bp, Artificial sequence
  SiRNA target sequence
atgacttgcgtagcatgaagc

SEQ ID NO: 9636 - DNA, 21 bp, Artificial sequence
  SiRNA target sequence
tgacttgcgtagcatgaagcg

SEQ ID NO: 9637 - DNA, 21 bp, Artificial sequence
  SiRNA target sequence
gacttgcgtagcatgaagcgc

SEQ ID NO: 9638 - DNA, 21 bp, Artificial sequence
  SiRNA target sequence
acttgcgtagcatgaagcgca

SEQ ID NO: 9639 - DNA, 21 bp, Artificial sequence
  SiRNA target sequence
cttgcgtagcatgaagcgcat

SEQ ID NO: 9640 - DNA, 21 bp, Artificial sequence
  SiRNA target sequence
ttgcgtagcatgaagcgcatg

SEQ ID NO: 9641 - DNA, 21 bp, Artificial sequence
  SiRNA target sequence
tgcgtagcatgaagcgcatgc

SEQ ID NO: 9642 - DNA, 21 bp, Artificial sequence
  SiRNA target sequence
gcgtagcatgaagcgcatgct

SEQ ID NO: 9643 - DNA, 21 bp, Artificial sequence
  SiRNA target sequence
cgtagcatgaagcgcatgctt

SEQ ID NO: 9644 - DNA, 21 bp, Artificial sequence
  SiRNA target sequence
gtagcatgaagcgcatgcttg

SEQ ID NO: 9645 - DNA, 21 bp, Artificial sequence
  SiRNA target sequence
tagcatgaagcgcatgcttgt

SEQ ID NO: 9646 - DNA, 21 bp, Artificial sequence
  SiRNA target sequence
agcatgaagcgcatgcttgta

SEQ ID NO: 9647 - DNA, 21 bp, Artificial sequence
  SiRNA target sequence
gcatgaagcgcatgcttgtag

SEQ ID NO: 9648 - DNA, 21 bp, Artificial sequence
  SiRNA target sequence
catgaagcgcatgcttgtagt

SEQ ID NO: 9649 - DNA, 21 bp, Artificial sequence
  SiRNA target sequence
atgaagcgcatgcttgtagtt

SEQ ID NO: 9650 - DNA, 21 bp, Artificial sequence
  SiRNA target sequence
tgaagcgcatgcttgtagttg

SEQ ID NO: 9651 - DNA, 21 bp, Artificial sequence
  SiRNA target sequence
gaagcgcatgcttgtagttgt

SEQ ID NO: 9652 - DNA, 21 bp, Artificial sequence
  SiRNA target sequence
aagcgcatgcttgtagttgta

SEQ ID NO: 9653 - DNA, 21 bp, Artificial sequence
  SiRNA target sequence
agcgcatgcttgtagttgtaa

SEQ ID NO: 9654 - DNA, 21 bp, Artificial sequence
  SiRNA target sequence
gcgcatgcttgtagttgtaac

SEQ ID NO: 9655 - DNA, 21 bp, Artificial sequence
  SiRNA target sequence
cgcatgcttgtagttgtaact

SEQ ID NO: 9656 - DNA, 21 bp, Artificial sequence
  SiRNA target sequence
gcatgcttgtagttgtaacta

SEQ ID NO: 9657 - DNA, 21 bp, Artificial sequence
  SiRNA target sequence
catgcttgtagttgtaactat

SEQ ID NO: 9658 - DNA, 21 bp, Artificial sequence
  SiRNA target sequence
atgcttgtagttgtaactatg

SEQ ID NO: 9659 - DNA, 21 bp, Artificial sequence
  SiRNA target sequence
tgcttgtagttgtaactatgt

SEQ ID NO: 9660 - DNA, 21 bp, Artificial sequence
  SiRNA target sequence
gcttgtagttgtaactatgtt

SEQ ID NO: 9661 - DNA, 21 bp, Artificial sequence
  SiRNA target sequence
cttgtagttgtaactatgtta

SEQ ID NO: 9662 - DNA, 21 bp, Artificial sequence
  SiRNA target sequence
ttgtagttgtaactatgttac

SEQ ID NO: 9663 - DNA, 21 bp, Artificial sequence
  SiRNA target sequence
tgtagttgtaactatgttact

SEQ ID NO: 9664 - DNA, 21 bp, Artificial sequence
  SiRNA target sequence
gtagttgtaactatgttactt

SEQ ID NO: 9665 - DNA, 21 bp, Artificial sequence
  SiRNA target sequence
tagttgtaactatgttacttt

SEQ ID NO: 9666 - DNA, 21 bp, Artificial sequence
  SiRNA target sequence
  misc_feature (21)..(21): n is a, c, g, or t
agttgtaactatgttactttn

SEQ ID NO: 9667 - DNA, 21 bp, Artificial sequence
  SiRNA target sequence
  misc_feature (20)..(20): n is a, c, g, or t
gttgtaactatgttactttnc

SEQ ID NO: 9668 - DNA, 21 bp, Artificial sequence
  SiRNA target sequence
  misc_feature (19)..(19): n is a, c, g, or t
ttgtaactatgttactttnca

SEQ ID NO: 9669 - DNA, 21 bp, Artificial sequence
  SiRNA target sequence
  misc_feature (18)..(18): n is a, c, g, or t
tgtaactatgttactttncaa

SEQ ID NO: 9670 - DNA, 21 bp, Artificial sequence
  SiRNA target sequence
  misc_feature (17)..(17): n is a, c, g, or t
gtaactatgttactttncaag

SEQ ID NO: 9671 - DNA, 21 bp, Artificial sequence
  SiRNA target sequence
  misc_feature (16)..(16): n is a, c, g, or t
taactatgttactttncaagt

SEQ ID NO: 9672 - DNA, 21 bp, Artificial sequence
  SiRNA target sequence
  misc_feature (15)..(15): n is a, c, g, or t
aactatgttactttncaagtt

SEQ ID NO: 9673 - DNA, 21 bp, Artificial sequence
  SiRNA target sequence
  misc_feature (14)..(14): n is a, c, g, or t
actatgttactttncaagttg

SEQ ID NO: 9674 - DNA, 21 bp, Artificial sequence
  SiRNA target sequence
  misc_feature (13)..(13): n is a, c, g, or t
ctatgttactttncaagttgg

SEQ ID NO: 9675 - DNA, 21 bp, Artificial sequence
  SiRNA target sequence
  misc_feature (12)..(12): n is a, c, g, or t
tatgttactttncaagttgga

SEQ ID NO: 9676 - DNA, 21 bp, Artificial sequence
  SiRNA target sequence
  misc_feature (11)..(11): n is a, c, g, or t
atgttactttncaagttggag

SEQ ID NO: 9677 - DNA, 21 bp, Artificial sequence
  SiRNA target sequence
  misc_feature (10)..(10): n is a, c, g, or t
tgttactttncaagttggagt

SEQ ID NO: 9678 - DNA, 21 bp, Artificial sequence
  SiRNA target sequence
  misc_feature (9)..(9): n is a, c, g, or t
gttactttncaagttggagtt

SEQ ID NO: 9679 - DNA, 21 bp, Artificial sequence
  SiRNA target sequence
  misc_feature (8)..(8): n is a, c, g, or t
ttactttncaagttggagttt

SEQ ID NO: 9680 - DNA, 21 bp, Artificial sequence
  SiRNA target sequence
  misc_feature (7)..(7): n is a, c, g, or t
tactttncaagttggagttta

SEQ ID NO: 9681 - DNA, 21 bp, Artificial sequence
  SiRNA target sequence
  misc_feature (6)..(6): n is a, c, g, or t
actttncaagttggagtttac

SEQ ID NO: 9682 - DNA, 21 bp, Artificial sequence
  SiRNA target sequence
  misc_feature (5)..(5): n is a, c, g, or t
ctttncaagttggagtttact

SEQ ID NO: 9683 - DNA, 21 bp, Artificial sequence
  SiRNA target sequence
  misc_feature (4)..(4): n is a, c, g, or t
tttncaagttggagtttacta

SEQ ID NO: 9684 - DNA, 21 bp, Artificial sequence
  SiRNA target sequence
  misc_feature (3)..(3): n is a, c, g, or t
ttncaagttggagtttactat

SEQ ID NO: 9685 - DNA, 21 bp, Artificial sequence
  SiRNA target sequence
  misc_feature (2)..(2): n is a, c, g, or t
  misc_feature (21)..(21): n is a, c, g, or t
tncaagttggagtttactatn

SEQ ID NO: 9686 - DNA, 21 bp, Artificial sequence
  SiRNA target sequence
  misc_feature (1)..(1): n is a, c, g, or t
  misc_feature (20)..(20): n is a, c, g, or t
ncaagttggagtttactatnt

SEQ ID NO: 9687 - DNA, 21 bp, Artificial sequence
  SiRNA target sequence
  misc_feature (19)..(19): n is a, c, g, or t
caagttggagtttactatntt

SEQ ID NO: 9688 - DNA, 21 bp, Artificial sequence
  SiRNA target sequence
  misc_feature (18)..(18): n is a, c, g, or t
aagttggagtttactatnttg

SEQ ID NO: 9689 - DNA, 21 bp, Artificial sequence
  SiRNA target sequence
  misc_feature (17)..(17): n is a, c, g, or t
agttggagtttactatnttgg

SEQ ID NO: 9690 - DNA, 21 bp, Artificial sequence
  SiRNA target sequence
  misc_feature (16)..(16): n is a, c, g, or t
gttggagtttactatnttgga

SEQ ID NO: 9691 - DNA, 21 bp, Artificial sequence
  SiRNA target sequence
  misc_feature (15)..(15): n is a, c, g, or t
ttggagtttactatnttggat

SEQ ID NO: 9692 - DNA, 21 bp, Artificial sequence
  SiRNA target sequence
  misc_feature (14)..(14): n is a, c, g, or t
tggagtttactatnttggatt

SEQ ID NO: 9693 - DNA, 21 bp, Artificial sequence
  SiRNA target sequence
  misc_feature (13)..(13): n is a, c, g, or t
ggagtttactatnttggatta

SEQ ID NO: 9694 - DNA, 21 bp, Artificial sequence
  SiRNA target sequence
  misc_feature (12)..(12): n is a, c, g, or t
gagtttactatnttggattat

SEQ ID NO: 9695 - DNA, 21 bp, Artificial sequence
  SiRNA target sequence
  misc_feature (11)..(11): n is a, c, g, or t
agtttactatnttggattatg

SEQ ID NO: 9696 - DNA, 21 bp, Artificial sequence
  SiRNA target sequence
  misc_feature (10)..(10): n is a, c, g, or t
gtttactatnttggattatga

SEQ ID NO: 9697 - DNA, 21 bp, Artificial sequence
  SiRNA target sequence
  misc_feature (9)..(9): n is a, c, g, or t
tttactatnttggattatgaa

SEQ ID NO: 9698 - DNA, 21 bp, Artificial sequence
  SiRNA target sequence
  misc_feature (8)..(8): n is a, c, g, or t
ttactatnttggattatgaat

SEQ ID NO: 9699 - DNA, 21 bp, Artificial sequence
  SiRNA target sequence
  misc_feature (7)..(7): n is a, c, g, or t
tactatnttggattatgaata

SEQ ID NO: 9700 - DNA, 21 bp, Artificial sequence
  SiRNA target sequence
  misc_feature (6)..(6): n is a, c, g, or t
actatnttggattatgaatat

SEQ ID NO: 9701 - DNA, 21 bp, Artificial sequence
  SiRNA target sequence
  misc_feature (5)..(5): n is a, c, g, or t
ctatnttggattatgaatatg

SEQ ID NO: 9702 - DNA, 21 bp, Artificial sequence
  SiRNA target sequence
  misc_feature (4)..(4): n is a, c, g, or t
tatnttggattatgaatatgt

SEQ ID NO: 9703 - DNA, 21 bp, Artificial sequence
  SiRNA target sequence
  misc_feature (3)..(3): n is a, c, g, or t
atnttggattatgaatatgtg

SEQ ID NO: 9704 - DNA, 21 bp, Artificial sequence
  SiRNA target sequence
  misc_feature (2)..(2): n is a, c, g, or t
tnttggattatgaatatgtgc

SEQ ID NO: 9705 - DNA, 21 bp, Artificial sequence
  SiRNA target sequence
  misc_feature (1)..(1): n is a, c, g, or t
nttggattatgaatatgtgca

SEQ ID NO: 9706 - DNA, 21 bp, Artificial sequence
  SiRNA target sequence
ttggattatgaatatgtgcac

SEQ ID NO: 9707 - DNA, 21 bp, Artificial sequence
  SiRNA target sequence
tggattatgaatatgtgcact

SEQ ID NO: 9708 - DNA, 21 bp, Artificial sequence
  SiRNA target sequence
ggattatgaatatgtgcactt

SEQ ID NO: 9709 - DNA, 21 bp, Artificial sequence
  SiRNA target sequence
gattatgaatatgtgcactta

SEQ ID NO: 9710 - DNA, 21 bp, Artificial sequence
  SiRNA target sequence
attatgaatatgtgcacttag

SEQ ID NO: 9711 - DNA, 21 bp, Artificial sequence
  SiRNA target sequence
ttatgaatatgtgcacttagt

SEQ ID NO: 9712 - DNA, 21 bp, Artificial sequence
  SiRNA target sequence
tatgaatatgtgcacttagtg

SEQ ID NO: 9713 - DNA, 21 bp, Artificial sequence
  SiRNA target sequence
atgaatatgtgcacttagtgt

SEQ ID NO: 9714 - DNA, 21 bp, Artificial sequence
  SiRNA target sequence
tgaatatgtgcacttagtgtc

SEQ ID NO: 9715 - DNA, 21 bp, Artificial sequence
  SiRNA target sequence
gaatatgtgcacttagtgtct

SEQ ID NO: 9716 - DNA, 21 bp, Artificial sequence
  SiRNA target sequence
aatatgtgcacttagtgtctg

SEQ ID NO: 9717 - DNA, 21 bp, Artificial sequence
  SiRNA target sequence
atatgtgcacttagtgtctgt

SEQ ID NO: 9718 - DNA, 21 bp, Artificial sequence
  SiRNA target sequence
tatgtgcacttagtgtctgta

SEQ ID NO: 9719 - DNA, 21 bp, Artificial sequence
  SiRNA target sequence
atgtgcacttagtgtctgtat

SEQ ID NO: 9720 - DNA, 21 bp, Artificial sequence
  SiRNA target sequence
tgtgcacttagtgtctgtatt

SEQ ID NO: 9721 - DNA, 21 bp, Artificial sequence
  SiRNA target sequence
gtgcacttagtgtctgtattt

SEQ ID NO: 9722 - DNA, 21 bp, Artificial sequence
  SiRNA target sequence
tgcacttagtgtctgtattta

SEQ ID NO: 9723 - DNA, 21 bp, Artificial sequence
  SiRNA target sequence
gcacttagtgtctgtatttat

SEQ ID NO: 9724 - DNA, 21 bp, Artificial sequence
  SiRNA target sequence
cacttagtgtctgtatttata

SEQ ID NO: 9725 - DNA, 21 bp, Artificial sequence
  SiRNA target sequence
acttagtgtctgtatttatag

SEQ ID NO: 9726 - DNA, 21 bp, Artificial sequence
  SiRNA target sequence
cttagtgtctgtatttatagt

SEQ ID NO: 9727 - DNA, 21 bp, Artificial sequence
  SiRNA target sequence
ttagtgtctgtatttatagtc

SEQ ID NO: 9728 - DNA, 21 bp, Artificial sequence
  SiRNA target sequence
tagtgtctgtatttatagtcg

SEQ ID NO: 9729 - DNA, 21 bp, Artificial sequence
  SiRNA target sequence
agtgtctgtatttatagtcgt

SEQ ID NO: 9730 - DNA, 21 bp, Artificial sequence
  SiRNA target sequence
gtgtctgtatttatagtcgtt

SEQ ID NO: 9731 - DNA, 21 bp, Artificial sequence
  SiRNA target sequence
tgtctgtatttatagtcgttt

SEQ ID NO: 9732 - DNA, 21 bp, Artificial sequence
  SiRNA target sequence
gtctgtatttatagtcgtttg

SEQ ID NO: 9733 - DNA, 21 bp, Artificial sequence
  SiRNA target sequence
tctgtatttatagtcgtttgt

SEQ ID NO: 9734 - DNA, 21 bp, Artificial sequence
  SiRNA target sequence
ctgtatttatagtcgtttgtg

SEQ ID NO: 9735 - DNA, 21 bp, Artificial sequence
  SiRNA target sequence
tgtatttatagtcgtttgtgg

SEQ ID NO: 9736 - DNA, 21 bp, Artificial sequence
  SiRNA target sequence
gtatttatagtcgtttgtggt

SEQ ID NO: 9737 - DNA, 21 bp, Artificial sequence
  SiRNA target sequence
tatttatagtcgtttgtggtt

SEQ ID NO: 9738 - DNA, 21 bp, Artificial sequence
  SiRNA target sequence
atttatagtcgtttgtggttc

SEQ ID NO: 9739 - DNA, 21 bp, Artificial sequence
  SiRNA target sequence
tttatagtcgtttgtggttca

SEQ ID NO: 9740 - DNA, 21 bp, Artificial sequence
  SiRNA target sequence
ttatagtcgtttgtggttcaa

SEQ ID NO: 9741 - DNA, 21 bp, Artificial sequence
  SiRNA target sequence
tatagtcgtttgtggttcaag

SEQ ID NO: 9742 - DNA, 21 bp, Artificial sequence
  SiRNA target sequence
atagtcgtttgtggttcaagg

SEQ ID NO: 9743 - DNA, 21 bp, Artificial sequence
  SiRNA target sequence
tagtcgtttgtggttcaaggt

SEQ ID NO: 9744 - DNA, 21 bp, Artificial sequence
  SiRNA target sequence
agtcgtttgtggttcaaggtt

SEQ ID NO: 9745 - DNA, 21 bp, Artificial sequence
  SiRNA target sequence
gtcgtttgtggttcaaggttt

SEQ ID NO: 9746 - DNA, 21 bp, Artificial sequence
  SiRNA target sequence
tcgtttgtggttcaaggtttt

SEQ ID NO: 9747 - DNA, 21 bp, Artificial sequence
  SiRNA target sequence
cgtttgtggttcaaggttttg

SEQ ID NO: 9748 - DNA, 21 bp, Artificial sequence
  SiRNA target sequence
gtttgtggttcaaggttttgt

SEQ ID NO: 9749 - DNA, 21 bp, Artificial sequence
  SiRNA target sequence
tttgtggttcaaggttttgtg

SEQ ID NO: 9750 - DNA, 21 bp, Artificial sequence
  SiRNA target sequence
ttgtggttcaaggttttgtgt

SEQ ID NO: 9751 - DNA, 21 bp, Artificial sequence
  SiRNA target sequence
tgtggttcaaggttttgtgtt

SEQ ID NO: 9752 - DNA, 21 bp, Artificial sequence
  SiRNA target sequence
gtggttcaaggttttgtgtta

SEQ ID NO: 9753 - DNA, 21 bp, Artificial sequence
  SiRNA target sequence
tggttcaaggttttgtgttag

SEQ ID NO: 9754 - DNA, 21 bp, Artificial sequence
  SiRNA target sequence
ggttcaaggttttgtgttagt

SEQ ID NO: 9755 - DNA, 21 bp, Artificial sequence
  SiRNA target sequence
gttcaaggttttgtgttagta

SEQ ID NO: 9756 - DNA, 21 bp, Artificial sequence
  SiRNA target sequence
ttcaaggttttgtgttagtag

SEQ ID NO: 9757 - DNA, 21 bp, Artificial sequence
  SiRNA target sequence
tcaaggttttgtgttagtagt

SEQ ID NO: 9758 - DNA, 21 bp, Artificial sequence
  SiRNA target sequence
caaggttttgtgttagtagta

SEQ ID NO: 9759 - DNA, 21 bp, Artificial sequence
  SiRNA target sequence
aaggttttgtgttagtagtac

SEQ ID NO: 9760 - DNA, 21 bp, Artificial sequence
  SiRNA target sequence
aggttttgtgttagtagtaca

SEQ ID NO: 9761 - DNA, 21 bp, Artificial sequence
  SiRNA target sequence
ggttttgtgttagtagtacac

SEQ ID NO: 9762 - DNA, 21 bp, Artificial sequence
  SiRNA target sequence
gttttgtgttagtagtacact

SEQ ID NO: 9763 - DNA, 21 bp, Artificial sequence
  SiRNA target sequence
ttttgtgttagtagtacactt

SEQ ID NO: 9764 - DNA, 21 bp, Artificial sequence
  SiRNA target sequence
tttgtgttagtagtacactta

SEQ ID NO: 9765 - DNA, 21 bp, Artificial sequence
  SiRNA target sequence
ttgtgttagtagtacacttat

SEQ ID NO: 9766 - DNA, 21 bp, Artificial sequence
  SiRNA target sequence
tgtgttagtagtacacttatg

SEQ ID NO: 9767 - DNA, 21 bp, Artificial sequence
  SiRNA target sequence
gtgttagtagtacacttatgt

SEQ ID NO: 9768 - DNA, 21 bp, Artificial sequence
  SiRNA target sequence
tgttagtagtacacttatgta

SEQ ID NO: 9769 - DNA, 21 bp, Artificial sequence
  SiRNA target sequence
gttagtagtacacttatgtat

SEQ ID NO: 9770 - DNA, 21 bp, Artificial sequence
  SiRNA target sequence
ttagtagtacacttatgtatg

SEQ ID NO: 9771 - DNA, 21 bp, Artificial sequence
  SiRNA target sequence
tagtagtacacttatgtatga

SEQ ID NO: 9772 - DNA, 21 bp, Artificial sequence
  SiRNA target sequence
agtagtacacttatgtatgaa

SEQ ID NO: 9773 - DNA, 21 bp, Artificial sequence
  SiRNA target sequence
gtagtacacttatgtatgaat

SEQ ID NO: 9774 - DNA, 21 bp, Artificial sequence
  SiRNA target sequence
tagtacacttatgtatgaatg

SEQ ID NO: 9775 - DNA, 21 bp, Artificial sequence
  SiRNA target sequence
agtacacttatgtatgaatgt

SEQ ID NO: 9776 - DNA, 21 bp, Artificial sequence
  SiRNA target sequence
gtacacttatgtatgaatgta

SEQ ID NO: 9777 - DNA, 21 bp, Artificial sequence
  SiRNA target sequence
  misc_feature (21)..(21): n is a, c, g, or t
tacacttatgtatgaatgtan

SEQ ID NO: 9778 - DNA, 21 bp, Artificial sequence
  SiRNA target sequence
  misc_feature (20)..(20): n is a, c, g, or t
acacttatgtatgaatgtanc

SEQ ID NO: 9779 - DNA, 21 bp, Artificial sequence
  SiRNA target sequence
  misc_feature (19)..(19): n is a, c, g, or t
cacttatgtatgaatgtanct

SEQ ID NO: 9780 - DNA, 21 bp, Artificial sequence
  SiRNA target sequence
  misc_feature (18)..(18): n is a, c, g, or t
acttatgtatgaatgtanctt

SEQ ID NO: 9781 - DNA, 21 bp, Artificial sequence
  SiRNA target sequence
  misc_feature (17)..(17): n is a, c, g, or t
cttatgtatgaatgtancttt

SEQ ID NO: 9782 - DNA, 21 bp, Artificial sequence
  SiRNA target sequence
  misc_feature (16)..(16): n is a, c, g, or t
ttatgtatgaatgtancttta

SEQ ID NO: 9783 - DNA, 21 bp, Artificial sequence
  SiRNA target sequence
  misc_feature (15)..(15): n is a, c, g, or t
tatgtatgaatgtanctttag

SEQ ID NO: 9784 - DNA, 21 bp, Artificial sequence
  SiRNA target sequence
  misc_feature (14)..(14): n is a, c, g, or t
atgtatgaatgtanctttagt

SEQ ID NO: 9785 - DNA, 21 bp, Artificial sequence
  SiRNA target sequence
  misc_feature (13)..(13): n is a, c, g, or t
tgtatgaatgtanctttagta

SEQ ID NO: 9786 - DNA, 21 bp, Artificial sequence
  SiRNA target sequence
  misc_feature (12)..(12): n is a, c, g, or t
gtatgaatgtanctttagtat

SEQ ID NO: 9787 - DNA, 21 bp, Artificial sequence
  SiRNA target sequence
  misc_feature (11)..(11): n is a, c, g, or t
tatgaatgtanctttagtatg

SEQ ID NO: 9788 - DNA, 21 bp, Artificial sequence
  SiRNA target sequence
  misc_feature (10)..(10): n is a, c, g, or t
atgaatgtanctttagtatga

SEQ ID NO: 9789 - DNA, 21 bp, Artificial sequence
  SiRNA target sequence
  misc_feature (9)..(9): n is a, c, g, or t
tgaatgtanctttagtatgaa

SEQ ID NO: 9790 - DNA, 21 bp, Artificial sequence
  SiRNA target sequence
  misc_feature (8)..(8): n is a, c, g, or t
gaatgtanctttagtatgaat

SEQ ID NO: 9791 - DNA, 21 bp, Artificial sequence
  SiRNA target sequence
  misc_feature (7)..(7): n is a, c, g, or t
aatgtanctttagtatgaatg

SEQ ID NO: 9792 - DNA, 21 bp, Artificial sequence
  SiRNA target sequence
  misc_feature (6)..(6): n is a, c, g, or t
atgtanctttagtatgaatgt

SEQ ID NO: 9793 - DNA, 21 bp, Artificial sequence
  SiRNA target sequence
  misc_feature (5)..(5): n is a, c, g, or t
tgtanctttagtatgaatgtt

SEQ ID NO: 9794 - DNA, 21 bp, Artificial sequence
  SiRNA target sequence
  misc_feature (4)..(4): n is a, c, g, or t
gtanctttagtatgaatgtta

SEQ ID NO: 9795 - DNA, 21 bp, Artificial sequence
  SiRNA target sequence
  misc_feature (3)..(3): n is a, c, g, or t
tanctttagtatgaatgttat

SEQ ID NO: 9796 - DNA, 21 bp, Artificial sequence
  SiRNA target sequence
  misc_feature (2)..(2): n is a, c, g, or t
anctttagtatgaatgttata

SEQ ID NO: 9797 - DNA, 21 bp, Artificial sequence
  SiRNA target sequence
  misc_feature (1)..(1): n is a, c, g, or t
nctttagtatgaatgttatag

SEQ ID NO: 9798 - DNA, 21 bp, Artificial sequence
  SiRNA target sequence
ctttagtatgaatgttataga

SEQ ID NO: 9799 - DNA, 21 bp, Artificial sequence
  SiRNA target sequence
tttagtatgaatgttatagaa

SEQ ID NO: 9800 - DNA, 21 bp, Artificial sequence
  SiRNA target sequence
ttagtatgaatgttatagaat

SEQ ID NO: 9801 - DNA, 21 bp, Artificial sequence
  SiRNA target sequence
tagtatgaatgttatagaatg

SEQ ID NO: 9802 - DNA, 21 bp, Artificial sequence
  SiRNA target sequence
agtatgaatgttatagaatga

SEQ ID NO: 9803 - DNA, 21 bp, Artificial sequence
  SiRNA target sequence
gtatgaatgttatagaatgac

SEQ ID NO: 9804 - DNA, 21 bp, Artificial sequence
  SiRNA target sequence
tatgaatgttatagaatgaca

SEQ ID NO: 9805 - DNA, 21 bp, Artificial sequence
  SiRNA target sequence
atgaatgttatagaatgacaa

SEQ ID NO: 9806 - DNA, 21 bp, Artificial sequence
  SiRNA target sequence
tgaatgttatagaatgacaat

SEQ ID NO: 9807 - DNA, 21 bp, Artificial sequence
  SiRNA target sequence
gaatgttatagaatgacaata

SEQ ID NO: 9808 - DNA, 21 bp, Artificial sequence
  SiRNA target sequence
aatgttatagaatgacaatat

SEQ ID NO: 9809 - DNA, 21 bp, Artificial sequence
  SiRNA target sequence
atgttatagaatgacaatatc

SEQ ID NO: 9810 - DNA, 21 bp, Artificial sequence
  SiRNA target sequence
tgttatagaatgacaatatcg

SEQ ID NO: 9811 - DNA, 21 bp, Artificial sequence
  SiRNA target sequence
gttatagaatgacaatatcga

SEQ ID NO: 9812 - DNA, 21 bp, Artificial sequence
  SiRNA target sequence
ttatagaatgacaatatcgaa

SEQ ID NO: 9813 - DNA, 21 bp, Artificial sequence
  SiRNA target sequence
  misc_feature (21)..(21): n is a, c, g, or t
tatagaatgacaatatcgaan

SEQ ID NO: 9814 - DNA, 21 bp, Artificial sequence
  SiRNA target sequence
  misc_feature (20)..(20): n is a, c, g, or t
atagaatgacaatatcgaang

SEQ ID NO: 9815 - DNA, 21 bp, Artificial sequence
  SiRNA target sequence
  misc_feature (19)..(19): n is a, c, g, or t
tagaatgacaatatcgaanga

SEQ ID NO: 9816 - DNA, 21 bp, Artificial sequence
  SiRNA target sequence
  misc_feature (18)..(18): n is a, c, g, or t
agaatgacaatatcgaangaa

SEQ ID NO: 9817 - DNA, 21 bp, Artificial sequence
  SiRNA target sequence
  misc_feature (17)..(17): n is a, c, g, or t
gaatgacaatatcgaangaaa

SEQ ID NO: 9818 - DNA, 21 bp, Artificial sequence
  SiRNA target sequence
  misc_feature (16)..(16): n is a, c, g, or t
aatgacaatatcgaangaaaa

SEQ ID NO: 9819 - DNA, 21 bp, Artificial sequence
  SiRNA target sequence
  misc_feature (15)..(15): n is a, c, g, or t
atgacaatatcgaangaaaaa

SEQ ID NO: 9820 - DNA, 21 bp, Artificial sequence
  SiRNA target sequence
  misc_feature (14)..(14): n is a, c, g, or t
tgacaatatcgaangaaaaat

SEQ ID NO: 9821 - DNA, 21 bp, Artificial sequence
  SiRNA target sequence
  misc_feature (13)..(13): n is a, c, g, or t
  misc_feature (21)..(21): n is a, c, g, or t
gacaatatcgaangaaaaatn

SEQ ID NO: 9822 - DNA, 21 bp, Artificial sequence
  SiRNA target sequence
  misc_feature (12)..(12): n is a, c, g, or t
  misc_feature (20)..(20): n is a, c, g, or t
acaatatcgaangaaaaatnt

SEQ ID NO: 9823 - DNA, 21 bp, Artificial sequence
  SiRNA target sequence
  misc_feature (11)..(11): n is a, c, g, or t
  misc_feature (19)..(19): n is a, c, g, or t
caatatcgaangaaaaatntt

SEQ ID NO: 9824 - DNA, 21 bp, Artificial sequence
  SiRNA target sequence
  misc_feature (10)..(10): n is a, c, g, or t
  misc_feature (18)..(18): n is a, c, g, or t
aatatcgaangaaaaatnttt

SEQ ID NO: 9825 - DNA, 21 bp, Artificial sequence
  SiRNA target sequence
  misc_feature (9)..(9): n is a, c, g, or t
  misc_feature (17)..(17): n is a, c, g, or t
atatcgaangaaaaatnttta

SEQ ID NO: 9826 - DNA, 21 bp, Artificial sequence
  SiRNA target sequence
  misc_feature (8)..(8): n is a, c, g, or t
  misc_feature (16)..(16): n is a, c, g, or t
tatcgaangaaaaatntttat

SEQ ID NO: 9827 - DNA, 21 bp, Artificial sequence
  SiRNA target sequence
  misc_feature (7)..(7): n is a, c, g, or t
  misc_feature (15)..(15): n is a, c, g, or t
atcgaangaaaaatntttata

SEQ ID NO: 9828 - DNA, 21 bp, Artificial sequence
  SiRNA target sequence
  misc_feature (6)..(6): n is a, c, g, or t
  misc_feature (14)..(14): n is a, c, g, or t
tcgaangaaaaatntttataa

SEQ ID NO: 9829 - DNA, 21 bp, Artificial sequence
  SiRNA target sequence
  misc_feature (5)..(5): n is a, c, g, or t
  misc_feature (13)..(13): n is a, c, g, or t
cgaangaaaaatntttataaa

SEQ ID NO: 9830 - DNA, 21 bp, Artificial sequence
  SiRNA target sequence
  misc_feature (4)..(4): n is a, c, g, or t
  misc_feature (12)..(12): n is a, c, g, or t
gaangaaaaatntttataaaa

SEQ ID NO: 9831 - DNA, 21 bp, Artificial sequence
  SiRNA target sequence
  misc_feature (3)..(3): n is a, c, g, or t
  misc_feature (11)..(11): n is a, c, g, or t
aangaaaaatntttataaaat

SEQ ID NO: 9832 - DNA, 21 bp, Artificial sequence
  SiRNA target sequence
  misc_feature (2)..(2): n is a, c, g, or t
  misc_feature (10)..(10): n is a, c, g, or t
angaaaaatntttataaaata

SEQ ID NO: 9833 - DNA, 21 bp, Artificial sequence
  SiRNA target sequence
  misc_feature (1)..(1): n is a, c, g, or t
  misc_feature (9)..(9): n is a, c, g, or t
ngaaaaatntttataaaatac

SEQ ID NO: 9834 - DNA, 21 bp, Artificial sequence
  SiRNA target sequence
  misc_feature (8)..(8): n is a, c, g, or t
gaaaaatntttataaaataca

SEQ ID NO: 9835 - DNA, 21 bp, Artificial sequence
  SiRNA target sequence
  misc_feature (7)..(7): n is a, c, g, or t
aaaaatntttataaaatacaa

SEQ ID NO: 9836 - DNA, 21 bp, Artificial sequence
  SiRNA target sequence
  misc_feature (6)..(6): n is a, c, g, or t
aaaatntttataaaatacaaa

SEQ ID NO: 9837 - DNA, 21 bp, Artificial sequence
  SiRNA target sequence
  misc_feature (5)..(5): n is a, c, g, or t
aaatntttataaaatacaaaa

SEQ ID NO: 9838 - DNA, 21 bp, Artificial sequence
  SiRNA target sequence
  misc_feature (4)..(4): n is a, c, g, or t
aatntttataaaatacaaaaa

SEQ ID NO: 9839 - DNA, 21 bp, Artificial sequence
  SiRNA target sequence
  misc_feature (3)..(3): n is a, c, g, or t
atntttataaaatacaaaaat

SEQ ID NO: 9840 - DNA, 21 bp, Artificial sequence
  SiRNA target sequence
  misc_feature (2)..(2): n is a, c, g, or t
tntttataaaatacaaaaata

SEQ ID NO: 9841 - DNA, 21 bp, Artificial sequence
  SiRNA target sequence
  misc_feature (1)..(1): n is a, c, g, or t
ntttataaaatacaaaaatat

SEQ ID NO: 9842 - DNA, 21 bp, Artificial sequence
  SiRNA target sequence
tttataaaatacaaaaatatt

SEQ ID NO: 9843 - DNA, 21 bp, Artificial sequence
  SiRNA target sequence
ttataaaatacaaaaatattg

SEQ ID NO: 9844 - DNA, 21 bp, Artificial sequence
  SiRNA target sequence
tataaaatacaaaaatattgt

SEQ ID NO: 9845 - DNA, 21 bp, Artificial sequence
  SiRNA target sequence
ataaaatacaaaaatattgtt

SEQ ID NO: 9846 - DNA, 21 bp, Artificial sequence
  SiRNA target sequence
taaaatacaaaaatattgttt

SEQ ID NO: 9847 - DNA, 21 bp, Artificial sequence
  SiRNA target sequence
aaaatacaaaaatattgtttt

SEQ ID NO: 9848 - DNA, 21 bp, Artificial sequence
  SiRNA target sequence
aaatacaaaaatattgttttt

SEQ ID NO: 9849 - DNA, 21 bp, Artificial sequence
  SiRNA target sequence
aatacaaaaatattgttttta

SEQ ID NO: 9850 - DNA, 21 bp, Artificial sequence
  SiRNA target sequence
atacaaaaatattgtttttat

SEQ ID NO: 9851 - DNA, 21 bp, Artificial sequence
  SiRNA target sequence
tacaaaaatattgtttttatt

SEQ ID NO: 9852 - DNA, 21 bp, Artificial sequence
  SiRNA target sequence
acaaaaatattgtttttatta

SEQ ID NO: 9853 - DNA, 21 bp, Artificial sequence
  SiRNA target sequence
caaaaatattgtttttattat

SEQ ID NO: 9854 - DNA, 21 bp, Artificial sequence
  SiRNA target sequence
aaaaatattgtttttattatt

SEQ ID NO: 9855 - DNA, 21 bp, Artificial sequence
  SiRNA target sequence
aaaatattgtttttattattt

SEQ ID NO: 9856 - DNA, 21 bp, Artificial sequence
  SiRNA target sequence
aaatattgtttttattatttc

SEQ ID NO: 9857 - DNA, 21 bp, Artificial sequence
  SiRNA target sequence
aatattgtttttattatttcg

SEQ ID NO: 9858 - DNA, 21 bp, Artificial sequence
  SiRNA target sequence
atattgtttttattatttcga

SEQ ID NO: 9859 - DNA, 21 bp, Artificial sequence
  SiRNA target sequence
tattgtttttattatttcgat

SEQ ID NO: 9860 - DNA, 21 bp, Artificial sequence
  SiRNA target sequence
attgtttttattatttcgata

SEQ ID NO: 9861 - DNA, 21 bp, Artificial sequence
  SiRNA target sequence
ttgtttttattatttcgatat

SEQ ID NO: 9862 - DNA, 21 bp, Artificial sequence
  SiRNA target sequence
tgtttttattatttcgatatg

SEQ ID NO: 9863 - DNA, 21 bp, Artificial sequence
  SiRNA target sequence
gtttttattatttcgatatgg

SEQ ID NO: 9864 - DNA, 21 bp, Artificial sequence
  SiRNA target sequence
tttttattatttcgatatggt

SEQ ID NO: 9865 - DNA, 21 bp, Artificial sequence
  SiRNA target sequence
ttttattatttcgatatggtg

SEQ ID NO: 9866 - DNA, 21 bp, Artificial sequence
  SiRNA target sequence
tttattatttcgatatggtgt

SEQ ID NO: 9867 - DNA, 21 bp, Artificial sequence
  SiRNA target sequence
ttattatttcgatatggtgtt

SEQ ID NO: 9868 - DNA, 21 bp, Artificial sequence
  SiRNA target sequence
tattatttcgatatggtgttt

SEQ ID NO: 9869 - DNA, 21 bp, Artificial sequence
  SiRNA target sequence
attatttcgatatggtgtttt

SEQ ID NO: 9870 - DNA, 21 bp, Artificial sequence
  SiRNA target sequence
ttatttcgatatggtgtttta

SEQ ID NO: 9871 - DNA, 21 bp, Artificial sequence
  SiRNA target sequence
tatttcgatatggtgttttat

SEQ ID NO: 9872 - DNA, 21 bp, Artificial sequence
  SiRNA target sequence
atttcgatatggtgttttata

SEQ ID NO: 9873 - DNA, 21 bp, Artificial sequence
  SiRNA target sequence
tttcgatatggtgttttatag

SEQ ID NO: 9874 - DNA, 21 bp, Artificial sequence
  SiRNA target sequence
ttcgatatggtgttttataga

SEQ ID NO: 9875 - DNA, 21 bp, Artificial sequence
  SiRNA target sequence
tcgatatggtgttttatagag

SEQ ID NO: 9876 - DNA, 21 bp, Artificial sequence
  SiRNA target sequence
cgatatggtgttttatagagt

SEQ ID NO: 9877 - DNA, 21 bp, Artificial sequence
  SiRNA target sequence
gatatggtgttttatagagta

SEQ ID NO: 9878 - DNA, 21 bp, Artificial sequence
  SiRNA target sequence
atatggtgttttatagagtag

SEQ ID NO: 9879 - DNA, 21 bp, Artificial sequence
  SiRNA target sequence
tatggtgttttatagagtaga

SEQ ID NO: 9880 - DNA, 21 bp, Artificial sequence
  SiRNA target sequence
atggtgttttatagagtagat

SEQ ID NO: 9881 - DNA, 21 bp, Artificial sequence
  SiRNA target sequence
tggtgttttatagagtagatt

SEQ ID NO: 9882 - DNA, 21 bp, Artificial sequence
  SiRNA target sequence
ggtgttttatagagtagattg

SEQ ID NO: 9883 - DNA, 21 bp, Artificial sequence
  SiRNA target sequence
gtgttttatagagtagattgc

SEQ ID NO: 9884 - DNA, 21 bp, Artificial sequence
  SiRNA target sequence
tgttttatagagtagattgcc

SEQ ID NO: 9885 - DNA, 21 bp, Artificial sequence
  SiRNA target sequence
gttttatagagtagattgcca

SEQ ID NO: 9886 - DNA, 21 bp, Artificial sequence
  SiRNA target sequence
ttttatagagtagattgccat

SEQ ID NO: 9887 - DNA, 21 bp, Artificial sequence
  SiRNA target sequence
tttatagagtagattgccatg

SEQ ID NO: 9888 - DNA, 21 bp, Artificial sequence
  SiRNA target sequence
ttatagagtagattgccatgt

SEQ ID NO: 9889 - DNA, 21 bp, Artificial sequence
  SiRNA target sequence
tatagagtagattgccatgtg

SEQ ID NO: 9890 - DNA, 21 bp, Artificial sequence
  SiRNA target sequence
atagagtagattgccatgtga

SEQ ID NO: 9891 - DNA, 21 bp, Artificial sequence
  SiRNA target sequence
tagagtagattgccatgtgac

SEQ ID NO: 9892 - DNA, 21 bp, Artificial sequence
  SiRNA target sequence
agagtagattgccatgtgacc

SEQ ID NO: 9893 - DNA, 21 bp, Artificial sequence
  SiRNA target sequence
gagtagattgccatgtgaccg

SEQ ID NO: 9894 - DNA, 21 bp, Artificial sequence
  SiRNA target sequence
agtagattgccatgtgaccgc

SEQ ID NO: 9895 - DNA, 21 bp, Artificial sequence
  SiRNA target sequence
gtagattgccatgtgaccgct

SEQ ID NO: 9896 - DNA, 21 bp, Artificial sequence
  SiRNA target sequence
tagattgccatgtgaccgctc

SEQ ID NO: 9897 - DNA, 21 bp, Artificial sequence
  SiRNA target sequence
  misc_feature (21)..(21): n is a, c, g, or t
agattgccatgtgaccgctcn

SEQ ID NO: 9898 - DNA, 21 bp, Artificial sequence
  SiRNA target sequence
  misc_feature (20)..(20): n is a, c, g, or t
gattgccatgtgaccgctcnt

SEQ ID NO: 9899 - DNA, 21 bp, Artificial sequence
  SiRNA target sequence
  misc_feature (19)..(19): n is a, c, g, or t
attgccatgtgaccgctcnta

SEQ ID NO: 9900 - DNA, 21 bp, Artificial sequence
  SiRNA target sequence
  misc_feature (18)..(18): n is a, c, g, or t
ttgccatgtgaccgctcntag

SEQ ID NO: 9901 - DNA, 21 bp, Artificial sequence
  SiRNA target sequence
  misc_feature (17)..(17): n is a, c, g, or t
tgccatgtgaccgctcntaga

SEQ ID NO: 9902 - DNA, 21 bp, Artificial sequence
  SiRNA target sequence
  misc_feature (16)..(16): n is a, c, g, or t
gccatgtgaccgctcntagaa

SEQ ID NO: 9903 - DNA, 21 bp, Artificial sequence
  SiRNA target sequence
  misc_feature (15)..(15): n is a, c, g, or t
ccatgtgaccgctcntagaag

SEQ ID NO: 9904 - DNA, 21 bp, Artificial sequence
  SiRNA target sequence
  misc_feature (14)..(14): n is a, c, g, or t
catgtgaccgctcntagaagt

SEQ ID NO: 9905 - DNA, 21 bp, Artificial sequence
  SiRNA target sequence
  misc_feature (13)..(13): n is a, c, g, or t
atgtgaccgctcntagaagtc

SEQ ID NO: 9906 - DNA, 21 bp, Artificial sequence
  SiRNA target sequence
  misc_feature (12)..(12): n is a, c, g, or t
tgtgaccgctcntagaagtcc

SEQ ID NO: 9907 - DNA, 21 bp, Artificial sequence
  SiRNA target sequence
  misc_feature (11)..(11): n is a, c, g, or t
gtgaccgctcntagaagtcca

SEQ ID NO: 9908 - DNA, 21 bp, Artificial sequence
  SiRNA target sequence
  misc_feature (10)..(10): n is a, c, g, or t
tgaccgctcntagaagtccat

SEQ ID NO: 9909 - DNA, 21 bp, Artificial sequence
  SiRNA target sequence
  misc_feature (9)..(9): n is a, c, g, or t
gaccgctcntagaagtccatt

SEQ ID NO: 9910 - DNA, 21 bp, Artificial sequence
  SiRNA target sequence
  misc_feature (8)..(8): n is a, c, g, or t
accgctcntagaagtccatta

SEQ ID NO: 9911 - DNA, 21 bp, Artificial sequence
  SiRNA target sequence
  misc_feature (7)..(7): n is a, c, g, or t
ccgctcntagaagtccattat

SEQ ID NO: 9912 - DNA, 21 bp, Artificial sequence
  SiRNA target sequence
  misc_feature (6)..(6): n is a, c, g, or t
cgctcntagaagtccattatg

SEQ ID NO: 9913 - DNA, 21 bp, Artificial sequence
  SiRNA target sequence
  misc_feature (5)..(5): n is a, c, g, or t
gctcntagaagtccattatgg

SEQ ID NO: 9914 - DNA, 21 bp, Artificial sequence
  SiRNA target sequence
  misc_feature (4)..(4): n is a, c, g, or t
ctcntagaagtccattatggt

SEQ ID NO: 9915 - DNA, 21 bp, Artificial sequence
  SiRNA target sequence
  misc_feature (3)..(3): n is a, c, g, or t
tcntagaagtccattatggtt

SEQ ID NO: 9916 - DNA, 21 bp, Artificial sequence
  SiRNA target sequence
  misc_feature (2)..(2): n is a, c, g, or t
cntagaagtccattatggttt

SEQ ID NO: 9917 - DNA, 21 bp, Artificial sequence
  SiRNA target sequence
  misc_feature (1)..(1): n is a, c, g, or t
ntagaagtccattatggttta

SEQ ID NO: 9918 - DNA, 21 bp, Artificial sequence
  SiRNA target sequence
tagaagtccattatggtttat

SEQ ID NO: 9919 - DNA, 21 bp, Artificial sequence
  SiRNA target sequence
agaagtccattatggtttatc

SEQ ID NO: 9920 - DNA, 21 bp, Artificial sequence
  SiRNA target sequence
gaagtccattatggtttatca

SEQ ID NO: 9921 - DNA, 21 bp, Artificial sequence
  SiRNA target sequence
aagtccattatggtttatcaa

SEQ ID NO: 9922 - DNA, 21 bp, Artificial sequence
  SiRNA target sequence
agtccattatggtttatcaat

SEQ ID NO: 9923 - DNA, 21 bp, Artificial sequence
  SiRNA target sequence
gtccattatggtttatcaatc

SEQ ID NO: 9924 - DNA, 21 bp, Artificial sequence
  SiRNA target sequence
tccattatggtttatcaatcg

SEQ ID NO: 9925 - DNA, 21 bp, Artificial sequence
  SiRNA target sequence
ccattatggtttatcaatcga

SEQ ID NO: 9926 - DNA, 21 bp, Artificial sequence
  SiRNA target sequence
cattatggtttatcaatcgaa

SEQ ID NO: 9927 - DNA, 21 bp, Artificial sequence
  SiRNA target sequence
attatggtttatcaatcgaag

SEQ ID NO: 9928 - DNA, 21 bp, Artificial sequence
  SiRNA target sequence
ttatggtttatcaatcgaagt

SEQ ID NO: 9929 - DNA, 21 bp, Artificial sequence
  SiRNA target sequence
tatggtttatcaatcgaagtt

SEQ ID NO: 9930 - DNA, 21 bp, Artificial sequence
  SiRNA target sequence
atggtttatcaatcgaagttg

SEQ ID NO: 9931 - DNA, 21 bp, Artificial sequence
  SiRNA target sequence
tggtttatcaatcgaagttga

SEQ ID NO: 9932 - DNA, 21 bp, Artificial sequence
  SiRNA target sequence
ggtttatcaatcgaagttgaa

SEQ ID NO: 9933 - DNA, 21 bp, Artificial sequence
  SiRNA target sequence
gtttatcaatcgaagttgaat

SEQ ID NO: 9934 - DNA, 21 bp, Artificial sequence
  SiRNA target sequence
tttatcaatcgaagttgaatg

SEQ ID NO: 9935 - DNA, 21 bp, Artificial sequence
  SiRNA target sequence
ttatcaatcgaagttgaatgt

SEQ ID NO: 9936 - DNA, 21 bp, Artificial sequence
  SiRNA target sequence
tatcaatcgaagttgaatgta

SEQ ID NO: 9937 - DNA, 21 bp, Artificial sequence
  SiRNA target sequence
atcaatcgaagttgaatgtat

SEQ ID NO: 9938 - DNA, 21 bp, Artificial sequence
  SiRNA target sequence
tcaatcgaagttgaatgtatt

SEQ ID NO: 9939 - DNA, 21 bp, Artificial sequence
  SiRNA target sequence
caatcgaagttgaatgtattt

SEQ ID NO: 9940 - DNA, 21 bp, Artificial sequence
  SiRNA target sequence
aatcgaagttgaatgtattta

SEQ ID NO: 9941 - DNA, 21 bp, Artificial sequence
  SiRNA target sequence
atcgaagttgaatgtatttat

SEQ ID NO: 9942 - DNA, 21 bp, Artificial sequence
  SiRNA target sequence
tcgaagttgaatgtatttata

SEQ ID NO: 9943 - DNA, 21 bp, Artificial sequence
  SiRNA target sequence
cgaagttgaatgtatttataa

SEQ ID NO: 9944 - DNA, 21 bp, Artificial sequence
  SiRNA target sequence
gaagttgaatgtatttataag

SEQ ID NO: 9945 - DNA, 21 bp, Artificial sequence
  SiRNA target sequence
  misc_feature (21)..(21): n is a, c, g, or t
aagttgaatgtatttataagn

SEQ ID NO: 9946 - DNA, 21 bp, Artificial sequence
  SiRNA target sequence
  misc_feature (20)..(20): n is a, c, g, or t
agttgaatgtatttataagna

SEQ ID NO: 9947 - DNA, 21 bp, Artificial sequence
  SiRNA target sequence
  misc_feature (19)..(19): n is a, c, g, or t
gttgaatgtatttataagnat

SEQ ID NO: 9948 - DNA, 21 bp, Artificial sequence
  SiRNA target sequence
  misc_feature (18)..(18): n is a, c, g, or t
ttgaatgtatttataagnata

SEQ ID NO: 9949 - DNA, 21 bp, Artificial sequence
  SiRNA target sequence
  misc_feature (17)..(17): n is a, c, g, or t
tgaatgtatttataagnatat

SEQ ID NO: 9950 - DNA, 21 bp, Artificial sequence
  SiRNA target sequence
  misc_feature (16)..(16): n is a, c, g, or t
gaatgtatttataagnatatt

SEQ ID NO: 9951 - DNA, 21 bp, Artificial sequence
  SiRNA target sequence
  misc_feature (15)..(15): n is a, c, g, or t
aatgtatttataagnatatta

SEQ ID NO: 9952 - DNA, 21 bp, Artificial sequence
  SiRNA target sequence
  misc_feature (14)..(14): n is a, c, g, or t
atgtatttataagnatattat

SEQ ID NO: 9953 - DNA, 21 bp, Artificial sequence
  SiRNA target sequence
  misc_feature (13)..(13): n is a, c, g, or t
tgtatttataagnatattata

SEQ ID NO: 9954 - DNA, 21 bp, Artificial sequence
  SiRNA target sequence
  misc_feature (12)..(12): n is a, c, g, or t
gtatttataagnatattatac

SEQ ID NO: 9955 - DNA, 21 bp, Artificial sequence
  SiRNA target sequence
  misc_feature (11)..(11): n is a, c, g, or t
tatttataagnatattatact

SEQ ID NO: 9956 - DNA, 21 bp, Artificial sequence
  SiRNA target sequence
  misc_feature (10)..(10): n is a, c, g, or t
atttataagnatattatactt

SEQ ID NO: 9957 - DNA, 21 bp, Artificial sequence
  SiRNA target sequence
  misc_feature (9)..(9): n is a, c, g, or t
tttataagnatattatactta

SEQ ID NO: 9958 - DNA, 21 bp, Artificial sequence
  SiRNA target sequence
  misc_feature (8)..(8): n is a, c, g, or t
ttataagnatattatacttaa

SEQ ID NO: 9959 - DNA, 21 bp, Artificial sequence
  SiRNA target sequence
  misc_feature (7)..(7): n is a, c, g, or t
tataagnatattatacttaat

SEQ ID NO: 9960 - DNA, 21 bp, Artificial sequence
  SiRNA target sequence
  misc_feature (6)..(6): n is a, c, g, or t
ataagnatattatacttaatt

SEQ ID NO: 9961 - DNA, 21 bp, Artificial sequence
  SiRNA target sequence
  misc_feature (5)..(5): n is a, c, g, or t
taagnatattatacttaatta

SEQ ID NO: 9962 - DNA, 21 bp, Artificial sequence
  SiRNA target sequence
  misc_feature (4)..(4): n is a, c, g, or t
aagnatattatacttaattag

SEQ ID NO: 9963 - DNA, 21 bp, Artificial sequence
  SiRNA target sequence
  misc_feature (3)..(3): n is a, c, g, or t
agnatattatacttaattagt

SEQ ID NO: 9964 - DNA, 21 bp, Artificial sequence
  SiRNA target sequence
  misc_feature (2)..(2): n is a, c, g, or t
gnatattatacttaattagta

SEQ ID NO: 9965 - DNA, 21 bp, Artificial sequence
  SiRNA target sequence
  misc_feature (1)..(1): n is a, c, g, or t
natattatacttaattagtaa

SEQ ID NO: 9966 - DNA, 21 bp, Artificial sequence
  SiRNA target sequence
atattatacttaattagtaat

SEQ ID NO: 9967 - DNA, 21 bp, Artificial sequence
  SiRNA target sequence
tattatacttaattagtaata

SEQ ID NO: 9968 - DNA, 21 bp, Artificial sequence
  SiRNA target sequence
attatacttaattagtaatat

SEQ ID NO: 9969 - DNA, 21 bp, Artificial sequence
  SiRNA target sequence
ttatacttaattagtaatatt

SEQ ID NO: 9970 - DNA, 21 bp, Artificial sequence
  SiRNA target sequence
tatacttaattagtaatatta

SEQ ID NO: 9971 - DNA, 21 bp, Artificial sequence
  SiRNA target sequence
atacttaattagtaatattag

SEQ ID NO: 9972 - DNA, 21 bp, Artificial sequence
  SiRNA target sequence
tacttaattagtaatattagt

SEQ ID NO: 9973 - DNA, 21 bp, Artificial sequence
  SiRNA target sequence
acttaattagtaatattagta

SEQ ID NO: 9974 - DNA, 21 bp, Artificial sequence
  SiRNA target sequence
cttaattagtaatattagtag

SEQ ID NO: 9975 - DNA, 21 bp, Artificial sequence
  SiRNA target sequence
ttaattagtaatattagtagt

SEQ ID NO: 9976 - DNA, 21 bp, Artificial sequence
  SiRNA target sequence
taattagtaatattagtagtc

SEQ ID NO: 9977 - DNA, 21 bp, Artificial sequence
  SiRNA target sequence
aattagtaatattagtagtcc

SEQ ID NO: 9978 - DNA, 21 bp, Artificial sequence
  SiRNA target sequence
attagtaatattagtagtccg

SEQ ID NO: 9979 - DNA, 21 bp, Artificial sequence
  SiRNA target sequence
ttagtaatattagtagtccgt

SEQ ID NO: 9980 - DNA, 21 bp, Artificial sequence
  SiRNA target sequence
tagtaatattagtagtccgta

SEQ ID NO: 9981 - DNA, 21 bp, Artificial sequence
  SiRNA target sequence
agtaatattagtagtccgtaa

SEQ ID NO: 9982 - DNA, 21 bp, Artificial sequence
  SiRNA target sequence
gtaatattagtagtccgtaac

SEQ ID NO: 9983 - DNA, 21 bp, Artificial sequence
  SiRNA target sequence
taatattagtagtccgtaact

SEQ ID NO: 9984 - DNA, 21 bp, Artificial sequence
  SiRNA target sequence
aatattagtagtccgtaacta

SEQ ID NO: 9985 - DNA, 21 bp, Artificial sequence
  SiRNA target sequence
atattagtagtccgtaactat

SEQ ID NO: 9986 - DNA, 21 bp, Artificial sequence
  SiRNA target sequence
tattagtagtccgtaactatt

SEQ ID NO: 9987 - DNA, 21 bp, Artificial sequence
  SiRNA target sequence
attagtagtccgtaactatta

SEQ ID NO: 9988 - DNA, 21 bp, Artificial sequence
  SiRNA target sequence
ttagtagtccgtaactattat

SEQ ID NO: 9989 - DNA, 21 bp, Artificial sequence
  SiRNA target sequence
tagtagtccgtaactattatc

SEQ ID NO: 9990 - DNA, 21 bp, Artificial sequence
  SiRNA target sequence
agtagtccgtaactattatca

SEQ ID NO: 9991 - DNA, 21 bp, Artificial sequence
  SiRNA target sequence
gtagtccgtaactattatcat

SEQ ID NO: 9992 - DNA, 21 bp, Artificial sequence
  SiRNA target sequence
tagtccgtaactattatcatc

SEQ ID NO: 9993 - DNA, 21 bp, Artificial sequence
  SiRNA target sequence
agtccgtaactattatcatcc

SEQ ID NO: 9994 - DNA, 21 bp, Artificial sequence
  SiRNA target sequence
gtccgtaactattatcatcct

SEQ ID NO: 9995 - DNA, 21 bp, Artificial sequence
  SiRNA target sequence
tccgtaactattatcatcctt

SEQ ID NO: 9996 - DNA, 21 bp, Artificial sequence
  SiRNA target sequence
ccgtaactattatcatccttt

SEQ ID NO: 9997 - DNA, 21 bp, Artificial sequence
  SiRNA target sequence
cgtaactattatcatcctttt

SEQ ID NO: 9998 - DNA, 21 bp, Artificial sequence
  SiRNA target sequence
gtaactattatcatccttttt

SEQ ID NO: 9999 - DNA, 21 bp, Artificial sequence
  SiRNA target sequence
taactattatcatcctttttc

SEQ ID NO: 10000 - DNA, 21 bp, Artificial sequence
  SiRNA target sequence
aactattatcatcctttttca

SEQ ID NO: 10001 - DNA, 21 bp, Artificial sequence
  SiRNA target sequence
actattatcatcctttttcag

SEQ ID NO: 10002 - DNA, 21 bp, Artificial sequence
  SiRNA target sequence
ctattatcatcctttttcagt

SEQ ID NO: 10003 - DNA, 21 bp, Artificial sequence
  SiRNA target sequence
tattatcatcctttttcagtt

SEQ ID NO: 10004 - DNA, 21 bp, Artificial sequence
  SiRNA target sequence
attatcatcctttttcagttt

SEQ ID NO: 10005 - DNA, 21 bp, Artificial sequence
  SiRNA target sequence
ttatcatcctttttcagtttg

SEQ ID NO: 10006 - DNA, 21 bp, Artificial sequence
  SiRNA target sequence
tatcatcctttttcagtttga

SEQ ID NO: 10007 - DNA, 21 bp, Artificial sequence
  SiRNA target sequence
atcatcctttttcagtttgat

SEQ ID NO: 10008 - DNA, 21 bp, Artificial sequence
  SiRNA target sequence
tcatcctttttcagtttgatg

SEQ ID NO: 10009 - DNA, 21 bp, Artificial sequence
  SiRNA target sequence
catcctttttcagtttgatgt

SEQ ID NO: 10010 - DNA, 21 bp, Artificial sequence
  SiRNA target sequence
atcctttttcagtttgatgtg

SEQ ID NO: 10011 - DNA, 21 bp, Artificial sequence
  SiRNA target sequence
tcctttttcagtttgatgtga

SEQ ID NO: 10012 - DNA, 21 bp, Artificial sequence
  SiRNA target sequence
cctttttcagtttgatgtgat

SEQ ID NO: 10013 - DNA, 21 bp, Artificial sequence
  SiRNA target sequence
ctttttcagtttgatgtgata

SEQ ID NO: 10014 - DNA, 21 bp, Artificial sequence
  SiRNA target sequence
tttttcagtttgatgtgataa

SEQ ID NO: 10015 - DNA, 21 bp, Artificial sequence
  SiRNA target sequence
ttttcagtttgatgtgataat

SEQ ID NO: 10016 - DNA, 21 bp, Artificial sequence
  SiRNA target sequence
tttcagtttgatgtgataata

SEQ ID NO: 10017 - DNA, 21 bp, Artificial sequence
  SiRNA target sequence
ttcagtttgatgtgataatag

SEQ ID NO: 10018 - DNA, 21 bp, Artificial sequence
  SiRNA target sequence
tcagtttgatgtgataataga

SEQ ID NO: 10019 - DNA, 21 bp, Artificial sequence
  SiRNA target sequence
cagtttgatgtgataatagac

SEQ ID NO: 10020 - DNA, 21 bp, Artificial sequence
  SiRNA target sequence
agtttgatgtgataatagacc

SEQ ID NO: 10021 - DNA, 21 bp, Artificial sequence
  SiRNA target sequence
gtttgatgtgataatagacca

SEQ ID NO: 10022 - DNA, 21 bp, Artificial sequence
  SiRNA target sequence
tttgatgtgataatagaccac

SEQ ID NO: 10023 - DNA, 21 bp, Artificial sequence
  SiRNA target sequence
ttgatgtgataatagaccact

SEQ ID NO: 10024 - DNA, 21 bp, Artificial sequence
  SiRNA target sequence
tgatgtgataatagaccactg

SEQ ID NO: 10025 - DNA, 21 bp, Artificial sequence
  SiRNA target sequence
gatgtgataatagaccactgc

SEQ ID NO: 10026 - DNA, 21 bp, Artificial sequence
  SiRNA target sequence
atgtgataatagaccactgca

SEQ ID NO: 10027 - DNA, 21 bp, Artificial sequence
  SiRNA target sequence
tgtgataatagaccactgcag

SEQ ID NO: 10028 - DNA, 21 bp, Artificial sequence
  SiRNA target sequence
gtgataatagaccactgcagt

SEQ ID NO: 10029 - DNA, 21 bp, Artificial sequence
  SiRNA target sequence
tgataatagaccactgcagta

SEQ ID NO: 10030 - DNA, 21 bp, Artificial sequence
  SiRNA target sequence
gataatagaccactgcagtat

SEQ ID NO: 10031 - DNA, 21 bp, Artificial sequence
  SiRNA target sequence
ataatagaccactgcagtatc

SEQ ID NO: 10032 - DNA, 21 bp, Artificial sequence
  SiRNA target sequence
taatagaccactgcagtatcg

SEQ ID NO: 10033 - DNA, 21 bp, Artificial sequence
  SiRNA target sequence
aatagaccactgcagtatcga

SEQ ID NO: 10034 - DNA, 21 bp, Artificial sequence
  SiRNA target sequence
atagaccactgcagtatcgag

SEQ ID NO: 10035 - DNA, 21 bp, Artificial sequence
  SiRNA target sequence
tagaccactgcagtatcgagt

SEQ ID NO: 10036 - DNA, 21 bp, Artificial sequence
  SiRNA target sequence
agaccactgcagtatcgagta

SEQ ID NO: 10037 - DNA, 21 bp, Artificial sequence
  SiRNA target sequence
gaccactgcagtatcgagtag

SEQ ID NO: 10038 - DNA, 21 bp, Artificial sequence
  SiRNA target sequence
accactgcagtatcgagtaga

SEQ ID NO: 10039 - DNA, 21 bp, Artificial sequence
  SiRNA target sequence
ccactgcagtatcgagtagag

SEQ ID NO: 10040 - DNA, 21 bp, Artificial sequence
  SiRNA target sequence
cactgcagtatcgagtagagt

SEQ ID NO: 10041 - DNA, 21 bp, Artificial sequence
  SiRNA target sequence
actgcagtatcgagtagagtt

SEQ ID NO: 10042 - DNA, 21 bp, Artificial sequence
  SiRNA target sequence
ctgcagtatcgagtagagttt

SEQ ID NO: 10043 - DNA, 21 bp, Artificial sequence
  SiRNA target sequence
tgcagtatcgagtagagtttc

SEQ ID NO: 10044 - DNA, 21 bp, Artificial sequence
  SiRNA target sequence
gcagtatcgagtagagtttcg

SEQ ID NO: 10045 - DNA, 21 bp, Artificial sequence
  SiRNA target sequence
cagtatcgagtagagtttcga

SEQ ID NO: 10046 - DNA, 21 bp, Artificial sequence
  SiRNA target sequence
agtatcgagtagagtttcgaa

SEQ ID NO: 10047 - DNA, 21 bp, Artificial sequence
  SiRNA target sequence
gtatcgagtagagtttcgaat

SEQ ID NO: 10048 - DNA, 21 bp, Artificial sequence
  SiRNA target sequence
tatcgagtagagtttcgaatg

SEQ ID NO: 10049 - DNA, 21 bp, Artificial sequence
  SiRNA target sequence
atcgagtagagtttcgaatgc

SEQ ID NO: 10050 - DNA, 21 bp, Artificial sequence
  SiRNA target sequence
tcgagtagagtttcgaatgcg

SEQ ID NO: 10051 - DNA, 21 bp, Artificial sequence
  SiRNA target sequence
cgagtagagtttcgaatgcgt

SEQ ID NO: 10052 - DNA, 21 bp, Artificial sequence
  SiRNA target sequence
gagtagagtttcgaatgcgta

SEQ ID NO: 10053 - DNA, 21 bp, Artificial sequence
  SiRNA target sequence
agtagagtttcgaatgcgtag

SEQ ID NO: 10054 - DNA, 21 bp, Artificial sequence
  SiRNA target sequence
gtagagtttcgaatgcgtagt

SEQ ID NO: 10055 - DNA, 21 bp, Artificial sequence
  SiRNA target sequence
tagagtttcgaatgcgtagtg

SEQ ID NO: 10056 - DNA, 21 bp, Artificial sequence
  SiRNA target sequence
agagtttcgaatgcgtagtgc

SEQ ID NO: 10057 - DNA, 21 bp, Artificial sequence
  SiRNA target sequence
gagtttcgaatgcgtagtgca

SEQ ID NO: 10058 - DNA, 21 bp, Artificial sequence
  SiRNA target sequence
agtttcgaatgcgtagtgcaa

SEQ ID NO: 10059 - DNA, 21 bp, Artificial sequence
  SiRNA target sequence
gtttcgaatgcgtagtgcaat

SEQ ID NO: 10060 - DNA, 21 bp, Artificial sequence
  SiRNA target sequence
tttcgaatgcgtagtgcaata

SEQ ID NO: 10061 - DNA, 21 bp, Artificial sequence
  SiRNA target sequence
ttcgaatgcgtagtgcaatag

SEQ ID NO: 10062 - DNA, 21 bp, Artificial sequence
  SiRNA target sequence
tcgaatgcgtagtgcaatagt

SEQ ID NO: 10063 - DNA, 21 bp, Artificial sequence
  SiRNA target sequence
cgaatgcgtagtgcaatagta

SEQ ID NO: 10064 - DNA, 21 bp, Artificial sequence
  SiRNA target sequence
gaatgcgtagtgcaatagtat

SEQ ID NO: 10065 - DNA, 21 bp, Artificial sequence
  SiRNA target sequence
aatgcgtagtgcaatagtata

SEQ ID NO: 10066 - DNA, 21 bp, Artificial sequence
  SiRNA target sequence
atgcgtagtgcaatagtataa

SEQ ID NO: 10067 - DNA, 21 bp, Artificial sequence
  SiRNA target sequence
tgcgtagtgcaatagtataat

SEQ ID NO: 10068 - DNA, 21 bp, Artificial sequence
  SiRNA target sequence
  misc_feature (21)..(21): n is a, c, g, or t
gcgtagtgcaatagtataatn

SEQ ID NO: 10069 - DNA, 21 bp, Artificial sequence
  SiRNA target sequence
  misc_feature (20)..(20): n is a, c, g, or t
cgtagtgcaatagtataatna

SEQ ID NO: 10070 - DNA, 21 bp, Artificial sequence
  SiRNA target sequence
  misc_feature (19)..(19): n is a, c, g, or t
gtagtgcaatagtataatnac

SEQ ID NO: 10071 - DNA, 21 bp, Artificial sequence
  SiRNA target sequence
  misc_feature (18)..(18): n is a, c, g, or t
tagtgcaatagtataatnact

SEQ ID NO: 10072 - DNA, 21 bp, Artificial sequence
  SiRNA target sequence
  misc_feature (17)..(17): n is a, c, g, or t
agtgcaatagtataatnactg

SEQ ID NO: 10073 - DNA, 21 bp, Artificial sequence
  SiRNA target sequence
  misc_feature (16)..(16): n is a, c, g, or t
gtgcaatagtataatnactgt

SEQ ID NO: 10074 - DNA, 21 bp, Artificial sequence
  SiRNA target sequence
  misc_feature (15)..(15): n is a, c, g, or t
tgcaatagtataatnactgtc

SEQ ID NO: 10075 - DNA, 21 bp, Artificial sequence
  SiRNA target sequence
  misc_feature (14)..(14): n is a, c, g, or t
gcaatagtataatnactgtca

SEQ ID NO: 10076 - DNA, 21 bp, Artificial sequence
  SiRNA target sequence
  misc_feature (13)..(13): n is a, c, g, or t
caatagtataatnactgtcac

SEQ ID NO: 10077 - DNA, 21 bp, Artificial sequence
  SiRNA target sequence
  misc_feature (12)..(12): n is a, c, g, or t
aatagtataatnactgtcacc

SEQ ID NO: 10078 - DNA, 21 bp, Artificial sequence
  SiRNA target sequence
  misc_feature (11)..(11): n is a, c, g, or t
atagtataatnactgtcaccg

SEQ ID NO: 10079 - DNA, 21 bp, Artificial sequence
  SiRNA target sequence
  misc_feature (10)..(10): n is a, c, g, or t
tagtataatnactgtcaccga

SEQ ID NO: 10080 - DNA, 21 bp, Artificial sequence
  SiRNA target sequence
  misc_feature (9)..(9): n is a, c, g, or t
agtataatnactgtcaccgac

SEQ ID NO: 10081 - DNA, 21 bp, Artificial sequence
  SiRNA target sequence
  misc_feature (8)..(8): n is a, c, g, or t
gtataatnactgtcaccgacc

SEQ ID NO: 10082 - DNA, 21 bp, Artificial sequence
  SiRNA target sequence
  misc_feature (7)..(7): n is a, c, g, or t
tataatnactgtcaccgacca

SEQ ID NO: 10083 - DNA, 21 bp, Artificial sequence
  SiRNA target sequence
  misc_feature (6)..(6): n is a, c, g, or t
ataatnactgtcaccgaccat

SEQ ID NO: 10084 - DNA, 21 bp, Artificial sequence
  SiRNA target sequence
  misc_feature (5)..(5): n is a, c, g, or t
taatnactgtcaccgaccatc

SEQ ID NO: 10085 - DNA, 21 bp, Artificial sequence
  SiRNA target sequence
  misc_feature (4)..(4): n is a, c, g, or t
aatnactgtcaccgaccatct

SEQ ID NO: 10086 - DNA, 21 bp, Artificial sequence
  SiRNA target sequence
  misc_feature (3)..(3): n is a, c, g, or t
atnactgtcaccgaccatcta

SEQ ID NO: 10087 - DNA, 21 bp, Artificial sequence
  SiRNA target sequence
  misc_feature (2)..(2): n is a, c, g, or t
tnactgtcaccgaccatctat

SEQ ID NO: 10088 - DNA, 21 bp, Artificial sequence
  SiRNA target sequence
  misc_feature (1)..(1): n is a, c, g, or t
nactgtcaccgaccatctatt

SEQ ID NO: 10089 - DNA, 21 bp, Artificial sequence
  SiRNA target sequence
actgtcaccgaccatctattg

SEQ ID NO: 10090 - DNA, 21 bp, Artificial sequence
  SiRNA target sequence
ctgtcaccgaccatctattgt

SEQ ID NO: 10091 - DNA, 21 bp, Artificial sequence
  SiRNA target sequence
tgtcaccgaccatctattgta

SEQ ID NO: 10092 - DNA, 21 bp, Artificial sequence
  SiRNA target sequence
gtcaccgaccatctattgtaa

SEQ ID NO: 10093 - DNA, 21 bp, Artificial sequence
  SiRNA target sequence
tcaccgaccatctattgtaat

SEQ ID NO: 10094 - DNA, 21 bp, Artificial sequence
  SiRNA target sequence
caccgaccatctattgtaatg

SEQ ID NO: 10095 - DNA, 21 bp, Artificial sequence
  SiRNA target sequence
accgaccatctattgtaatga

SEQ ID NO: 10096 - DNA, 21 bp, Artificial sequence
  SiRNA target sequence
ccgaccatctattgtaatgat

SEQ ID NO: 10097 - DNA, 21 bp, Artificial sequence
  SiRNA target sequence
cgaccatctattgtaatgata

SEQ ID NO: 10098 - DNA, 21 bp, Artificial sequence
  SiRNA target sequence
gaccatctattgtaatgatag

SEQ ID NO: 10099 - DNA, 21 bp, Artificial sequence
  SiRNA target sequence
accatctattgtaatgataga

SEQ ID NO: 10100 - DNA, 21 bp, Artificial sequence
  SiRNA target sequence
ccatctattgtaatgatagat

SEQ ID NO: 10101 - DNA, 21 bp, Artificial sequence
  SiRNA target sequence
catctattgtaatgatagatc

SEQ ID NO: 10102 - DNA, 21 bp, Artificial sequence
  SiRNA target sequence
atctattgtaatgatagatct

SEQ ID NO: 10103 - DNA, 21 bp, Artificial sequence
  SiRNA target sequence
tctattgtaatgatagatctg

SEQ ID NO: 10104 - DNA, 21 bp, Artificial sequence
  SiRNA target sequence
ctattgtaatgatagatctgt

SEQ ID NO: 10105 - DNA, 21 bp, Artificial sequence
  SiRNA target sequence
tattgtaatgatagatctgtc

SEQ ID NO: 10106 - DNA, 21 bp, Artificial sequence
  SiRNA target sequence
attgtaatgatagatctgtcg

SEQ ID NO: 10107 - DNA, 21 bp, Artificial sequence
  SiRNA target sequence
ttgtaatgatagatctgtcgg

SEQ ID NO: 10108 - DNA, 21 bp, Artificial sequence
  SiRNA target sequence
tgtaatgatagatctgtcgga

SEQ ID NO: 10109 - DNA, 21 bp, Artificial sequence
  SiRNA target sequence
gtaatgatagatctgtcggaa

SEQ ID NO: 10110 - DNA, 21 bp, Artificial sequence
  SiRNA target sequence
taatgatagatctgtcggaaa

SEQ ID NO: 10111 - DNA, 21 bp, Artificial sequence
  SiRNA target sequence
aatgatagatctgtcggaaac

SEQ ID NO: 10112 - DNA, 21 bp, Artificial sequence
  SiRNA target sequence
atgatagatctgtcggaaacc

SEQ ID NO: 10113 - DNA, 21 bp, Artificial sequence
  SiRNA target sequence
tgatagatctgtcggaaacca

SEQ ID NO: 10114 - DNA, 21 bp, Artificial sequence
  SiRNA target sequence
gatagatctgtcggaaaccat

SEQ ID NO: 10115 - DNA, 21 bp, Artificial sequence
  SiRNA target sequence
atagatctgtcggaaaccatt

SEQ ID NO: 10116 - DNA, 21 bp, Artificial sequence
  SiRNA target sequence
tagatctgtcggaaaccatta

SEQ ID NO: 10117 - DNA, 21 bp, Artificial sequence
  SiRNA target sequence
agatctgtcggaaaccattat

SEQ ID NO: 10118 - DNA, 21 bp, Artificial sequence
  SiRNA target sequence
gatctgtcggaaaccattatt

SEQ ID NO: 10119 - DNA, 21 bp, Artificial sequence
  SiRNA target sequence
atctgtcggaaaccattattt

SEQ ID NO: 10120 - DNA, 21 bp, Artificial sequence
  SiRNA target sequence
tctgtcggaaaccattattta

SEQ ID NO: 10121 - DNA, 21 bp, Artificial sequence
  SiRNA target sequence
ctgtcggaaaccattatttat

SEQ ID NO: 10122 - DNA, 21 bp, Artificial sequence
  SiRNA target sequence
tgtcggaaaccattatttatg

SEQ ID NO: 10123 - DNA, 21 bp, Artificial sequence
  SiRNA target sequence
gtcggaaaccattatttatga

SEQ ID NO: 10124 - DNA, 21 bp, Artificial sequence
  SiRNA target sequence
tcggaaaccattatttatgaa

SEQ ID NO: 10125 - DNA, 21 bp, Artificial sequence
  SiRNA target sequence
cggaaaccattatttatgaag

SEQ ID NO: 10126 - DNA, 21 bp, Artificial sequence
  SiRNA target sequence
ggaaaccattatttatgaagt

SEQ ID NO: 10127 - DNA, 21 bp, Artificial sequence
  SiRNA target sequence
gaaaccattatttatgaagtg

SEQ ID NO: 10128 - DNA, 21 bp, Artificial sequence
  SiRNA target sequence
aaaccattatttatgaagtga

SEQ ID NO: 10129 - DNA, 21 bp, Artificial sequence
  SiRNA target sequence
aaccattatttatgaagtgac

SEQ ID NO: 10130 - DNA, 21 bp, Artificial sequence
  SiRNA target sequence
accattatttatgaagtgact

SEQ ID NO: 10131 - DNA, 21 bp, Artificial sequence
  SiRNA target sequence
ccattatttatgaagtgacta

SEQ ID NO: 10132 - DNA, 21 bp, Artificial sequence
  SiRNA target sequence
cattatttatgaagtgactag

SEQ ID NO: 10133 - DNA, 21 bp, Artificial sequence
  SiRNA target sequence
attatttatgaagtgactagc

SEQ ID NO: 10134 - DNA, 21 bp, Artificial sequence
  SiRNA target sequence
ttatttatgaagtgactagca

SEQ ID NO: 10135 - DNA, 21 bp, Artificial sequence
  SiRNA target sequence
tatttatgaagtgactagcaa

SEQ ID NO: 10136 - DNA, 21 bp, Artificial sequence
  SiRNA target sequence
atttatgaagtgactagcaat

SEQ ID NO: 10137 - DNA, 21 bp, Artificial sequence
  SiRNA target sequence
tttatgaagtgactagcaatc

SEQ ID NO: 10138 - DNA, 21 bp, Artificial sequence
  SiRNA target sequence
ttatgaagtgactagcaatca

SEQ ID NO: 10139 - DNA, 21 bp, Artificial sequence
  SiRNA target sequence
tatgaagtgactagcaatcat

SEQ ID NO: 10140 - DNA, 21 bp, Artificial sequence
  SiRNA target sequence
atgaagtgactagcaatcatg

SEQ ID NO: 10141 - DNA, 21 bp, Artificial sequence
  SiRNA target sequence
tgaagtgactagcaatcatgg

SEQ ID NO: 10142 - DNA, 21 bp, Artificial sequence
  SiRNA target sequence
gaagtgactagcaatcatgga

SEQ ID NO: 10143 - DNA, 21 bp, Artificial sequence
  SiRNA target sequence
aagtgactagcaatcatggat

SEQ ID NO: 10144 - DNA, 21 bp, Artificial sequence
  SiRNA target sequence
agtgactagcaatcatggatt

SEQ ID NO: 10145 - DNA, 21 bp, Artificial sequence
  SiRNA target sequence
gtgactagcaatcatggatta

SEQ ID NO: 10146 - DNA, 21 bp, Artificial sequence
  SiRNA target sequence
tgactagcaatcatggattaa

SEQ ID NO: 10147 - DNA, 21 bp, Artificial sequence
  SiRNA target sequence
gactagcaatcatggattaaa

SEQ ID NO: 10148 - DNA, 21 bp, Artificial sequence
  SiRNA target sequence
actagcaatcatggattaaat

SEQ ID NO: 10149 - DNA, 21 bp, Artificial sequence
  SiRNA target sequence
ctagcaatcatggattaaatt

SEQ ID NO: 10150 - DNA, 21 bp, Artificial sequence
  SiRNA target sequence
tagcaatcatggattaaatta

SEQ ID NO: 10151 - DNA, 21 bp, Artificial sequence
  SiRNA target sequence
agcaatcatggattaaattag

SEQ ID NO: 10152 - DNA, 21 bp, Artificial sequence
  SiRNA target sequence
gcaatcatggattaaattaga

SEQ ID NO: 10153 - DNA, 21 bp, Artificial sequence
  SiRNA target sequence
caatcatggattaaattagat

SEQ ID NO: 10154 - DNA, 21 bp, Artificial sequence
  SiRNA target sequence
aatcatggattaaattagatg

SEQ ID NO: 10155 - DNA, 21 bp, Artificial sequence
  SiRNA target sequence
atcatggattaaattagatgg

SEQ ID NO: 10156 - DNA, 21 bp, Artificial sequence
  SiRNA target sequence
tcatggattaaattagatggt

SEQ ID NO: 10157 - DNA, 21 bp, Artificial sequence
  SiRNA target sequence
catggattaaattagatggta

SEQ ID NO: 10158 - DNA, 21 bp, Artificial sequence
  SiRNA target sequence
atggattaaattagatggtat

SEQ ID NO: 10159 - DNA, 21 bp, Artificial sequence
  SiRNA target sequence
tggattaaattagatggtatt

SEQ ID NO: 10160 - DNA, 21 bp, Artificial sequence
  SiRNA target sequence
ggattaaattagatggtattc

SEQ ID NO: 10161 - DNA, 21 bp, Artificial sequence
  SiRNA target sequence
gattaaattagatggtattct

SEQ ID NO: 10162 - DNA, 21 bp, Artificial sequence
  SiRNA target sequence
attaaattagatggtattcta

SEQ ID NO: 10163 - DNA, 21 bp, Artificial sequence
  SiRNA target sequence
ttaaattagatggtattctag

SEQ ID NO: 10164 - DNA, 21 bp, Artificial sequence
  SiRNA target sequence
taaattagatggtattctagt

SEQ ID NO: 10165 - DNA, 21 bp, Artificial sequence
  SiRNA target sequence
aaattagatggtattctagtt

SEQ ID NO: 10166 - DNA, 21 bp, Artificial sequence
  SiRNA target sequence
aattagatggtattctagttt

SEQ ID NO: 10167 - DNA, 21 bp, Artificial sequence
  SiRNA target sequence
attagatggtattctagttta

SEQ ID NO: 10168 - DNA, 21 bp, Artificial sequence
  SiRNA target sequence
ttagatggtattctagtttag

SEQ ID NO: 10169 - DNA, 21 bp, Artificial sequence
  SiRNA target sequence
tagatggtattctagtttaga

SEQ ID NO: 10170 - DNA, 21 bp, Artificial sequence
  SiRNA target sequence
agatggtattctagtttagag

SEQ ID NO: 10171 - DNA, 21 bp, Artificial sequence
  SiRNA target sequence
gatggtattctagtttagagg

SEQ ID NO: 10172 - DNA, 21 bp, Artificial sequence
  SiRNA target sequence
atggtattctagtttagaggt

SEQ ID NO: 10173 - DNA, 21 bp, Artificial sequence
  SiRNA target sequence
tggtattctagtttagaggtg

SEQ ID NO: 10174 - DNA, 21 bp, Artificial sequence
  SiRNA target sequence
ggtattctagtttagaggtga

SEQ ID NO: 10175 - DNA, 21 bp, Artificial sequence
  SiRNA target sequence
gtattctagtttagaggtgat

SEQ ID NO: 10176 - DNA, 21 bp, Artificial sequence
  SiRNA target sequence
tattctagtttagaggtgatt

SEQ ID NO: 10177 - DNA, 21 bp, Artificial sequence
  SiRNA target sequence
attctagtttagaggtgattc

SEQ ID NO: 10178 - DNA, 21 bp, Artificial sequence
  SiRNA target sequence
ttctagtttagaggtgattcg

SEQ ID NO: 10179 - DNA, 21 bp, Artificial sequence
  SiRNA target sequence
tctagtttagaggtgattcgg

SEQ ID NO: 10180 - DNA, 21 bp, Artificial sequence
  SiRNA target sequence
ctagtttagaggtgattcggc

SEQ ID NO: 10181 - DNA, 21 bp, Artificial sequence
  SiRNA target sequence
tagtttagaggtgattcggcg

SEQ ID NO: 10182 - DNA, 21 bp, Artificial sequence
  SiRNA target sequence
agtttagaggtgattcggcgc

SEQ ID NO: 10183 - DNA, 21 bp, Artificial sequence
  SiRNA target sequence
gtttagaggtgattcggcgct

SEQ ID NO: 10184 - DNA, 21 bp, Artificial sequence
  SiRNA target sequence
tttagaggtgattcggcgctg

SEQ ID NO: 10185 - DNA, 21 bp, Artificial sequence
  SiRNA target sequence
ttagaggtgattcggcgctgc

SEQ ID NO: 10186 - DNA, 21 bp, Artificial sequence
  SiRNA target sequence
tagaggtgattcggcgctgcg

SEQ ID NO: 10187 - DNA, 21 bp, Artificial sequence
  SiRNA target sequence
agaggtgattcggcgctgcgg

SEQ ID NO: 10188 - DNA, 21 bp, Artificial sequence
  SiRNA target sequence
gaggtgattcggcgctgcggt

SEQ ID NO: 10189 - DNA, 21 bp, Artificial sequence
  SiRNA target sequence
aggtgattcggcgctgcggtg

SEQ ID NO: 10190 - DNA, 21 bp, Artificial sequence
  SiRNA target sequence
ggtgattcggcgctgcggtgc

SEQ ID NO: 10191 - DNA, 21 bp, Artificial sequence
  SiRNA target sequence
gtgattcggcgctgcggtgcg

SEQ ID NO: 10192 - DNA, 21 bp, Artificial sequence
  SiRNA target sequence
tgattcggcgctgcggtgcga

SEQ ID NO: 10193 - DNA, 21 bp, Artificial sequence
  SiRNA target sequence
gattcggcgctgcggtgcgac

SEQ ID NO: 10194 - DNA, 21 bp, Artificial sequence
  SiRNA target sequence
attcggcgctgcggtgcgact

SEQ ID NO: 10195 - DNA, 21 bp, Artificial sequence
  SiRNA target sequence
ttcggcgctgcggtgcgactg

SEQ ID NO: 10196 - DNA, 21 bp, Artificial sequence
  SiRNA target sequence
tcggcgctgcggtgcgactga

SEQ ID NO: 10197 - DNA, 21 bp, Artificial sequence
  SiRNA target sequence
cggcgctgcggtgcgactgaa

SEQ ID NO: 10198 - DNA, 21 bp, Artificial sequence
  SiRNA target sequence
ggcgctgcggtgcgactgaaa

SEQ ID NO: 10199 - DNA, 21 bp, Artificial sequence
  SiRNA target sequence
gcgctgcggtgcgactgaaac

SEQ ID NO: 10200 - DNA, 21 bp, Artificial sequence
  SiRNA target sequence
cgctgcggtgcgactgaaact

SEQ ID NO: 10201 - DNA, 21 bp, Artificial sequence
  SiRNA target sequence
gctgcggtgcgactgaaactt

SEQ ID NO: 10202 - DNA, 21 bp, Artificial sequence
  SiRNA target sequence
ctgcggtgcgactgaaacttc

SEQ ID NO: 10203 - DNA, 21 bp, Artificial sequence
  SiRNA target sequence
tgcggtgcgactgaaacttct

SEQ ID NO: 10204 - DNA, 21 bp, Artificial sequence
  SiRNA target sequence
gcggtgcgactgaaacttcta

SEQ ID NO: 10205 - DNA, 21 bp, Artificial sequence
  SiRNA target sequence
cggtgcgactgaaacttctaa

SEQ ID NO: 10206 - DNA, 21 bp, Artificial sequence
  SiRNA target sequence
ggtgcgactgaaacttctaaa

SEQ ID NO: 10207 - DNA, 21 bp, Artificial sequence
  SiRNA target sequence
gtgcgactgaaacttctaaat

SEQ ID NO: 10208 - DNA, 21 bp, Artificial sequence
  SiRNA target sequence
tgcgactgaaacttctaaatt

SEQ ID NO: 10209 - DNA, 21 bp, Artificial sequence
  SiRNA target sequence
gcgactgaaacttctaaatta

SEQ ID NO: 10210 - DNA, 21 bp, Artificial sequence
  SiRNA target sequence
cgactgaaacttctaaattag

SEQ ID NO: 10211 - DNA, 21 bp, Artificial sequence
  SiRNA target sequence
gactgaaacttctaaattagc

SEQ ID NO: 10212 - DNA, 21 bp, Artificial sequence
  SiRNA target sequence
actgaaacttctaaattagca

SEQ ID NO: 10213 - DNA, 21 bp, Artificial sequence
  SiRNA target sequence
ctgaaacttctaaattagcat

SEQ ID NO: 10214 - DNA, 21 bp, Artificial sequence
  SiRNA target sequence
tgaaacttctaaattagcatg

SEQ ID NO: 10215 - DNA, 21 bp, Artificial sequence
  SiRNA target sequence
gaaacttctaaattagcatgt

SEQ ID NO: 10216 - DNA, 21 bp, Artificial sequence
  SiRNA target sequence
aaacttctaaattagcatgtc

SEQ ID NO: 10217 - DNA, 21 bp, Artificial sequence
  SiRNA target sequence
aacttctaaattagcatgtca

SEQ ID NO: 10218 - DNA, 21 bp, Artificial sequence
  SiRNA target sequence
acttctaaattagcatgtcag

SEQ ID NO: 10219 - DNA, 21 bp, Artificial sequence
  SiRNA target sequence
cttctaaattagcatgtcaga

SEQ ID NO: 10220 - DNA, 21 bp, Artificial sequence
  SiRNA target sequence
ttctaaattagcatgtcagat

SEQ ID NO: 10221 - DNA, 21 bp, Artificial sequence
  SiRNA target sequence
tctaaattagcatgtcagatt

SEQ ID NO: 10222 - DNA, 21 bp, Artificial sequence
  SiRNA target sequence
ctaaattagcatgtcagatta

SEQ ID NO: 10223 - DNA, 21 bp, Artificial sequence
  SiRNA target sequence
taaattagcatgtcagattat

SEQ ID NO: 10224 - DNA, 21 bp, Artificial sequence
  SiRNA target sequence
aaattagcatgtcagattata

SEQ ID NO: 10225 - DNA, 21 bp, Artificial sequence
  SiRNA target sequence
aattagcatgtcagattatat

SEQ ID NO: 10226 - DNA, 21 bp, Artificial sequence
  SiRNA target sequence
attagcatgtcagattatatt

SEQ ID NO: 10227 - DNA, 21 bp, Artificial sequence
  SiRNA target sequence
ttagcatgtcagattatatta

SEQ ID NO: 10228 - DNA, 21 bp, Artificial sequence
  SiRNA target sequence
tagcatgtcagattatattat

SEQ ID NO: 10229 - DNA, 21 bp, Artificial sequence
  SiRNA target sequence
agcatgtcagattatattatg

SEQ ID NO: 10230 - DNA, 21 bp, Artificial sequence
  SiRNA target sequence
gcatgtcagattatattatga

SEQ ID NO: 10231 - DNA, 21 bp, Artificial sequence
  SiRNA target sequence
catgtcagattatattatgaa

SEQ ID NO: 10232 - DNA, 21 bp, Artificial sequence
  SiRNA target sequence
atgtcagattatattatgaat

SEQ ID NO: 10233 - DNA, 21 bp, Artificial sequence
  SiRNA target sequence
tgtcagattatattatgaatg

SEQ ID NO: 10234 - DNA, 21 bp, Artificial sequence
  SiRNA target sequence
gtcagattatattatgaatgc

SEQ ID NO: 10235 - DNA, 21 bp, Artificial sequence
  SiRNA target sequence
tcagattatattatgaatgcg

SEQ ID NO: 10236 - DNA, 21 bp, Artificial sequence
  SiRNA target sequence
cagattatattatgaatgcgt

SEQ ID NO: 10237 - DNA, 21 bp, Artificial sequence
  SiRNA target sequence
agattatattatgaatgcgtt

SEQ ID NO: 10238 - DNA, 21 bp, Artificial sequence
  SiRNA target sequence
gattatattatgaatgcgtta

SEQ ID NO: 10239 - DNA, 21 bp, Artificial sequence
  SiRNA target sequence
attatattatgaatgcgttag

SEQ ID NO: 10240 - DNA, 21 bp, Artificial sequence
  SiRNA target sequence
ttatattatgaatgcgttagt

SEQ ID NO: 10241 - DNA, 21 bp, Artificial sequence
  SiRNA target sequence
tatattatgaatgcgttagta

SEQ ID NO: 10242 - DNA, 21 bp, Artificial sequence
  SiRNA target sequence
atattatgaatgcgttagtag

SEQ ID NO: 10243 - DNA, 21 bp, Artificial sequence
  SiRNA target sequence
tattatgaatgcgttagtagt

SEQ ID NO: 10244 - DNA, 21 bp, Artificial sequence
  SiRNA target sequence
attatgaatgcgttagtagta

SEQ ID NO: 10245 - DNA, 21 bp, Artificial sequence
  SiRNA target sequence
ttatgaatgcgttagtagtaa

SEQ ID NO: 10246 - DNA, 21 bp, Artificial sequence
  SiRNA target sequence
tatgaatgcgttagtagtaat

SEQ ID NO: 10247 - DNA, 21 bp, Artificial sequence
  SiRNA target sequence
atgaatgcgttagtagtaatt

SEQ ID NO: 10248 - DNA, 21 bp, Artificial sequence
  SiRNA target sequence
tgaatgcgttagtagtaattt

SEQ ID NO: 10249 - DNA, 21 bp, Artificial sequence
  SiRNA target sequence
gaatgcgttagtagtaatttc

SEQ ID NO: 10250 - DNA, 21 bp, Artificial sequence
  SiRNA target sequence
aatgcgttagtagtaatttct

SEQ ID NO: 10251 - DNA, 21 bp, Artificial sequence
  SiRNA target sequence
atgcgttagtagtaatttctg

SEQ ID NO: 10252 - DNA, 21 bp, Artificial sequence
  SiRNA target sequence
tgcgttagtagtaatttctgc

SEQ ID NO: 10253 - DNA, 21 bp, Artificial sequence
  SiRNA target sequence
gcgttagtagtaatttctgcg

SEQ ID NO: 10254 - DNA, 21 bp, Artificial sequence
  SiRNA target sequence
cgttagtagtaatttctgcga

SEQ ID NO: 10255 - DNA, 21 bp, Artificial sequence
  SiRNA target sequence
gttagtagtaatttctgcgat

SEQ ID NO: 10256 - DNA, 21 bp, Artificial sequence
  SiRNA target sequence
ttagtagtaatttctgcgata

SEQ ID NO: 10257 - DNA, 21 bp, Artificial sequence
  SiRNA target sequence
tagtagtaatttctgcgatag

SEQ ID NO: 10258 - DNA, 21 bp, Artificial sequence
  SiRNA target sequence
agtagtaatttctgcgataga

SEQ ID NO: 10259 - DNA, 21 bp, Artificial sequence
  SiRNA target sequence
gtagtaatttctgcgatagag

SEQ ID NO: 10260 - DNA, 21 bp, Artificial sequence
  SiRNA target sequence
tagtaatttctgcgatagagc

SEQ ID NO: 10261 - DNA, 21 bp, Artificial sequence
  SiRNA target sequence
agtaatttctgcgatagagct

SEQ ID NO: 10262 - DNA, 21 bp, Artificial sequence
  SiRNA target sequence
gtaatttctgcgatagagctg

SEQ ID NO: 10263 - DNA, 21 bp, Artificial sequence
  SiRNA target sequence
taatttctgcgatagagctgg

SEQ ID NO: 10264 - DNA, 21 bp, Artificial sequence
  SiRNA target sequence
aatttctgcgatagagctggg

SEQ ID NO: 10265 - DNA, 21 bp, Artificial sequence
  SiRNA target sequence
atttctgcgatagagctggga

SEQ ID NO: 10266 - DNA, 21 bp, Artificial sequence
  SiRNA target sequence
tttctgcgatagagctgggac

SEQ ID NO: 10267 - DNA, 21 bp, Artificial sequence
  SiRNA target sequence
ttctgcgatagagctgggacc

SEQ ID NO: 10268 - DNA, 21 bp, Artificial sequence
  SiRNA target sequence
tctgcgatagagctgggaccc

SEQ ID NO: 10269 - DNA, 21 bp, Artificial sequence
  SiRNA target sequence
ctgcgatagagctgggacccc

SEQ ID NO: 10270 - DNA, 21 bp, Artificial sequence
  SiRNA target sequence
tgcgatagagctgggacccct

SEQ ID NO: 10271 - DNA, 21 bp, Artificial sequence
  SiRNA target sequence
gcgatagagctgggacccctc

SEQ ID NO: 10272 - DNA, 21 bp, Artificial sequence
  SiRNA target sequence
cgatagagctgggacccctca

SEQ ID NO: 10273 - DNA, 21 bp, Artificial sequence
  SiRNA target sequence
gatagagctgggacccctcag

SEQ ID NO: 10274 - DNA, 21 bp, Artificial sequence
  SiRNA target sequence
atagagctgggacccctcagt

SEQ ID NO: 10275 - DNA, 21 bp, Artificial sequence
  SiRNA target sequence
tagagctgggacccctcagtc

SEQ ID NO: 10276 - DNA, 21 bp, Artificial sequence
  SiRNA target sequence
agagctgggacccctcagtct

SEQ ID NO: 10277 - DNA, 21 bp, Artificial sequence
  SiRNA target sequence
gagctgggacccctcagtctc

SEQ ID NO: 10278 - DNA, 21 bp, Artificial sequence
  SiRNA target sequence
agctgggacccctcagtctct

SEQ ID NO: 10279 - DNA, 21 bp, Artificial sequence
  SiRNA target sequence
gctgggacccctcagtctctc

SEQ ID NO: 10280 - DNA, 21 bp, Artificial sequence
  SiRNA target sequence
ctgggacccctcagtctctca

SEQ ID NO: 10281 - DNA, 21 bp, Artificial sequence
  SiRNA target sequence
tgggacccctcagtctctcag

SEQ ID NO: 10282 - DNA, 21 bp, Artificial sequence
  SiRNA target sequence
gggacccctcagtctctcagg

SEQ ID NO: 10283 - DNA, 21 bp, Artificial sequence
  SiRNA target sequence
ggacccctcagtctctcaggt

SEQ ID NO: 10284 - DNA, 21 bp, Artificial sequence
  SiRNA target sequence
gacccctcagtctctcaggta

SEQ ID NO: 10285 - DNA, 21 bp, Artificial sequence
  SiRNA target sequence
acccctcagtctctcaggtat

SEQ ID NO: 10286 - DNA, 21 bp, Artificial sequence
  SiRNA target sequence
cccctcagtctctcaggtatt

SEQ ID NO: 10287 - DNA, 21 bp, Artificial sequence
  SiRNA target sequence
ccctcagtctctcaggtattg

SEQ ID NO: 10288 - DNA, 21 bp, Artificial sequence
  SiRNA target sequence
cctcagtctctcaggtattgt

SEQ ID NO: 10289 - DNA, 21 bp, Artificial sequence
  SiRNA target sequence
ctcagtctctcaggtattgta

SEQ ID NO: 10290 - DNA, 21 bp, Artificial sequence
  SiRNA target sequence
tcagtctctcaggtattgtac

SEQ ID NO: 10291 - DNA, 21 bp, Artificial sequence
  SiRNA target sequence
cagtctctcaggtattgtacg

SEQ ID NO: 10292 - DNA, 21 bp, Artificial sequence
  SiRNA target sequence
agtctctcaggtattgtacga

SEQ ID NO: 10293 - DNA, 21 bp, Artificial sequence
  SiRNA target sequence
gtctctcaggtattgtacgag

SEQ ID NO: 10294 - DNA, 21 bp, Artificial sequence
  SiRNA target sequence
tctctcaggtattgtacgagg

SEQ ID NO: 10295 - DNA, 21 bp, Artificial sequence
  SiRNA target sequence
ctctcaggtattgtacgaggc

SEQ ID NO: 10296 - DNA, 21 bp, Artificial sequence
  SiRNA target sequence
tctcaggtattgtacgaggcg

SEQ ID NO: 10297 - DNA, 21 bp, Artificial sequence
  SiRNA target sequence
ctcaggtattgtacgaggcga

SEQ ID NO: 10298 - DNA, 21 bp, Artificial sequence
  SiRNA target sequence
tcaggtattgtacgaggcgaa

SEQ ID NO: 10299 - DNA, 21 bp, Artificial sequence
  SiRNA target sequence
caggtattgtacgaggcgaaa

SEQ ID NO: 10300 - DNA, 21 bp, Artificial sequence
  SiRNA target sequence
aggtattgtacgaggcgaaag

SEQ ID NO: 10301 - DNA, 21 bp, Artificial sequence
  SiRNA target sequence
ggtattgtacgaggcgaaagt

SEQ ID NO: 10302 - DNA, 21 bp, Artificial sequence
  SiRNA target sequence
gtattgtacgaggcgaaagtg

SEQ ID NO: 10303 - DNA, 21 bp, Artificial sequence
  SiRNA target sequence
tattgtacgaggcgaaagtgt

SEQ ID NO: 10304 - DNA, 21 bp, Artificial sequence
  SiRNA target sequence
attgtacgaggcgaaagtgtg

SEQ ID NO: 10305 - DNA, 21 bp, Artificial sequence
  SiRNA target sequence
ttgtacgaggcgaaagtgtga

SEQ ID NO: 10306 - DNA, 21 bp, Artificial sequence
  SiRNA target sequence
tgtacgaggcgaaagtgtgaa

SEQ ID NO: 10307 - DNA, 21 bp, Artificial sequence
  SiRNA target sequence
gtacgaggcgaaagtgtgaaa

SEQ ID NO: 10308 - DNA, 21 bp, Artificial sequence
  SiRNA target sequence
tacgaggcgaaagtgtgaaag

SEQ ID NO: 10309 - DNA, 21 bp, Artificial sequence
  SiRNA target sequence
acgaggcgaaagtgtgaaagt

SEQ ID NO: 10310 - DNA, 21 bp, Artificial sequence
  SiRNA target sequence
cgaggcgaaagtgtgaaagtt

SEQ ID NO: 10311 - DNA, 21 bp, Artificial sequence
  SiRNA target sequence
gaggcgaaagtgtgaaagttt

SEQ ID NO: 10312 - DNA, 21 bp, Artificial sequence
  SiRNA target sequence
aggcgaaagtgtgaaagtttt

SEQ ID NO: 10313 - DNA, 21 bp, Artificial sequence
  SiRNA target sequence
ggcgaaagtgtgaaagttttg

SEQ ID NO: 10314 - DNA, 21 bp, Artificial sequence
  SiRNA target sequence
gcgaaagtgtgaaagttttgt

SEQ ID NO: 10315 - DNA, 21 bp, Artificial sequence
  SiRNA target sequence
cgaaagtgtgaaagttttgta

SEQ ID NO: 10316 - DNA, 21 bp, Artificial sequence
  SiRNA target sequence
gaaagtgtgaaagttttgtat

SEQ ID NO: 10317 - DNA, 21 bp, Artificial sequence
  SiRNA target sequence
aaagtgtgaaagttttgtatg

SEQ ID NO: 10318 - DNA, 21 bp, Artificial sequence
  SiRNA target sequence
aagtgtgaaagttttgtatgt

SEQ ID NO: 10319 - DNA, 21 bp, Artificial sequence
  SiRNA target sequence
agtgtgaaagttttgtatgtg

SEQ ID NO: 10320 - DNA, 21 bp, Artificial sequence
  SiRNA target sequence
gtgtgaaagttttgtatgtgt

SEQ ID NO: 10321 - DNA, 21 bp, Artificial sequence
  SiRNA target sequence
tgtgaaagttttgtatgtgtt

SEQ ID NO: 10322 - DNA, 21 bp, Artificial sequence
  SiRNA target sequence
gtgaaagttttgtatgtgttt

SEQ ID NO: 10323 - DNA, 21 bp, Artificial sequence
  SiRNA target sequence
tgaaagttttgtatgtgtttt

SEQ ID NO: 10324 - DNA, 21 bp, Artificial sequence
  SiRNA target sequence
gaaagttttgtatgtgttttt

SEQ ID NO: 10325 - DNA, 21 bp, Artificial sequence
  SiRNA target sequence
aaagttttgtatgtgttttta

SEQ ID NO: 10326 - DNA, 21 bp, Artificial sequence
  SiRNA target sequence
aagttttgtatgtgtttttat

SEQ ID NO: 10327 - DNA, 21 bp, Artificial sequence
  SiRNA target sequence
agttttgtatgtgtttttata

SEQ ID NO: 10328 - DNA, 21 bp, Artificial sequence
  SiRNA target sequence
gttttgtatgtgtttttatat

SEQ ID NO: 10329 - DNA, 21 bp, Artificial sequence
  SiRNA target sequence
ttttgtatgtgtttttatatg

SEQ ID NO: 10330 - DNA, 21 bp, Artificial sequence
  SiRNA target sequence
tttgtatgtgtttttatatgt

SEQ ID NO: 10331 - DNA, 21 bp, Artificial sequence
  SiRNA target sequence
ttgtatgtgtttttatatgta

SEQ ID NO: 10332 - DNA, 21 bp, Artificial sequence
  SiRNA target sequence
tgtatgtgtttttatatgtac

SEQ ID NO: 10333 - DNA, 21 bp, Artificial sequence
  SiRNA target sequence
gtatgtgtttttatatgtacg

SEQ ID NO: 10334 - DNA, 21 bp, Artificial sequence
  SiRNA target sequence
tatgtgtttttatatgtacga

SEQ ID NO: 10335 - DNA, 21 bp, Artificial sequence
  SiRNA target sequence
atgtgtttttatatgtacgac

SEQ ID NO: 10336 - DNA, 21 bp, Artificial sequence
  SiRNA target sequence
tgtgtttttatatgtacgact

SEQ ID NO: 10337 - DNA, 21 bp, Artificial sequence
  SiRNA target sequence
gtgtttttatatgtacgactg

SEQ ID NO: 10338 - DNA, 21 bp, Artificial sequence
  SiRNA target sequence
tgtttttatatgtacgactgt

SEQ ID NO: 10339 - DNA, 21 bp, Artificial sequence
  SiRNA target sequence
gtttttatatgtacgactgta

SEQ ID NO: 10340 - DNA, 21 bp, Artificial sequence
  SiRNA target sequence
tttttatatgtacgactgtat

SEQ ID NO: 10341 - DNA, 21 bp, Artificial sequence
  SiRNA target sequence
ttttatatgtacgactgtatc

SEQ ID NO: 10342 - DNA, 21 bp, Artificial sequence
  SiRNA target sequence
tttatatgtacgactgtatcg

SEQ ID NO: 10343 - DNA, 21 bp, Artificial sequence
  SiRNA target sequence
ttatatgtacgactgtatcgg

SEQ ID NO: 10344 - DNA, 21 bp, Artificial sequence
  SiRNA target sequence
tatatgtacgactgtatcggg

SEQ ID NO: 10345 - DNA, 21 bp, Artificial sequence
  SiRNA target sequence
atatgtacgactgtatcggga

SEQ ID NO: 10346 - DNA, 21 bp, Artificial sequence
  SiRNA target sequence
tatgtacgactgtatcgggaa

SEQ ID NO: 10347 - DNA, 21 bp, Artificial sequence
  SiRNA target sequence
atgtacgactgtatcgggaat

SEQ ID NO: 10348 - DNA, 21 bp, Artificial sequence
  SiRNA target sequence
tgtacgactgtatcgggaatt

SEQ ID NO: 10349 - DNA, 21 bp, Artificial sequence
  SiRNA target sequence
gtacgactgtatcgggaattc

SEQ ID NO: 10350 - DNA, 21 bp, Artificial sequence
  SiRNA target sequence
tacgactgtatcgggaattcc

SEQ ID NO: 10351 - DNA, 21 bp, Artificial sequence
  SiRNA target sequence
acgactgtatcgggaattcct

SEQ ID NO: 10352 - DNA, 21 bp, Artificial sequence
  SiRNA target sequence
cgactgtatcgggaattcctt

SEQ ID NO: 10353 - DNA, 21 bp, Artificial sequence
  SiRNA target sequence
gactgtatcgggaattccttt

SEQ ID NO: 10354 - DNA, 21 bp, Artificial sequence
  SiRNA target sequence
actgtatcgggaattccttta

SEQ ID NO: 10355 - DNA, 21 bp, Artificial sequence
  SiRNA target sequence
ctgtatcgggaattcctttag

SEQ ID NO: 10356 - DNA, 21 bp, Artificial sequence
  SiRNA target sequence
tgtatcgggaattcctttagc

SEQ ID NO: 10357 - DNA, 21 bp, Artificial sequence
  SiRNA target sequence
gtatcgggaattcctttagca

SEQ ID NO: 10358 - DNA, 21 bp, Artificial sequence
  SiRNA target sequence
tatcgggaattcctttagcaa

SEQ ID NO: 10359 - DNA, 21 bp, Artificial sequence
  SiRNA target sequence
atcgggaattcctttagcaag

SEQ ID NO: 10360 - DNA, 21 bp, Artificial sequence
  SiRNA target sequence
tcgggaattcctttagcaaga

SEQ ID NO: 10361 - DNA, 21 bp, Artificial sequence
  SiRNA target sequence
cgggaattcctttagcaagaa

SEQ ID NO: 10362 - DNA, 21 bp, Artificial sequence
  SiRNA target sequence
gggaattcctttagcaagaat

SEQ ID NO: 10363 - DNA, 21 bp, Artificial sequence
  SiRNA target sequence
ggaattcctttagcaagaatc

SEQ ID NO: 10364 - DNA, 21 bp, Artificial sequence
  SiRNA target sequence
gaattcctttagcaagaatcc

SEQ ID NO: 10365 - DNA, 21 bp, Artificial sequence
  SiRNA target sequence
aattcctttagcaagaatcct

SEQ ID NO: 10366 - DNA, 21 bp, Artificial sequence
  SiRNA target sequence
attcctttagcaagaatcctt

SEQ ID NO: 10367 - DNA, 21 bp, Artificial sequence
  SiRNA target sequence
ttcctttagcaagaatccttt

SEQ ID NO: 10368 - DNA, 21 bp, Artificial sequence
  SiRNA target sequence
tcctttagcaagaatcctttt

SEQ ID NO: 10369 - DNA, 21 bp, Artificial sequence
  SiRNA target sequence
cctttagcaagaatcctttta

SEQ ID NO: 10370 - DNA, 21 bp, Artificial sequence
  SiRNA target sequence
ctttagcaagaatccttttaa

SEQ ID NO: 10371 - DNA, 21 bp, Artificial sequence
  SiRNA target sequence
tttagcaagaatccttttaat

SEQ ID NO: 10372 - DNA, 21 bp, Artificial sequence
  SiRNA target sequence
ttagcaagaatccttttaata

SEQ ID NO: 10373 - DNA, 21 bp, Artificial sequence
  SiRNA target sequence
tagcaagaatccttttaatac

SEQ ID NO: 10374 - DNA, 21 bp, Artificial sequence
  SiRNA target sequence
agcaagaatccttttaataca

SEQ ID NO: 10375 - DNA, 21 bp, Artificial sequence
  SiRNA target sequence
gcaagaatccttttaatacag

SEQ ID NO: 10376 - DNA, 21 bp, Artificial sequence
  SiRNA target sequence
caagaatccttttaatacagt

SEQ ID NO: 10377 - DNA, 21 bp, Artificial sequence
  SiRNA target sequence
aagaatccttttaatacagta

SEQ ID NO: 10378 - DNA, 21 bp, Artificial sequence
  SiRNA target sequence
agaatccttttaatacagtat

SEQ ID NO: 10379 - DNA, 21 bp, Artificial sequence
  SiRNA target sequence
gaatccttttaatacagtata

SEQ ID NO: 10380 - DNA, 21 bp, Artificial sequence
  SiRNA target sequence
aatccttttaatacagtataa

SEQ ID NO: 10381 - DNA, 21 bp, Artificial sequence
  SiRNA target sequence
atccttttaatacagtataat

SEQ ID NO: 10382 - DNA, 21 bp, Artificial sequence
  SiRNA target sequence
tccttttaatacagtataatt

SEQ ID NO: 10383 - DNA, 21 bp, Artificial sequence
  SiRNA target sequence
ccttttaatacagtataattt

SEQ ID NO: 10384 - DNA, 21 bp, Artificial sequence
  SiRNA target sequence
cttttaatacagtataatttg

SEQ ID NO: 10385 - DNA, 21 bp, Artificial sequence
  SiRNA target sequence
ttttaatacagtataatttgt

SEQ ID NO: 10386 - DNA, 21 bp, Artificial sequence
  SiRNA target sequence
tttaatacagtataatttgtg

SEQ ID NO: 10387 - DNA, 21 bp, Artificial sequence
  SiRNA target sequence
ttaatacagtataatttgtgc

SEQ ID NO: 10388 - DNA, 21 bp, Artificial sequence
  SiRNA target sequence
taatacagtataatttgtgct

SEQ ID NO: 10389 - DNA, 21 bp, Artificial sequence
  SiRNA target sequence
aatacagtataatttgtgcta

SEQ ID NO: 10390 - DNA, 21 bp, Artificial sequence
  SiRNA target sequence
atacagtataatttgtgctac

SEQ ID NO: 10391 - DNA, 21 bp, Artificial sequence
  SiRNA target sequence
tacagtataatttgtgctacg

SEQ ID NO: 10392 - DNA, 21 bp, Artificial sequence
  SiRNA target sequence
acagtataatttgtgctacgg

SEQ ID NO: 10393 - DNA, 21 bp, Artificial sequence
  SiRNA target sequence
cagtataatttgtgctacggt

SEQ ID NO: 10394 - DNA, 21 bp, Artificial sequence
  SiRNA target sequence
agtataatttgtgctacggta

SEQ ID NO: 10395 - DNA, 21 bp, Artificial sequence
  SiRNA target sequence
gtataatttgtgctacggtac

SEQ ID NO: 10396 - DNA, 21 bp, Artificial sequence
  SiRNA target sequence
tataatttgtgctacggtacg

SEQ ID NO: 10397 - DNA, 21 bp, Artificial sequence
  SiRNA target sequence
ataatttgtgctacggtacgt

SEQ ID NO: 10398 - DNA, 21 bp, Artificial sequence
  SiRNA target sequence
taatttgtgctacggtacgtt

SEQ ID NO: 10399 - DNA, 21 bp, Artificial sequence
  SiRNA target sequence
aatttgtgctacggtacgtta

SEQ ID NO: 10400 - DNA, 21 bp, Artificial sequence
  SiRNA target sequence
atttgtgctacggtacgttac

SEQ ID NO: 10401 - DNA, 21 bp, Artificial sequence
  SiRNA target sequence
tttgtgctacggtacgttacg

SEQ ID NO: 10402 - DNA, 21 bp, Artificial sequence
  SiRNA target sequence
ttgtgctacggtacgttacgt

SEQ ID NO: 10403 - DNA, 21 bp, Artificial sequence
  SiRNA target sequence
tgtgctacggtacgttacgtt

SEQ ID NO: 10404 - DNA, 21 bp, Artificial sequence
  SiRNA target sequence
gtgctacggtacgttacgttc

SEQ ID NO: 10405 - DNA, 21 bp, Artificial sequence
  SiRNA target sequence
tgctacggtacgttacgttcg

SEQ ID NO: 10406 - DNA, 21 bp, Artificial sequence
  SiRNA target sequence
gctacggtacgttacgttcgc

SEQ ID NO: 10407 - DNA, 21 bp, Artificial sequence
  SiRNA target sequence
ctacggtacgttacgttcgca

SEQ ID NO: 10408 - DNA, 21 bp, Artificial sequence
  SiRNA target sequence
tacggtacgttacgttcgcag

SEQ ID NO: 10409 - DNA, 21 bp, Artificial sequence
  SiRNA target sequence
acggtacgttacgttcgcagg

SEQ ID NO: 10410 - DNA, 21 bp, Artificial sequence
  SiRNA target sequence
cggtacgttacgttcgcaggg

SEQ ID NO: 10411 - DNA, 21 bp, Artificial sequence
  SiRNA target sequence
ggtacgttacgttcgcagggc

SEQ ID NO: 10412 - DNA, 21 bp, Artificial sequence
  SiRNA target sequence
gtacgttacgttcgcagggca

SEQ ID NO: 10413 - DNA, 21 bp, Artificial sequence
  SiRNA target sequence
tacgttacgttcgcagggcac

SEQ ID NO: 10414 - DNA, 21 bp, Artificial sequence
  SiRNA target sequence
acgttacgttcgcagggcacc

SEQ ID NO: 10415 - DNA, 21 bp, Artificial sequence
  SiRNA target sequence
cgttacgttcgcagggcaccc

SEQ ID NO: 10416 - DNA, 21 bp, Artificial sequence
  SiRNA target sequence
gttacgttcgcagggcacccg

SEQ ID NO: 10417 - DNA, 21 bp, Artificial sequence
  SiRNA target sequence
ttacgttcgcagggcacccgt

SEQ ID NO: 10418 - DNA, 21 bp, Artificial sequence
  SiRNA target sequence
tacgttcgcagggcacccgtt

SEQ ID NO: 10419 - DNA, 21 bp, Artificial sequence
  SiRNA target sequence
acgttcgcagggcacccgtta

SEQ ID NO: 10420 - DNA, 21 bp, Artificial sequence
  SiRNA target sequence
cgttcgcagggcacccgttaa

SEQ ID NO: 10421 - DNA, 21 bp, Artificial sequence
  SiRNA target sequence
gttcgcagggcacccgttaat

SEQ ID NO: 10422 - DNA, 21 bp, Artificial sequence
  SiRNA target sequence
ttcgcagggcacccgttaatg

SEQ ID NO: 10423 - DNA, 21 bp, Artificial sequence
  SiRNA target sequence
tcgcagggcacccgttaatgt

SEQ ID NO: 10424 - DNA, 21 bp, Artificial sequence
  SiRNA target sequence
cgcagggcacccgttaatgtc

SEQ ID NO: 10425 - DNA, 21 bp, Artificial sequence
  SiRNA target sequence
gcagggcacccgttaatgtct

SEQ ID NO: 10426 - DNA, 21 bp, Artificial sequence
  SiRNA target sequence
cagggcacccgttaatgtctc

SEQ ID NO: 10427 - DNA, 21 bp, Artificial sequence
  SiRNA target sequence
agggcacccgttaatgtctca

SEQ ID NO: 10428 - DNA, 21 bp, Artificial sequence
  SiRNA target sequence
gggcacccgttaatgtctcat

SEQ ID NO: 10429 - DNA, 21 bp, Artificial sequence
  SiRNA target sequence
ggcacccgttaatgtctcata

SEQ ID NO: 10430 - DNA, 21 bp, Artificial sequence
  SiRNA target sequence
gcacccgttaatgtctcatag

SEQ ID NO: 10431 - DNA, 21 bp, Artificial sequence
  SiRNA target sequence
cacccgttaatgtctcatagc

SEQ ID NO: 10432 - DNA, 21 bp, Artificial sequence
  SiRNA target sequence
acccgttaatgtctcatagcc

SEQ ID NO: 10433 - DNA, 21 bp, Artificial sequence
  SiRNA target sequence
cccgttaatgtctcatagccc

SEQ ID NO: 10434 - DNA, 21 bp, Artificial sequence
  SiRNA target sequence
ccgttaatgtctcatagccca

SEQ ID NO: 10435 - DNA, 21 bp, Artificial sequence
  SiRNA target sequence
cgttaatgtctcatagcccag

SEQ ID NO: 10436 - DNA, 21 bp, Artificial sequence
  SiRNA target sequence
gttaatgtctcatagcccaga

SEQ ID NO: 10437 - DNA, 21 bp, Artificial sequence
  SiRNA target sequence
ttaatgtctcatagcccagac

SEQ ID NO: 10438 - DNA, 21 bp, Artificial sequence
  SiRNA target sequence
taatgtctcatagcccagacg

SEQ ID NO: 10439 - DNA, 21 bp, Artificial sequence
  SiRNA target sequence
aatgtctcatagcccagacga

SEQ ID NO: 10440 - DNA, 21 bp, Artificial sequence
  SiRNA target sequence
atgtctcatagcccagacgat

SEQ ID NO: 10441 - DNA, 21 bp, Artificial sequence
  SiRNA target sequence
tgtctcatagcccagacgatg

SEQ ID NO: 10442 - DNA, 21 bp, Artificial sequence
  SiRNA target sequence
gtctcatagcccagacgatgg

SEQ ID NO: 10443 - DNA, 21 bp, Artificial sequence
  SiRNA target sequence
tctcatagcccagacgatggc

SEQ ID NO: 10444 - DNA, 21 bp, Artificial sequence
  SiRNA target sequence
ctcatagcccagacgatggcg

SEQ ID NO: 10445 - DNA, 21 bp, Artificial sequence
  SiRNA target sequence
tcatagcccagacgatggcgg

SEQ ID NO: 10446 - DNA, 21 bp, Artificial sequence
  SiRNA target sequence
catagcccagacgatggcgga

SEQ ID NO: 10447 - DNA, 21 bp, Artificial sequence
  SiRNA target sequence
atagcccagacgatggcggat

SEQ ID NO: 10448 - DNA, 21 bp, Artificial sequence
  SiRNA target sequence
tagcccagacgatggcggatg

SEQ ID NO: 10449 - DNA, 21 bp, Artificial sequence
  SiRNA target sequence
agcccagacgatggcggatgg

SEQ ID NO: 10450 - DNA, 21 bp, Artificial sequence
  SiRNA target sequence
gcccagacgatggcggatgga

SEQ ID NO: 10451 - DNA, 21 bp, Artificial sequence
  SiRNA target sequence
cccagacgatggcggatggaa

SEQ ID NO: 10452 - DNA, 21 bp, Artificial sequence
  SiRNA target sequence
ccagacgatggcggatggaaa

SEQ ID NO: 10453 - DNA, 21 bp, Artificial sequence
  SiRNA target sequence
cagacgatggcggatggaaag

SEQ ID NO: 10454 - DNA, 21 bp, Artificial sequence
  SiRNA target sequence
agacgatggcggatggaaaga

SEQ ID NO: 10455 - DNA, 21 bp, Artificial sequence
  SiRNA target sequence
gacgatggcggatggaaagac

SEQ ID NO: 10456 - DNA, 21 bp, Artificial sequence
  SiRNA target sequence
acgatggcggatggaaagaca

SEQ ID NO: 10457 - DNA, 21 bp, Artificial sequence
  SiRNA target sequence
cgatggcggatggaaagacat

SEQ ID NO: 10458 - DNA, 21 bp, Artificial sequence
  SiRNA target sequence
gatggcggatggaaagacatc

SEQ ID NO: 10459 - DNA, 21 bp, Artificial sequence
  SiRNA target sequence
atggcggatggaaagacatca

SEQ ID NO: 10460 - DNA, 21 bp, Artificial sequence
  SiRNA target sequence
tggcggatggaaagacatcat

SEQ ID NO: 10461 - DNA, 21 bp, Artificial sequence
  SiRNA target sequence
ggcggatggaaagacatcata

SEQ ID NO: 10462 - DNA, 21 bp, Artificial sequence
  SiRNA target sequence
gcggatggaaagacatcatat

SEQ ID NO: 10463 - DNA, 21 bp, Artificial sequence
  SiRNA target sequence
cggatggaaagacatcatatt

SEQ ID NO: 10464 - DNA, 21 bp, Artificial sequence
  SiRNA target sequence
ggatggaaagacatcatattt

SEQ ID NO: 10465 - DNA, 21 bp, Artificial sequence
  SiRNA target sequence
gatggaaagacatcatatttt

SEQ ID NO: 10466 - DNA, 21 bp, Artificial sequence
  SiRNA target sequence
atggaaagacatcatatttta

SEQ ID NO: 10467 - DNA, 21 bp, Artificial sequence
  SiRNA target sequence
tggaaagacatcatattttat

SEQ ID NO: 10468 - DNA, 21 bp, Artificial sequence
  SiRNA target sequence
ggaaagacatcatattttatt

SEQ ID NO: 10469 - DNA, 21 bp, Artificial sequence
  SiRNA target sequence
gaaagacatcatattttattt

SEQ ID NO: 10470 - DNA, 21 bp, Artificial sequence
  SiRNA target sequence
aaagacatcatattttatttt

SEQ ID NO: 10471 - DNA, 21 bp, Artificial sequence
  SiRNA target sequence
aagacatcatattttatttta

SEQ ID NO: 10472 - DNA, 21 bp, Artificial sequence
  SiRNA target sequence
agacatcatattttattttaa

SEQ ID NO: 10473 - DNA, 21 bp, Artificial sequence
  SiRNA target sequence
gacatcatattttattttaat

SEQ ID NO: 10474 - DNA, 21 bp, Artificial sequence
  SiRNA target sequence
acatcatattttattttaatg

SEQ ID NO: 10475 - DNA, 21 bp, Artificial sequence
  SiRNA target sequence
catcatattttattttaatgc

SEQ ID NO: 10476 - DNA, 21 bp, Artificial sequence
  SiRNA target sequence
atcatattttattttaatgct

SEQ ID NO: 10477 - DNA, 21 bp, Artificial sequence
  SiRNA target sequence
tcatattttattttaatgctg

SEQ ID NO: 10478 - DNA, 21 bp, Artificial sequence
  SiRNA target sequence
catattttattttaatgctgt

SEQ ID NO: 10479 - DNA, 21 bp, Artificial sequence
  SiRNA target sequence
atattttattttaatgctgtc

SEQ ID NO: 10480 - DNA, 21 bp, Artificial sequence
  SiRNA target sequence
tattttattttaatgctgtct

SEQ ID NO: 10481 - DNA, 21 bp, Artificial sequence
  SiRNA target sequence
attttattttaatgctgtctt

SEQ ID NO: 10482 - DNA, 21 bp, Artificial sequence
  SiRNA target sequence
ttttattttaatgctgtcttt

SEQ ID NO: 10483 - DNA, 21 bp, Artificial sequence
  SiRNA target sequence
tttattttaatgctgtcttta

SEQ ID NO: 10484 - DNA, 21 bp, Artificial sequence
  SiRNA target sequence
ttattttaatgctgtctttat

SEQ ID NO: 10485 - DNA, 21 bp, Artificial sequence
  SiRNA target sequence
tattttaatgctgtctttatt

SEQ ID NO: 10486 - DNA, 21 bp, Artificial sequence
  SiRNA target sequence
attttaatgctgtctttattg

SEQ ID NO: 10487 - DNA, 21 bp, Artificial sequence
  SiRNA target sequence
ttttaatgctgtctttattgc

SEQ ID NO: 10488 - DNA, 21 bp, Artificial sequence
  SiRNA target sequence
tttaatgctgtctttattgct

SEQ ID NO: 10489 - DNA, 21 bp, Artificial sequence
  SiRNA target sequence
ttaatgctgtctttattgctg

SEQ ID NO: 10490 - DNA, 21 bp, Artificial sequence
  SiRNA target sequence
taatgctgtctttattgctga

SEQ ID NO: 10491 - DNA, 21 bp, Artificial sequence
  SiRNA target sequence
aatgctgtctttattgctgat

SEQ ID NO: 10492 - DNA, 21 bp, Artificial sequence
  SiRNA target sequence
atgctgtctttattgctgatt

SEQ ID NO: 10493 - DNA, 21 bp, Artificial sequence
  SiRNA target sequence
tgctgtctttattgctgattt

SEQ ID NO: 10494 - DNA, 21 bp, Artificial sequence
  SiRNA target sequence
gctgtctttattgctgattta

SEQ ID NO: 10495 - DNA, 21 bp, Artificial sequence
  SiRNA target sequence
ctgtctttattgctgatttat

SEQ ID NO: 10496 - DNA, 21 bp, Artificial sequence
  SiRNA target sequence
tgtctttattgctgatttatt

SEQ ID NO: 10497 - DNA, 21 bp, Artificial sequence
  SiRNA target sequence
gtctttattgctgatttattt

SEQ ID NO: 10498 - DNA, 21 bp, Artificial sequence
  SiRNA target sequence
tctttattgctgatttatttt

SEQ ID NO: 10499 - DNA, 21 bp, Artificial sequence
  SiRNA target sequence
ctttattgctgatttattttg

SEQ ID NO: 10500 - DNA, 21 bp, Artificial sequence
  SiRNA target sequence
tttattgctgatttattttgc

SEQ ID NO: 10501 - DNA, 21 bp, Artificial sequence
  SiRNA target sequence
ttattgctgatttattttgct

SEQ ID NO: 10502 - DNA, 21 bp, Artificial sequence
  SiRNA target sequence
tattgctgatttattttgctg

SEQ ID NO: 10503 - DNA, 21 bp, Artificial sequence
  SiRNA target sequence
attgctgatttattttgctgt

SEQ ID NO: 10504 - DNA, 21 bp, Artificial sequence
  SiRNA target sequence
ttgctgatttattttgctgtt

SEQ ID NO: 10505 - DNA, 21 bp, Artificial sequence
  SiRNA target sequence
tgctgatttattttgctgttt

SEQ ID NO: 10506 - DNA, 21 bp, Artificial sequence
  SiRNA target sequence
gctgatttattttgctgtttt

SEQ ID NO: 10507 - DNA, 21 bp, Artificial sequence
  SiRNA target sequence
ctgatttattttgctgttttt

SEQ ID NO: 10508 - DNA, 21 bp, Artificial sequence
  SiRNA target sequence
tgatttattttgctgttttta

SEQ ID NO: 10509 - DNA, 21 bp, Artificial sequence
  SiRNA target sequence
gatttattttgctgtttttat

SEQ ID NO: 10510 - DNA, 21 bp, Artificial sequence
  SiRNA target sequence
atttattttgctgtttttatt

SEQ ID NO: 10511 - DNA, 21 bp, Artificial sequence
  SiRNA target sequence
tttattttgctgtttttattt

SEQ ID NO: 10512 - DNA, 21 bp, Artificial sequence
  SiRNA target sequence
ttattttgctgtttttatttg

SEQ ID NO: 10513 - DNA, 21 bp, Artificial sequence
  SiRNA target sequence
tattttgctgtttttatttgc

SEQ ID NO: 10514 - DNA, 21 bp, Artificial sequence
  SiRNA target sequence
attttgctgtttttatttgct

SEQ ID NO: 10515 - DNA, 21 bp, Artificial sequence
  SiRNA target sequence
ttttgctgtttttatttgcta

SEQ ID NO: 10516 - DNA, 21 bp, Artificial sequence
  SiRNA target sequence
tttgctgtttttatttgctat

SEQ ID NO: 10517 - DNA, 21 bp, Artificial sequence
  SiRNA target sequence
ttgctgtttttatttgctatt

SEQ ID NO: 10518 - DNA, 21 bp, Artificial sequence
  SiRNA target sequence
tgctgtttttatttgctattt

SEQ ID NO: 10519 - DNA, 21 bp, Artificial sequence
  SiRNA target sequence
gctgtttttatttgctatttt

SEQ ID NO: 10520 - DNA, 21 bp, Artificial sequence
  SiRNA target sequence
ctgtttttatttgctatttta

SEQ ID NO: 10521 - DNA, 21 bp, Artificial sequence
  SiRNA target sequence
tgtttttatttgctattttat

SEQ ID NO: 10522 - DNA, 21 bp, Artificial sequence
  SiRNA target sequence
gtttttatttgctattttata

SEQ ID NO: 10523 - DNA, 21 bp, Artificial sequence
  SiRNA target sequence
tttttatttgctattttatat

SEQ ID NO: 10524 - DNA, 21 bp, Artificial sequence
  SiRNA target sequence
ttttatttgctattttatatt

SEQ ID NO: 10525 - DNA, 21 bp, Artificial sequence
  SiRNA target sequence
tttatttgctattttatattt

SEQ ID NO: 10526 - DNA, 21 bp, Artificial sequence
  SiRNA target sequence
ttatttgctattttatatttg

SEQ ID NO: 10527 - DNA, 21 bp, Artificial sequence
  SiRNA target sequence
tatttgctattttatatttgc

SEQ ID NO: 10528 - DNA, 21 bp, Artificial sequence
  SiRNA target sequence
atttgctattttatatttgct

SEQ ID NO: 10529 - DNA, 21 bp, Artificial sequence
  SiRNA target sequence
tttgctattttatatttgcta

SEQ ID NO: 10530 - DNA, 21 bp, Artificial sequence
  SiRNA target sequence
ttgctattttatatttgctaa

SEQ ID NO: 10531 - DNA, 21 bp, Artificial sequence
  SiRNA target sequence
tgctattttatatttgctaat

SEQ ID NO: 10532 - DNA, 21 bp, Artificial sequence
  SiRNA target sequence
gctattttatatttgctaatt

SEQ ID NO: 10533 - DNA, 21 bp, Artificial sequence
  SiRNA target sequence
  misc_feature (21)..(21): n is a, c, g, or t
ctattttatatttgctaattn

SEQ ID NO: 10534 - DNA, 21 bp, Artificial sequence
  SiRNA target sequence
  misc_feature (20)..(20): n is a, c, g, or t
tattttatatttgctaattnt

SEQ ID NO: 10535 - DNA, 21 bp, Artificial sequence
  SiRNA target sequence
  misc_feature (19)..(19): n is a, c, g, or t
attttatatttgctaattntc

SEQ ID NO: 10536 - DNA, 21 bp, Artificial sequence
  SiRNA target sequence
  misc_feature (18)..(18): n is a, c, g, or t
ttttatatttgctaattntca

SEQ ID NO: 10537 - DNA, 21 bp, Artificial sequence
  SiRNA target sequence
  misc_feature (17)..(17): n is a, c, g, or t
tttatatttgctaattntcat

SEQ ID NO: 10538 - DNA, 21 bp, Artificial sequence
  SiRNA target sequence
  misc_feature (16)..(16): n is a, c, g, or t
ttatatttgctaattntcatt

SEQ ID NO: 10539 - DNA, 21 bp, Artificial sequence
  SiRNA target sequence
  misc_feature (15)..(15): n is a, c, g, or t
tatatttgctaattntcatta

SEQ ID NO: 10540 - DNA, 21 bp, Artificial sequence
  SiRNA target sequence
  misc_feature (14)..(14): n is a, c, g, or t
atatttgctaattntcattat

SEQ ID NO: 10541 - DNA, 21 bp, Artificial sequence
  SiRNA target sequence
  misc_feature (13)..(13): n is a, c, g, or t
tatttgctaattntcattatt

SEQ ID NO: 10542 - DNA, 21 bp, Artificial sequence
  SiRNA target sequence
  misc_feature (12)..(12): n is a, c, g, or t
atttgctaattntcattattg

SEQ ID NO: 10543 - DNA, 21 bp, Artificial sequence
  SiRNA target sequence
  misc_feature (11)..(11): n is a, c, g, or t
tttgctaattntcattattgc

SEQ ID NO: 10544 - DNA, 21 bp, Artificial sequence
  SiRNA target sequence
  misc_feature (10)..(10): n is a, c, g, or t
ttgctaattntcattattgcg

SEQ ID NO: 10545 - DNA, 21 bp, Artificial sequence
  SiRNA target sequence
  misc_feature (9)..(9): n is a, c, g, or t
tgctaattntcattattgcga

SEQ ID NO: 10546 - DNA, 21 bp, Artificial sequence
  SiRNA target sequence
  misc_feature (8)..(8): n is a, c, g, or t
gctaattntcattattgcgaa

SEQ ID NO: 10547 - DNA, 21 bp, Artificial sequence
  SiRNA target sequence
  misc_feature (7)..(7): n is a, c, g, or t
ctaattntcattattgcgaaa

SEQ ID NO: 10548 - DNA, 21 bp, Artificial sequence
  SiRNA target sequence
  misc_feature (6)..(6): n is a, c, g, or t
taattntcattattgcgaaat

SEQ ID NO: 10549 - DNA, 21 bp, Artificial sequence
  SiRNA target sequence
  misc_feature (5)..(5): n is a, c, g, or t
aattntcattattgcgaaata

SEQ ID NO: 10550 - DNA, 21 bp, Artificial sequence
  SiRNA target sequence
  misc_feature (4)..(4): n is a, c, g, or t
attntcattattgcgaaatat

SEQ ID NO: 10551 - DNA, 21 bp, Artificial sequence
  SiRNA target sequence
  misc_feature (3)..(3): n is a, c, g, or t
ttntcattattgcgaaatata

SEQ ID NO: 10552 - DNA, 21 bp, Artificial sequence
  SiRNA target sequence
  misc_feature (2)..(2): n is a, c, g, or t
tntcattattgcgaaatatat

SEQ ID NO: 10553 - DNA, 21 bp, Artificial sequence
  SiRNA target sequence
  misc_feature (1)..(1): n is a, c, g, or t
ntcattattgcgaaatatatt

SEQ ID NO: 10554 - DNA, 21 bp, Artificial sequence
  SiRNA target sequence
tcattattgcgaaatatatta

SEQ ID NO: 10555 - DNA, 21 bp, Artificial sequence
  SiRNA target sequence
cattattgcgaaatatattac

SEQ ID NO: 10556 - DNA, 21 bp, Artificial sequence
  SiRNA target sequence
attattgcgaaatatattaca

SEQ ID NO: 10557 - DNA, 21 bp, Artificial sequence
  SiRNA target sequence
ttattgcgaaatatattacat

SEQ ID NO: 10558 - DNA, 21 bp, Artificial sequence
  SiRNA target sequence
tattgcgaaatatattacatt

SEQ ID NO: 10559 - DNA, 21 bp, Artificial sequence
  SiRNA target sequence
attgcgaaatatattacattg

SEQ ID NO: 10560 - DNA, 21 bp, Artificial sequence
  SiRNA target sequence
ttgcgaaatatattacattgc

SEQ ID NO: 10561 - DNA, 21 bp, Artificial sequence
  SiRNA target sequence
tgcgaaatatattacattgct

SEQ ID NO: 10562 - DNA, 21 bp, Artificial sequence
  SiRNA target sequence
gcgaaatatattacattgcta

SEQ ID NO: 10563 - DNA, 21 bp, Artificial sequence
  SiRNA target sequence
cgaaatatattacattgctat

SEQ ID NO: 10564 - DNA, 21 bp, Artificial sequence
  SiRNA target sequence
gaaatatattacattgctatt

SEQ ID NO: 10565 - DNA, 21 bp, Artificial sequence
  SiRNA target sequence
aaatatattacattgctattt

SEQ ID NO: 10566 - DNA, 21 bp, Artificial sequence
  SiRNA target sequence
aatatattacattgctatttt

SEQ ID NO: 10567 - DNA, 21 bp, Artificial sequence
  SiRNA target sequence
atatattacattgctattttt

SEQ ID NO: 10568 - DNA, 21 bp, Artificial sequence
  SiRNA target sequence
tatattacattgctattttta

SEQ ID NO: 10569 - DNA, 21 bp, Artificial sequence
  SiRNA target sequence
atattacattgctatttttat

SEQ ID NO: 10570 - DNA, 21 bp, Artificial sequence
  SiRNA target sequence
tattacattgctatttttatt

SEQ ID NO: 10571 - DNA, 21 bp, Artificial sequence
  SiRNA target sequence
attacattgctatttttatta

SEQ ID NO: 10572 - DNA, 21 bp, Artificial sequence
  SiRNA target sequence
ttacattgctatttttattat

SEQ ID NO: 10573 - DNA, 21 bp, Artificial sequence
  SiRNA target sequence
tacattgctatttttattata

SEQ ID NO: 10574 - DNA, 21 bp, Artificial sequence
  SiRNA target sequence
acattgctatttttattatat

SEQ ID NO: 10575 - DNA, 21 bp, Artificial sequence
  SiRNA target sequence
cattgctatttttattatata

SEQ ID NO: 10576 - DNA, 21 bp, Artificial sequence
  SiRNA target sequence
attgctatttttattatatac

SEQ ID NO: 10577 - DNA, 21 bp, Artificial sequence
  SiRNA target sequence
ttgctatttttattatatacg

SEQ ID NO: 10578 - DNA, 21 bp, Artificial sequence
  SiRNA target sequence
tgctatttttattatatacgc

SEQ ID NO: 10579 - DNA, 21 bp, Artificial sequence
  SiRNA target sequence
gctatttttattatatacgct

SEQ ID NO: 10580 - DNA, 21 bp, Artificial sequence
  SiRNA target sequence
ctatttttattatatacgcta

SEQ ID NO: 10581 - DNA, 21 bp, Artificial sequence
  SiRNA target sequence
tatttttattatatacgctag

SEQ ID NO: 10582 - DNA, 21 bp, Artificial sequence
  SiRNA target sequence
atttttattatatacgctaga

SEQ ID NO: 10583 - DNA, 21 bp, Artificial sequence
  SiRNA target sequence
tttttattatatacgctagat

SEQ ID NO: 10584 - DNA, 21 bp, Artificial sequence
  SiRNA target sequence
ttttattatatacgctagatt

SEQ ID NO: 10585 - DNA, 21 bp, Artificial sequence
  SiRNA target sequence
tttattatatacgctagattc

SEQ ID NO: 10586 - DNA, 21 bp, Artificial sequence
  SiRNA target sequence
ttattatatacgctagattca

SEQ ID NO: 10587 - DNA, 21 bp, Artificial sequence
  SiRNA target sequence
tattatatacgctagattcaa

SEQ ID NO: 10588 - DNA, 21 bp, Artificial sequence
  SiRNA target sequence
attatatacgctagattcaat

SEQ ID NO: 10589 - DNA, 21 bp, Artificial sequence
  SiRNA target sequence
ttatatacgctagattcaatt

SEQ ID NO: 10590 - DNA, 21 bp, Artificial sequence
  SiRNA target sequence
tatatacgctagattcaattt

SEQ ID NO: 10591 - DNA, 21 bp, Artificial sequence
  SiRNA target sequence
atatacgctagattcaatttt

SEQ ID NO: 10592 - DNA, 21 bp, Artificial sequence
  SiRNA target sequence
tatacgctagattcaatttta

SEQ ID NO: 10593 - DNA, 21 bp, Artificial sequence
  SiRNA target sequence
atacgctagattcaattttat

SEQ ID NO: 10594 - DNA, 21 bp, Artificial sequence
  SiRNA target sequence
tacgctagattcaattttatt

SEQ ID NO: 10595 - DNA, 21 bp, Artificial sequence
  SiRNA target sequence
acgctagattcaattttattt

SEQ ID NO: 10596 - DNA, 21 bp, Artificial sequence
  SiRNA target sequence
cgctagattcaattttatttt

SEQ ID NO: 10597 - DNA, 21 bp, Artificial sequence
  SiRNA target sequence
gctagattcaattttattttt

SEQ ID NO: 10598 - DNA, 21 bp, Artificial sequence
  SiRNA target sequence
  misc_feature (21)..(21): n is a, c, g, or t
ctagattcaattttatttttn

SEQ ID NO: 10599 - DNA, 21 bp, Artificial sequence
  SiRNA target sequence
  misc_feature (20)..(20): n is a, c, g, or t
tagattcaattttatttttnc

SEQ ID NO: 10600 - DNA, 21 bp, Artificial sequence
  SiRNA target sequence
  misc_feature (19)..(19): n is a, c, g, or t
agattcaattttatttttnct

SEQ ID NO: 10601 - DNA, 21 bp, Artificial sequence
  SiRNA target sequence
  misc_feature (18)..(18): n is a, c, g, or t
gattcaattttatttttncta

SEQ ID NO: 10602 - DNA, 21 bp, Artificial sequence
  SiRNA target sequence
  misc_feature (17)..(17): n is a, c, g, or t
attcaattttatttttnctat

SEQ ID NO: 10603 - DNA, 21 bp, Artificial sequence
  SiRNA target sequence
  misc_feature (16)..(16): n is a, c, g, or t
ttcaattttatttttnctata

SEQ ID NO: 10604 - DNA, 21 bp, Artificial sequence
  SiRNA target sequence
  misc_feature (15)..(15): n is a, c, g, or t
tcaattttatttttnctatat

SEQ ID NO: 10605 - DNA, 21 bp, Artificial sequence
  SiRNA target sequence
  misc_feature (14)..(14): n is a, c, g, or t
caattttatttttnctatatt

SEQ ID NO: 10606 - DNA, 21 bp, Artificial sequence
  SiRNA target sequence
  misc_feature (13)..(13): n is a, c, g, or t
aattttatttttnctatattt

SEQ ID NO: 10607 - DNA, 21 bp, Artificial sequence
  SiRNA target sequence
  misc_feature (12)..(12): n is a, c, g, or t
attttatttttnctatatttt

SEQ ID NO: 10608 - DNA, 21 bp, Artificial sequence
  SiRNA target sequence
  misc_feature (11)..(11): n is a, c, g, or t
ttttatttttnctatattttc

SEQ ID NO: 10609 - DNA, 21 bp, Artificial sequence
  SiRNA target sequence
  misc_feature (10)..(10): n is a, c, g, or t
tttatttttnctatattttca

SEQ ID NO: 10610 - DNA, 21 bp, Artificial sequence
  SiRNA target sequence
  misc_feature (9)..(9): n is a, c, g, or t
ttatttttnctatattttcaa

SEQ ID NO: 10611 - DNA, 21 bp, Artificial sequence
  SiRNA target sequence
  misc_feature (8)..(8): n is a, c, g, or t
tatttttnctatattttcaat

SEQ ID NO: 10612 - DNA, 21 bp, Artificial sequence
  SiRNA target sequence
  misc_feature (7)..(7): n is a, c, g, or t
atttttnctatattttcaatt

SEQ ID NO: 10613 - DNA, 21 bp, Artificial sequence
  SiRNA target sequence
  misc_feature (6)..(6): n is a, c, g, or t
tttttnctatattttcaattt

SEQ ID NO: 10614 - DNA, 21 bp, Artificial sequence
  SiRNA target sequence
  misc_feature (5)..(5): n is a, c, g, or t
ttttnctatattttcaattta

SEQ ID NO: 10615 - DNA, 21 bp, Artificial sequence
  SiRNA target sequence
  misc_feature (4)..(4): n is a, c, g, or t
tttnctatattttcaatttaa

SEQ ID NO: 10616 - DNA, 21 bp, Artificial sequence
  SiRNA target sequence
  misc_feature (3)..(3): n is a, c, g, or t
ttnctatattttcaatttaat

SEQ ID NO: 10617 - DNA, 21 bp, Artificial sequence
  SiRNA target sequence
  misc_feature (2)..(2): n is a, c, g, or t
tnctatattttcaatttaatt

SEQ ID NO: 10618 - DNA, 21 bp, Artificial sequence
  SiRNA target sequence
  misc_feature (1)..(1): n is a, c, g, or t
nctatattttcaatttaattt

SEQ ID NO: 10619 - DNA, 21 bp, Artificial sequence
  SiRNA target sequence
ctatattttcaatttaatttt

SEQ ID NO: 10620 - DNA, 21 bp, Artificial sequence
  SiRNA target sequence
tatattttcaatttaattttg

SEQ ID NO: 10621 - DNA, 21 bp, Artificial sequence
  SiRNA target sequence
atattttcaatttaattttga

SEQ ID NO: 10622 - DNA, 21 bp, Artificial sequence
  SiRNA target sequence
tattttcaatttaattttgat

SEQ ID NO: 10623 - DNA, 21 bp, Artificial sequence
  SiRNA target sequence
attttcaatttaattttgatt

SEQ ID NO: 10624 - DNA, 21 bp, Artificial sequence
  SiRNA target sequence
ttttcaatttaattttgattt

SEQ ID NO: 10625 - DNA, 21 bp, Artificial sequence
  SiRNA target sequence
tttcaatttaattttgatttc

SEQ ID NO: 10626 - DNA, 21 bp, Artificial sequence
  SiRNA target sequence
ttcaatttaattttgatttcg

SEQ ID NO: 10627 - DNA, 21 bp, Artificial sequence
  SiRNA target sequence
tcaatttaattttgatttcga

SEQ ID NO: 10628 - DNA, 21 bp, Artificial sequence
  SiRNA target sequence
caatttaattttgatttcgaa

SEQ ID NO: 10629 - DNA, 21 bp, Artificial sequence
  SiRNA target sequence
aatttaattttgatttcgaag

SEQ ID NO: 10630 - DNA, 21 bp, Artificial sequence
  SiRNA target sequence
atttaattttgatttcgaagg

SEQ ID NO: 10631 - DNA, 21 bp, Artificial sequence
  SiRNA target sequence
tttaattttgatttcgaaggt

SEQ ID NO: 10632 - DNA, 21 bp, Artificial sequence
  SiRNA target sequence
ttaattttgatttcgaaggta

SEQ ID NO: 10633 - DNA, 21 bp, Artificial sequence
  SiRNA target sequence
taattttgatttcgaaggtaa

SEQ ID NO: 10634 - DNA, 21 bp, Artificial sequence
  SiRNA target sequence
aattttgatttcgaaggtaaa

SEQ ID NO: 10635 - DNA, 21 bp, Artificial sequence
  SiRNA target sequence
attttgatttcgaaggtaaat

SEQ ID NO: 10636 - DNA, 21 bp, Artificial sequence
  SiRNA target sequence
ttttgatttcgaaggtaaata

SEQ ID NO: 10637 - DNA, 21 bp, Artificial sequence
  SiRNA target sequence
tttgatttcgaaggtaaatat

SEQ ID NO: 10638 - DNA, 21 bp, Artificial sequence
  SiRNA target sequence
ttgatttcgaaggtaaatata

SEQ ID NO: 10639 - DNA, 21 bp, Artificial sequence
  SiRNA target sequence
tgatttcgaaggtaaatatat

SEQ ID NO: 10640 - DNA, 21 bp, Artificial sequence
  SiRNA target sequence
gatttcgaaggtaaatatata

SEQ ID NO: 10641 - DNA, 21 bp, Artificial sequence
  SiRNA target sequence
atttcgaaggtaaatatatat

SEQ ID NO: 10642 - DNA, 21 bp, Artificial sequence
  SiRNA target sequence
tttcgaaggtaaatatatata

SEQ ID NO: 10643 - DNA, 21 bp, Artificial sequence
  SiRNA target sequence
ttcgaaggtaaatatatataa

SEQ ID NO: 10644 - DNA, 21 bp, Artificial sequence
  SiRNA target sequence
tcgaaggtaaatatatataat

SEQ ID NO: 10645 - DNA, 21 bp, Artificial sequence
  SiRNA target sequence
cgaaggtaaatatatataatt

SEQ ID NO: 10646 - DNA, 21 bp, Artificial sequence
  SiRNA target sequence
  misc_feature (21)..(21): n is a, c, g, or t
gaaggtaaatatatataattn

SEQ ID NO: 10647 - DNA, 21 bp, Artificial sequence
  SiRNA target sequence
  misc_feature (20)..(20): n is a, c, g, or t
aaggtaaatatatataattna

SEQ ID NO: 10648 - DNA, 21 bp, Artificial sequence
  SiRNA target sequence
  misc_feature (19)..(19): n is a, c, g, or t
aggtaaatatatataattnat

SEQ ID NO: 10649 - DNA, 21 bp, Artificial sequence
  SiRNA target sequence
  misc_feature (18)..(18): n is a, c, g, or t
ggtaaatatatataattnatt

SEQ ID NO: 10650 - DNA, 21 bp, Artificial sequence
  SiRNA target sequence
  misc_feature (17)..(17): n is a, c, g, or t
gtaaatatatataattnatta

SEQ ID NO: 10651 - DNA, 21 bp, Artificial sequence
  SiRNA target sequence
  misc_feature (16)..(16): n is a, c, g, or t
taaatatatataattnattat

SEQ ID NO: 10652 - DNA, 21 bp, Artificial sequence
  SiRNA target sequence
  misc_feature (15)..(15): n is a, c, g, or t
aaatatatataattnattatt

SEQ ID NO: 10653 - DNA, 21 bp, Artificial sequence
  SiRNA target sequence
  misc_feature (14)..(14): n is a, c, g, or t
aatatatataattnattatta

SEQ ID NO: 10654 - DNA, 21 bp, Artificial sequence
  SiRNA target sequence
  misc_feature (13)..(13): n is a, c, g, or t
atatatataattnattattaa

SEQ ID NO: 10655 - DNA, 21 bp, Artificial sequence
  SiRNA target sequence
  misc_feature (12)..(12): n is a, c, g, or t
tatatataattnattattaaa

SEQ ID NO: 10656 - DNA, 21 bp, Artificial sequence
  SiRNA target sequence
  misc_feature (11)..(11): n is a, c, g, or t
atatataattnattattaaaa

SEQ ID NO: 10657 - DNA, 21 bp, Artificial sequence
  SiRNA target sequence
  misc_feature (10)..(10): n is a, c, g, or t
tatataattnattattaaaaa

SEQ ID NO: 10658 - DNA, 21 bp, Artificial sequence
  SiRNA target sequence
  misc_feature (9)..(9): n is a, c, g, or t
atataattnattattaaaaat

SEQ ID NO: 10659 - DNA, 21 bp, Artificial sequence
  SiRNA target sequence
  misc_feature (8)..(8): n is a, c, g, or t
tataattnattattaaaaatg

SEQ ID NO: 10660 - DNA, 21 bp, Artificial sequence
  SiRNA target sequence
  misc_feature (7)..(7): n is a, c, g, or t
ataattnattattaaaaatgg

SEQ ID NO: 10661 - DNA, 21 bp, Artificial sequence
  SiRNA target sequence
  misc_feature (6)..(6): n is a, c, g, or t
taattnattattaaaaatggc

SEQ ID NO: 10662 - DNA, 21 bp, Artificial sequence
  SiRNA target sequence
  misc_feature (5)..(5): n is a, c, g, or t
aattnattattaaaaatggcc

SEQ ID NO: 10663 - DNA, 21 bp, Artificial sequence
  SiRNA target sequence
  misc_feature (4)..(4): n is a, c, g, or t
attnattattaaaaatggcct

SEQ ID NO: 10664 - DNA, 21 bp, Artificial sequence
  SiRNA target sequence
  misc_feature (3)..(3): n is a, c, g, or t
ttnattattaaaaatggcctt

SEQ ID NO: 10665 - DNA, 21 bp, Artificial sequence
  SiRNA target sequence
  misc_feature (2)..(2): n is a, c, g, or t
tnattattaaaaatggccttt

SEQ ID NO: 10666 - DNA, 21 bp, Artificial sequence
  SiRNA target sequence
  misc_feature (1)..(1): n is a, c, g, or t
nattattaaaaatggccttta

SEQ ID NO: 10667 - DNA, 21 bp, Artificial sequence
  SiRNA target sequence
attattaaaaatggcctttag

SEQ ID NO: 10668 - DNA, 21 bp, Artificial sequence
  SiRNA target sequence
ttattaaaaatggcctttagt

SEQ ID NO: 10669 - DNA, 21 bp, Artificial sequence
  SiRNA target sequence
tattaaaaatggcctttagtt

SEQ ID NO: 10670 - DNA, 21 bp, Artificial sequence
  SiRNA target sequence
attaaaaatggcctttagttg

SEQ ID NO: 10671 - DNA, 21 bp, Artificial sequence
  SiRNA target sequence
ttaaaaatggcctttagttgt

SEQ ID NO: 10672 - DNA, 21 bp, Artificial sequence
  SiRNA target sequence
taaaaatggcctttagttgtg

SEQ ID NO: 10673 - DNA, 21 bp, Artificial sequence
  SiRNA target sequence
aaaaatggcctttagttgtgg

SEQ ID NO: 10674 - DNA, 21 bp, Artificial sequence
  SiRNA target sequence
aaaatggcctttagttgtgga

SEQ ID NO: 10675 - DNA, 21 bp, Artificial sequence
  SiRNA target sequence
aaatggcctttagttgtggaa

SEQ ID NO: 10676 - DNA, 21 bp, Artificial sequence
  SiRNA target sequence
aatggcctttagttgtggaac

SEQ ID NO: 10677 - DNA, 21 bp, Artificial sequence
  SiRNA target sequence
atggcctttagttgtggaact

SEQ ID NO: 10678 - DNA, 21 bp, Artificial sequence
  SiRNA target sequence
tggcctttagttgtggaactc

SEQ ID NO: 10679 - DNA, 21 bp, Artificial sequence
  SiRNA target sequence
ggcctttagttgtggaactct

SEQ ID NO: 10680 - DNA, 21 bp, Artificial sequence
  SiRNA target sequence
  misc_feature (21)..(21): n is a, c, g, or t
gcctttagttgtggaactctn

SEQ ID NO: 10681 - DNA, 21 bp, Artificial sequence
  SiRNA target sequence
  misc_feature (20)..(20): n is a, c, g, or t
cctttagttgtggaactctnt

SEQ ID NO: 10682 - DNA, 21 bp, Artificial sequence
  SiRNA target sequence
  misc_feature (19)..(19): n is a, c, g, or t
ctttagttgtggaactctntc

SEQ ID NO: 10683 - DNA, 21 bp, Artificial sequence
  SiRNA target sequence
  misc_feature (18)..(18): n is a, c, g, or t
tttagttgtggaactctntct

SEQ ID NO: 10684 - DNA, 21 bp, Artificial sequence
  SiRNA target sequence
  misc_feature (17)..(17): n is a, c, g, or t
ttagttgtggaactctntctt

SEQ ID NO: 10685 - DNA, 21 bp, Artificial sequence
  SiRNA target sequence
  misc_feature (16)..(16): n is a, c, g, or t
tagttgtggaactctntctta

SEQ ID NO: 10686 - DNA, 21 bp, Artificial sequence
  SiRNA target sequence
  misc_feature (15)..(15): n is a, c, g, or t
agttgtggaactctntcttac

SEQ ID NO: 10687 - DNA, 21 bp, Artificial sequence
  SiRNA target sequence
  misc_feature (14)..(14): n is a, c, g, or t
gttgtggaactctntcttact

SEQ ID NO: 10688 - DNA, 21 bp, Artificial sequence
  SiRNA target sequence
  misc_feature (13)..(13): n is a, c, g, or t
ttgtggaactctntcttactc

SEQ ID NO: 10689 - DNA, 21 bp, Artificial sequence
  SiRNA target sequence
  misc_feature (12)..(12): n is a, c, g, or t
tgtggaactctntcttactct

SEQ ID NO: 10690 - DNA, 21 bp, Artificial sequence
  SiRNA target sequence
  misc_feature (11)..(11): n is a, c, g, or t
gtggaactctntcttactctg

SEQ ID NO: 10691 - DNA, 21 bp, Artificial sequence
  SiRNA target sequence
  misc_feature (10)..(10): n is a, c, g, or t
tggaactctntcttactctgc

SEQ ID NO: 10692 - DNA, 21 bp, Artificial sequence
  SiRNA target sequence
  misc_feature (9)..(9): n is a, c, g, or t
ggaactctntcttactctgcc

SEQ ID NO: 10693 - DNA, 21 bp, Artificial sequence
  SiRNA target sequence
  misc_feature (8)..(8): n is a, c, g, or t
gaactctntcttactctgccg

SEQ ID NO: 10694 - DNA, 21 bp, Artificial sequence
  SiRNA target sequence
  misc_feature (7)..(7): n is a, c, g, or t
aactctntcttactctgccgt

SEQ ID NO: 10695 - DNA, 21 bp, Artificial sequence
  SiRNA target sequence
  misc_feature (6)..(6): n is a, c, g, or t
actctntcttactctgccgtc

SEQ ID NO: 10696 - DNA, 21 bp, Artificial sequence
  SiRNA target sequence
  misc_feature (5)..(5): n is a, c, g, or t
ctctntcttactctgccgtcg

SEQ ID NO: 10697 - DNA, 21 bp, Artificial sequence
  SiRNA target sequence
  misc_feature (4)..(4): n is a, c, g, or t
tctntcttactctgccgtcgc

SEQ ID NO: 10698 - DNA, 21 bp, Artificial sequence
  SiRNA target sequence
  misc_feature (3)..(3): n is a, c, g, or t
ctntcttactctgccgtcgcc

SEQ ID NO: 10699 - DNA, 21 bp, Artificial sequence
  SiRNA target sequence
  misc_feature (2)..(2): n is a, c, g, or t
tntcttactctgccgtcgccc

SEQ ID NO: 10700 - DNA, 21 bp, Artificial sequence
  SiRNA target sequence
  misc_feature (1)..(1): n is a, c, g, or t
ntcttactctgccgtcgccca

SEQ ID NO: 10701 - DNA, 21 bp, Artificial sequence
  SiRNA target sequence
tcttactctgccgtcgcccaa

SEQ ID NO: 10702 - DNA, 21 bp, Artificial sequence
  SiRNA target sequence
cttactctgccgtcgcccaag

SEQ ID NO: 10703 - DNA, 21 bp, Artificial sequence
  SiRNA target sequence
ttactctgccgtcgcccaagc

SEQ ID NO: 10704 - DNA, 21 bp, Artificial sequence
  SiRNA target sequence
tactctgccgtcgcccaagct

SEQ ID NO: 10705 - DNA, 21 bp, Artificial sequence
  SiRNA target sequence
actctgccgtcgcccaagctc

SEQ ID NO: 10706 - DNA, 21 bp, Artificial sequence
  SiRNA target sequence
ctctgccgtcgcccaagctcc

SEQ ID NO: 10707 - DNA, 21 bp, Artificial sequence
  SiRNA target sequence
tctgccgtcgcccaagctccg

SEQ ID NO: 10708 - DNA, 21 bp, Artificial sequence
  SiRNA target sequence
ctgccgtcgcccaagctccgt

SEQ ID NO: 10709 - DNA, 21 bp, Artificial sequence
  SiRNA target sequence
tgccgtcgcccaagctccgtc

SEQ ID NO: 10710 - DNA, 21 bp, Artificial sequence
  SiRNA target sequence
gccgtcgcccaagctccgtct

SEQ ID NO: 10711 - DNA, 21 bp, Artificial sequence
  SiRNA target sequence
ccgtcgcccaagctccgtctg

SEQ ID NO: 10712 - DNA, 21 bp, Artificial sequence
  SiRNA target sequence
cgtcgcccaagctccgtctgt

SEQ ID NO: 10713 - DNA, 21 bp, Artificial sequence
  SiRNA target sequence
gtcgcccaagctccgtctgtc

SEQ ID NO: 10714 - DNA, 21 bp, Artificial sequence
  SiRNA target sequence
tcgcccaagctccgtctgtcg

SEQ ID NO: 10715 - DNA, 21 bp, Artificial sequence
  SiRNA target sequence
cgcccaagctccgtctgtcgc

SEQ ID NO: 10716 - DNA, 21 bp, Artificial sequence
  SiRNA target sequence
  misc_feature (21)..(21): n is a, c, g, or t
gcccaagctccgtctgtcgcn

SEQ ID NO: 10717 - DNA, 21 bp, Artificial sequence
  SiRNA target sequence
  misc_feature (20)..(20): n is a, c, g, or t
cccaagctccgtctgtcgcnt

SEQ ID NO: 10718 - DNA, 21 bp, Artificial sequence
  SiRNA target sequence
  misc_feature (19)..(19): n is a, c, g, or t
ccaagctccgtctgtcgcnta

SEQ ID NO: 10719 - DNA, 21 bp, Artificial sequence
  SiRNA target sequence
  misc_feature (18)..(18): n is a, c, g, or t
caagctccgtctgtcgcntat

SEQ ID NO: 10720 - DNA, 21 bp, Artificial sequence
  SiRNA target sequence
  misc_feature (17)..(17): n is a, c, g, or t
aagctccgtctgtcgcntatg

SEQ ID NO: 10721 - DNA, 21 bp, Artificial sequence
  SiRNA target sequence
  misc_feature (16)..(16): n is a, c, g, or t
agctccgtctgtcgcntatgc

SEQ ID NO: 10722 - DNA, 21 bp, Artificial sequence
  SiRNA target sequence
  misc_feature (15)..(15): n is a, c, g, or t
gctccgtctgtcgcntatgca

SEQ ID NO: 10723 - DNA, 21 bp, Artificial sequence
  SiRNA target sequence
  misc_feature (14)..(14): n is a, c, g, or t
ctccgtctgtcgcntatgcac

SEQ ID NO: 10724 - DNA, 21 bp, Artificial sequence
  SiRNA target sequence
  misc_feature (13)..(13): n is a, c, g, or t
tccgtctgtcgcntatgcacc

SEQ ID NO: 10725 - DNA, 21 bp, Artificial sequence
  SiRNA target sequence
  misc_feature (12)..(12): n is a, c, g, or t
ccgtctgtcgcntatgcacct

SEQ ID NO: 10726 - DNA, 21 bp, Artificial sequence
  SiRNA target sequence
  misc_feature (11)..(11): n is a, c, g, or t
cgtctgtcgcntatgcacctc

SEQ ID NO: 10727 - DNA, 21 bp, Artificial sequence
  SiRNA target sequence
  misc_feature (10)..(10): n is a, c, g, or t
gtctgtcgcntatgcacctcg

SEQ ID NO: 10728 - DNA, 21 bp, Artificial sequence
  SiRNA target sequence
  misc_feature (9)..(9): n is a, c, g, or t
tctgtcgcntatgcacctcgt

SEQ ID NO: 10729 - DNA, 21 bp, Artificial sequence
  SiRNA target sequence
  misc_feature (8)..(8): n is a, c, g, or t
ctgtcgcntatgcacctcgta

SEQ ID NO: 10730 - DNA, 21 bp, Artificial sequence
  SiRNA target sequence
  misc_feature (7)..(7): n is a, c, g, or t
tgtcgcntatgcacctcgtac

SEQ ID NO: 10731 - DNA, 21 bp, Artificial sequence
  SiRNA target sequence
  misc_feature (6)..(6): n is a, c, g, or t
gtcgcntatgcacctcgtaca

SEQ ID NO: 10732 - DNA, 21 bp, Artificial sequence
  SiRNA target sequence
  misc_feature (5)..(5): n is a, c, g, or t
tcgcntatgcacctcgtacat

SEQ ID NO: 10733 - DNA, 21 bp, Artificial sequence
  SiRNA target sequence
  misc_feature (4)..(4): n is a, c, g, or t
cgcntatgcacctcgtacatg

SEQ ID NO: 10734 - DNA, 21 bp, Artificial sequence
  SiRNA target sequence
  misc_feature (3)..(3): n is a, c, g, or t
gcntatgcacctcgtacatgg

SEQ ID NO: 10735 - DNA, 21 bp, Artificial sequence
  SiRNA target sequence
  misc_feature (2)..(2): n is a, c, g, or t
cntatgcacctcgtacatggg

SEQ ID NO: 10736 - DNA, 21 bp, Artificial sequence
  SiRNA target sequence
  misc_feature (1)..(1): n is a, c, g, or t
ntatgcacctcgtacatggga

SEQ ID NO: 10737 - DNA, 21 bp, Artificial sequence
  SiRNA target sequence
tatgcacctcgtacatgggaa

SEQ ID NO: 10738 - DNA, 21 bp, Artificial sequence
  SiRNA target sequence
atgcacctcgtacatgggaag

SEQ ID NO: 10739 - DNA, 21 bp, Artificial sequence
  SiRNA target sequence
tgcacctcgtacatgggaagt

SEQ ID NO: 10740 - DNA, 21 bp, Artificial sequence
  SiRNA target sequence
gcacctcgtacatgggaagtt

SEQ ID NO: 10741 - DNA, 21 bp, Artificial sequence
  SiRNA target sequence
cacctcgtacatgggaagttg

SEQ ID NO: 10742 - DNA, 21 bp, Artificial sequence
  SiRNA target sequence
acctcgtacatgggaagttga

SEQ ID NO: 10743 - DNA, 21 bp, Artificial sequence
  SiRNA target sequence
cctcgtacatgggaagttgat

SEQ ID NO: 10744 - DNA, 21 bp, Artificial sequence
  SiRNA target sequence
ctcgtacatgggaagttgatg

SEQ ID NO: 10745 - DNA, 21 bp, Artificial sequence
  SiRNA target sequence
tcgtacatgggaagttgatga

SEQ ID NO: 10746 - DNA, 21 bp, Artificial sequence
  SiRNA target sequence
cgtacatgggaagttgatgaa

SEQ ID NO: 10747 - DNA, 21 bp, Artificial sequence
  SiRNA target sequence
gtacatgggaagttgatgaag

SEQ ID NO: 10748 - DNA, 21 bp, Artificial sequence
  SiRNA target sequence
tacatgggaagttgatgaagc

SEQ ID NO: 10749 - DNA, 21 bp, Artificial sequence
  SiRNA target sequence
acatgggaagttgatgaagct

SEQ ID NO: 10750 - DNA, 21 bp, Artificial sequence
  SiRNA target sequence
catgggaagttgatgaagcta

SEQ ID NO: 10751 - DNA, 21 bp, Artificial sequence
  SiRNA target sequence
atgggaagttgatgaagctag

SEQ ID NO: 10752 - DNA, 21 bp, Artificial sequence
  SiRNA target sequence
tgggaagttgatgaagctagg

SEQ ID NO: 10753 - DNA, 21 bp, Artificial sequence
  SiRNA target sequence
gggaagttgatgaagctaggc

SEQ ID NO: 10754 - DNA, 21 bp, Artificial sequence
  SiRNA target sequence
ggaagttgatgaagctaggcg

SEQ ID NO: 10755 - DNA, 21 bp, Artificial sequence
  SiRNA target sequence
gaagttgatgaagctaggcgg

SEQ ID NO: 10756 - DNA, 21 bp, Artificial sequence
  SiRNA target sequence
aagttgatgaagctaggcggc

SEQ ID NO: 10757 - DNA, 21 bp, Artificial sequence
  SiRNA target sequence
agttgatgaagctaggcggcg

SEQ ID NO: 10758 - DNA, 21 bp, Artificial sequence
  SiRNA target sequence
gttgatgaagctaggcggcgc

SEQ ID NO: 10759 - DNA, 21 bp, Artificial sequence
  SiRNA target sequence
ttgatgaagctaggcggcgcc

SEQ ID NO: 10760 - DNA, 21 bp, Artificial sequence
  SiRNA target sequence
tgatgaagctaggcggcgccg

SEQ ID NO: 10761 - DNA, 21 bp, Artificial sequence
  SiRNA target sequence
gatgaagctaggcggcgccga

SEQ ID NO: 10762 - DNA, 21 bp, Artificial sequence
  SiRNA target sequence
atgaagctaggcggcgccgag

SEQ ID NO: 10763 - DNA, 21 bp, Artificial sequence
  SiRNA target sequence
tgaagctaggcggcgccgagt

SEQ ID NO: 10764 - DNA, 21 bp, Artificial sequence
  SiRNA target sequence
gaagctaggcggcgccgagtc

SEQ ID NO: 10765 - DNA, 21 bp, Artificial sequence
  SiRNA target sequence
aagctaggcggcgccgagtca

SEQ ID NO: 10766 - DNA, 21 bp, Artificial sequence
  SiRNA target sequence
agctaggcggcgccgagtcat

SEQ ID NO: 10767 - DNA, 21 bp, Artificial sequence
  SiRNA target sequence
gctaggcggcgccgagtcatt

SEQ ID NO: 10768 - DNA, 21 bp, Artificial sequence
  SiRNA target sequence
ctaggcggcgccgagtcatta

SEQ ID NO: 10769 - DNA, 21 bp, Artificial sequence
  SiRNA target sequence
taggcggcgccgagtcattaa

SEQ ID NO: 10770 - DNA, 21 bp, Artificial sequence
  SiRNA target sequence
aggcggcgccgagtcattaaa

SEQ ID NO: 10771 - DNA, 21 bp, Artificial sequence
  SiRNA target sequence
ggcggcgccgagtcattaaac

SEQ ID NO: 10772 - DNA, 21 bp, Artificial sequence
  SiRNA target sequence
gcggcgccgagtcattaaacg

SEQ ID NO: 10773 - DNA, 21 bp, Artificial sequence
  SiRNA target sequence
cggcgccgagtcattaaacgt

SEQ ID NO: 10774 - DNA, 21 bp, Artificial sequence
  SiRNA target sequence
ggcgccgagtcattaaacgtt

SEQ ID NO: 10775 - DNA, 21 bp, Artificial sequence
  SiRNA target sequence
gcgccgagtcattaaacgttt

SEQ ID NO: 10776 - DNA, 21 bp, Artificial sequence
  SiRNA target sequence
cgccgagtcattaaacgtttg

SEQ ID NO: 10777 - DNA, 21 bp, Artificial sequence
  SiRNA target sequence
gccgagtcattaaacgtttgg

SEQ ID NO: 10778 - DNA, 21 bp, Artificial sequence
  SiRNA target sequence
ccgagtcattaaacgtttggc

SEQ ID NO: 10779 - DNA, 21 bp, Artificial sequence
  SiRNA target sequence
cgagtcattaaacgtttggcg

SEQ ID NO: 10780 - DNA, 21 bp, Artificial sequence
  SiRNA target sequence
gagtcattaaacgtttggcgc

SEQ ID NO: 10781 - DNA, 21 bp, Artificial sequence
  SiRNA target sequence
agtcattaaacgtttggcgct

SEQ ID NO: 10782 - DNA, 21 bp, Artificial sequence
  SiRNA target sequence
gtcattaaacgtttggcgctg

SEQ ID NO: 10783 - DNA, 21 bp, Artificial sequence
  SiRNA target sequence
tcattaaacgtttggcgctgg

SEQ ID NO: 10784 - DNA, 21 bp, Artificial sequence
  SiRNA target sequence
cattaaacgtttggcgctgga

SEQ ID NO: 10785 - DNA, 21 bp, Artificial sequence
  SiRNA target sequence
attaaacgtttggcgctggag

SEQ ID NO: 10786 - DNA, 21 bp, Artificial sequence
  SiRNA target sequence
ttaaacgtttggcgctggagc

SEQ ID NO: 10787 - DNA, 21 bp, Artificial sequence
  SiRNA target sequence
taaacgtttggcgctggagca

SEQ ID NO: 10788 - DNA, 21 bp, Artificial sequence
  SiRNA target sequence
aaacgtttggcgctggagcaa

SEQ ID NO: 10789 - DNA, 21 bp, Artificial sequence
  SiRNA target sequence
aacgtttggcgctggagcaag

SEQ ID NO: 10790 - DNA, 21 bp, Artificial sequence
  SiRNA target sequence
acgtttggcgctggagcaaga

SEQ ID NO: 10791 - DNA, 21 bp, Artificial sequence
  SiRNA target sequence
cgtttggcgctggagcaagaa

SEQ ID NO: 10792 - DNA, 21 bp, Artificial sequence
  SiRNA target sequence
gtttggcgctggagcaagaac

SEQ ID NO: 10793 - DNA, 21 bp, Artificial sequence
  SiRNA target sequence
tttggcgctggagcaagaacg

SEQ ID NO: 10794 - DNA, 21 bp, Artificial sequence
  SiRNA target sequence
ttggcgctggagcaagaacgt

SEQ ID NO: 10795 - DNA, 21 bp, Artificial sequence
  SiRNA target sequence
tggcgctggagcaagaacgta

SEQ ID NO: 10796 - DNA, 21 bp, Artificial sequence
  SiRNA target sequence
ggcgctggagcaagaacgtat

SEQ ID NO: 10797 - DNA, 21 bp, Artificial sequence
  SiRNA target sequence
gcgctggagcaagaacgtatt

SEQ ID NO: 10798 - DNA, 21 bp, Artificial sequence
  SiRNA target sequence
cgctggagcaagaacgtattc

SEQ ID NO: 10799 - DNA, 21 bp, Artificial sequence
  SiRNA target sequence
gctggagcaagaacgtattcg

SEQ ID NO: 10800 - DNA, 21 bp, Artificial sequence
  SiRNA target sequence
ctggagcaagaacgtattcgt

SEQ ID NO: 10801 - DNA, 21 bp, Artificial sequence
  SiRNA target sequence
tggagcaagaacgtattcgta

SEQ ID NO: 10802 - DNA, 21 bp, Artificial sequence
  SiRNA target sequence
ggagcaagaacgtattcgtaa

SEQ ID NO: 10803 - DNA, 21 bp, Artificial sequence
  SiRNA target sequence
gagcaagaacgtattcgtaac

SEQ ID NO: 10804 - DNA, 21 bp, Artificial sequence
  SiRNA target sequence
agcaagaacgtattcgtaacg

SEQ ID NO: 10805 - DNA, 21 bp, Artificial sequence
  SiRNA target sequence
gcaagaacgtattcgtaacgt

SEQ ID NO: 10806 - DNA, 21 bp, Artificial sequence
  SiRNA target sequence
caagaacgtattcgtaacgtt

SEQ ID NO: 10807 - DNA, 21 bp, Artificial sequence
  SiRNA target sequence
aagaacgtattcgtaacgttc

SEQ ID NO: 10808 - DNA, 21 bp, Artificial sequence
  SiRNA target sequence
agaacgtattcgtaacgttct

SEQ ID NO: 10809 - DNA, 21 bp, Artificial sequence
  SiRNA target sequence
gaacgtattcgtaacgttctt

SEQ ID NO: 10810 - DNA, 21 bp, Artificial sequence
  SiRNA target sequence
aacgtattcgtaacgttcttg

SEQ ID NO: 10811 - DNA, 21 bp, Artificial sequence
  SiRNA target sequence
acgtattcgtaacgttcttga

SEQ ID NO: 10812 - DNA, 21 bp, Artificial sequence
  SiRNA target sequence
cgtattcgtaacgttcttgac

SEQ ID NO: 10813 - DNA, 21 bp, Artificial sequence
  SiRNA target sequence
gtattcgtaacgttcttgacg

SEQ ID NO: 10814 - DNA, 21 bp, Artificial sequence
  SiRNA target sequence
tattcgtaacgttcttgacgt

SEQ ID NO: 10815 - DNA, 21 bp, Artificial sequence
  SiRNA target sequence
attcgtaacgttcttgacgtt

SEQ ID NO: 10816 - DNA, 21 bp, Artificial sequence
  SiRNA target sequence
ttcgtaacgttcttgacgttg

SEQ ID NO: 10817 - DNA, 21 bp, Artificial sequence
  SiRNA target sequence
tcgtaacgttcttgacgttgc

SEQ ID NO: 10818 - DNA, 21 bp, Artificial sequence
  SiRNA target sequence
cgtaacgttcttgacgttgcc

SEQ ID NO: 10819 - DNA, 21 bp, Artificial sequence
  SiRNA target sequence
gtaacgttcttgacgttgccg

SEQ ID NO: 10820 - DNA, 21 bp, Artificial sequence
  SiRNA target sequence
taacgttcttgacgttgccgt

SEQ ID NO: 10821 - DNA, 21 bp, Artificial sequence
  SiRNA target sequence
aacgttcttgacgttgccgtc

SEQ ID NO: 10822 - DNA, 21 bp, Artificial sequence
  SiRNA target sequence
acgttcttgacgttgccgtct

SEQ ID NO: 10823 - DNA, 21 bp, Artificial sequence
  SiRNA target sequence
cgttcttgacgttgccgtcta

SEQ ID NO: 10824 - DNA, 21 bp, Artificial sequence
  SiRNA target sequence
gttcttgacgttgccgtctat

SEQ ID NO: 10825 - DNA, 21 bp, Artificial sequence
  SiRNA target sequence
ttcttgacgttgccgtctatg

SEQ ID NO: 10826 - DNA, 21 bp, Artificial sequence
  SiRNA target sequence
tcttgacgttgccgtctatga

SEQ ID NO: 10827 - DNA, 21 bp, Artificial sequence
  SiRNA target sequence
cttgacgttgccgtctatgac

SEQ ID NO: 10828 - DNA, 21 bp, Artificial sequence
  SiRNA target sequence
ttgacgttgccgtctatgacc

SEQ ID NO: 10829 - DNA, 21 bp, Artificial sequence
  SiRNA target sequence
tgacgttgccgtctatgacca

SEQ ID NO: 10830 - DNA, 21 bp, Artificial sequence
  SiRNA target sequence
gacgttgccgtctatgaccag

SEQ ID NO: 10831 - DNA, 21 bp, Artificial sequence
  SiRNA target sequence
acgttgccgtctatgaccagg

SEQ ID NO: 10832 - DNA, 21 bp, Artificial sequence
  SiRNA target sequence
cgttgccgtctatgaccaggc

SEQ ID NO: 10833 - DNA, 21 bp, Artificial sequence
  SiRNA target sequence
gttgccgtctatgaccaggcg

SEQ ID NO: 10834 - DNA, 21 bp, Artificial sequence
  SiRNA target sequence
ttgccgtctatgaccaggcga

SEQ ID NO: 10835 - DNA, 21 bp, Artificial sequence
  SiRNA target sequence
tgccgtctatgaccaggcgac

SEQ ID NO: 10836 - DNA, 21 bp, Artificial sequence
  SiRNA target sequence
gccgtctatgaccaggcgaca

SEQ ID NO: 10837 - DNA, 21 bp, Artificial sequence
  SiRNA target sequence
ccgtctatgaccaggcgacat

SEQ ID NO: 10838 - DNA, 21 bp, Artificial sequence
  SiRNA target sequence
cgtctatgaccaggcgacatg

SEQ ID NO: 10839 - DNA, 21 bp, Artificial sequence
  SiRNA target sequence
gtctatgaccaggcgacatgg

SEQ ID NO: 10840 - DNA, 21 bp, Artificial sequence
  SiRNA target sequence
tctatgaccaggcgacatggg

SEQ ID NO: 10841 - DNA, 21 bp, Artificial sequence
  SiRNA target sequence
ctatgaccaggcgacatggga

SEQ ID NO: 10842 - DNA, 21 bp, Artificial sequence
  SiRNA target sequence
tatgaccaggcgacatgggaa

SEQ ID NO: 10843 - DNA, 21 bp, Artificial sequence
  SiRNA target sequence
atgaccaggcgacatgggaac

SEQ ID NO: 10844 - DNA, 21 bp, Artificial sequence
  SiRNA target sequence
tgaccaggcgacatgggaaca

SEQ ID NO: 10845 - DNA, 21 bp, Artificial sequence
  SiRNA target sequence
gaccaggcgacatgggaacag

SEQ ID NO: 10846 - DNA, 21 bp, Artificial sequence
  SiRNA target sequence
accaggcgacatgggaacagg

SEQ ID NO: 10847 - DNA, 21 bp, Artificial sequence
  SiRNA target sequence
ccaggcgacatgggaacagga

SEQ ID NO: 10848 - DNA, 21 bp, Artificial sequence
  SiRNA target sequence
caggcgacatgggaacaggag

SEQ ID NO: 10849 - DNA, 21 bp, Artificial sequence
  SiRNA target sequence
aggcgacatgggaacaggagg

SEQ ID NO: 10850 - DNA, 21 bp, Artificial sequence
  SiRNA target sequence
ggcgacatgggaacaggagga

SEQ ID NO: 10851 - DNA, 21 bp, Artificial sequence
  SiRNA target sequence
gcgacatgggaacaggaggac

SEQ ID NO: 10852 - DNA, 21 bp, Artificial sequence
  SiRNA target sequence
cgacatgggaacaggaggacg

SEQ ID NO: 10853 - DNA, 21 bp, Artificial sequence
  SiRNA target sequence
gacatgggaacaggaggacgc

SEQ ID NO: 10854 - DNA, 21 bp, Artificial sequence
  SiRNA target sequence
acatgggaacaggaggacgcg

SEQ ID NO: 10855 - DNA, 21 bp, Artificial sequence
  SiRNA target sequence
catgggaacaggaggacgcgc

SEQ ID NO: 10856 - DNA, 21 bp, Artificial sequence
  SiRNA target sequence
atgggaacaggaggacgcgcg

SEQ ID NO: 10857 - DNA, 21 bp, Artificial sequence
  SiRNA target sequence
tgggaacaggaggacgcgcgc

SEQ ID NO: 10858 - DNA, 21 bp, Artificial sequence
  SiRNA target sequence
gggaacaggaggacgcgcgcg

SEQ ID NO: 10859 - DNA, 21 bp, Artificial sequence
  SiRNA target sequence
ggaacaggaggacgcgcgcga

SEQ ID NO: 10860 - DNA, 21 bp, Artificial sequence
  SiRNA target sequence
gaacaggaggacgcgcgcgat

SEQ ID NO: 10861 - DNA, 21 bp, Artificial sequence
  SiRNA target sequence
aacaggaggacgcgcgcgata

SEQ ID NO: 10862 - DNA, 21 bp, Artificial sequence
  SiRNA target sequence
acaggaggacgcgcgcgataa

SEQ ID NO: 10863 - DNA, 21 bp, Artificial sequence
  SiRNA target sequence
caggaggacgcgcgcgataat

SEQ ID NO: 10864 - DNA, 21 bp, Artificial sequence
  SiRNA target sequence
aggaggacgcgcgcgataatg

SEQ ID NO: 10865 - DNA, 21 bp, Artificial sequence
  SiRNA target sequence
ggaggacgcgcgcgataatga

SEQ ID NO: 10866 - DNA, 21 bp, Artificial sequence
  SiRNA target sequence
gaggacgcgcgcgataatgag

SEQ ID NO: 10867 - DNA, 21 bp, Artificial sequence
  SiRNA target sequence
aggacgcgcgcgataatgagt

SEQ ID NO: 10868 - DNA, 21 bp, Artificial sequence
  SiRNA target sequence
ggacgcgcgcgataatgagtt

SEQ ID NO: 10869 - DNA, 21 bp, Artificial sequence
  SiRNA target sequence
gacgcgcgcgataatgagttc

SEQ ID NO: 10870 - DNA, 21 bp, Artificial sequence
  SiRNA target sequence
acgcgcgcgataatgagttcc

SEQ ID NO: 10871 - DNA, 21 bp, Artificial sequence
  SiRNA target sequence
cgcgcgcgataatgagttcct

SEQ ID NO: 10872 - DNA, 21 bp, Artificial sequence
  SiRNA target sequence
gcgcgcgataatgagttccta

SEQ ID NO: 10873 - DNA, 21 bp, Artificial sequence
  SiRNA target sequence
cgcgcgataatgagttcctaa

SEQ ID NO: 10874 - DNA, 21 bp, Artificial sequence
  SiRNA target sequence
gcgcgataatgagttcctaac

SEQ ID NO: 10875 - DNA, 21 bp, Artificial sequence
  SiRNA target sequence
cgcgataatgagttcctaacg

SEQ ID NO: 10876 - DNA, 21 bp, Artificial sequence
  SiRNA target sequence
gcgataatgagttcctaacgg

SEQ ID NO: 10877 - DNA, 21 bp, Artificial sequence
  SiRNA target sequence
cgataatgagttcctaacgga

SEQ ID NO: 10878 - DNA, 21 bp, Artificial sequence
  SiRNA target sequence
gataatgagttcctaacggaa

SEQ ID NO: 10879 - DNA, 21 bp, Artificial sequence
  SiRNA target sequence
ataatgagttcctaacggaac

SEQ ID NO: 10880 - DNA, 21 bp, Artificial sequence
  SiRNA target sequence
taatgagttcctaacggaaca

SEQ ID NO: 10881 - DNA, 21 bp, Artificial sequence
  SiRNA target sequence
aatgagttcctaacggaacaa

SEQ ID NO: 10882 - DNA, 21 bp, Artificial sequence
  SiRNA target sequence
atgagttcctaacggaacaat

SEQ ID NO: 10883 - DNA, 21 bp, Artificial sequence
  SiRNA target sequence
tgagttcctaacggaacaatt

SEQ ID NO: 10884 - DNA, 21 bp, Artificial sequence
  SiRNA target sequence
gagttcctaacggaacaatta

SEQ ID NO: 10885 - DNA, 21 bp, Artificial sequence
  SiRNA target sequence
agttcctaacggaacaattaa

SEQ ID NO: 10886 - DNA, 21 bp, Artificial sequence
  SiRNA target sequence
gttcctaacggaacaattaaa

SEQ ID NO: 10887 - DNA, 21 bp, Artificial sequence
  SiRNA target sequence
  misc_feature (21)..(21): n is a, c, g, or t
ttcctaacggaacaattaaan

SEQ ID NO: 10888 - DNA, 21 bp, Artificial sequence
  SiRNA target sequence
  misc_feature (20)..(20): n is a, c, g, or t
tcctaacggaacaattaaana

SEQ ID NO: 10889 - DNA, 21 bp, Artificial sequence
  SiRNA target sequence
  misc_feature (19)..(19): n is a, c, g, or t
cctaacggaacaattaaanaa

SEQ ID NO: 10890 - DNA, 21 bp, Artificial sequence
  SiRNA target sequence
  misc_feature (18)..(18): n is a, c, g, or t
ctaacggaacaattaaanaat

SEQ ID NO: 10891 - DNA, 21 bp, Artificial sequence
  SiRNA target sequence
  misc_feature (17)..(17): n is a, c, g, or t
taacggaacaattaaanaatt

SEQ ID NO: 10892 - DNA, 21 bp, Artificial sequence
  SiRNA target sequence
  misc_feature (16)..(16): n is a, c, g, or t
aacggaacaattaaanaattt

SEQ ID NO: 10893 - DNA, 21 bp, Artificial sequence
  SiRNA target sequence
  misc_feature (15)..(15): n is a, c, g, or t
acggaacaattaaanaattta

SEQ ID NO: 10894 - DNA, 21 bp, Artificial sequence
  SiRNA target sequence
  misc_feature (14)..(14): n is a, c, g, or t
cggaacaattaaanaatttat

SEQ ID NO: 10895 - DNA, 21 bp, Artificial sequence
  SiRNA target sequence
  misc_feature (13)..(13): n is a, c, g, or t
ggaacaattaaanaatttata

SEQ ID NO: 10896 - DNA, 21 bp, Artificial sequence
  SiRNA target sequence
  misc_feature (12)..(12): n is a, c, g, or t
gaacaattaaanaatttatat

SEQ ID NO: 10897 - DNA, 21 bp, Artificial sequence
  SiRNA target sequence
  misc_feature (11)..(11): n is a, c, g, or t
aacaattaaanaatttatata

SEQ ID NO: 10898 - DNA, 21 bp, Artificial sequence
  SiRNA target sequence
  misc_feature (10)..(10): n is a, c, g, or t
acaattaaanaatttatatac

SEQ ID NO: 10899 - DNA, 21 bp, Artificial sequence
  SiRNA target sequence
  misc_feature (9)..(9): n is a, c, g, or t
caattaaanaatttatatact

SEQ ID NO: 10900 - DNA, 21 bp, Artificial sequence
  SiRNA target sequence
  misc_feature (8)..(8): n is a, c, g, or t
aattaaanaatttatatacta

SEQ ID NO: 10901 - DNA, 21 bp, Artificial sequence
  SiRNA target sequence
  misc_feature (7)..(7): n is a, c, g, or t
attaaanaatttatatactat

SEQ ID NO: 10902 - DNA, 21 bp, Artificial sequence
  SiRNA target sequence
  misc_feature (6)..(6): n is a, c, g, or t
ttaaanaatttatatactatt

SEQ ID NO: 10903 - DNA, 21 bp, Artificial sequence
  SiRNA target sequence
  misc_feature (5)..(5): n is a, c, g, or t
taaanaatttatatactattt

SEQ ID NO: 10904 - DNA, 21 bp, Artificial sequence
  SiRNA target sequence
  misc_feature (4)..(4): n is a, c, g, or t
aaanaatttatatactattta

SEQ ID NO: 10905 - DNA, 21 bp, Artificial sequence
  SiRNA target sequence
  misc_feature (3)..(3): n is a, c, g, or t
aanaatttatatactatttat

SEQ ID NO: 10906 - DNA, 21 bp, Artificial sequence
  SiRNA target sequence
  misc_feature (2)..(2): n is a, c, g, or t
anaatttatatactatttatt

SEQ ID NO: 10907 - DNA, 21 bp, Artificial sequence
  SiRNA target sequence
  misc_feature (1)..(1): n is a, c, g, or t
naatttatatactatttattc

SEQ ID NO: 10908 - DNA, 21 bp, Artificial sequence
  SiRNA target sequence
aatttatatactatttattcg

SEQ ID NO: 10909 - DNA, 21 bp, Artificial sequence
  SiRNA target sequence
atttatatactatttattcga

SEQ ID NO: 10910 - DNA, 21 bp, Artificial sequence
  SiRNA target sequence
tttatatactatttattcgat

SEQ ID NO: 10911 - DNA, 21 bp, Artificial sequence
  SiRNA target sequence
ttatatactatttattcgatc

SEQ ID NO: 10912 - DNA, 21 bp, Artificial sequence
  SiRNA target sequence
tatatactatttattcgatcg

SEQ ID NO: 10913 - DNA, 21 bp, Artificial sequence
  SiRNA target sequence
atatactatttattcgatcgc

SEQ ID NO: 10914 - DNA, 21 bp, Artificial sequence
  SiRNA target sequence
tatactatttattcgatcgct

SEQ ID NO: 10915 - DNA, 21 bp, Artificial sequence
  SiRNA target sequence
atactatttattcgatcgctg

SEQ ID NO: 10916 - DNA, 21 bp, Artificial sequence
  SiRNA target sequence
tactatttattcgatcgctga

SEQ ID NO: 10917 - DNA, 21 bp, Artificial sequence
  SiRNA target sequence
actatttattcgatcgctgaa

SEQ ID NO: 10918 - DNA, 21 bp, Artificial sequence
  SiRNA target sequence
ctatttattcgatcgctgaac

SEQ ID NO: 10919 - DNA, 21 bp, Artificial sequence
  SiRNA target sequence
tatttattcgatcgctgaacg

SEQ ID NO: 10920 - DNA, 21 bp, Artificial sequence
  SiRNA target sequence
atttattcgatcgctgaacgt

SEQ ID NO: 10921 - DNA, 21 bp, Artificial sequence
  SiRNA target sequence
tttattcgatcgctgaacgtt

SEQ ID NO: 10922 - DNA, 21 bp, Artificial sequence
  SiRNA target sequence
ttattcgatcgctgaacgttg

SEQ ID NO: 10923 - DNA, 21 bp, Artificial sequence
  SiRNA target sequence
tattcgatcgctgaacgttgt

SEQ ID NO: 10924 - DNA, 21 bp, Artificial sequence
  SiRNA target sequence
attcgatcgctgaacgttgta

SEQ ID NO: 10925 - DNA, 21 bp, Artificial sequence
  SiRNA target sequence
ttcgatcgctgaacgttgtac

SEQ ID NO: 10926 - DNA, 21 bp, Artificial sequence
  SiRNA target sequence
tcgatcgctgaacgttgtacg

SEQ ID NO: 10927 - DNA, 21 bp, Artificial sequence
  SiRNA target sequence
cgatcgctgaacgttgtacgc

SEQ ID NO: 10928 - DNA, 21 bp, Artificial sequence
  SiRNA target sequence
gatcgctgaacgttgtacgcg

SEQ ID NO: 10929 - DNA, 21 bp, Artificial sequence
  SiRNA target sequence
atcgctgaacgttgtacgcgt

SEQ ID NO: 10930 - DNA, 21 bp, Artificial sequence
  SiRNA target sequence
tcgctgaacgttgtacgcgtc

SEQ ID NO: 10931 - DNA, 21 bp, Artificial sequence
  SiRNA target sequence
cgctgaacgttgtacgcgtcg

SEQ ID NO: 10932 - DNA, 21 bp, Artificial sequence
  SiRNA target sequence
gctgaacgttgtacgcgtcgg

SEQ ID NO: 10933 - DNA, 21 bp, Artificial sequence
  SiRNA target sequence
ctgaacgttgtacgcgtcggc

SEQ ID NO: 10934 - DNA, 21 bp, Artificial sequence
  SiRNA target sequence
tgaacgttgtacgcgtcggcc

SEQ ID NO: 10935 - DNA, 21 bp, Artificial sequence
  SiRNA target sequence
gaacgttgtacgcgtcggcct

SEQ ID NO: 10936 - DNA, 21 bp, Artificial sequence
  SiRNA target sequence
aacgttgtacgcgtcggccta

SEQ ID NO: 10937 - DNA, 21 bp, Artificial sequence
  SiRNA target sequence
acgttgtacgcgtcggcctat

SEQ ID NO: 10938 - DNA, 21 bp, Artificial sequence
  SiRNA target sequence
cgttgtacgcgtcggcctatc

SEQ ID NO: 10939 - DNA, 21 bp, Artificial sequence
  SiRNA target sequence
gttgtacgcgtcggcctatca

SEQ ID NO: 10940 - DNA, 21 bp, Artificial sequence
  SiRNA target sequence
ttgtacgcgtcggcctatcaa

SEQ ID NO: 10941 - DNA, 21 bp, Artificial sequence
  SiRNA target sequence
tgtacgcgtcggcctatcaaa

SEQ ID NO: 10942 - DNA, 21 bp, Artificial sequence
  SiRNA target sequence
gtacgcgtcggcctatcaaag

SEQ ID NO: 10943 - DNA, 21 bp, Artificial sequence
  SiRNA target sequence
tacgcgtcggcctatcaaaga

SEQ ID NO: 10944 - DNA, 21 bp, Artificial sequence
  SiRNA target sequence
acgcgtcggcctatcaaagag

SEQ ID NO: 10945 - DNA, 21 bp, Artificial sequence
  SiRNA target sequence
  misc_feature (21)..(21): n is a, c, g, or t
cgcgtcggcctatcaaagagn

SEQ ID NO: 10946 - DNA, 21 bp, Artificial sequence
  SiRNA target sequence
  misc_feature (20)..(20): n is a, c, g, or t
gcgtcggcctatcaaagagna

SEQ ID NO: 10947 - DNA, 21 bp, Artificial sequence
  SiRNA target sequence
  misc_feature (19)..(19): n is a, c, g, or t
cgtcggcctatcaaagagnac

SEQ ID NO: 10948 - DNA, 21 bp, Artificial sequence
  SiRNA target sequence
  misc_feature (18)..(18): n is a, c, g, or t
gtcggcctatcaaagagnact

SEQ ID NO: 10949 - DNA, 21 bp, Artificial sequence
  SiRNA target sequence
  misc_feature (17)..(17): n is a, c, g, or t
tcggcctatcaaagagnactc

SEQ ID NO: 10950 - DNA, 21 bp, Artificial sequence
  SiRNA target sequence
  misc_feature (16)..(16): n is a, c, g, or t
cggcctatcaaagagnactct

SEQ ID NO: 10951 - DNA, 21 bp, Artificial sequence
  SiRNA target sequence
  misc_feature (15)..(15): n is a, c, g, or t
ggcctatcaaagagnactctc

SEQ ID NO: 10952 - DNA, 21 bp, Artificial sequence
  SiRNA target sequence
  misc_feature (14)..(14): n is a, c, g, or t
gcctatcaaagagnactctcc

SEQ ID NO: 10953 - DNA, 21 bp, Artificial sequence
  SiRNA target sequence
  misc_feature (13)..(13): n is a, c, g, or t
cctatcaaagagnactctcct

SEQ ID NO: 10954 - DNA, 21 bp, Artificial sequence
  SiRNA target sequence
  misc_feature (12)..(12): n is a, c, g, or t
ctatcaaagagnactctccta

SEQ ID NO: 10955 - DNA, 21 bp, Artificial sequence
  SiRNA target sequence
  misc_feature (11)..(11): n is a, c, g, or t
tatcaaagagnactctcctat

SEQ ID NO: 10956 - DNA, 21 bp, Artificial sequence
  SiRNA target sequence
  misc_feature (10)..(10): n is a, c, g, or t
atcaaagagnactctcctata

SEQ ID NO: 10957 - DNA, 21 bp, Artificial sequence
  SiRNA target sequence
  misc_feature (9)..(9): n is a, c, g, or t
tcaaagagnactctcctatat

SEQ ID NO: 10958 - DNA, 21 bp, Artificial sequence
  SiRNA target sequence
  misc_feature (8)..(8): n is a, c, g, or t
caaagagnactctcctatatc

SEQ ID NO: 10959 - DNA, 21 bp, Artificial sequence
  SiRNA target sequence
  misc_feature (7)..(7): n is a, c, g, or t
aaagagnactctcctatatca

SEQ ID NO: 10960 - DNA, 21 bp, Artificial sequence
  SiRNA target sequence
  misc_feature (6)..(6): n is a, c, g, or t
aagagnactctcctatatcag

SEQ ID NO: 10961 - DNA, 21 bp, Artificial sequence
  SiRNA target sequence
  misc_feature (5)..(5): n is a, c, g, or t
agagnactctcctatatcagt

SEQ ID NO: 10962 - DNA, 21 bp, Artificial sequence
  SiRNA target sequence
  misc_feature (4)..(4): n is a, c, g, or t
gagnactctcctatatcagtt

SEQ ID NO: 10963 - DNA, 21 bp, Artificial sequence
  SiRNA target sequence
  misc_feature (3)..(3): n is a, c, g, or t
agnactctcctatatcagttt

SEQ ID NO: 10964 - DNA, 21 bp, Artificial sequence
  SiRNA target sequence
  misc_feature (2)..(2): n is a, c, g, or t
gnactctcctatatcagtttc

SEQ ID NO: 10965 - DNA, 21 bp, Artificial sequence
  SiRNA target sequence
  misc_feature (1)..(1): n is a, c, g, or t
nactctcctatatcagtttcg

SEQ ID NO: 10966 - DNA, 21 bp, Artificial sequence
  SiRNA target sequence
actctcctatatcagtttcga

SEQ ID NO: 10967 - DNA, 21 bp, Artificial sequence
  SiRNA target sequence
ctctcctatatcagtttcgaa

SEQ ID NO: 10968 - DNA, 21 bp, Artificial sequence
  SiRNA target sequence
tctcctatatcagtttcgaat

SEQ ID NO: 10969 - DNA, 21 bp, Artificial sequence
  SiRNA target sequence
ctcctatatcagtttcgaata

SEQ ID NO: 10970 - DNA, 21 bp, Artificial sequence
  SiRNA target sequence
tcctatatcagtttcgaatag

SEQ ID NO: 10971 - DNA, 21 bp, Artificial sequence
  SiRNA target sequence
cctatatcagtttcgaatagg

SEQ ID NO: 10972 - DNA, 21 bp, Artificial sequence
  SiRNA target sequence
ctatatcagtttcgaataggt

SEQ ID NO: 10973 - DNA, 21 bp, Artificial sequence
  SiRNA target sequence
tatatcagtttcgaataggtt

SEQ ID NO: 10974 - DNA, 21 bp, Artificial sequence
  SiRNA target sequence
atatcagtttcgaataggttt

SEQ ID NO: 10975 - DNA, 21 bp, Artificial sequence
  SiRNA target sequence
tatcagtttcgaataggtttg

SEQ ID NO: 10976 - DNA, 21 bp, Artificial sequence
  SiRNA target sequence
atcagtttcgaataggtttgc

SEQ ID NO: 10977 - DNA, 21 bp, Artificial sequence
  SiRNA target sequence
tcagtttcgaataggtttgct

SEQ ID NO: 10978 - DNA, 21 bp, Artificial sequence
  SiRNA target sequence
cagtttcgaataggtttgctc

SEQ ID NO: 10979 - DNA, 21 bp, Artificial sequence
  SiRNA target sequence
agtttcgaataggtttgctcc

SEQ ID NO: 10980 - DNA, 21 bp, Artificial sequence
  SiRNA target sequence
gtttcgaataggtttgctcca

SEQ ID NO: 10981 - DNA, 21 bp, Artificial sequence
  SiRNA target sequence
tttcgaataggtttgctccac

SEQ ID NO: 10982 - DNA, 21 bp, Artificial sequence
  SiRNA target sequence
ttcgaataggtttgctccact

SEQ ID NO: 10983 - DNA, 21 bp, Artificial sequence
  SiRNA target sequence
tcgaataggtttgctccactg

SEQ ID NO: 10984 - DNA, 21 bp, Artificial sequence
  SiRNA target sequence
cgaataggtttgctccactgg

SEQ ID NO: 10985 - DNA, 21 bp, Artificial sequence
  SiRNA target sequence
gaataggtttgctccactgga

SEQ ID NO: 10986 - DNA, 21 bp, Artificial sequence
  SiRNA target sequence
  misc_feature (21)..(21): n is a, c, g, or t
aataggtttgctccactggan

SEQ ID NO: 10987 - DNA, 21 bp, Artificial sequence
  SiRNA target sequence
  misc_feature (20)..(20): n is a, c, g, or t
ataggtttgctccactggant

SEQ ID NO: 10988 - DNA, 21 bp, Artificial sequence
  SiRNA target sequence
  misc_feature (19)..(19): n is a, c, g, or t
taggtttgctccactggantc

SEQ ID NO: 10989 - DNA, 21 bp, Artificial sequence
  SiRNA target sequence
  misc_feature (18)..(18): n is a, c, g, or t
aggtttgctccactggantcc

SEQ ID NO: 10990 - DNA, 21 bp, Artificial sequence
  SiRNA target sequence
  misc_feature (17)..(17): n is a, c, g, or t
ggtttgctccactggantccc

SEQ ID NO: 10991 - DNA, 21 bp, Artificial sequence
  SiRNA target sequence
  misc_feature (16)..(16): n is a, c, g, or t
gtttgctccactggantccct

SEQ ID NO: 10992 - DNA, 21 bp, Artificial sequence
  SiRNA target sequence
  misc_feature (15)..(15): n is a, c, g, or t
  misc_feature (21)..(21): n is a, c, g, or t
tttgctccactggantccctn

SEQ ID NO: 10993 - DNA, 21 bp, Artificial sequence
  SiRNA target sequence
  misc_feature (14)..(14): n is a, c, g, or t
  misc_feature (20)..(20): n is a, c, g, or t
ttgctccactggantccctna

SEQ ID NO: 10994 - DNA, 21 bp, Artificial sequence
  SiRNA target sequence
  misc_feature (13)..(13): n is a, c, g, or t
  misc_feature (19)..(19): n is a, c, g, or t
tgctccactggantccctnaa

SEQ ID NO: 10995 - DNA, 21 bp, Artificial sequence
  SiRNA target sequence
  misc_feature (12)..(12): n is a, c, g, or t
  misc_feature (18)..(18): n is a, c, g, or t
gctccactggantccctnaag

SEQ ID NO: 10996 - DNA, 21 bp, Artificial sequence
  SiRNA target sequence
  misc_feature (11)..(11): n is a, c, g, or t
  misc_feature (17)..(17): n is a, c, g, or t
ctccactggantccctnaagg

SEQ ID NO: 10997 - DNA, 21 bp, Artificial sequence
  SiRNA target sequence
  misc_feature (10)..(10): n is a, c, g, or t
  misc_feature (16)..(16): n is a, c, g, or t
tccactggantccctnaaggt

SEQ ID NO: 10998 - DNA, 21 bp, Artificial sequence
  SiRNA target sequence
  misc_feature (9)..(9): n is a, c, g, or t
  misc_feature (15)..(15): n is a, c, g, or t
ccactggantccctnaaggtc

SEQ ID NO: 10999 - DNA, 21 bp, Artificial sequence
  SiRNA target sequence
  misc_feature (8)..(8): n is a, c, g, or t
  misc_feature (14)..(14): n is a, c, g, or t
cactggantccctnaaggtcg

SEQ ID NO: 11000 - DNA, 21 bp, Artificial sequence
  SiRNA target sequence
  misc_feature (7)..(7): n is a, c, g, or t
  misc_feature (13)..(13): n is a, c, g, or t
actggantccctnaaggtcga

SEQ ID NO: 11001 - DNA, 21 bp, Artificial sequence
  SiRNA target sequence
  misc_feature (6)..(6): n is a, c, g, or t
  misc_feature (12)..(12): n is a, c, g, or t
ctggantccctnaaggtcgag

SEQ ID NO: 11002 - DNA, 21 bp, Artificial sequence
  SiRNA target sequence
  misc_feature (5)..(5): n is a, c, g, or t
  misc_feature (11)..(11): n is a, c, g, or t
tggantccctnaaggtcgagg

SEQ ID NO: 11003 - DNA, 21 bp, Artificial sequence
  SiRNA target sequence
  misc_feature (4)..(4): n is a, c, g, or t
  misc_feature (10)..(10): n is a, c, g, or t
ggantccctnaaggtcgaggt

SEQ ID NO: 11004 - DNA, 21 bp, Artificial sequence
  SiRNA target sequence
  misc_feature (3)..(3): n is a, c, g, or t
  misc_feature (9)..(9): n is a, c, g, or t
gantccctnaaggtcgaggtc

SEQ ID NO: 11005 - DNA, 21 bp, Artificial sequence
  SiRNA target sequence
  misc_feature (2)..(2): n is a, c, g, or t
  misc_feature (8)..(8): n is a, c, g, or t
antccctnaaggtcgaggtcg

SEQ ID NO: 11006 - DNA, 21 bp, Artificial sequence
  SiRNA target sequence
  misc_feature (1)..(1): n is a, c, g, or t
  misc_feature (7)..(7): n is a, c, g, or t
ntccctnaaggtcgaggtcgg

SEQ ID NO: 11007 - DNA, 21 bp, Artificial sequence
  SiRNA target sequence
  misc_feature (6)..(6): n is a, c, g, or t
tccctnaaggtcgaggtcggt

SEQ ID NO: 11008 - DNA, 21 bp, Artificial sequence
  SiRNA target sequence
  misc_feature (5)..(5): n is a, c, g, or t
ccctnaaggtcgaggtcggtc

SEQ ID NO: 11009 - DNA, 21 bp, Artificial sequence
  SiRNA target sequence
  misc_feature (4)..(4): n is a, c, g, or t
cctnaaggtcgaggtcggtca

SEQ ID NO: 11010 - DNA, 21 bp, Artificial sequence
  SiRNA target sequence
  misc_feature (3)..(3): n is a, c, g, or t
ctnaaggtcgaggtcggtcaa

SEQ ID NO: 11011 - DNA, 21 bp, Artificial sequence
  SiRNA target sequence
  misc_feature (2)..(2): n is a, c, g, or t
tnaaggtcgaggtcggtcaag

SEQ ID NO: 11012 - DNA, 21 bp, Artificial sequence
  SiRNA target sequence
  misc_feature (1)..(1): n is a, c, g, or t
naaggtcgaggtcggtcaaga

SEQ ID NO: 11013 - DNA, 21 bp, Artificial sequence
  SiRNA target sequence
aaggtcgaggtcggtcaagaa

SEQ ID NO: 11014 - DNA, 21 bp, Artificial sequence
  SiRNA target sequence
aggtcgaggtcggtcaagaag

SEQ ID NO: 11015 - DNA, 21 bp, Artificial sequence
  SiRNA target sequence
ggtcgaggtcggtcaagaagc

SEQ ID NO: 11016 - DNA, 21 bp, Artificial sequence
  SiRNA target sequence
gtcgaggtcggtcaagaagca

SEQ ID NO: 11017 - DNA, 21 bp, Artificial sequence
  SiRNA target sequence
  misc_feature (21)..(21): n is a, c, g, or t
tcgaggtcggtcaagaagcan

SEQ ID NO: 11018 - DNA, 21 bp, Artificial sequence
  SiRNA target sequence
  misc_feature (20)..(20): n is a, c, g, or t
cgaggtcggtcaagaagcang

SEQ ID NO: 11019 - DNA, 21 bp, Artificial sequence
  SiRNA target sequence
  misc_feature (19)..(19): n is a, c, g, or t
gaggtcggtcaagaagcangc

SEQ ID NO: 11020 - DNA, 21 bp, Artificial sequence
  SiRNA target sequence
  misc_feature (18)..(18): n is a, c, g, or t
aggtcggtcaagaagcangcg

SEQ ID NO: 11021 - DNA, 21 bp, Artificial sequence
  SiRNA target sequence
  misc_feature (17)..(17): n is a, c, g, or t
ggtcggtcaagaagcangcga

SEQ ID NO: 11022 - DNA, 21 bp, Artificial sequence
  SiRNA target sequence
  misc_feature (16)..(16): n is a, c, g, or t
gtcggtcaagaagcangcgaa

SEQ ID NO: 11023 - DNA, 21 bp, Artificial sequence
  SiRNA target sequence
  misc_feature (15)..(15): n is a, c, g, or t
tcggtcaagaagcangcgaat

SEQ ID NO: 11024 - DNA, 21 bp, Artificial sequence
  SiRNA target sequence
  misc_feature (14)..(14): n is a, c, g, or t
cggtcaagaagcangcgaatg

SEQ ID NO: 11025 - DNA, 21 bp, Artificial sequence
  SiRNA target sequence
  misc_feature (13)..(13): n is a, c, g, or t
ggtcaagaagcangcgaatgt

SEQ ID NO: 11026 - DNA, 21 bp, Artificial sequence
  SiRNA target sequence
  misc_feature (12)..(12): n is a, c, g, or t
gtcaagaagcangcgaatgta

SEQ ID NO: 11027 - DNA, 21 bp, Artificial sequence
  SiRNA target sequence
  misc_feature (11)..(11): n is a, c, g, or t
tcaagaagcangcgaatgtat

SEQ ID NO: 11028 - DNA, 21 bp, Artificial sequence
  SiRNA target sequence
  misc_feature (10)..(10): n is a, c, g, or t
  misc_feature (21)..(21): n is a, c, g, or t
caagaagcangcgaatgtatn

SEQ ID NO: 11029 - DNA, 21 bp, Artificial sequence
  SiRNA target sequence
  misc_feature (9)..(9): n is a, c, g, or t
  misc_feature (20)..(20): n is a, c, g, or t
aagaagcangcgaatgtatnt

SEQ ID NO: 11030 - DNA, 21 bp, Artificial sequence
  SiRNA target sequence
  misc_feature (8)..(8): n is a, c, g, or t
  misc_feature (19)..(19): n is a, c, g, or t
agaagcangcgaatgtatntt

SEQ ID NO: 11031 - DNA, 21 bp, Artificial sequence
  SiRNA target sequence
  misc_feature (7)..(7): n is a, c, g, or t
  misc_feature (18)..(18): n is a, c, g, or t
gaagcangcgaatgtatnttt

SEQ ID NO: 11032 - DNA, 21 bp, Artificial sequence
  SiRNA target sequence
  misc_feature (6)..(6): n is a, c, g, or t
  misc_feature (17)..(17): n is a, c, g, or t
aagcangcgaatgtatnttta

SEQ ID NO: 11033 - DNA, 21 bp, Artificial sequence
  SiRNA target sequence
  misc_feature (5)..(5): n is a, c, g, or t
  misc_feature (16)..(16): n is a, c, g, or t
agcangcgaatgtatntttaa

SEQ ID NO: 11034 - DNA, 21 bp, Artificial sequence
  SiRNA target sequence
  misc_feature (4)..(4): n is a, c, g, or t
  misc_feature (15)..(15): n is a, c, g, or t
gcangcgaatgtatntttaag

SEQ ID NO: 11035 - DNA, 21 bp, Artificial sequence
  SiRNA target sequence
  misc_feature (3)..(3): n is a, c, g, or t
  misc_feature (14)..(14): n is a, c, g, or t
cangcgaatgtatntttaaga

SEQ ID NO: 11036 - DNA, 21 bp, Artificial sequence
  SiRNA target sequence
  misc_feature (2)..(2): n is a, c, g, or t
  misc_feature (13)..(13): n is a, c, g, or t
angcgaatgtatntttaagaa

SEQ ID NO: 11037 - DNA, 21 bp, Artificial sequence
  SiRNA target sequence
  misc_feature (1)..(1): n is a, c, g, or t
  misc_feature (12)..(12): n is a, c, g, or t
ngcgaatgtatntttaagaaa

SEQ ID NO: 11038 - DNA, 21 bp, Artificial sequence
  SiRNA target sequence
  misc_feature (11)..(11): n is a, c, g, or t
gcgaatgtatntttaagaaac

SEQ ID NO: 11039 - DNA, 21 bp, Artificial sequence
  SiRNA target sequence
  misc_feature (10)..(10): n is a, c, g, or t
cgaatgtatntttaagaaacc

SEQ ID NO: 11040 - DNA, 21 bp, Artificial sequence
  SiRNA target sequence
  misc_feature (9)..(9): n is a, c, g, or t
gaatgtatntttaagaaacct

SEQ ID NO: 11041 - DNA, 21 bp, Artificial sequence
  SiRNA target sequence
  misc_feature (8)..(8): n is a, c, g, or t
aatgtatntttaagaaaccta

SEQ ID NO: 11042 - DNA, 21 bp, Artificial sequence
  SiRNA target sequence
  misc_feature (7)..(7): n is a, c, g, or t
atgtatntttaagaaacctaa

SEQ ID NO: 11043 - DNA, 21 bp, Artificial sequence
  SiRNA target sequence
  misc_feature (6)..(6): n is a, c, g, or t
tgtatntttaagaaacctaaa

SEQ ID NO: 11044 - DNA, 21 bp, Artificial sequence
  SiRNA target sequence
  misc_feature (5)..(5): n is a, c, g, or t
gtatntttaagaaacctaaat

SEQ ID NO: 11045 - DNA, 21 bp, Artificial sequence
  SiRNA target sequence
  misc_feature (4)..(4): n is a, c, g, or t
tatntttaagaaacctaaata

SEQ ID NO: 11046 - DNA, 21 bp, Artificial sequence
  SiRNA target sequence
  misc_feature (3)..(3): n is a, c, g, or t
atntttaagaaacctaaatat

SEQ ID NO: 11047 - DNA, 21 bp, Artificial sequence
  SiRNA target sequence
  misc_feature (2)..(2): n is a, c, g, or t
tntttaagaaacctaaatata

SEQ ID NO: 11048 - DNA, 21 bp, Artificial sequence
  SiRNA target sequence
  misc_feature (1)..(1): n is a, c, g, or t
ntttaagaaacctaaatatac

SEQ ID NO: 11049 - DNA, 21 bp, Artificial sequence
  SiRNA target sequence
tttaagaaacctaaatatacg

SEQ ID NO: 11050 - DNA, 21 bp, Artificial sequence
  SiRNA target sequence
ttaagaaacctaaatatacgc

SEQ ID NO: 11051 - DNA, 21 bp, Artificial sequence
  SiRNA target sequence
taagaaacctaaatatacgcg

SEQ ID NO: 11052 - DNA, 21 bp, Artificial sequence
  SiRNA target sequence
aagaaacctaaatatacgcgc

SEQ ID NO: 11053 - DNA, 21 bp, Artificial sequence
  SiRNA target sequence
  misc_feature (21)..(21): n is a, c, g, or t
agaaacctaaatatacgcgcn

SEQ ID NO: 11054 - DNA, 21 bp, Artificial sequence
  SiRNA target sequence
  misc_feature (20)..(20): n is a, c, g, or t
gaaacctaaatatacgcgcnt

SEQ ID NO: 11055 - DNA, 21 bp, Artificial sequence
  SiRNA target sequence
  misc_feature (19)..(19): n is a, c, g, or t
aaacctaaatatacgcgcntt

SEQ ID NO: 11056 - DNA, 21 bp, Artificial sequence
  SiRNA target sequence
  misc_feature (18)..(18): n is a, c, g, or t
aacctaaatatacgcgcnttt

SEQ ID NO: 11057 - DNA, 21 bp, Artificial sequence
  SiRNA target sequence
  misc_feature (17)..(17): n is a, c, g, or t
acctaaatatacgcgcntttg

SEQ ID NO: 11058 - DNA, 21 bp, Artificial sequence
  SiRNA target sequence
  misc_feature (16)..(16): n is a, c, g, or t
cctaaatatacgcgcntttgc

SEQ ID NO: 11059 - DNA, 21 bp, Artificial sequence
  SiRNA target sequence
  misc_feature (15)..(15): n is a, c, g, or t
ctaaatatacgcgcntttgca

SEQ ID NO: 11060 - DNA, 21 bp, Artificial sequence
  SiRNA target sequence
  misc_feature (14)..(14): n is a, c, g, or t
taaatatacgcgcntttgcaa

SEQ ID NO: 11061 - DNA, 21 bp, Artificial sequence
  SiRNA target sequence
  misc_feature (13)..(13): n is a, c, g, or t
aaatatacgcgcntttgcaag

SEQ ID NO: 11062 - DNA, 21 bp, Artificial sequence
  SiRNA target sequence
  misc_feature (12)..(12): n is a, c, g, or t
aatatacgcgcntttgcaaga

SEQ ID NO: 11063 - DNA, 21 bp, Artificial sequence
  SiRNA target sequence
  misc_feature (11)..(11): n is a, c, g, or t
atatacgcgcntttgcaagaa

SEQ ID NO: 11064 - DNA, 21 bp, Artificial sequence
  SiRNA target sequence
  misc_feature (10)..(10): n is a, c, g, or t
tatacgcgcntttgcaagaaa

SEQ ID NO: 11065 - DNA, 21 bp, Artificial sequence
  SiRNA target sequence
  misc_feature (9)..(9): n is a, c, g, or t
atacgcgcntttgcaagaaag

SEQ ID NO: 11066 - DNA, 21 bp, Artificial sequence
  SiRNA target sequence
  misc_feature (8)..(8): n is a, c, g, or t
tacgcgcntttgcaagaaagt

SEQ ID NO: 11067 - DNA, 21 bp, Artificial sequence
  SiRNA target sequence
  misc_feature (7)..(7): n is a, c, g, or t
acgcgcntttgcaagaaagtg

SEQ ID NO: 11068 - DNA, 21 bp, Artificial sequence
  SiRNA target sequence
  misc_feature (6)..(6): n is a, c, g, or t
cgcgcntttgcaagaaagtga

SEQ ID NO: 11069 - DNA, 21 bp, Artificial sequence
  SiRNA target sequence
  misc_feature (5)..(5): n is a, c, g, or t
gcgcntttgcaagaaagtgaa

SEQ ID NO: 11070 - DNA, 21 bp, Artificial sequence
  SiRNA target sequence
  misc_feature (4)..(4): n is a, c, g, or t
cgcntttgcaagaaagtgaag

SEQ ID NO: 11071 - DNA, 21 bp, Artificial sequence
  SiRNA target sequence
  misc_feature (3)..(3): n is a, c, g, or t
gcntttgcaagaaagtgaagc

SEQ ID NO: 11072 - DNA, 21 bp, Artificial sequence
  SiRNA target sequence
  misc_feature (2)..(2): n is a, c, g, or t
cntttgcaagaaagtgaagcg

SEQ ID NO: 11073 - DNA, 21 bp, Artificial sequence
  SiRNA target sequence
  misc_feature (1)..(1): n is a, c, g, or t
ntttgcaagaaagtgaagcgt

SEQ ID NO: 11074 - DNA, 21 bp, Artificial sequence
  SiRNA target sequence
tttgcaagaaagtgaagcgtg

SEQ ID NO: 11075 - DNA, 21 bp, Artificial sequence
  SiRNA target sequence
ttgcaagaaagtgaagcgtgt

SEQ ID NO: 11076 - DNA, 21 bp, Artificial sequence
  SiRNA target sequence
tgcaagaaagtgaagcgtgtt

SEQ ID NO: 11077 - DNA, 21 bp, Artificial sequence
  SiRNA target sequence
gcaagaaagtgaagcgtgttg

SEQ ID NO: 11078 - DNA, 21 bp, Artificial sequence
  SiRNA target sequence
caagaaagtgaagcgtgttgc

SEQ ID NO: 11079 - DNA, 21 bp, Artificial sequence
  SiRNA target sequence
aagaaagtgaagcgtgttgca

SEQ ID NO: 11080 - DNA, 21 bp, Artificial sequence
  SiRNA target sequence
agaaagtgaagcgtgttgcaa

SEQ ID NO: 11081 - DNA, 21 bp, Artificial sequence
  SiRNA target sequence
gaaagtgaagcgtgttgcaac

SEQ ID NO: 11082 - DNA, 21 bp, Artificial sequence
  SiRNA target sequence
aaagtgaagcgtgttgcaact

SEQ ID NO: 11083 - DNA, 21 bp, Artificial sequence
  SiRNA target sequence
aagtgaagcgtgttgcaactc

SEQ ID NO: 11084 - DNA, 21 bp, Artificial sequence
  SiRNA target sequence
agtgaagcgtgttgcaactcg

SEQ ID NO: 11085 - DNA, 21 bp, Artificial sequence
  SiRNA target sequence
gtgaagcgtgttgcaactcgc

SEQ ID NO: 11086 - DNA, 21 bp, Artificial sequence
  SiRNA target sequence
tgaagcgtgttgcaactcgct

SEQ ID NO: 11087 - DNA, 21 bp, Artificial sequence
  SiRNA target sequence
gaagcgtgttgcaactcgctt

SEQ ID NO: 11088 - DNA, 21 bp, Artificial sequence
  SiRNA target sequence
aagcgtgttgcaactcgcttc

SEQ ID NO: 11089 - DNA, 21 bp, Artificial sequence
  SiRNA target sequence
agcgtgttgcaactcgcttcg

SEQ ID NO: 11090 - DNA, 21 bp, Artificial sequence
  SiRNA target sequence
gcgtgttgcaactcgcttcgt

SEQ ID NO: 11091 - DNA, 21 bp, Artificial sequence
  SiRNA target sequence
cgtgttgcaactcgcttcgtt

SEQ ID NO: 11092 - DNA, 21 bp, Artificial sequence
  SiRNA target sequence
gtgttgcaactcgcttcgttc

SEQ ID NO: 11093 - DNA, 21 bp, Artificial sequence
  SiRNA target sequence
tgttgcaactcgcttcgttcg

SEQ ID NO: 11094 - DNA, 21 bp, Artificial sequence
  SiRNA target sequence
gttgcaactcgcttcgttcgt

SEQ ID NO: 11095 - DNA, 21 bp, Artificial sequence
  SiRNA target sequence
ttgcaactcgcttcgttcgtg

SEQ ID NO: 11096 - DNA, 21 bp, Artificial sequence
  SiRNA target sequence
tgcaactcgcttcgttcgtga

SEQ ID NO: 11097 - DNA, 21 bp, Artificial sequence
  SiRNA target sequence
gcaactcgcttcgttcgtgaa

SEQ ID NO: 11098 - DNA, 21 bp, Artificial sequence
  SiRNA target sequence
caactcgcttcgttcgtgaaa

SEQ ID NO: 11099 - DNA, 21 bp, Artificial sequence
  SiRNA target sequence
aactcgcttcgttcgtgaaaa

SEQ ID NO: 11100 - DNA, 21 bp, Artificial sequence
  SiRNA target sequence
actcgcttcgttcgtgaaaaa

SEQ ID NO: 11101 - DNA, 21 bp, Artificial sequence
  SiRNA target sequence
ctcgcttcgttcgtgaaaaag

SEQ ID NO: 11102 - DNA, 21 bp, Artificial sequence
  SiRNA target sequence
tcgcttcgttcgtgaaaaagt

SEQ ID NO: 11103 - DNA, 21 bp, Artificial sequence
  SiRNA target sequence
cgcttcgttcgtgaaaaagtt

SEQ ID NO: 11104 - DNA, 21 bp, Artificial sequence
  SiRNA target sequence
gcttcgttcgtgaaaaagttg

SEQ ID NO: 11105 - DNA, 21 bp, Artificial sequence
  SiRNA target sequence
cttcgttcgtgaaaaagttgt

SEQ ID NO: 11106 - DNA, 21 bp, Artificial sequence
  SiRNA target sequence
ttcgttcgtgaaaaagttgtt

SEQ ID NO: 11107 - DNA, 21 bp, Artificial sequence
  SiRNA target sequence
tcgttcgtgaaaaagttgttc

SEQ ID NO: 11108 - DNA, 21 bp, Artificial sequence
  SiRNA target sequence
cgttcgtgaaaaagttgttcg

SEQ ID NO: 11109 - DNA, 21 bp, Artificial sequence
  SiRNA target sequence
gttcgtgaaaaagttgttcgt

SEQ ID NO: 11110 - DNA, 21 bp, Artificial sequence
  SiRNA target sequence
ttcgtgaaaaagttgttcgtc

SEQ ID NO: 11111 - DNA, 21 bp, Artificial sequence
  SiRNA target sequence
tcgtgaaaaagttgttcgtcc

SEQ ID NO: 11112 - DNA, 21 bp, Artificial sequence
  SiRNA target sequence
cgtgaaaaagttgttcgtcct

SEQ ID NO: 11113 - DNA, 21 bp, Artificial sequence
  SiRNA target sequence
gtgaaaaagttgttcgtccta

SEQ ID NO: 11114 - DNA, 21 bp, Artificial sequence
  SiRNA target sequence
tgaaaaagttgttcgtcctat

SEQ ID NO: 11115 - DNA, 21 bp, Artificial sequence
  SiRNA target sequence
gaaaaagttgttcgtcctatg

SEQ ID NO: 11116 - DNA, 21 bp, Artificial sequence
  SiRNA target sequence
aaaaagttgttcgtcctatgt

SEQ ID NO: 11117 - DNA, 21 bp, Artificial sequence
  SiRNA target sequence
aaaagttgttcgtcctatgtg

SEQ ID NO: 11118 - DNA, 21 bp, Artificial sequence
  SiRNA target sequence
  misc_feature (21)..(21): n is a, c, g, or t
aaagttgttcgtcctatgtgn

SEQ ID NO: 11119 - DNA, 21 bp, Artificial sequence
  SiRNA target sequence
  misc_feature (20)..(20): n is a, c, g, or t
aagttgttcgtcctatgtgnt

SEQ ID NO: 11120 - DNA, 21 bp, Artificial sequence
  SiRNA target sequence
  misc_feature (19)..(19): n is a, c, g, or t
agttgttcgtcctatgtgntc

SEQ ID NO: 11121 - DNA, 21 bp, Artificial sequence
  SiRNA target sequence
  misc_feature (18)..(18): n is a, c, g, or t
  misc_feature (21)..(21): n is a, c, g, or t
gttgttcgtcctatgtgntcn

SEQ ID NO: 11122 - DNA, 21 bp, Artificial sequence
  SiRNA target sequence
  misc_feature (17)..(17): n is a, c, g, or t
  misc_feature (20)..(20): n is a, c, g, or t
ttgttcgtcctatgtgntcna

SEQ ID NO: 11123 - DNA, 21 bp, Artificial sequence
  SiRNA target sequence
  misc_feature (16)..(16): n is a, c, g, or t
  misc_feature (19)..(19): n is a, c, g, or t
tgttcgtcctatgtgntcnag

SEQ ID NO: 11124 - DNA, 21 bp, Artificial sequence
  SiRNA target sequence
  misc_feature (15)..(15): n is a, c, g, or t
  misc_feature (18)..(18): n is a, c, g, or t
gttcgtcctatgtgntcnaga

SEQ ID NO: 11125 - DNA, 21 bp, Artificial sequence
  SiRNA target sequence
  misc_feature (14)..(14): n is a, c, g, or t
  misc_feature (17)..(17): n is a, c, g, or t
ttcgtcctatgtgntcnagat

SEQ ID NO: 11126 - DNA, 21 bp, Artificial sequence
  SiRNA target sequence
  misc_feature (13)..(13): n is a, c, g, or t
  misc_feature (16)..(16): n is a, c, g, or t
tcgtcctatgtgntcnagatc

SEQ ID NO: 11127 - DNA, 21 bp, Artificial sequence
  SiRNA target sequence
  misc_feature (12)..(12): n is a, c, g, or t
  misc_feature (15)..(15): n is a, c, g, or t
cgtcctatgtgntcnagatcc

SEQ ID NO: 11128 - DNA, 21 bp, Artificial sequence
  SiRNA target sequence
  misc_feature (11)..(11): n is a, c, g, or t
  misc_feature (14)..(14): n is a, c, g, or t
gtcctatgtgntcnagatccc

SEQ ID NO: 11129 - DNA, 21 bp, Artificial sequence
  SiRNA target sequence
  misc_feature (10)..(10): n is a, c, g, or t
  misc_feature (13)..(13): n is a, c, g, or t
tcctatgtgntcnagatcccc

SEQ ID NO: 11130 - DNA, 21 bp, Artificial sequence
  SiRNA target sequence
  misc_feature (9)..(9): n is a, c, g, or t
  misc_feature (12)..(12): n is a, c, g, or t
cctatgtgntcnagatcccct

SEQ ID NO: 11131 - DNA, 21 bp, Artificial sequence
  SiRNA target sequence
  misc_feature (8)..(8): n is a, c, g, or t
  misc_feature (11)..(11): n is a, c, g, or t
ctatgtgntcnagatccccta

SEQ ID NO: 11132 - DNA, 21 bp, Artificial sequence
  SiRNA target sequence
  misc_feature (7)..(7): n is a, c, g, or t
  misc_feature (10)..(10): n is a, c, g, or t
tatgtgntcnagatcccctat

SEQ ID NO: 11133 - DNA, 21 bp, Artificial sequence
  SiRNA target sequence
  misc_feature (6)..(6): n is a, c, g, or t
  misc_feature (9)..(9): n is a, c, g, or t
atgtgntcnagatcccctatg

SEQ ID NO: 11134 - DNA, 21 bp, Artificial sequence
  SiRNA target sequence
  misc_feature (5)..(5): n is a, c, g, or t
  misc_feature (8)..(8): n is a, c, g, or t
tgtgntcnagatcccctatgc

SEQ ID NO: 11135 - DNA, 21 bp, Artificial sequence
  SiRNA target sequence
  misc_feature (4)..(4): n is a, c, g, or t
  misc_feature (7)..(7): n is a, c, g, or t
gtgntcnagatcccctatgct

SEQ ID NO: 11136 - DNA, 21 bp, Artificial sequence
  SiRNA target sequence
  misc_feature (3)..(3): n is a, c, g, or t
  misc_feature (6)..(6): n is a, c, g, or t
tgntcnagatcccctatgcta

SEQ ID NO: 11137 - DNA, 21 bp, Artificial sequence
  SiRNA target sequence
  misc_feature (2)..(2): n is a, c, g, or t
  misc_feature (5)..(5): n is a, c, g, or t
gntcnagatcccctatgctat

SEQ ID NO: 11138 - DNA, 21 bp, Artificial sequence
  SiRNA target sequence
  misc_feature (1)..(1): n is a, c, g, or t
  misc_feature (4)..(4): n is a, c, g, or t
ntcnagatcccctatgctatt

SEQ ID NO: 11139 - DNA, 21 bp, Artificial sequence
  SiRNA target sequence
  misc_feature (3)..(3): n is a, c, g, or t
tcnagatcccctatgctatta

SEQ ID NO: 11140 - DNA, 21 bp, Artificial sequence
  SiRNA target sequence
  misc_feature (2)..(2): n is a, c, g, or t
cnagatcccctatgctattat

SEQ ID NO: 11141 - DNA, 21 bp, Artificial sequence
  SiRNA target sequence
  misc_feature (1)..(1): n is a, c, g, or t
nagatcccctatgctattatt

SEQ ID NO: 11142 - DNA, 21 bp, Artificial sequence
  SiRNA target sequence
agatcccctatgctattattt

SEQ ID NO: 11143 - DNA, 21 bp, Artificial sequence
  SiRNA target sequence
gatcccctatgctattattta

SEQ ID NO: 11144 - DNA, 21 bp, Artificial sequence
  SiRNA target sequence
atcccctatgctattatttaa

SEQ ID NO: 11145 - DNA, 21 bp, Artificial sequence
  SiRNA target sequence
tcccctatgctattatttaag

SEQ ID NO: 11146 - DNA, 21 bp, Artificial sequence
  SiRNA target sequence
cccctatgctattatttaagc

SEQ ID NO: 11147 - DNA, 21 bp, Artificial sequence
  SiRNA target sequence
ccctatgctattatttaagct

SEQ ID NO: 11148 - DNA, 21 bp, Artificial sequence
  SiRNA target sequence
cctatgctattatttaagctt

SEQ ID NO: 11149 - DNA, 21 bp, Artificial sequence
  SiRNA target sequence
ctatgctattatttaagctta

SEQ ID NO: 11150 - DNA, 21 bp, Artificial sequence
  SiRNA target sequence
tatgctattatttaagcttaa

SEQ ID NO: 11151 - DNA, 21 bp, Artificial sequence
  SiRNA target sequence
atgctattatttaagcttaag

SEQ ID NO: 11152 - DNA, 21 bp, Artificial sequence
  SiRNA target sequence
tgctattatttaagcttaaga

SEQ ID NO: 11153 - DNA, 21 bp, Artificial sequence
  SiRNA target sequence
gctattatttaagcttaagaa

SEQ ID NO: 11154 - DNA, 21 bp, Artificial sequence
  SiRNA target sequence
ctattatttaagcttaagaaa

SEQ ID NO: 11155 - DNA, 21 bp, Artificial sequence
  SiRNA target sequence
tattatttaagcttaagaaaa

SEQ ID NO: 11156 - DNA, 21 bp, Artificial sequence
  SiRNA target sequence
attatttaagcttaagaaaat

SEQ ID NO: 11157 - DNA, 21 bp, Artificial sequence
  SiRNA target sequence
ttatttaagcttaagaaaatt

SEQ ID NO: 11158 - DNA, 21 bp, Artificial sequence
  SiRNA target sequence
tatttaagcttaagaaaatta

SEQ ID NO: 11159 - DNA, 21 bp, Artificial sequence
  SiRNA target sequence
atttaagcttaagaaaattat

SEQ ID NO: 11160 - DNA, 21 bp, Artificial sequence
  SiRNA target sequence
tttaagcttaagaaaattatt

SEQ ID NO: 11161 - DNA, 21 bp, Artificial sequence
  SiRNA target sequence
ttaagcttaagaaaattattt

SEQ ID NO: 11162 - DNA, 21 bp, Artificial sequence
  SiRNA target sequence
taagcttaagaaaattattta

SEQ ID NO: 11163 - DNA, 21 bp, Artificial sequence
  SiRNA target sequence
aagcttaagaaaattatttat

SEQ ID NO: 11164 - DNA, 21 bp, Artificial sequence
  SiRNA target sequence
agcttaagaaaattatttatg

SEQ ID NO: 11165 - DNA, 21 bp, Artificial sequence
  SiRNA target sequence
gcttaagaaaattatttatga

SEQ ID NO: 11166 - DNA, 21 bp, Artificial sequence
  SiRNA target sequence
cttaagaaaattatttatgat

SEQ ID NO: 11167 - DNA, 21 bp, Artificial sequence
  SiRNA target sequence
ttaagaaaattatttatgatt

SEQ ID NO: 11168 - DNA, 21 bp, Artificial sequence
  SiRNA target sequence
taagaaaattatttatgattt

SEQ ID NO: 11169 - DNA, 21 bp, Artificial sequence
  SiRNA target sequence
aagaaaattatttatgatttg

SEQ ID NO: 11170 - DNA, 21 bp, Artificial sequence
  SiRNA target sequence
agaaaattatttatgatttgc

SEQ ID NO: 11171 - DNA, 21 bp, Artificial sequence
  SiRNA target sequence
gaaaattatttatgatttgca

SEQ ID NO: 11172 - DNA, 21 bp, Artificial sequence
  SiRNA target sequence
aaaattatttatgatttgcat

SEQ ID NO: 11173 - DNA, 21 bp, Artificial sequence
  SiRNA target sequence
aaattatttatgatttgcatt

SEQ ID NO: 11174 - DNA, 21 bp, Artificial sequence
  SiRNA target sequence
aattatttatgatttgcattt

SEQ ID NO: 11175 - DNA, 21 bp, Artificial sequence
  SiRNA target sequence
attatttatgatttgcattta

SEQ ID NO: 11176 - DNA, 21 bp, Artificial sequence
  SiRNA target sequence
ttatttatgatttgcatttat

SEQ ID NO: 11177 - DNA, 21 bp, Artificial sequence
  SiRNA target sequence
tatttatgatttgcatttata

SEQ ID NO: 11178 - DNA, 21 bp, Artificial sequence
  SiRNA target sequence
atttatgatttgcatttatat

SEQ ID NO: 11179 - DNA, 21 bp, Artificial sequence
  SiRNA target sequence
tttatgatttgcatttatata

SEQ ID NO: 11180 - DNA, 21 bp, Artificial sequence
  SiRNA target sequence
ttatgatttgcatttatatag

SEQ ID NO: 11181 - DNA, 21 bp, Artificial sequence
  SiRNA target sequence
tatgatttgcatttatataga

SEQ ID NO: 11182 - DNA, 21 bp, Artificial sequence
  SiRNA target sequence
atgatttgcatttatatagat

SEQ ID NO: 11183 - DNA, 21 bp, Artificial sequence
  SiRNA target sequence
tgatttgcatttatatagatt

SEQ ID NO: 11184 - DNA, 21 bp, Artificial sequence
  SiRNA target sequence
gatttgcatttatatagatta

SEQ ID NO: 11185 - DNA, 21 bp, Artificial sequence
  SiRNA target sequence
atttgcatttatatagattaa

SEQ ID NO: 11186 - DNA, 21 bp, Artificial sequence
  SiRNA target sequence
tttgcatttatatagattaag

SEQ ID NO: 11187 - DNA, 21 bp, Artificial sequence
  SiRNA target sequence
ttgcatttatatagattaaga

SEQ ID NO: 11188 - DNA, 21 bp, Artificial sequence
  SiRNA target sequence
tgcatttatatagattaagaa

SEQ ID NO: 11189 - DNA, 21 bp, Artificial sequence
  SiRNA target sequence
gcatttatatagattaagaaa

SEQ ID NO: 11190 - DNA, 21 bp, Artificial sequence
  SiRNA target sequence
catttatatagattaagaaaa

SEQ ID NO: 11191 - DNA, 21 bp, Artificial sequence
  SiRNA target sequence
atttatatagattaagaaaac

SEQ ID NO: 11192 - DNA, 21 bp, Artificial sequence
  SiRNA target sequence
tttatatagattaagaaaaca

SEQ ID NO: 11193 - DNA, 21 bp, Artificial sequence
  SiRNA target sequence
ttatatagattaagaaaacag

SEQ ID NO: 11194 - DNA, 21 bp, Artificial sequence
  SiRNA target sequence
tatatagattaagaaaacaga

SEQ ID NO: 11195 - DNA, 21 bp, Artificial sequence
  SiRNA target sequence
atatagattaagaaaacagat

SEQ ID NO: 11196 - DNA, 21 bp, Artificial sequence
  SiRNA target sequence
tatagattaagaaaacagatt

SEQ ID NO: 11197 - DNA, 21 bp, Artificial sequence
  SiRNA target sequence
atagattaagaaaacagatta

SEQ ID NO: 11198 - DNA, 21 bp, Artificial sequence
  SiRNA target sequence
tagattaagaaaacagattag

SEQ ID NO: 11199 - DNA, 21 bp, Artificial sequence
  SiRNA target sequence
agattaagaaaacagattagg

SEQ ID NO: 11200 - DNA, 21 bp, Artificial sequence
  SiRNA target sequence
gattaagaaaacagattagga

SEQ ID NO: 11201 - DNA, 21 bp, Artificial sequence
  SiRNA target sequence
attaagaaaacagattaggat

SEQ ID NO: 11202 - DNA, 21 bp, Artificial sequence
  SiRNA target sequence
ttaagaaaacagattaggatg

SEQ ID NO: 11203 - DNA, 21 bp, Artificial sequence
  SiRNA target sequence
taagaaaacagattaggatgt

SEQ ID NO: 11204 - DNA, 21 bp, Artificial sequence
  SiRNA target sequence
aagaaaacagattaggatgtt

SEQ ID NO: 11205 - DNA, 21 bp, Artificial sequence
  SiRNA target sequence
agaaaacagattaggatgttg

SEQ ID NO: 11206 - DNA, 21 bp, Artificial sequence
  SiRNA target sequence
gaaaacagattaggatgttga

SEQ ID NO: 11207 - DNA, 21 bp, Artificial sequence
  SiRNA target sequence
aaaacagattaggatgttgag

SEQ ID NO: 11208 - DNA, 21 bp, Artificial sequence
  SiRNA target sequence
aaacagattaggatgttgaga

SEQ ID NO: 11209 - DNA, 21 bp, Artificial sequence
  SiRNA target sequence
aacagattaggatgttgagac

SEQ ID NO: 11210 - DNA, 21 bp, Artificial sequence
  SiRNA target sequence
acagattaggatgttgagacg

SEQ ID NO: 11211 - DNA, 21 bp, Artificial sequence
  SiRNA target sequence
cagattaggatgttgagacgt

SEQ ID NO: 11212 - DNA, 21 bp, Artificial sequence
  SiRNA target sequence
agattaggatgttgagacgtc

SEQ ID NO: 11213 - DNA, 21 bp, Artificial sequence
  SiRNA target sequence
gattaggatgttgagacgtca

SEQ ID NO: 11214 - DNA, 21 bp, Artificial sequence
  SiRNA target sequence
attaggatgttgagacgtcaa

SEQ ID NO: 11215 - DNA, 21 bp, Artificial sequence
  SiRNA target sequence
ttaggatgttgagacgtcaaa

SEQ ID NO: 11216 - DNA, 21 bp, Artificial sequence
  SiRNA target sequence
taggatgttgagacgtcaaaa

SEQ ID NO: 11217 - DNA, 21 bp, Artificial sequence
  SiRNA target sequence
aggatgttgagacgtcaaaaa

SEQ ID NO: 11218 - DNA, 21 bp, Artificial sequence
  SiRNA target sequence
ggatgttgagacgtcaaaaac

SEQ ID NO: 11219 - DNA, 21 bp, Artificial sequence
  SiRNA target sequence
gatgttgagacgtcaaaaaca

SEQ ID NO: 11220 - DNA, 21 bp, Artificial sequence
  SiRNA target sequence
atgttgagacgtcaaaaacag

SEQ ID NO: 11221 - DNA, 21 bp, Artificial sequence
  SiRNA target sequence
tgttgagacgtcaaaaacagc

SEQ ID NO: 11222 - DNA, 21 bp, Artificial sequence
  SiRNA target sequence
gttgagacgtcaaaaacagcg

SEQ ID NO: 11223 - DNA, 21 bp, Artificial sequence
  SiRNA target sequence
ttgagacgtcaaaaacagcgc

SEQ ID NO: 11224 - DNA, 21 bp, Artificial sequence
  SiRNA target sequence
tgagacgtcaaaaacagcgcg

SEQ ID NO: 11225 - DNA, 21 bp, Artificial sequence
  SiRNA target sequence
gagacgtcaaaaacagcgcga

SEQ ID NO: 11226 - DNA, 21 bp, Artificial sequence
  SiRNA target sequence
agacgtcaaaaacagcgcgat

SEQ ID NO: 11227 - DNA, 21 bp, Artificial sequence
  SiRNA target sequence
gacgtcaaaaacagcgcgatt

SEQ ID NO: 11228 - DNA, 21 bp, Artificial sequence
  SiRNA target sequence
acgtcaaaaacagcgcgatta

SEQ ID NO: 11229 - DNA, 21 bp, Artificial sequence
  SiRNA target sequence
cgtcaaaaacagcgcgattat

SEQ ID NO: 11230 - DNA, 21 bp, Artificial sequence
  SiRNA target sequence
gtcaaaaacagcgcgattatg

SEQ ID NO: 11231 - DNA, 21 bp, Artificial sequence
  SiRNA target sequence
tcaaaaacagcgcgattatga

SEQ ID NO: 11232 - DNA, 21 bp, Artificial sequence
  SiRNA target sequence
caaaaacagcgcgattatgag

SEQ ID NO: 11233 - DNA, 21 bp, Artificial sequence
  SiRNA target sequence
aaaaacagcgcgattatgagt

SEQ ID NO: 11234 - DNA, 21 bp, Artificial sequence
  SiRNA target sequence
aaaacagcgcgattatgagtt

SEQ ID NO: 11235 - DNA, 21 bp, Artificial sequence
  SiRNA target sequence
aaacagcgcgattatgagtta

SEQ ID NO: 11236 - DNA, 21 bp, Artificial sequence
  SiRNA target sequence
aacagcgcgattatgagttag

SEQ ID NO: 11237 - DNA, 21 bp, Artificial sequence
  SiRNA target sequence
acagcgcgattatgagttaga

SEQ ID NO: 11238 - DNA, 21 bp, Artificial sequence
  SiRNA target sequence
cagcgcgattatgagttagag

SEQ ID NO: 11239 - DNA, 21 bp, Artificial sequence
  SiRNA target sequence
agcgcgattatgagttagagt

SEQ ID NO: 11240 - DNA, 21 bp, Artificial sequence
  SiRNA target sequence
gcgcgattatgagttagagtg

SEQ ID NO: 11241 - DNA, 21 bp, Artificial sequence
  SiRNA target sequence
cgcgattatgagttagagtgt

SEQ ID NO: 11242 - DNA, 21 bp, Artificial sequence
  SiRNA target sequence
gcgattatgagttagagtgtg

SEQ ID NO: 11243 - DNA, 21 bp, Artificial sequence
  SiRNA target sequence
cgattatgagttagagtgtgt

SEQ ID NO: 11244 - DNA, 21 bp, Artificial sequence
  SiRNA target sequence
gattatgagttagagtgtgtc

SEQ ID NO: 11245 - DNA, 21 bp, Artificial sequence
  SiRNA target sequence
attatgagttagagtgtgtca

SEQ ID NO: 11246 - DNA, 21 bp, Artificial sequence
  SiRNA target sequence
ttatgagttagagtgtgtcac

SEQ ID NO: 11247 - DNA, 21 bp, Artificial sequence
  SiRNA target sequence
tatgagttagagtgtgtcact

SEQ ID NO: 11248 - DNA, 21 bp, Artificial sequence
  SiRNA target sequence
atgagttagagtgtgtcacta

SEQ ID NO: 11249 - DNA, 21 bp, Artificial sequence
  SiRNA target sequence
tgagttagagtgtgtcactaa

SEQ ID NO: 11250 - DNA, 21 bp, Artificial sequence
  SiRNA target sequence
gagttagagtgtgtcactaat

SEQ ID NO: 11251 - DNA, 21 bp, Artificial sequence
  SiRNA target sequence
agttagagtgtgtcactaatc

SEQ ID NO: 11252 - DNA, 21 bp, Artificial sequence
  SiRNA target sequence
gttagagtgtgtcactaatct

SEQ ID NO: 11253 - DNA, 21 bp, Artificial sequence
  SiRNA target sequence
ttagagtgtgtcactaatctg

SEQ ID NO: 11254 - DNA, 21 bp, Artificial sequence
  SiRNA target sequence
  misc_feature (21)..(21): n is a, c, g, or t
tagagtgtgtcactaatctgn

SEQ ID NO: 11255 - DNA, 21 bp, Artificial sequence
  SiRNA target sequence
  misc_feature (20)..(20): n is a, c, g, or t
agagtgtgtcactaatctgnt

SEQ ID NO: 11256 - DNA, 21 bp, Artificial sequence
  SiRNA target sequence
  misc_feature (19)..(19): n is a, c, g, or t
gagtgtgtcactaatctgnta

SEQ ID NO: 11257 - DNA, 21 bp, Artificial sequence
  SiRNA target sequence
  misc_feature (18)..(18): n is a, c, g, or t
agtgtgtcactaatctgntac

SEQ ID NO: 11258 - DNA, 21 bp, Artificial sequence
  SiRNA target sequence
  misc_feature (17)..(17): n is a, c, g, or t
gtgtgtcactaatctgntaca

SEQ ID NO: 11259 - DNA, 21 bp, Artificial sequence
  SiRNA target sequence
  misc_feature (16)..(16): n is a, c, g, or t
tgtgtcactaatctgntacaa

SEQ ID NO: 11260 - DNA, 21 bp, Artificial sequence
  SiRNA target sequence
  misc_feature (15)..(15): n is a, c, g, or t
gtgtcactaatctgntacaat

SEQ ID NO: 11261 - DNA, 21 bp, Artificial sequence
  SiRNA target sequence
  misc_feature (14)..(14): n is a, c, g, or t
tgtcactaatctgntacaatt

SEQ ID NO: 11262 - DNA, 21 bp, Artificial sequence
  SiRNA target sequence
  misc_feature (13)..(13): n is a, c, g, or t
gtcactaatctgntacaatta

SEQ ID NO: 11263 - DNA, 21 bp, Artificial sequence
  SiRNA target sequence
  misc_feature (12)..(12): n is a, c, g, or t
tcactaatctgntacaattat

SEQ ID NO: 11264 - DNA, 21 bp, Artificial sequence
  SiRNA target sequence
  misc_feature (11)..(11): n is a, c, g, or t
cactaatctgntacaattatc

SEQ ID NO: 11265 - DNA, 21 bp, Artificial sequence
  SiRNA target sequence
  misc_feature (10)..(10): n is a, c, g, or t
actaatctgntacaattatcg

SEQ ID NO: 11266 - DNA, 21 bp, Artificial sequence
  SiRNA target sequence
  misc_feature (9)..(9): n is a, c, g, or t
ctaatctgntacaattatcga

SEQ ID NO: 11267 - DNA, 21 bp, Artificial sequence
  SiRNA target sequence
  misc_feature (8)..(8): n is a, c, g, or t
taatctgntacaattatcgaa

SEQ ID NO: 11268 - DNA, 21 bp, Artificial sequence
  SiRNA target sequence
  misc_feature (7)..(7): n is a, c, g, or t
aatctgntacaattatcgaat

SEQ ID NO: 11269 - DNA, 21 bp, Artificial sequence
  SiRNA target sequence
  misc_feature (6)..(6): n is a, c, g, or t
atctgntacaattatcgaatc

SEQ ID NO: 11270 - DNA, 21 bp, Artificial sequence
  SiRNA target sequence
  misc_feature (5)..(5): n is a, c, g, or t
tctgntacaattatcgaatcc

SEQ ID NO: 11271 - DNA, 21 bp, Artificial sequence
  SiRNA target sequence
  misc_feature (4)..(4): n is a, c, g, or t
ctgntacaattatcgaatcca

SEQ ID NO: 11272 - DNA, 21 bp, Artificial sequence
  SiRNA target sequence
  misc_feature (3)..(3): n is a, c, g, or t
tgntacaattatcgaatccag

SEQ ID NO: 11273 - DNA, 21 bp, Artificial sequence
  SiRNA target sequence
  misc_feature (2)..(2): n is a, c, g, or t
gntacaattatcgaatccagt

SEQ ID NO: 11274 - DNA, 21 bp, Artificial sequence
  SiRNA target sequence
  misc_feature (1)..(1): n is a, c, g, or t
ntacaattatcgaatccagtg

SEQ ID NO: 11275 - DNA, 21 bp, Artificial sequence
  SiRNA target sequence
tacaattatcgaatccagtgc

SEQ ID NO: 11276 - DNA, 21 bp, Artificial sequence
  SiRNA target sequence
acaattatcgaatccagtgca

SEQ ID NO: 11277 - DNA, 21 bp, Artificial sequence
  SiRNA target sequence
caattatcgaatccagtgcag

SEQ ID NO: 11278 - DNA, 21 bp, Artificial sequence
  SiRNA target sequence
aattatcgaatccagtgcagg

SEQ ID NO: 11279 - DNA, 21 bp, Artificial sequence
  SiRNA target sequence
attatcgaatccagtgcaggc

SEQ ID NO: 11280 - DNA, 21 bp, Artificial sequence
  SiRNA target sequence
ttatcgaatccagtgcaggca

SEQ ID NO: 11281 - DNA, 21 bp, Artificial sequence
  SiRNA target sequence
tatcgaatccagtgcaggcaa

SEQ ID NO: 11282 - DNA, 21 bp, Artificial sequence
  SiRNA target sequence
atcgaatccagtgcaggcaaa

SEQ ID NO: 11283 - DNA, 21 bp, Artificial sequence
  SiRNA target sequence
tcgaatccagtgcaggcaaaa

SEQ ID NO: 11284 - DNA, 21 bp, Artificial sequence
  SiRNA target sequence
cgaatccagtgcaggcaaaac

SEQ ID NO: 11285 - DNA, 21 bp, Artificial sequence
  SiRNA target sequence
gaatccagtgcaggcaaaacc

SEQ ID NO: 11286 - DNA, 21 bp, Artificial sequence
  SiRNA target sequence
aatccagtgcaggcaaaacca

SEQ ID NO: 11287 - DNA, 21 bp, Artificial sequence
  SiRNA target sequence
atccagtgcaggcaaaaccag

SEQ ID NO: 11288 - DNA, 21 bp, Artificial sequence
  SiRNA target sequence
tccagtgcaggcaaaaccaga

SEQ ID NO: 11289 - DNA, 21 bp, Artificial sequence
  SiRNA target sequence
ccagtgcaggcaaaaccagag

SEQ ID NO: 11290 - DNA, 21 bp, Artificial sequence
  SiRNA target sequence
cagtgcaggcaaaaccagaga

SEQ ID NO: 11291 - DNA, 21 bp, Artificial sequence
  SiRNA target sequence
agtgcaggcaaaaccagagat

SEQ ID NO: 11292 - DNA, 21 bp, Artificial sequence
  SiRNA target sequence
gtgcaggcaaaaccagagatg

SEQ ID NO: 11293 - DNA, 21 bp, Artificial sequence
  SiRNA target sequence
tgcaggcaaaaccagagatgg

SEQ ID NO: 11294 - DNA, 21 bp, Artificial sequence
  SiRNA target sequence
gcaggcaaaaccagagatgga

SEQ ID NO: 11295 - DNA, 21 bp, Artificial sequence
  SiRNA target sequence
caggcaaaaccagagatggat

SEQ ID NO: 11296 - DNA, 21 bp, Artificial sequence
  SiRNA target sequence
aggcaaaaccagagatggata

SEQ ID NO: 11297 - DNA, 21 bp, Artificial sequence
  SiRNA target sequence
ggcaaaaccagagatggataa

SEQ ID NO: 11298 - DNA, 21 bp, Artificial sequence
  SiRNA target sequence
gcaaaaccagagatggataac

SEQ ID NO: 11299 - DNA, 21 bp, Artificial sequence
  SiRNA target sequence
caaaaccagagatggataacc

SEQ ID NO: 11300 - DNA, 21 bp, Artificial sequence
  SiRNA target sequence
aaaaccagagatggataaccc

SEQ ID NO: 11301 - DNA, 21 bp, Artificial sequence
  SiRNA target sequence
aaaccagagatggataaccct

SEQ ID NO: 11302 - DNA, 21 bp, Artificial sequence
  SiRNA target sequence
aaccagagatggataacccta

SEQ ID NO: 11303 - DNA, 21 bp, Artificial sequence
  SiRNA target sequence
accagagatggataaccctaa

SEQ ID NO: 11304 - DNA, 21 bp, Artificial sequence
  SiRNA target sequence
ccagagatggataaccctaat

SEQ ID NO: 11305 - DNA, 21 bp, Artificial sequence
  SiRNA target sequence
cagagatggataaccctaatc

SEQ ID NO: 11306 - DNA, 21 bp, Artificial sequence
  SiRNA target sequence
agagatggataaccctaatcc

SEQ ID NO: 11307 - DNA, 21 bp, Artificial sequence
  SiRNA target sequence
gagatggataaccctaatcca

SEQ ID NO: 11308 - DNA, 21 bp, Artificial sequence
  SiRNA target sequence
agatggataaccctaatccag

SEQ ID NO: 11309 - DNA, 21 bp, Artificial sequence
  SiRNA target sequence
gatggataaccctaatccagg

SEQ ID NO: 11310 - DNA, 21 bp, Artificial sequence
  SiRNA target sequence
atggataaccctaatccagga

SEQ ID NO: 11311 - DNA, 21 bp, Artificial sequence
  SiRNA target sequence
tggataaccctaatccaggac

SEQ ID NO: 11312 - DNA, 21 bp, Artificial sequence
  SiRNA target sequence
ggataaccctaatccaggacc

SEQ ID NO: 11313 - DNA, 21 bp, Artificial sequence
  SiRNA target sequence
gataaccctaatccaggacct

SEQ ID NO: 11314 - DNA, 21 bp, Artificial sequence
  SiRNA target sequence
ataaccctaatccaggacctg

SEQ ID NO: 11315 - DNA, 21 bp, Artificial sequence
  SiRNA target sequence
taaccctaatccaggacctga

SEQ ID NO: 11316 - DNA, 21 bp, Artificial sequence
  SiRNA target sequence
aaccctaatccaggacctgat

SEQ ID NO: 11317 - DNA, 21 bp, Artificial sequence
  SiRNA target sequence
accctaatccaggacctgatg

SEQ ID NO: 11318 - DNA, 21 bp, Artificial sequence
  SiRNA target sequence
ccctaatccaggacctgatgg

SEQ ID NO: 11319 - DNA, 21 bp, Artificial sequence
  SiRNA target sequence
cctaatccaggacctgatggc

SEQ ID NO: 11320 - DNA, 21 bp, Artificial sequence
  SiRNA target sequence
ctaatccaggacctgatggcg

SEQ ID NO: 11321 - DNA, 21 bp, Artificial sequence
  SiRNA target sequence
taatccaggacctgatggcga

SEQ ID NO: 11322 - DNA, 21 bp, Artificial sequence
  SiRNA target sequence
aatccaggacctgatggcgag

SEQ ID NO: 11323 - DNA, 21 bp, Artificial sequence
  SiRNA target sequence
atccaggacctgatggcgagg

SEQ ID NO: 11324 - DNA, 21 bp, Artificial sequence
  SiRNA target sequence
tccaggacctgatggcgaggg

SEQ ID NO: 11325 - DNA, 21 bp, Artificial sequence
  SiRNA target sequence
ccaggacctgatggcgagggt

SEQ ID NO: 11326 - DNA, 21 bp, Artificial sequence
  SiRNA target sequence
caggacctgatggcgagggtg

SEQ ID NO: 11327 - DNA, 21 bp, Artificial sequence
  SiRNA target sequence
aggacctgatggcgagggtga

SEQ ID NO: 11328 - DNA, 21 bp, Artificial sequence
  SiRNA target sequence
ggacctgatggcgagggtgaa

SEQ ID NO: 11329 - DNA, 21 bp, Artificial sequence
  SiRNA target sequence
gacctgatggcgagggtgaag

SEQ ID NO: 11330 - DNA, 21 bp, Artificial sequence
  SiRNA target sequence
acctgatggcgagggtgaagt

SEQ ID NO: 11331 - DNA, 21 bp, Artificial sequence
  SiRNA target sequence
cctgatggcgagggtgaagtt

SEQ ID NO: 11332 - DNA, 21 bp, Artificial sequence
  SiRNA target sequence
ctgatggcgagggtgaagttg

SEQ ID NO: 11333 - DNA, 21 bp, Artificial sequence
  SiRNA target sequence
tgatggcgagggtgaagttga

SEQ ID NO: 11334 - DNA, 21 bp, Artificial sequence
  SiRNA target sequence
gatggcgagggtgaagttgaa

SEQ ID NO: 11335 - DNA, 21 bp, Artificial sequence
  SiRNA target sequence
atggcgagggtgaagttgaat

SEQ ID NO: 11336 - DNA, 21 bp, Artificial sequence
  SiRNA target sequence
tggcgagggtgaagttgaatt

SEQ ID NO: 11337 - DNA, 21 bp, Artificial sequence
  SiRNA target sequence
ggcgagggtgaagttgaatta

SEQ ID NO: 11338 - DNA, 21 bp, Artificial sequence
  SiRNA target sequence
gcgagggtgaagttgaattag

SEQ ID NO: 11339 - DNA, 21 bp, Artificial sequence
  SiRNA target sequence
cgagggtgaagttgaattaga

SEQ ID NO: 11340 - DNA, 21 bp, Artificial sequence
  SiRNA target sequence
gagggtgaagttgaattagaa

SEQ ID NO: 11341 - DNA, 21 bp, Artificial sequence
  SiRNA target sequence
agggtgaagttgaattagaaa

SEQ ID NO: 11342 - DNA, 21 bp, Artificial sequence
  SiRNA target sequence
gggtgaagttgaattagaaaa

SEQ ID NO: 11343 - DNA, 21 bp, Artificial sequence
  SiRNA target sequence
ggtgaagttgaattagaaaag

SEQ ID NO: 11344 - DNA, 21 bp, Artificial sequence
  SiRNA target sequence
gtgaagttgaattagaaaagg

SEQ ID NO: 11345 - DNA, 21 bp, Artificial sequence
  SiRNA target sequence
tgaagttgaattagaaaagga

SEQ ID NO: 11346 - DNA, 21 bp, Artificial sequence
  SiRNA target sequence
gaagttgaattagaaaaggat

SEQ ID NO: 11347 - DNA, 21 bp, Artificial sequence
  SiRNA target sequence
aagttgaattagaaaaggata

SEQ ID NO: 11348 - DNA, 21 bp, Artificial sequence
  SiRNA target sequence
agttgaattagaaaaggatag

SEQ ID NO: 11349 - DNA, 21 bp, Artificial sequence
  SiRNA target sequence
gttgaattagaaaaggatagc

SEQ ID NO: 11350 - DNA, 21 bp, Artificial sequence
  SiRNA target sequence
ttgaattagaaaaggatagca

SEQ ID NO: 11351 - DNA, 21 bp, Artificial sequence
  SiRNA target sequence
tgaattagaaaaggatagcaa

SEQ ID NO: 11352 - DNA, 21 bp, Artificial sequence
  SiRNA target sequence
gaattagaaaaggatagcaat

SEQ ID NO: 11353 - DNA, 21 bp, Artificial sequence
  SiRNA target sequence
aattagaaaaggatagcaatg

SEQ ID NO: 11354 - DNA, 21 bp, Artificial sequence
  SiRNA target sequence
attagaaaaggatagcaatgt

SEQ ID NO: 11355 - DNA, 21 bp, Artificial sequence
  SiRNA target sequence
ttagaaaaggatagcaatgtt

SEQ ID NO: 11356 - DNA, 21 bp, Artificial sequence
  SiRNA target sequence
tagaaaaggatagcaatgttg

SEQ ID NO: 11357 - DNA, 21 bp, Artificial sequence
  SiRNA target sequence
agaaaaggatagcaatgttgt

SEQ ID NO: 11358 - DNA, 21 bp, Artificial sequence
  SiRNA target sequence
gaaaaggatagcaatgttgtt

SEQ ID NO: 11359 - DNA, 21 bp, Artificial sequence
  SiRNA target sequence
aaaaggatagcaatgttgttt

SEQ ID NO: 11360 - DNA, 21 bp, Artificial sequence
  SiRNA target sequence
aaaggatagcaatgttgtttt

SEQ ID NO: 11361 - DNA, 21 bp, Artificial sequence
  SiRNA target sequence
aaggatagcaatgttgtttta

SEQ ID NO: 11362 - DNA, 21 bp, Artificial sequence
  SiRNA target sequence
aggatagcaatgttgttttaa

SEQ ID NO: 11363 - DNA, 21 bp, Artificial sequence
  SiRNA target sequence
ggatagcaatgttgttttaac

SEQ ID NO: 11364 - DNA, 21 bp, Artificial sequence
  SiRNA target sequence
gatagcaatgttgttttaaca

SEQ ID NO: 11365 - DNA, 21 bp, Artificial sequence
  SiRNA target sequence
atagcaatgttgttttaacaa

SEQ ID NO: 11366 - DNA, 21 bp, Artificial sequence
  SiRNA target sequence
tagcaatgttgttttaacaac

SEQ ID NO: 11367 - DNA, 21 bp, Artificial sequence
  SiRNA target sequence
agcaatgttgttttaacaact

SEQ ID NO: 11368 - DNA, 21 bp, Artificial sequence
  SiRNA target sequence
gcaatgttgttttaacaactc

SEQ ID NO: 11369 - DNA, 21 bp, Artificial sequence
  SiRNA target sequence
caatgttgttttaacaactca

SEQ ID NO: 11370 - DNA, 21 bp, Artificial sequence
  SiRNA target sequence
aatgttgttttaacaactcag

SEQ ID NO: 11371 - DNA, 21 bp, Artificial sequence
  SiRNA target sequence
atgttgttttaacaactcagc

SEQ ID NO: 11372 - DNA, 21 bp, Artificial sequence
  SiRNA target sequence
tgttgttttaacaactcagcg

SEQ ID NO: 11373 - DNA, 21 bp, Artificial sequence
  SiRNA target sequence
gttgttttaacaactcagcga

SEQ ID NO: 11374 - DNA, 21 bp, Artificial sequence
  SiRNA target sequence
ttgttttaacaactcagcgag

SEQ ID NO: 11375 - DNA, 21 bp, Artificial sequence
  SiRNA target sequence
tgttttaacaactcagcgaga

SEQ ID NO: 11376 - DNA, 21 bp, Artificial sequence
  SiRNA target sequence
gttttaacaactcagcgagat

SEQ ID NO: 11377 - DNA, 21 bp, Artificial sequence
  SiRNA target sequence
ttttaacaactcagcgagatc

SEQ ID NO: 11378 - DNA, 21 bp, Artificial sequence
  SiRNA target sequence
tttaacaactcagcgagatcc

SEQ ID NO: 11379 - DNA, 21 bp, Artificial sequence
  SiRNA target sequence
ttaacaactcagcgagatcct

SEQ ID NO: 11380 - DNA, 21 bp, Artificial sequence
  SiRNA target sequence
taacaactcagcgagatccta

SEQ ID NO: 11381 - DNA, 21 bp, Artificial sequence
  SiRNA target sequence
aacaactcagcgagatcctag

SEQ ID NO: 11382 - DNA, 21 bp, Artificial sequence
  SiRNA target sequence
acaactcagcgagatcctagt

SEQ ID NO: 11383 - DNA, 21 bp, Artificial sequence
  SiRNA target sequence
caactcagcgagatcctagta

SEQ ID NO: 11384 - DNA, 21 bp, Artificial sequence
  SiRNA target sequence
aactcagcgagatcctagtac

SEQ ID NO: 11385 - DNA, 21 bp, Artificial sequence
  SiRNA target sequence
actcagcgagatcctagtaca

SEQ ID NO: 11386 - DNA, 21 bp, Artificial sequence
  SiRNA target sequence
ctcagcgagatcctagtacat

SEQ ID NO: 11387 - DNA, 21 bp, Artificial sequence
  SiRNA target sequence
tcagcgagatcctagtacatc

SEQ ID NO: 11388 - DNA, 21 bp, Artificial sequence
  SiRNA target sequence
cagcgagatcctagtacatct

SEQ ID NO: 11389 - DNA, 21 bp, Artificial sequence
  SiRNA target sequence
agcgagatcctagtacatcta

SEQ ID NO: 11390 - DNA, 21 bp, Artificial sequence
  SiRNA target sequence
gcgagatcctagtacatctat

SEQ ID NO: 11391 - DNA, 21 bp, Artificial sequence
  SiRNA target sequence
cgagatcctagtacatctatt

SEQ ID NO: 11392 - DNA, 21 bp, Artificial sequence
  SiRNA target sequence
gagatcctagtacatctattc

SEQ ID NO: 11393 - DNA, 21 bp, Artificial sequence
  SiRNA target sequence
agatcctagtacatctattcc

SEQ ID NO: 11394 - DNA, 21 bp, Artificial sequence
  SiRNA target sequence
gatcctagtacatctattcca

SEQ ID NO: 11395 - DNA, 21 bp, Artificial sequence
  SiRNA target sequence
atcctagtacatctattccag

SEQ ID NO: 11396 - DNA, 21 bp, Artificial sequence
  SiRNA target sequence
tcctagtacatctattccagc

SEQ ID NO: 11397 - DNA, 21 bp, Artificial sequence
  SiRNA target sequence
cctagtacatctattccagcg

SEQ ID NO: 11398 - DNA, 21 bp, Artificial sequence
  SiRNA target sequence
ctagtacatctattccagcgc

SEQ ID NO: 11399 - DNA, 21 bp, Artificial sequence
  SiRNA target sequence
tagtacatctattccagcgcc

SEQ ID NO: 11400 - DNA, 21 bp, Artificial sequence
  SiRNA target sequence
agtacatctattccagcgccg

SEQ ID NO: 11401 - DNA, 21 bp, Artificial sequence
  SiRNA target sequence
gtacatctattccagcgccgg

SEQ ID NO: 11402 - DNA, 21 bp, Artificial sequence
  SiRNA target sequence
tacatctattccagcgccggt

SEQ ID NO: 11403 - DNA, 21 bp, Artificial sequence
  SiRNA target sequence
acatctattccagcgccggtg

SEQ ID NO: 11404 - DNA, 21 bp, Artificial sequence
  SiRNA target sequence
catctattccagcgccggtga

SEQ ID NO: 11405 - DNA, 21 bp, Artificial sequence
  SiRNA target sequence
atctattccagcgccggtgag

SEQ ID NO: 11406 - DNA, 21 bp, Artificial sequence
  SiRNA target sequence
tctattccagcgccggtgagc

SEQ ID NO: 11407 - DNA, 21 bp, Artificial sequence
  SiRNA target sequence
ctattccagcgccggtgagcg

SEQ ID NO: 11408 - DNA, 21 bp, Artificial sequence
  SiRNA target sequence
tattccagcgccggtgagcgt

SEQ ID NO: 11409 - DNA, 21 bp, Artificial sequence
  SiRNA target sequence
attccagcgccggtgagcgta

SEQ ID NO: 11410 - DNA, 21 bp, Artificial sequence
  SiRNA target sequence
ttccagcgccggtgagcgtaa

SEQ ID NO: 11411 - DNA, 21 bp, Artificial sequence
  SiRNA target sequence
tccagcgccggtgagcgtaaa

SEQ ID NO: 11412 - DNA, 21 bp, Artificial sequence
  SiRNA target sequence
ccagcgccggtgagcgtaaaa

SEQ ID NO: 11413 - DNA, 21 bp, Artificial sequence
  SiRNA target sequence
cagcgccggtgagcgtaaaat

SEQ ID NO: 11414 - DNA, 21 bp, Artificial sequence
  SiRNA target sequence
agcgccggtgagcgtaaaatg

SEQ ID NO: 11415 - DNA, 21 bp, Artificial sequence
  SiRNA target sequence
gcgccggtgagcgtaaaatgg

SEQ ID NO: 11416 - DNA, 21 bp, Artificial sequence
  SiRNA target sequence
cgccggtgagcgtaaaatgga

SEQ ID NO: 11417 - DNA, 21 bp, Artificial sequence
  SiRNA target sequence
gccggtgagcgtaaaatggag

SEQ ID NO: 11418 - DNA, 21 bp, Artificial sequence
  SiRNA target sequence
ccggtgagcgtaaaatggagt

SEQ ID NO: 11419 - DNA, 21 bp, Artificial sequence
  SiRNA target sequence
cggtgagcgtaaaatggagta

SEQ ID NO: 11420 - DNA, 21 bp, Artificial sequence
  SiRNA target sequence
ggtgagcgtaaaatggagtag

SEQ ID NO: 11421 - DNA, 21 bp, Artificial sequence
  SiRNA target sequence
gtgagcgtaaaatggagtaga

SEQ ID NO: 11422 - DNA, 21 bp, Artificial sequence
  SiRNA target sequence
tgagcgtaaaatggagtagat

SEQ ID NO: 11423 - DNA, 21 bp, Artificial sequence
  SiRNA target sequence
gagcgtaaaatggagtagatg

SEQ ID NO: 11424 - DNA, 21 bp, Artificial sequence
  SiRNA target sequence
agcgtaaaatggagtagatgg

SEQ ID NO: 11425 - DNA, 21 bp, Artificial sequence
  SiRNA target sequence
gcgtaaaatggagtagatgga

SEQ ID NO: 11426 - DNA, 21 bp, Artificial sequence
  SiRNA target sequence
cgtaaaatggagtagatggac

SEQ ID NO: 11427 - DNA, 21 bp, Artificial sequence
  SiRNA target sequence
gtaaaatggagtagatggact

SEQ ID NO: 11428 - DNA, 21 bp, Artificial sequence
  SiRNA target sequence
taaaatggagtagatggacta

SEQ ID NO: 11429 - DNA, 21 bp, Artificial sequence
  SiRNA target sequence
aaaatggagtagatggactag

SEQ ID NO: 11430 - DNA, 21 bp, Artificial sequence
  SiRNA target sequence
aaatggagtagatggactagt

SEQ ID NO: 11431 - DNA, 21 bp, Artificial sequence
  SiRNA target sequence
aatggagtagatggactagta

SEQ ID NO: 11432 - DNA, 21 bp, Artificial sequence
  SiRNA target sequence
atggagtagatggactagtaa

SEQ ID NO: 11433 - DNA, 21 bp, Artificial sequence
  SiRNA target sequence
tggagtagatggactagtaat

SEQ ID NO: 11434 - DNA, 21 bp, Artificial sequence
  SiRNA target sequence
ggagtagatggactagtaatg

SEQ ID NO: 11435 - DNA, 21 bp, Artificial sequence
  SiRNA target sequence
gagtagatggactagtaatga

SEQ ID NO: 11436 - DNA, 21 bp, Artificial sequence
  SiRNA target sequence
agtagatggactagtaatgac

SEQ ID NO: 11437 - DNA, 21 bp, Artificial sequence
  SiRNA target sequence
gtagatggactagtaatgacg

SEQ ID NO: 11438 - DNA, 21 bp, Artificial sequence
  SiRNA target sequence
tagatggactagtaatgacgt

SEQ ID NO: 11439 - DNA, 21 bp, Artificial sequence
  SiRNA target sequence
agatggactagtaatgacgta

SEQ ID NO: 11440 - DNA, 21 bp, Artificial sequence
  SiRNA target sequence
gatggactagtaatgacgtag

SEQ ID NO: 11441 - DNA, 21 bp, Artificial sequence
  SiRNA target sequence
atggactagtaatgacgtagt

SEQ ID NO: 11442 - DNA, 21 bp, Artificial sequence
  SiRNA target sequence
tggactagtaatgacgtagta

SEQ ID NO: 11443 - DNA, 21 bp, Artificial sequence
  SiRNA target sequence
ggactagtaatgacgtagtag

SEQ ID NO: 11444 - DNA, 21 bp, Artificial sequence
  SiRNA target sequence
gactagtaatgacgtagtaga

SEQ ID NO: 11445 - DNA, 21 bp, Artificial sequence
  SiRNA target sequence
actagtaatgacgtagtagat

SEQ ID NO: 11446 - DNA, 21 bp, Artificial sequence
  SiRNA target sequence
ctagtaatgacgtagtagatg

SEQ ID NO: 11447 - DNA, 21 bp, Artificial sequence
  SiRNA target sequence
tagtaatgacgtagtagatga

SEQ ID NO: 11448 - DNA, 21 bp, Artificial sequence
  SiRNA target sequence
agtaatgacgtagtagatgat

SEQ ID NO: 11449 - DNA, 21 bp, Artificial sequence
  SiRNA target sequence
gtaatgacgtagtagatgatt

SEQ ID NO: 11450 - DNA, 21 bp, Artificial sequence
  SiRNA target sequence
taatgacgtagtagatgatta

SEQ ID NO: 11451 - DNA, 21 bp, Artificial sequence
  SiRNA target sequence
aatgacgtagtagatgattat

SEQ ID NO: 11452 - DNA, 21 bp, Artificial sequence
  SiRNA target sequence
atgacgtagtagatgattatg

SEQ ID NO: 11453 - DNA, 21 bp, Artificial sequence
  SiRNA target sequence
tgacgtagtagatgattatgc

SEQ ID NO: 11454 - DNA, 21 bp, Artificial sequence
  SiRNA target sequence
gacgtagtagatgattatgcc

SEQ ID NO: 11455 - DNA, 21 bp, Artificial sequence
  SiRNA target sequence
acgtagtagatgattatgcca

SEQ ID NO: 11456 - DNA, 21 bp, Artificial sequence
  SiRNA target sequence
cgtagtagatgattatgccac

SEQ ID NO: 11457 - DNA, 21 bp, Artificial sequence
  SiRNA target sequence
gtagtagatgattatgccaca

SEQ ID NO: 11458 - DNA, 21 bp, Artificial sequence
  SiRNA target sequence
tagtagatgattatgccacaa

SEQ ID NO: 11459 - DNA, 21 bp, Artificial sequence
  SiRNA target sequence
agtagatgattatgccacaat

SEQ ID NO: 11460 - DNA, 21 bp, Artificial sequence
  SiRNA target sequence
gtagatgattatgccacaatc

SEQ ID NO: 11461 - DNA, 21 bp, Artificial sequence
  SiRNA target sequence
tagatgattatgccacaatca

SEQ ID NO: 11462 - DNA, 21 bp, Artificial sequence
  SiRNA target sequence
agatgattatgccacaatcac

SEQ ID NO: 11463 - DNA, 21 bp, Artificial sequence
  SiRNA target sequence
gatgattatgccacaatcaca

SEQ ID NO: 11464 - DNA, 21 bp, Artificial sequence
  SiRNA target sequence
atgattatgccacaatcacat

SEQ ID NO: 11465 - DNA, 21 bp, Artificial sequence
  SiRNA target sequence
tgattatgccacaatcacatc

SEQ ID NO: 11466 - DNA, 21 bp, Artificial sequence
  SiRNA target sequence
gattatgccacaatcacatct

SEQ ID NO: 11467 - DNA, 21 bp, Artificial sequence
  SiRNA target sequence
attatgccacaatcacatctc

SEQ ID NO: 11468 - DNA, 21 bp, Artificial sequence
  SiRNA target sequence
ttatgccacaatcacatctcg

SEQ ID NO: 11469 - DNA, 21 bp, Artificial sequence
  SiRNA target sequence
tatgccacaatcacatctcga

SEQ ID NO: 11470 - DNA, 21 bp, Artificial sequence
  SiRNA target sequence
atgccacaatcacatctcgat

SEQ ID NO: 11471 - DNA, 21 bp, Artificial sequence
  SiRNA target sequence
tgccacaatcacatctcgatg

SEQ ID NO: 11472 - DNA, 21 bp, Artificial sequence
  SiRNA target sequence
gccacaatcacatctcgatgg

SEQ ID NO: 11473 - DNA, 21 bp, Artificial sequence
  SiRNA target sequence
ccacaatcacatctcgatggt

SEQ ID NO: 11474 - DNA, 21 bp, Artificial sequence
  SiRNA target sequence
cacaatcacatctcgatggta

SEQ ID NO: 11475 - DNA, 21 bp, Artificial sequence
  SiRNA target sequence
  misc_feature (21)..(21): n is a, c, g, or t
acaatcacatctcgatggtan

SEQ ID NO: 11476 - DNA, 21 bp, Artificial sequence
  SiRNA target sequence
  misc_feature (20)..(20): n is a, c, g, or t
caatcacatctcgatggtanc

SEQ ID NO: 11477 - DNA, 21 bp, Artificial sequence
  SiRNA target sequence
  misc_feature (19)..(19): n is a, c, g, or t
aatcacatctcgatggtanca

SEQ ID NO: 11478 - DNA, 21 bp, Artificial sequence
  SiRNA target sequence
  misc_feature (18)..(18): n is a, c, g, or t
atcacatctcgatggtancag

SEQ ID NO: 11479 - DNA, 21 bp, Artificial sequence
  SiRNA target sequence
  misc_feature (17)..(17): n is a, c, g, or t
tcacatctcgatggtancaga

SEQ ID NO: 11480 - DNA, 21 bp, Artificial sequence
  SiRNA target sequence
  misc_feature (16)..(16): n is a, c, g, or t
cacatctcgatggtancagat

SEQ ID NO: 11481 - DNA, 21 bp, Artificial sequence
  SiRNA target sequence
  misc_feature (15)..(15): n is a, c, g, or t
acatctcgatggtancagatt

SEQ ID NO: 11482 - DNA, 21 bp, Artificial sequence
  SiRNA target sequence
  misc_feature (14)..(14): n is a, c, g, or t
catctcgatggtancagattg

SEQ ID NO: 11483 - DNA, 21 bp, Artificial sequence
  SiRNA target sequence
  misc_feature (13)..(13): n is a, c, g, or t
atctcgatggtancagattgc

SEQ ID NO: 11484 - DNA, 21 bp, Artificial sequence
  SiRNA target sequence
  misc_feature (12)..(12): n is a, c, g, or t
tctcgatggtancagattgct

SEQ ID NO: 11485 - DNA, 21 bp, Artificial sequence
  SiRNA target sequence
  misc_feature (11)..(11): n is a, c, g, or t
ctcgatggtancagattgctg

SEQ ID NO: 11486 - DNA, 21 bp, Artificial sequence
  SiRNA target sequence
  misc_feature (10)..(10): n is a, c, g, or t
tcgatggtancagattgctga

SEQ ID NO: 11487 - DNA, 21 bp, Artificial sequence
  SiRNA target sequence
  misc_feature (9)..(9): n is a, c, g, or t
cgatggtancagattgctgaa

SEQ ID NO: 11488 - DNA, 21 bp, Artificial sequence
  SiRNA target sequence
  misc_feature (8)..(8): n is a, c, g, or t
gatggtancagattgctgaat

SEQ ID NO: 11489 - DNA, 21 bp, Artificial sequence
  SiRNA target sequence
  misc_feature (7)..(7): n is a, c, g, or t
atggtancagattgctgaatt

SEQ ID NO: 11490 - DNA, 21 bp, Artificial sequence
  SiRNA target sequence
  misc_feature (6)..(6): n is a, c, g, or t
tggtancagattgctgaattt

SEQ ID NO: 11491 - DNA, 21 bp, Artificial sequence
  SiRNA target sequence
  misc_feature (5)..(5): n is a, c, g, or t
ggtancagattgctgaatttg

SEQ ID NO: 11492 - DNA, 21 bp, Artificial sequence
  SiRNA target sequence
  misc_feature (4)..(4): n is a, c, g, or t
gtancagattgctgaatttgt

SEQ ID NO: 11493 - DNA, 21 bp, Artificial sequence
  SiRNA target sequence
  misc_feature (3)..(3): n is a, c, g, or t
tancagattgctgaatttgtt

SEQ ID NO: 11494 - DNA, 21 bp, Artificial sequence
  SiRNA target sequence
  misc_feature (2)..(2): n is a, c, g, or t
ancagattgctgaatttgttt

SEQ ID NO: 11495 - DNA, 21 bp, Artificial sequence
  SiRNA target sequence
  misc_feature (1)..(1): n is a, c, g, or t
ncagattgctgaatttgtttg

SEQ ID NO: 11496 - DNA, 21 bp, Artificial sequence
  SiRNA target sequence
cagattgctgaatttgtttgg

SEQ ID NO: 11497 - DNA, 21 bp, Artificial sequence
  SiRNA target sequence
agattgctgaatttgtttggt

SEQ ID NO: 11498 - DNA, 21 bp, Artificial sequence
  SiRNA target sequence
gattgctgaatttgtttggtc

SEQ ID NO: 11499 - DNA, 21 bp, Artificial sequence
  SiRNA target sequence
attgctgaatttgtttggtcg

SEQ ID NO: 11500 - DNA, 21 bp, Artificial sequence
  SiRNA target sequence
ttgctgaatttgtttggtcga

SEQ ID NO: 11501 - DNA, 21 bp, Artificial sequence
  SiRNA target sequence
tgctgaatttgtttggtcgaa

SEQ ID NO: 11502 - DNA, 21 bp, Artificial sequence
  SiRNA target sequence
gctgaatttgtttggtcgaag

SEQ ID NO: 11503 - DNA, 21 bp, Artificial sequence
  SiRNA target sequence
ctgaatttgtttggtcgaagg

SEQ ID NO: 11504 - DNA, 21 bp, Artificial sequence
  SiRNA target sequence
tgaatttgtttggtcgaagga

SEQ ID NO: 11505 - DNA, 21 bp, Artificial sequence
  SiRNA target sequence
gaatttgtttggtcgaaggat

SEQ ID NO: 11506 - DNA, 21 bp, Artificial sequence
  SiRNA target sequence
aatttgtttggtcgaaggatg

SEQ ID NO: 11507 - DNA, 21 bp, Artificial sequence
  SiRNA target sequence
atttgtttggtcgaaggatga

SEQ ID NO: 11508 - DNA, 21 bp, Artificial sequence
  SiRNA target sequence
tttgtttggtcgaaggatgat

SEQ ID NO: 11509 - DNA, 21 bp, Artificial sequence
  SiRNA target sequence
ttgtttggtcgaaggatgatc

SEQ ID NO: 11510 - DNA, 21 bp, Artificial sequence
  SiRNA target sequence
tgtttggtcgaaggatgatcc

SEQ ID NO: 11511 - DNA, 21 bp, Artificial sequence
  SiRNA target sequence
gtttggtcgaaggatgatcca

SEQ ID NO: 11512 - DNA, 21 bp, Artificial sequence
  SiRNA target sequence
tttggtcgaaggatgatccat

SEQ ID NO: 11513 - DNA, 21 bp, Artificial sequence
  SiRNA target sequence
ttggtcgaaggatgatccatt

SEQ ID NO: 11514 - DNA, 21 bp, Artificial sequence
  SiRNA target sequence
tggtcgaaggatgatccattt

SEQ ID NO: 11515 - DNA, 21 bp, Artificial sequence
  SiRNA target sequence
ggtcgaaggatgatccatttg

SEQ ID NO: 11516 - DNA, 21 bp, Artificial sequence
  SiRNA target sequence
gtcgaaggatgatccatttga

SEQ ID NO: 11517 - DNA, 21 bp, Artificial sequence
  SiRNA target sequence
tcgaaggatgatccatttgat

SEQ ID NO: 11518 - DNA, 21 bp, Artificial sequence
  SiRNA target sequence
cgaaggatgatccatttgata

SEQ ID NO: 11519 - DNA, 21 bp, Artificial sequence
  SiRNA target sequence
gaaggatgatccatttgataa

SEQ ID NO: 11520 - DNA, 21 bp, Artificial sequence
  SiRNA target sequence
aaggatgatccatttgataag

SEQ ID NO: 11521 - DNA, 21 bp, Artificial sequence
  SiRNA target sequence
aggatgatccatttgataagg

SEQ ID NO: 11522 - DNA, 21 bp, Artificial sequence
  SiRNA target sequence
ggatgatccatttgataagga

SEQ ID NO: 11523 - DNA, 21 bp, Artificial sequence
  SiRNA target sequence
gatgatccatttgataaggag

SEQ ID NO: 11524 - DNA, 21 bp, Artificial sequence
  SiRNA target sequence
atgatccatttgataaggagt

SEQ ID NO: 11525 - DNA, 21 bp, Artificial sequence
  SiRNA target sequence
tgatccatttgataaggagtt

SEQ ID NO: 11526 - DNA, 21 bp, Artificial sequence
  SiRNA target sequence
gatccatttgataaggagtta

SEQ ID NO: 11527 - DNA, 21 bp, Artificial sequence
  SiRNA target sequence
atccatttgataaggagttag

SEQ ID NO: 11528 - DNA, 21 bp, Artificial sequence
  SiRNA target sequence
tccatttgataaggagttagc

SEQ ID NO: 11529 - DNA, 21 bp, Artificial sequence
  SiRNA target sequence
ccatttgataaggagttagca

SEQ ID NO: 11530 - DNA, 21 bp, Artificial sequence
  SiRNA target sequence
catttgataaggagttagcac

SEQ ID NO: 11531 - DNA, 21 bp, Artificial sequence
  SiRNA target sequence
atttgataaggagttagcacg

SEQ ID NO: 11532 - DNA, 21 bp, Artificial sequence
  SiRNA target sequence
tttgataaggagttagcacgt

SEQ ID NO: 11533 - DNA, 21 bp, Artificial sequence
  SiRNA target sequence
ttgataaggagttagcacgtt

SEQ ID NO: 11534 - DNA, 21 bp, Artificial sequence
  SiRNA target sequence
tgataaggagttagcacgttt

SEQ ID NO: 11535 - DNA, 21 bp, Artificial sequence
  SiRNA target sequence
gataaggagttagcacgttta

SEQ ID NO: 11536 - DNA, 21 bp, Artificial sequence
  SiRNA target sequence
ataaggagttagcacgtttaa

SEQ ID NO: 11537 - DNA, 21 bp, Artificial sequence
  SiRNA target sequence
taaggagttagcacgtttaat

SEQ ID NO: 11538 - DNA, 21 bp, Artificial sequence
  SiRNA target sequence
aaggagttagcacgtttaatt

SEQ ID NO: 11539 - DNA, 21 bp, Artificial sequence
  SiRNA target sequence
aggagttagcacgtttaattt

SEQ ID NO: 11540 - DNA, 21 bp, Artificial sequence
  SiRNA target sequence
ggagttagcacgtttaatttt

SEQ ID NO: 11541 - DNA, 21 bp, Artificial sequence
  SiRNA target sequence
gagttagcacgtttaattttg

SEQ ID NO: 11542 - DNA, 21 bp, Artificial sequence
  SiRNA target sequence
agttagcacgtttaattttgc

SEQ ID NO: 11543 - DNA, 21 bp, Artificial sequence
  SiRNA target sequence
gttagcacgtttaattttgcc

SEQ ID NO: 11544 - DNA, 21 bp, Artificial sequence
  SiRNA target sequence
ttagcacgtttaattttgcct

SEQ ID NO: 11545 - DNA, 21 bp, Artificial sequence
  SiRNA target sequence
tagcacgtttaattttgcctc

SEQ ID NO: 11546 - DNA, 21 bp, Artificial sequence
  SiRNA target sequence
agcacgtttaattttgcctcg

SEQ ID NO: 11547 - DNA, 21 bp, Artificial sequence
  SiRNA target sequence
gcacgtttaattttgcctcgt

SEQ ID NO: 11548 - DNA, 21 bp, Artificial sequence
  SiRNA target sequence
cacgtttaattttgcctcgtg

SEQ ID NO: 11549 - DNA, 21 bp, Artificial sequence
  SiRNA target sequence
acgtttaattttgcctcgtgc

SEQ ID NO: 11550 - DNA, 21 bp, Artificial sequence
  SiRNA target sequence
cgtttaattttgcctcgtgct

SEQ ID NO: 11551 - DNA, 21 bp, Artificial sequence
  SiRNA target sequence
gtttaattttgcctcgtgctt

SEQ ID NO: 11552 - DNA, 21 bp, Artificial sequence
  SiRNA target sequence
tttaattttgcctcgtgcttt

SEQ ID NO: 11553 - DNA, 21 bp, Artificial sequence
  SiRNA target sequence
ttaattttgcctcgtgctttg

SEQ ID NO: 11554 - DNA, 21 bp, Artificial sequence
  SiRNA target sequence
taattttgcctcgtgctttgt

SEQ ID NO: 11555 - DNA, 21 bp, Artificial sequence
  SiRNA target sequence
aattttgcctcgtgctttgtt

SEQ ID NO: 11556 - DNA, 21 bp, Artificial sequence
  SiRNA target sequence
attttgcctcgtgctttgtta

SEQ ID NO: 11557 - DNA, 21 bp, Artificial sequence
  SiRNA target sequence
ttttgcctcgtgctttgttat

SEQ ID NO: 11558 - DNA, 21 bp, Artificial sequence
  SiRNA target sequence
tttgcctcgtgctttgttatc

SEQ ID NO: 11559 - DNA, 21 bp, Artificial sequence
  SiRNA target sequence
ttgcctcgtgctttgttatct

SEQ ID NO: 11560 - DNA, 21 bp, Artificial sequence
  SiRNA target sequence
tgcctcgtgctttgttatcta

SEQ ID NO: 11561 - DNA, 21 bp, Artificial sequence
  SiRNA target sequence
gcctcgtgctttgttatctag

SEQ ID NO: 11562 - DNA, 21 bp, Artificial sequence
  SiRNA target sequence
cctcgtgctttgttatctagt

SEQ ID NO: 11563 - DNA, 21 bp, Artificial sequence
  SiRNA target sequence
ctcgtgctttgttatctagta

SEQ ID NO: 11564 - DNA, 21 bp, Artificial sequence
  SiRNA target sequence
tcgtgctttgttatctagtat

SEQ ID NO: 11565 - DNA, 21 bp, Artificial sequence
  SiRNA target sequence
cgtgctttgttatctagtata

SEQ ID NO: 11566 - DNA, 21 bp, Artificial sequence
  SiRNA target sequence
gtgctttgttatctagtatag

SEQ ID NO: 11567 - DNA, 21 bp, Artificial sequence
  SiRNA target sequence
tgctttgttatctagtataga

SEQ ID NO: 11568 - DNA, 21 bp, Artificial sequence
  SiRNA target sequence
gctttgttatctagtatagag

SEQ ID NO: 11569 - DNA, 21 bp, Artificial sequence
  SiRNA target sequence
ctttgttatctagtatagagg

SEQ ID NO: 11570 - DNA, 21 bp, Artificial sequence
  SiRNA target sequence
tttgttatctagtatagaggc

SEQ ID NO: 11571 - DNA, 21 bp, Artificial sequence
  SiRNA target sequence
ttgttatctagtatagaggct

SEQ ID NO: 11572 - DNA, 21 bp, Artificial sequence
  SiRNA target sequence
tgttatctagtatagaggcta

SEQ ID NO: 11573 - DNA, 21 bp, Artificial sequence
  SiRNA target sequence
gttatctagtatagaggctaa

SEQ ID NO: 11574 - DNA, 21 bp, Artificial sequence
  SiRNA target sequence
ttatctagtatagaggctaat

SEQ ID NO: 11575 - DNA, 21 bp, Artificial sequence
  SiRNA target sequence
tatctagtatagaggctaatt

SEQ ID NO: 11576 - DNA, 21 bp, Artificial sequence
  SiRNA target sequence
atctagtatagaggctaattc

SEQ ID NO: 11577 - DNA, 21 bp, Artificial sequence
  SiRNA target sequence
tctagtatagaggctaattct

SEQ ID NO: 11578 - DNA, 21 bp, Artificial sequence
  SiRNA target sequence
ctagtatagaggctaattctg

SEQ ID NO: 11579 - DNA, 21 bp, Artificial sequence
  SiRNA target sequence
tagtatagaggctaattctga

SEQ ID NO: 11580 - DNA, 21 bp, Artificial sequence
  SiRNA target sequence
agtatagaggctaattctgat

SEQ ID NO: 11581 - DNA, 21 bp, Artificial sequence
  SiRNA target sequence
gtatagaggctaattctgatg

SEQ ID NO: 11582 - DNA, 21 bp, Artificial sequence
  SiRNA target sequence
tatagaggctaattctgatgc

SEQ ID NO: 11583 - DNA, 21 bp, Artificial sequence
  SiRNA target sequence
atagaggctaattctgatgct

SEQ ID NO: 11584 - DNA, 21 bp, Artificial sequence
  SiRNA target sequence
tagaggctaattctgatgcta

SEQ ID NO: 11585 - DNA, 21 bp, Artificial sequence
  SiRNA target sequence
agaggctaattctgatgctat

SEQ ID NO: 11586 - DNA, 21 bp, Artificial sequence
  SiRNA target sequence
gaggctaattctgatgctata

SEQ ID NO: 11587 - DNA, 21 bp, Artificial sequence
  SiRNA target sequence
aggctaattctgatgctatat

SEQ ID NO: 11588 - DNA, 21 bp, Artificial sequence
  SiRNA target sequence
ggctaattctgatgctatatg

SEQ ID NO: 11589 - DNA, 21 bp, Artificial sequence
  SiRNA target sequence
gctaattctgatgctatatgt

SEQ ID NO: 11590 - DNA, 21 bp, Artificial sequence
  SiRNA target sequence
ctaattctgatgctatatgtg

SEQ ID NO: 11591 - DNA, 21 bp, Artificial sequence
  SiRNA target sequence
taattctgatgctatatgtga

SEQ ID NO: 11592 - DNA, 21 bp, Artificial sequence
  SiRNA target sequence
aattctgatgctatatgtgat

SEQ ID NO: 11593 - DNA, 21 bp, Artificial sequence
  SiRNA target sequence
attctgatgctatatgtgatg

SEQ ID NO: 11594 - DNA, 21 bp, Artificial sequence
  SiRNA target sequence
ttctgatgctatatgtgatgt

SEQ ID NO: 11595 - DNA, 21 bp, Artificial sequence
  SiRNA target sequence
tctgatgctatatgtgatgtg

SEQ ID NO: 11596 - DNA, 21 bp, Artificial sequence
  SiRNA target sequence
ctgatgctatatgtgatgtgc

SEQ ID NO: 11597 - DNA, 21 bp, Artificial sequence
  SiRNA target sequence
tgatgctatatgtgatgtgcc

SEQ ID NO: 11598 - DNA, 21 bp, Artificial sequence
  SiRNA target sequence
gatgctatatgtgatgtgcct

SEQ ID NO: 11599 - DNA, 21 bp, Artificial sequence
  SiRNA target sequence
atgctatatgtgatgtgccta

SEQ ID NO: 11600 - DNA, 21 bp, Artificial sequence
  SiRNA target sequence
tgctatatgtgatgtgcctaa

SEQ ID NO: 11601 - DNA, 21 bp, Artificial sequence
  SiRNA target sequence
gctatatgtgatgtgcctaat

SEQ ID NO: 11602 - DNA, 21 bp, Artificial sequence
  SiRNA target sequence
ctatatgtgatgtgcctaata

SEQ ID NO: 11603 - DNA, 21 bp, Artificial sequence
  SiRNA target sequence
tatatgtgatgtgcctaatac

SEQ ID NO: 11604 - DNA, 21 bp, Artificial sequence
  SiRNA target sequence
atatgtgatgtgcctaatact

SEQ ID NO: 11605 - DNA, 21 bp, Artificial sequence
  SiRNA target sequence
tatgtgatgtgcctaatacta

SEQ ID NO: 11606 - DNA, 21 bp, Artificial sequence
  SiRNA target sequence
atgtgatgtgcctaatactat

SEQ ID NO: 11607 - DNA, 21 bp, Artificial sequence
  SiRNA target sequence
tgtgatgtgcctaatactatc

SEQ ID NO: 11608 - DNA, 21 bp, Artificial sequence
  SiRNA target sequence
gtgatgtgcctaatactatcc

SEQ ID NO: 11609 - DNA, 21 bp, Artificial sequence
  SiRNA target sequence
tgatgtgcctaatactatccc

SEQ ID NO: 11610 - DNA, 21 bp, Artificial sequence
  SiRNA target sequence
gatgtgcctaatactatccca

SEQ ID NO: 11611 - DNA, 21 bp, Artificial sequence
  SiRNA target sequence
atgtgcctaatactatcccat

SEQ ID NO: 11612 - DNA, 21 bp, Artificial sequence
  SiRNA target sequence
tgtgcctaatactatcccatt

SEQ ID NO: 11613 - DNA, 21 bp, Artificial sequence
  SiRNA target sequence
gtgcctaatactatcccattt

SEQ ID NO: 11614 - DNA, 21 bp, Artificial sequence
  SiRNA target sequence
tgcctaatactatcccattta

SEQ ID NO: 11615 - DNA, 21 bp, Artificial sequence
  SiRNA target sequence
gcctaatactatcccatttaa

SEQ ID NO: 11616 - DNA, 21 bp, Artificial sequence
  SiRNA target sequence
cctaatactatcccatttaag

SEQ ID NO: 11617 - DNA, 21 bp, Artificial sequence
  SiRNA target sequence
ctaatactatcccatttaagg

SEQ ID NO: 11618 - DNA, 21 bp, Artificial sequence
  SiRNA target sequence
taatactatcccatttaaggt

SEQ ID NO: 11619 - DNA, 21 bp, Artificial sequence
  SiRNA target sequence
aatactatcccatttaaggta

SEQ ID NO: 11620 - DNA, 21 bp, Artificial sequence
  SiRNA target sequence
atactatcccatttaaggtac

SEQ ID NO: 11621 - DNA, 21 bp, Artificial sequence
  SiRNA target sequence
tactatcccatttaaggtaca

SEQ ID NO: 11622 - DNA, 21 bp, Artificial sequence
  SiRNA target sequence
actatcccatttaaggtacac

SEQ ID NO: 11623 - DNA, 21 bp, Artificial sequence
  SiRNA target sequence
ctatcccatttaaggtacacg

SEQ ID NO: 11624 - DNA, 21 bp, Artificial sequence
  SiRNA target sequence
tatcccatttaaggtacacgc

SEQ ID NO: 11625 - DNA, 21 bp, Artificial sequence
  SiRNA target sequence
atcccatttaaggtacacgca

SEQ ID NO: 11626 - DNA, 21 bp, Artificial sequence
  SiRNA target sequence
tcccatttaaggtacacgcat

SEQ ID NO: 11627 - DNA, 21 bp, Artificial sequence
  SiRNA target sequence
cccatttaaggtacacgcata

SEQ ID NO: 11628 - DNA, 21 bp, Artificial sequence
  SiRNA target sequence
ccatttaaggtacacgcatat

SEQ ID NO: 11629 - DNA, 21 bp, Artificial sequence
  SiRNA target sequence
catttaaggtacacgcatatt

SEQ ID NO: 11630 - DNA, 21 bp, Artificial sequence
  SiRNA target sequence
atttaaggtacacgcatattg

SEQ ID NO: 11631 - DNA, 21 bp, Artificial sequence
  SiRNA target sequence
tttaaggtacacgcatattgg

SEQ ID NO: 11632 - DNA, 21 bp, Artificial sequence
  SiRNA target sequence
ttaaggtacacgcatattggc

SEQ ID NO: 11633 - DNA, 21 bp, Artificial sequence
  SiRNA target sequence
taaggtacacgcatattggcg

SEQ ID NO: 11634 - DNA, 21 bp, Artificial sequence
  SiRNA target sequence
aaggtacacgcatattggcga

SEQ ID NO: 11635 - DNA, 21 bp, Artificial sequence
  SiRNA target sequence
aggtacacgcatattggcgag

SEQ ID NO: 11636 - DNA, 21 bp, Artificial sequence
  SiRNA target sequence
ggtacacgcatattggcgagg

SEQ ID NO: 11637 - DNA, 21 bp, Artificial sequence
  SiRNA target sequence
gtacacgcatattggcgaggc

SEQ ID NO: 11638 - DNA, 21 bp, Artificial sequence
  SiRNA target sequence
tacacgcatattggcgaggcg

SEQ ID NO: 11639 - DNA, 21 bp, Artificial sequence
  SiRNA target sequence
acacgcatattggcgaggcga

SEQ ID NO: 11640 - DNA, 21 bp, Artificial sequence
  SiRNA target sequence
cacgcatattggcgaggcgat

SEQ ID NO: 11641 - DNA, 21 bp, Artificial sequence
  SiRNA target sequence
acgcatattggcgaggcgata

SEQ ID NO: 11642 - DNA, 21 bp, Artificial sequence
  SiRNA target sequence
cgcatattggcgaggcgatat

SEQ ID NO: 11643 - DNA, 21 bp, Artificial sequence
  SiRNA target sequence
gcatattggcgaggcgatatg

SEQ ID NO: 11644 - DNA, 21 bp, Artificial sequence
  SiRNA target sequence
catattggcgaggcgatatgg

SEQ ID NO: 11645 - DNA, 21 bp, Artificial sequence
  SiRNA target sequence
atattggcgaggcgatatgga

SEQ ID NO: 11646 - DNA, 21 bp, Artificial sequence
  SiRNA target sequence
tattggcgaggcgatatggaa

SEQ ID NO: 11647 - DNA, 21 bp, Artificial sequence
  SiRNA target sequence
attggcgaggcgatatggaag

SEQ ID NO: 11648 - DNA, 21 bp, Artificial sequence
  SiRNA target sequence
ttggcgaggcgatatggaagt

SEQ ID NO: 11649 - DNA, 21 bp, Artificial sequence
  SiRNA target sequence
tggcgaggcgatatggaagtt

SEQ ID NO: 11650 - DNA, 21 bp, Artificial sequence
  SiRNA target sequence
ggcgaggcgatatggaagtta

SEQ ID NO: 11651 - DNA, 21 bp, Artificial sequence
  SiRNA target sequence
gcgaggcgatatggaagttag

SEQ ID NO: 11652 - DNA, 21 bp, Artificial sequence
  SiRNA target sequence
cgaggcgatatggaagttaga

SEQ ID NO: 11653 - DNA, 21 bp, Artificial sequence
  SiRNA target sequence
gaggcgatatggaagttagag

SEQ ID NO: 11654 - DNA, 21 bp, Artificial sequence
  SiRNA target sequence
aggcgatatggaagttagagt

SEQ ID NO: 11655 - DNA, 21 bp, Artificial sequence
  SiRNA target sequence
ggcgatatggaagttagagtt

SEQ ID NO: 11656 - DNA, 21 bp, Artificial sequence
  SiRNA target sequence
gcgatatggaagttagagttc

SEQ ID NO: 11657 - DNA, 21 bp, Artificial sequence
  SiRNA target sequence
cgatatggaagttagagttca

SEQ ID NO: 11658 - DNA, 21 bp, Artificial sequence
  SiRNA target sequence
gatatggaagttagagttcaa

SEQ ID NO: 11659 - DNA, 21 bp, Artificial sequence
  SiRNA target sequence
atatggaagttagagttcaaa

SEQ ID NO: 11660 - DNA, 21 bp, Artificial sequence
  SiRNA target sequence
tatggaagttagagttcaaat

SEQ ID NO: 11661 - DNA, 21 bp, Artificial sequence
  SiRNA target sequence
atggaagttagagttcaaatt

SEQ ID NO: 11662 - DNA, 21 bp, Artificial sequence
  SiRNA target sequence
tggaagttagagttcaaatta

SEQ ID NO: 11663 - DNA, 21 bp, Artificial sequence
  SiRNA target sequence
ggaagttagagttcaaattaa

SEQ ID NO: 11664 - DNA, 21 bp, Artificial sequence
  SiRNA target sequence
gaagttagagttcaaattaat

SEQ ID NO: 11665 - DNA, 21 bp, Artificial sequence
  SiRNA target sequence
aagttagagttcaaattaatt

SEQ ID NO: 11666 - DNA, 21 bp, Artificial sequence
  SiRNA target sequence
agttagagttcaaattaattc

SEQ ID NO: 11667 - DNA, 21 bp, Artificial sequence
  SiRNA target sequence
gttagagttcaaattaattca

SEQ ID NO: 11668 - DNA, 21 bp, Artificial sequence
  SiRNA target sequence
ttagagttcaaattaattcaa

SEQ ID NO: 11669 - DNA, 21 bp, Artificial sequence
  SiRNA target sequence
tagagttcaaattaattcaaa

SEQ ID NO: 11670 - DNA, 21 bp, Artificial sequence
  SiRNA target sequence
agagttcaaattaattcaaat

SEQ ID NO: 11671 - DNA, 21 bp, Artificial sequence
  SiRNA target sequence
gagttcaaattaattcaaata

SEQ ID NO: 11672 - DNA, 21 bp, Artificial sequence
  SiRNA target sequence
agttcaaattaattcaaataa

SEQ ID NO: 11673 - DNA, 21 bp, Artificial sequence
  SiRNA target sequence
gttcaaattaattcaaataaa

SEQ ID NO: 11674 - DNA, 21 bp, Artificial sequence
  SiRNA target sequence
ttcaaattaattcaaataaat

SEQ ID NO: 11675 - DNA, 21 bp, Artificial sequence
  SiRNA target sequence
tcaaattaattcaaataaatt

SEQ ID NO: 11676 - DNA, 21 bp, Artificial sequence
  SiRNA target sequence
caaattaattcaaataaattc

SEQ ID NO: 11677 - DNA, 21 bp, Artificial sequence
  SiRNA target sequence
aaattaattcaaataaattcc

SEQ ID NO: 11678 - DNA, 21 bp, Artificial sequence
  SiRNA target sequence
aattaattcaaataaattcca

SEQ ID NO: 11679 - DNA, 21 bp, Artificial sequence
  SiRNA target sequence
attaattcaaataaattccaa

SEQ ID NO: 11680 - DNA, 21 bp, Artificial sequence
  SiRNA target sequence
ttaattcaaataaattccaag

SEQ ID NO: 11681 - DNA, 21 bp, Artificial sequence
  SiRNA target sequence
taattcaaataaattccaagt

SEQ ID NO: 11682 - DNA, 21 bp, Artificial sequence
  SiRNA target sequence
aattcaaataaattccaagtt

SEQ ID NO: 11683 - DNA, 21 bp, Artificial sequence
  SiRNA target sequence
attcaaataaattccaagttg

SEQ ID NO: 11684 - DNA, 21 bp, Artificial sequence
  SiRNA target sequence
ttcaaataaattccaagttgg

SEQ ID NO: 11685 - DNA, 21 bp, Artificial sequence
  SiRNA target sequence
tcaaataaattccaagttggt

SEQ ID NO: 11686 - DNA, 21 bp, Artificial sequence
  SiRNA target sequence
caaataaattccaagttggtc

SEQ ID NO: 11687 - DNA, 21 bp, Artificial sequence
  SiRNA target sequence
aaataaattccaagttggtca

SEQ ID NO: 11688 - DNA, 21 bp, Artificial sequence
  SiRNA target sequence
aataaattccaagttggtcaa

SEQ ID NO: 11689 - DNA, 21 bp, Artificial sequence
  SiRNA target sequence
ataaattccaagttggtcaat

SEQ ID NO: 11690 - DNA, 21 bp, Artificial sequence
  SiRNA target sequence
taaattccaagttggtcaatt

SEQ ID NO: 11691 - DNA, 21 bp, Artificial sequence
  SiRNA target sequence
aaattccaagttggtcaatta

SEQ ID NO: 11692 - DNA, 21 bp, Artificial sequence
  SiRNA target sequence
aattccaagttggtcaattac

SEQ ID NO: 11693 - DNA, 21 bp, Artificial sequence
  SiRNA target sequence
attccaagttggtcaattaca

SEQ ID NO: 11694 - DNA, 21 bp, Artificial sequence
  SiRNA target sequence
ttccaagttggtcaattacaa

SEQ ID NO: 11695 - DNA, 21 bp, Artificial sequence
  SiRNA target sequence
tccaagttggtcaattacaag

SEQ ID NO: 11696 - DNA, 21 bp, Artificial sequence
  SiRNA target sequence
ccaagttggtcaattacaagc

SEQ ID NO: 11697 - DNA, 21 bp, Artificial sequence
  SiRNA target sequence
caagttggtcaattacaagct

SEQ ID NO: 11698 - DNA, 21 bp, Artificial sequence
  SiRNA target sequence
aagttggtcaattacaagcta

SEQ ID NO: 11699 - DNA, 21 bp, Artificial sequence
  SiRNA target sequence
agttggtcaattacaagctac

SEQ ID NO: 11700 - DNA, 21 bp, Artificial sequence
  SiRNA target sequence
gttggtcaattacaagctact

SEQ ID NO: 11701 - DNA, 21 bp, Artificial sequence
  SiRNA target sequence
ttggtcaattacaagctactt

SEQ ID NO: 11702 - DNA, 21 bp, Artificial sequence
  SiRNA target sequence
tggtcaattacaagctacttg

SEQ ID NO: 11703 - DNA, 21 bp, Artificial sequence
  SiRNA target sequence
ggtcaattacaagctacttgg

SEQ ID NO: 11704 - DNA, 21 bp, Artificial sequence
  SiRNA target sequence
gtcaattacaagctacttggt

SEQ ID NO: 11705 - DNA, 21 bp, Artificial sequence
  SiRNA target sequence
tcaattacaagctacttggta

SEQ ID NO: 11706 - DNA, 21 bp, Artificial sequence
  SiRNA target sequence
caattacaagctacttggtat

SEQ ID NO: 11707 - DNA, 21 bp, Artificial sequence
  SiRNA target sequence
aattacaagctacttggtatt

SEQ ID NO: 11708 - DNA, 21 bp, Artificial sequence
  SiRNA target sequence
attacaagctacttggtatta

SEQ ID NO: 11709 - DNA, 21 bp, Artificial sequence
  SiRNA target sequence
ttacaagctacttggtattat

SEQ ID NO: 11710 - DNA, 21 bp, Artificial sequence
  SiRNA target sequence
tacaagctacttggtattatt

SEQ ID NO: 11711 - DNA, 21 bp, Artificial sequence
  SiRNA target sequence
acaagctacttggtattattc

SEQ ID NO: 11712 - DNA, 21 bp, Artificial sequence
  SiRNA target sequence
caagctacttggtattattcg

SEQ ID NO: 11713 - DNA, 21 bp, Artificial sequence
  SiRNA target sequence
aagctacttggtattattcgg

SEQ ID NO: 11714 - DNA, 21 bp, Artificial sequence
  SiRNA target sequence
agctacttggtattattcgga

SEQ ID NO: 11715 - DNA, 21 bp, Artificial sequence
  SiRNA target sequence
gctacttggtattattcggat

SEQ ID NO: 11716 - DNA, 21 bp, Artificial sequence
  SiRNA target sequence
ctacttggtattattcggatc

SEQ ID NO: 11717 - DNA, 21 bp, Artificial sequence
  SiRNA target sequence
tacttggtattattcggatca

SEQ ID NO: 11718 - DNA, 21 bp, Artificial sequence
  SiRNA target sequence
acttggtattattcggatcat

SEQ ID NO: 11719 - DNA, 21 bp, Artificial sequence
  SiRNA target sequence
cttggtattattcggatcatg

SEQ ID NO: 11720 - DNA, 21 bp, Artificial sequence
  SiRNA target sequence
ttggtattattcggatcatga

SEQ ID NO: 11721 - DNA, 21 bp, Artificial sequence
  SiRNA target sequence
tggtattattcggatcatgag

SEQ ID NO: 11722 - DNA, 21 bp, Artificial sequence
  SiRNA target sequence
ggtattattcggatcatgaga

SEQ ID NO: 11723 - DNA, 21 bp, Artificial sequence
  SiRNA target sequence
gtattattcggatcatgagaa

SEQ ID NO: 11724 - DNA, 21 bp, Artificial sequence
  SiRNA target sequence
tattattcggatcatgagaat

SEQ ID NO: 11725 - DNA, 21 bp, Artificial sequence
  SiRNA target sequence
attattcggatcatgagaatt

SEQ ID NO: 11726 - DNA, 21 bp, Artificial sequence
  SiRNA target sequence
ttattcggatcatgagaattt

SEQ ID NO: 11727 - DNA, 21 bp, Artificial sequence
  SiRNA target sequence
tattcggatcatgagaatttg

SEQ ID NO: 11728 - DNA, 21 bp, Artificial sequence
  SiRNA target sequence
attcggatcatgagaatttga

SEQ ID NO: 11729 - DNA, 21 bp, Artificial sequence
  SiRNA target sequence
ttcggatcatgagaatttgaa

SEQ ID NO: 11730 - DNA, 21 bp, Artificial sequence
  SiRNA target sequence
tcggatcatgagaatttgaat

SEQ ID NO: 11731 - DNA, 21 bp, Artificial sequence
  SiRNA target sequence
cggatcatgagaatttgaata

SEQ ID NO: 11732 - DNA, 21 bp, Artificial sequence
  SiRNA target sequence
ggatcatgagaatttgaatat

SEQ ID NO: 11733 - DNA, 21 bp, Artificial sequence
  SiRNA target sequence
gatcatgagaatttgaatata

SEQ ID NO: 11734 - DNA, 21 bp, Artificial sequence
  SiRNA target sequence
atcatgagaatttgaatatat

SEQ ID NO: 11735 - DNA, 21 bp, Artificial sequence
  SiRNA target sequence
tcatgagaatttgaatatatc

SEQ ID NO: 11736 - DNA, 21 bp, Artificial sequence
  SiRNA target sequence
catgagaatttgaatatatcg

SEQ ID NO: 11737 - DNA, 21 bp, Artificial sequence
  SiRNA target sequence
atgagaatttgaatatatcgt

SEQ ID NO: 11738 - DNA, 21 bp, Artificial sequence
  SiRNA target sequence
tgagaatttgaatatatcgtc

SEQ ID NO: 11739 - DNA, 21 bp, Artificial sequence
  SiRNA target sequence
gagaatttgaatatatcgtct

SEQ ID NO: 11740 - DNA, 21 bp, Artificial sequence
  SiRNA target sequence
agaatttgaatatatcgtcta

SEQ ID NO: 11741 - DNA, 21 bp, Artificial sequence
  SiRNA target sequence
gaatttgaatatatcgtctaa

SEQ ID NO: 11742 - DNA, 21 bp, Artificial sequence
  SiRNA target sequence
aatttgaatatatcgtctaag

SEQ ID NO: 11743 - DNA, 21 bp, Artificial sequence
  SiRNA target sequence
atttgaatatatcgtctaaga

SEQ ID NO: 11744 - DNA, 21 bp, Artificial sequence
  SiRNA target sequence
tttgaatatatcgtctaagag

SEQ ID NO: 11745 - DNA, 21 bp, Artificial sequence
  SiRNA target sequence
ttgaatatatcgtctaagaga

SEQ ID NO: 11746 - DNA, 21 bp, Artificial sequence
  SiRNA target sequence
tgaatatatcgtctaagagaa

SEQ ID NO: 11747 - DNA, 21 bp, Artificial sequence
  SiRNA target sequence
gaatatatcgtctaagagaag

SEQ ID NO: 11748 - DNA, 21 bp, Artificial sequence
  SiRNA target sequence
aatatatcgtctaagagaagc

SEQ ID NO: 11749 - DNA, 21 bp, Artificial sequence
  SiRNA target sequence
atatatcgtctaagagaagcg

SEQ ID NO: 11750 - DNA, 21 bp, Artificial sequence
  SiRNA target sequence
tatatcgtctaagagaagcgt

SEQ ID NO: 11751 - DNA, 21 bp, Artificial sequence
  SiRNA target sequence
atatcgtctaagagaagcgtt

SEQ ID NO: 11752 - DNA, 21 bp, Artificial sequence
  SiRNA target sequence
tatcgtctaagagaagcgttt

SEQ ID NO: 11753 - DNA, 21 bp, Artificial sequence
  SiRNA target sequence
atcgtctaagagaagcgttta

SEQ ID NO: 11754 - DNA, 21 bp, Artificial sequence
  SiRNA target sequence
tcgtctaagagaagcgtttat

SEQ ID NO: 11755 - DNA, 21 bp, Artificial sequence
  SiRNA target sequence
cgtctaagagaagcgtttatg

SEQ ID NO: 11756 - DNA, 21 bp, Artificial sequence
  SiRNA target sequence
gtctaagagaagcgtttatgg

SEQ ID NO: 11757 - DNA, 21 bp, Artificial sequence
  SiRNA target sequence
tctaagagaagcgtttatgga

SEQ ID NO: 11758 - DNA, 21 bp, Artificial sequence
  SiRNA target sequence
ctaagagaagcgtttatggat

SEQ ID NO: 11759 - DNA, 21 bp, Artificial sequence
  SiRNA target sequence
taagagaagcgtttatggatt

SEQ ID NO: 11760 - DNA, 21 bp, Artificial sequence
  SiRNA target sequence
aagagaagcgtttatggattt

SEQ ID NO: 11761 - DNA, 21 bp, Artificial sequence
  SiRNA target sequence
agagaagcgtttatggatttt

SEQ ID NO: 11762 - DNA, 21 bp, Artificial sequence
  SiRNA target sequence
gagaagcgtttatggattttc

SEQ ID NO: 11763 - DNA, 21 bp, Artificial sequence
  SiRNA target sequence
agaagcgtttatggattttca

SEQ ID NO: 11764 - DNA, 21 bp, Artificial sequence
  SiRNA target sequence
gaagcgtttatggattttcac

SEQ ID NO: 11765 - DNA, 21 bp, Artificial sequence
  SiRNA target sequence
aagcgtttatggattttcaca

SEQ ID NO: 11766 - DNA, 21 bp, Artificial sequence
  SiRNA target sequence
agcgtttatggattttcacaa

SEQ ID NO: 11767 - DNA, 21 bp, Artificial sequence
  SiRNA target sequence
gcgtttatggattttcacaaa

SEQ ID NO: 11768 - DNA, 21 bp, Artificial sequence
  SiRNA target sequence
cgtttatggattttcacaaat

SEQ ID NO: 11769 - DNA, 21 bp, Artificial sequence
  SiRNA target sequence
gtttatggattttcacaaatg

SEQ ID NO: 11770 - DNA, 21 bp, Artificial sequence
  SiRNA target sequence
tttatggattttcacaaatgg

SEQ ID NO: 11771 - DNA, 21 bp, Artificial sequence
  SiRNA target sequence
ttatggattttcacaaatgga

SEQ ID NO: 11772 - DNA, 21 bp, Artificial sequence
  SiRNA target sequence
tatggattttcacaaatggat

SEQ ID NO: 11773 - DNA, 21 bp, Artificial sequence
  SiRNA target sequence
atggattttcacaaatggatc

SEQ ID NO: 11774 - DNA, 21 bp, Artificial sequence
  SiRNA target sequence
tggattttcacaaatggatca

SEQ ID NO: 11775 - DNA, 21 bp, Artificial sequence
  SiRNA target sequence
ggattttcacaaatggatcat

SEQ ID NO: 11776 - DNA, 21 bp, Artificial sequence
  SiRNA target sequence
gattttcacaaatggatcatg

SEQ ID NO: 11777 - DNA, 21 bp, Artificial sequence
  SiRNA target sequence
attttcacaaatggatcatgc

SEQ ID NO: 11778 - DNA, 21 bp, Artificial sequence
  SiRNA target sequence
ttttcacaaatggatcatgct

SEQ ID NO: 11779 - DNA, 21 bp, Artificial sequence
  SiRNA target sequence
tttcacaaatggatcatgctt

SEQ ID NO: 11780 - DNA, 21 bp, Artificial sequence
  SiRNA target sequence
ttcacaaatggatcatgcttt

SEQ ID NO: 11781 - DNA, 21 bp, Artificial sequence
  SiRNA target sequence
tcacaaatggatcatgctttg

SEQ ID NO: 11782 - DNA, 21 bp, Artificial sequence
  SiRNA target sequence
cacaaatggatcatgctttga

SEQ ID NO: 11783 - DNA, 21 bp, Artificial sequence
  SiRNA target sequence
acaaatggatcatgctttgat

SEQ ID NO: 11784 - DNA, 21 bp, Artificial sequence
  SiRNA target sequence
caaatggatcatgctttgatt

SEQ ID NO: 11785 - DNA, 21 bp, Artificial sequence
  SiRNA target sequence
aaatggatcatgctttgatta

SEQ ID NO: 11786 - DNA, 21 bp, Artificial sequence
  SiRNA target sequence
aatggatcatgctttgattag

SEQ ID NO: 11787 - DNA, 21 bp, Artificial sequence
  SiRNA target sequence
atggatcatgctttgattagt

SEQ ID NO: 11788 - DNA, 21 bp, Artificial sequence
  SiRNA target sequence
tggatcatgctttgattagtg

SEQ ID NO: 11789 - DNA, 21 bp, Artificial sequence
  SiRNA target sequence
ggatcatgctttgattagtgc

SEQ ID NO: 11790 - DNA, 21 bp, Artificial sequence
  SiRNA target sequence
gatcatgctttgattagtgcg

SEQ ID NO: 11791 - DNA, 21 bp, Artificial sequence
  SiRNA target sequence
atcatgctttgattagtgcgt

SEQ ID NO: 11792 - DNA, 21 bp, Artificial sequence
  SiRNA target sequence
tcatgctttgattagtgcgtc

SEQ ID NO: 11793 - DNA, 21 bp, Artificial sequence
  SiRNA target sequence
catgctttgattagtgcgtca

SEQ ID NO: 11794 - DNA, 21 bp, Artificial sequence
  SiRNA target sequence
atgctttgattagtgcgtcag

SEQ ID NO: 11795 - DNA, 21 bp, Artificial sequence
  SiRNA target sequence
tgctttgattagtgcgtcagc

SEQ ID NO: 11796 - DNA, 21 bp, Artificial sequence
  SiRNA target sequence
gctttgattagtgcgtcagca

SEQ ID NO: 11797 - DNA, 21 bp, Artificial sequence
  SiRNA target sequence
ctttgattagtgcgtcagcaa

SEQ ID NO: 11798 - DNA, 21 bp, Artificial sequence
  SiRNA target sequence
tttgattagtgcgtcagcaag

SEQ ID NO: 11799 - DNA, 21 bp, Artificial sequence
  SiRNA target sequence
ttgattagtgcgtcagcaagt

SEQ ID NO: 11800 - DNA, 21 bp, Artificial sequence
  SiRNA target sequence
tgattagtgcgtcagcaagta

SEQ ID NO: 11801 - DNA, 21 bp, Artificial sequence
  SiRNA target sequence
gattagtgcgtcagcaagtaa

SEQ ID NO: 11802 - DNA, 21 bp, Artificial sequence
  SiRNA target sequence
attagtgcgtcagcaagtaat

SEQ ID NO: 11803 - DNA, 21 bp, Artificial sequence
  SiRNA target sequence
ttagtgcgtcagcaagtaatg

SEQ ID NO: 11804 - DNA, 21 bp, Artificial sequence
  SiRNA target sequence
tagtgcgtcagcaagtaatga

SEQ ID NO: 11805 - DNA, 21 bp, Artificial sequence
  SiRNA target sequence
agtgcgtcagcaagtaatgaa

SEQ ID NO: 11806 - DNA, 21 bp, Artificial sequence
  SiRNA target sequence
gtgcgtcagcaagtaatgaag

SEQ ID NO: 11807 - DNA, 21 bp, Artificial sequence
  SiRNA target sequence
tgcgtcagcaagtaatgaagc

SEQ ID NO: 11808 - DNA, 21 bp, Artificial sequence
  SiRNA target sequence
gcgtcagcaagtaatgaagca

SEQ ID NO: 11809 - DNA, 21 bp, Artificial sequence
  SiRNA target sequence
cgtcagcaagtaatgaagcaa

SEQ ID NO: 11810 - DNA, 21 bp, Artificial sequence
  SiRNA target sequence
gtcagcaagtaatgaagcaaa

SEQ ID NO: 11811 - DNA, 21 bp, Artificial sequence
  SiRNA target sequence
tcagcaagtaatgaagcaaaa

SEQ ID NO: 11812 - DNA, 21 bp, Artificial sequence
  SiRNA target sequence
cagcaagtaatgaagcaaaat

SEQ ID NO: 11813 - DNA, 21 bp, Artificial sequence
  SiRNA target sequence
agcaagtaatgaagcaaaatt

SEQ ID NO: 11814 - DNA, 21 bp, Artificial sequence
  SiRNA target sequence
gcaagtaatgaagcaaaatta

SEQ ID NO: 11815 - DNA, 21 bp, Artificial sequence
  SiRNA target sequence
caagtaatgaagcaaaattag

SEQ ID NO: 11816 - DNA, 21 bp, Artificial sequence
  SiRNA target sequence
aagtaatgaagcaaaattagt

SEQ ID NO: 11817 - DNA, 21 bp, Artificial sequence
  SiRNA target sequence
agtaatgaagcaaaattagtt

SEQ ID NO: 11818 - DNA, 21 bp, Artificial sequence
  SiRNA target sequence
gtaatgaagcaaaattagtta

SEQ ID NO: 11819 - DNA, 21 bp, Artificial sequence
  SiRNA target sequence
taatgaagcaaaattagttat

SEQ ID NO: 11820 - DNA, 21 bp, Artificial sequence
  SiRNA target sequence
aatgaagcaaaattagttatt

SEQ ID NO: 11821 - DNA, 21 bp, Artificial sequence
  SiRNA target sequence
atgaagcaaaattagttattc

SEQ ID NO: 11822 - DNA, 21 bp, Artificial sequence
  SiRNA target sequence
tgaagcaaaattagttattcc

SEQ ID NO: 11823 - DNA, 21 bp, Artificial sequence
  SiRNA target sequence
gaagcaaaattagttattcca

SEQ ID NO: 11824 - DNA, 21 bp, Artificial sequence
  SiRNA target sequence
aagcaaaattagttattccat

SEQ ID NO: 11825 - DNA, 21 bp, Artificial sequence
  SiRNA target sequence
agcaaaattagttattccata

SEQ ID NO: 11826 - DNA, 21 bp, Artificial sequence
  SiRNA target sequence
gcaaaattagttattccatat

SEQ ID NO: 11827 - DNA, 21 bp, Artificial sequence
  SiRNA target sequence
caaaattagttattccatata

SEQ ID NO: 11828 - DNA, 21 bp, Artificial sequence
  SiRNA target sequence
aaaattagttattccatataa

SEQ ID NO: 11829 - DNA, 21 bp, Artificial sequence
  SiRNA target sequence
aaattagttattccatataag

SEQ ID NO: 11830 - DNA, 21 bp, Artificial sequence
  SiRNA target sequence
aattagttattccatataagc

SEQ ID NO: 11831 - DNA, 21 bp, Artificial sequence
  SiRNA target sequence
attagttattccatataagca

SEQ ID NO: 11832 - DNA, 21 bp, Artificial sequence
  SiRNA target sequence
ttagttattccatataagcat

SEQ ID NO: 11833 - DNA, 21 bp, Artificial sequence
  SiRNA target sequence
tagttattccatataagcatg

SEQ ID NO: 11834 - DNA, 21 bp, Artificial sequence
  SiRNA target sequence
agttattccatataagcatgt

SEQ ID NO: 11835 - DNA, 21 bp, Artificial sequence
  SiRNA target sequence
gttattccatataagcatgtt

SEQ ID NO: 11836 - DNA, 21 bp, Artificial sequence
  SiRNA target sequence
ttattccatataagcatgttt

SEQ ID NO: 11837 - DNA, 21 bp, Artificial sequence
  SiRNA target sequence
tattccatataagcatgttta

SEQ ID NO: 11838 - DNA, 21 bp, Artificial sequence
  SiRNA target sequence
attccatataagcatgtttat

SEQ ID NO: 11839 - DNA, 21 bp, Artificial sequence
  SiRNA target sequence
ttccatataagcatgtttatc

SEQ ID NO: 11840 - DNA, 21 bp, Artificial sequence
  SiRNA target sequence
tccatataagcatgtttatcc

SEQ ID NO: 11841 - DNA, 21 bp, Artificial sequence
  SiRNA target sequence
ccatataagcatgtttatcca

SEQ ID NO: 11842 - DNA, 21 bp, Artificial sequence
  SiRNA target sequence
catataagcatgtttatccat

SEQ ID NO: 11843 - DNA, 21 bp, Artificial sequence
  SiRNA target sequence
atataagcatgtttatccatt

SEQ ID NO: 11844 - DNA, 21 bp, Artificial sequence
  SiRNA target sequence
tataagcatgtttatccattt

SEQ ID NO: 11845 - DNA, 21 bp, Artificial sequence
  SiRNA target sequence
ataagcatgtttatccatttt

SEQ ID NO: 11846 - DNA, 21 bp, Artificial sequence
  SiRNA target sequence
taagcatgtttatccattttt

SEQ ID NO: 11847 - DNA, 21 bp, Artificial sequence
  SiRNA target sequence
aagcatgtttatccattttta

SEQ ID NO: 11848 - DNA, 21 bp, Artificial sequence
  SiRNA target sequence
agcatgtttatccatttttac

SEQ ID NO: 11849 - DNA, 21 bp, Artificial sequence
  SiRNA target sequence
gcatgtttatccatttttacc

SEQ ID NO: 11850 - DNA, 21 bp, Artificial sequence
  SiRNA target sequence
catgtttatccatttttaccg

SEQ ID NO: 11851 - DNA, 21 bp, Artificial sequence
  SiRNA target sequence
atgtttatccatttttaccga

SEQ ID NO: 11852 - DNA, 21 bp, Artificial sequence
  SiRNA target sequence
tgtttatccatttttaccgac

SEQ ID NO: 11853 - DNA, 21 bp, Artificial sequence
  SiRNA target sequence
gtttatccatttttaccgaca

SEQ ID NO: 11854 - DNA, 21 bp, Artificial sequence
  SiRNA target sequence
tttatccatttttaccgacaa

SEQ ID NO: 11855 - DNA, 21 bp, Artificial sequence
  SiRNA target sequence
ttatccatttttaccgacaag

SEQ ID NO: 11856 - DNA, 21 bp, Artificial sequence
  SiRNA target sequence
tatccatttttaccgacaaga

SEQ ID NO: 11857 - DNA, 21 bp, Artificial sequence
  SiRNA target sequence
atccatttttaccgacaagaa

SEQ ID NO: 11858 - DNA, 21 bp, Artificial sequence
  SiRNA target sequence
tccatttttaccgacaagaat

SEQ ID NO: 11859 - DNA, 21 bp, Artificial sequence
  SiRNA target sequence
ccatttttaccgacaagaatt

SEQ ID NO: 11860 - DNA, 21 bp, Artificial sequence
  SiRNA target sequence
catttttaccgacaagaattg

SEQ ID NO: 11861 - DNA, 21 bp, Artificial sequence
  SiRNA target sequence
atttttaccgacaagaattgt

SEQ ID NO: 11862 - DNA, 21 bp, Artificial sequence
  SiRNA target sequence
tttttaccgacaagaattgtg

SEQ ID NO: 11863 - DNA, 21 bp, Artificial sequence
  SiRNA target sequence
ttttaccgacaagaattgtgc

SEQ ID NO: 11864 - DNA, 21 bp, Artificial sequence
  SiRNA target sequence
tttaccgacaagaattgtgcc

SEQ ID NO: 11865 - DNA, 21 bp, Artificial sequence
  SiRNA target sequence
ttaccgacaagaattgtgcca

SEQ ID NO: 11866 - DNA, 21 bp, Artificial sequence
  SiRNA target sequence
taccgacaagaattgtgccag

SEQ ID NO: 11867 - DNA, 21 bp, Artificial sequence
  SiRNA target sequence
accgacaagaattgtgccaga

SEQ ID NO: 11868 - DNA, 21 bp, Artificial sequence
  SiRNA target sequence
ccgacaagaattgtgccagat

SEQ ID NO: 11869 - DNA, 21 bp, Artificial sequence
  SiRNA target sequence
cgacaagaattgtgccagatt

SEQ ID NO: 11870 - DNA, 21 bp, Artificial sequence
  SiRNA target sequence
gacaagaattgtgccagattg

SEQ ID NO: 11871 - DNA, 21 bp, Artificial sequence
  SiRNA target sequence
acaagaattgtgccagattgg

SEQ ID NO: 11872 - DNA, 21 bp, Artificial sequence
  SiRNA target sequence
caagaattgtgccagattgga

SEQ ID NO: 11873 - DNA, 21 bp, Artificial sequence
  SiRNA target sequence
aagaattgtgccagattggac

SEQ ID NO: 11874 - DNA, 21 bp, Artificial sequence
  SiRNA target sequence
agaattgtgccagattggact

SEQ ID NO: 11875 - DNA, 21 bp, Artificial sequence
  SiRNA target sequence
gaattgtgccagattggacta

SEQ ID NO: 11876 - DNA, 21 bp, Artificial sequence
  SiRNA target sequence
aattgtgccagattggactac

SEQ ID NO: 11877 - DNA, 21 bp, Artificial sequence
  SiRNA target sequence
attgtgccagattggactact

SEQ ID NO: 11878 - DNA, 21 bp, Artificial sequence
  SiRNA target sequence
ttgtgccagattggactactg

SEQ ID NO: 11879 - DNA, 21 bp, Artificial sequence
  SiRNA target sequence
tgtgccagattggactactgg

SEQ ID NO: 11880 - DNA, 21 bp, Artificial sequence
  SiRNA target sequence
gtgccagattggactactggc

SEQ ID NO: 11881 - DNA, 21 bp, Artificial sequence
  SiRNA target sequence
tgccagattggactactggca

SEQ ID NO: 11882 - DNA, 21 bp, Artificial sequence
  SiRNA target sequence
gccagattggactactggcat

SEQ ID NO: 11883 - DNA, 21 bp, Artificial sequence
  SiRNA target sequence
ccagattggactactggcatt

SEQ ID NO: 11884 - DNA, 21 bp, Artificial sequence
  SiRNA target sequence
cagattggactactggcattt

SEQ ID NO: 11885 - DNA, 21 bp, Artificial sequence
  SiRNA target sequence
agattggactactggcatttt

SEQ ID NO: 11886 - DNA, 21 bp, Artificial sequence
  SiRNA target sequence
gattggactactggcatttta

SEQ ID NO: 11887 - DNA, 21 bp, Artificial sequence
  SiRNA target sequence
attggactactggcattttag

SEQ ID NO: 11888 - DNA, 21 bp, Artificial sequence
  SiRNA target sequence
ttggactactggcattttaga

SEQ ID NO: 11889 - DNA, 21 bp, Artificial sequence
  SiRNA target sequence
tggactactggcattttagat

SEQ ID NO: 11890 - DNA, 21 bp, Artificial sequence
  SiRNA target sequence
ggactactggcattttagata

SEQ ID NO: 11891 - DNA, 21 bp, Artificial sequence
  SiRNA target sequence
gactactggcattttagatat

SEQ ID NO: 11892 - DNA, 21 bp, Artificial sequence
  SiRNA target sequence
actactggcattttagatatg

SEQ ID NO: 11893 - DNA, 21 bp, Artificial sequence
  SiRNA target sequence
ctactggcattttagatatgg

SEQ ID NO: 11894 - DNA, 21 bp, Artificial sequence
  SiRNA target sequence
tactggcattttagatatggg

SEQ ID NO: 11895 - DNA, 21 bp, Artificial sequence
  SiRNA target sequence
actggcattttagatatgggt

SEQ ID NO: 11896 - DNA, 21 bp, Artificial sequence
  SiRNA target sequence
ctggcattttagatatgggtg

SEQ ID NO: 11897 - DNA, 21 bp, Artificial sequence
  SiRNA target sequence
tggcattttagatatgggtgc

SEQ ID NO: 11898 - DNA, 21 bp, Artificial sequence
  SiRNA target sequence
ggcattttagatatgggtgct

SEQ ID NO: 11899 - DNA, 21 bp, Artificial sequence
  SiRNA target sequence
gcattttagatatgggtgctt

SEQ ID NO: 11900 - DNA, 21 bp, Artificial sequence
  SiRNA target sequence
cattttagatatgggtgcttt

SEQ ID NO: 11901 - DNA, 21 bp, Artificial sequence
  SiRNA target sequence
attttagatatgggtgctttg

SEQ ID NO: 11902 - DNA, 21 bp, Artificial sequence
  SiRNA target sequence
ttttagatatgggtgctttga

SEQ ID NO: 11903 - DNA, 21 bp, Artificial sequence
  SiRNA target sequence
tttagatatgggtgctttgaa

SEQ ID NO: 11904 - DNA, 21 bp, Artificial sequence
  SiRNA target sequence
ttagatatgggtgctttgaac

SEQ ID NO: 11905 - DNA, 21 bp, Artificial sequence
  SiRNA target sequence
tagatatgggtgctttgaaca

SEQ ID NO: 11906 - DNA, 21 bp, Artificial sequence
  SiRNA target sequence
agatatgggtgctttgaacat

SEQ ID NO: 11907 - DNA, 21 bp, Artificial sequence
  SiRNA target sequence
gatatgggtgctttgaacatt

SEQ ID NO: 11908 - DNA, 21 bp, Artificial sequence
  SiRNA target sequence
atatgggtgctttgaacattc

SEQ ID NO: 11909 - DNA, 21 bp, Artificial sequence
  SiRNA target sequence
tatgggtgctttgaacattcg

SEQ ID NO: 11910 - DNA, 21 bp, Artificial sequence
  SiRNA target sequence
atgggtgctttgaacattcgt

SEQ ID NO: 11911 - DNA, 21 bp, Artificial sequence
  SiRNA target sequence
tgggtgctttgaacattcgtg

SEQ ID NO: 11912 - DNA, 21 bp, Artificial sequence
  SiRNA target sequence
gggtgctttgaacattcgtgt

SEQ ID NO: 11913 - DNA, 21 bp, Artificial sequence
  SiRNA target sequence
ggtgctttgaacattcgtgta

SEQ ID NO: 11914 - DNA, 21 bp, Artificial sequence
  SiRNA target sequence
gtgctttgaacattcgtgtaa

SEQ ID NO: 11915 - DNA, 21 bp, Artificial sequence
  SiRNA target sequence
tgctttgaacattcgtgtaat

SEQ ID NO: 11916 - DNA, 21 bp, Artificial sequence
  SiRNA target sequence
gctttgaacattcgtgtaatt

SEQ ID NO: 11917 - DNA, 21 bp, Artificial sequence
  SiRNA target sequence
ctttgaacattcgtgtaattg

SEQ ID NO: 11918 - DNA, 21 bp, Artificial sequence
  SiRNA target sequence
tttgaacattcgtgtaattgc

SEQ ID NO: 11919 - DNA, 21 bp, Artificial sequence
  SiRNA target sequence
ttgaacattcgtgtaattgct

SEQ ID NO: 11920 - DNA, 21 bp, Artificial sequence
  SiRNA target sequence
tgaacattcgtgtaattgctc

SEQ ID NO: 11921 - DNA, 21 bp, Artificial sequence
  SiRNA target sequence
gaacattcgtgtaattgctcc

SEQ ID NO: 11922 - DNA, 21 bp, Artificial sequence
  SiRNA target sequence
aacattcgtgtaattgctccc

SEQ ID NO: 11923 - DNA, 21 bp, Artificial sequence
  SiRNA target sequence
acattcgtgtaattgctccct

SEQ ID NO: 11924 - DNA, 21 bp, Artificial sequence
  SiRNA target sequence
cattcgtgtaattgctccctt

SEQ ID NO: 11925 - DNA, 21 bp, Artificial sequence
  SiRNA target sequence
attcgtgtaattgctccctta

SEQ ID NO: 11926 - DNA, 21 bp, Artificial sequence
  SiRNA target sequence
ttcgtgtaattgctcccttac

SEQ ID NO: 11927 - DNA, 21 bp, Artificial sequence
  SiRNA target sequence
tcgtgtaattgctcccttacg

SEQ ID NO: 11928 - DNA, 21 bp, Artificial sequence
  SiRNA target sequence
cgtgtaattgctcccttacgg

SEQ ID NO: 11929 - DNA, 21 bp, Artificial sequence
  SiRNA target sequence
gtgtaattgctcccttacgga

SEQ ID NO: 11930 - DNA, 21 bp, Artificial sequence
  SiRNA target sequence
tgtaattgctcccttacggat

SEQ ID NO: 11931 - DNA, 21 bp, Artificial sequence
  SiRNA target sequence
gtaattgctcccttacggatg

SEQ ID NO: 11932 - DNA, 21 bp, Artificial sequence
  SiRNA target sequence
taattgctcccttacggatga

SEQ ID NO: 11933 - DNA, 21 bp, Artificial sequence
  SiRNA target sequence
aattgctcccttacggatgag

SEQ ID NO: 11934 - DNA, 21 bp, Artificial sequence
  SiRNA target sequence
attgctcccttacggatgagt

SEQ ID NO: 11935 - DNA, 21 bp, Artificial sequence
  SiRNA target sequence
ttgctcccttacggatgagtg

SEQ ID NO: 11936 - DNA, 21 bp, Artificial sequence
  SiRNA target sequence
tgctcccttacggatgagtgc

SEQ ID NO: 11937 - DNA, 21 bp, Artificial sequence
  SiRNA target sequence
gctcccttacggatgagtgct

SEQ ID NO: 11938 - DNA, 21 bp, Artificial sequence
  SiRNA target sequence
ctcccttacggatgagtgcta

SEQ ID NO: 11939 - DNA, 21 bp, Artificial sequence
  SiRNA target sequence
tcccttacggatgagtgctac

SEQ ID NO: 11940 - DNA, 21 bp, Artificial sequence
  SiRNA target sequence
cccttacggatgagtgctact

SEQ ID NO: 11941 - DNA, 21 bp, Artificial sequence
  SiRNA target sequence
ccttacggatgagtgctactg

SEQ ID NO: 11942 - DNA, 21 bp, Artificial sequence
  SiRNA target sequence
cttacggatgagtgctactgg

SEQ ID NO: 11943 - DNA, 21 bp, Artificial sequence
  SiRNA target sequence
ttacggatgagtgctactggt

SEQ ID NO: 11944 - DNA, 21 bp, Artificial sequence
  SiRNA target sequence
tacggatgagtgctactggtc

SEQ ID NO: 11945 - DNA, 21 bp, Artificial sequence
  SiRNA target sequence
acggatgagtgctactggtcc

SEQ ID NO: 11946 - DNA, 21 bp, Artificial sequence
  SiRNA target sequence
cggatgagtgctactggtcca

SEQ ID NO: 11947 - DNA, 21 bp, Artificial sequence
  SiRNA target sequence
ggatgagtgctactggtccaa

SEQ ID NO: 11948 - DNA, 21 bp, Artificial sequence
  SiRNA target sequence
gatgagtgctactggtccaac

SEQ ID NO: 11949 - DNA, 21 bp, Artificial sequence
  SiRNA target sequence
atgagtgctactggtccaact

SEQ ID NO: 11950 - DNA, 21 bp, Artificial sequence
  SiRNA target sequence
tgagtgctactggtccaacta

SEQ ID NO: 11951 - DNA, 21 bp, Artificial sequence
  SiRNA target sequence
gagtgctactggtccaactac

SEQ ID NO: 11952 - DNA, 21 bp, Artificial sequence
  SiRNA target sequence
agtgctactggtccaactacc

SEQ ID NO: 11953 - DNA, 21 bp, Artificial sequence
  SiRNA target sequence
gtgctactggtccaactacct

SEQ ID NO: 11954 - DNA, 21 bp, Artificial sequence
  SiRNA target sequence
tgctactggtccaactacctg

SEQ ID NO: 11955 - DNA, 21 bp, Artificial sequence
  SiRNA target sequence
gctactggtccaactacctgt

SEQ ID NO: 11956 - DNA, 21 bp, Artificial sequence
  SiRNA target sequence
ctactggtccaactacctgta

SEQ ID NO: 11957 - DNA, 21 bp, Artificial sequence
  SiRNA target sequence
tactggtccaactacctgtaa

SEQ ID NO: 11958 - DNA, 21 bp, Artificial sequence
  SiRNA target sequence
actggtccaactacctgtaat

SEQ ID NO: 11959 - DNA, 21 bp, Artificial sequence
  SiRNA target sequence
ctggtccaactacctgtaatg

SEQ ID NO: 11960 - DNA, 21 bp, Artificial sequence
  SiRNA target sequence
tggtccaactacctgtaatgt

SEQ ID NO: 11961 - DNA, 21 bp, Artificial sequence
  SiRNA target sequence
ggtccaactacctgtaatgtc

SEQ ID NO: 11962 - DNA, 21 bp, Artificial sequence
  SiRNA target sequence
gtccaactacctgtaatgtcg

SEQ ID NO: 11963 - DNA, 21 bp, Artificial sequence
  SiRNA target sequence
tccaactacctgtaatgtcgt

SEQ ID NO: 11964 - DNA, 21 bp, Artificial sequence
  SiRNA target sequence
ccaactacctgtaatgtcgtc

SEQ ID NO: 11965 - DNA, 21 bp, Artificial sequence
  SiRNA target sequence
caactacctgtaatgtcgtcg

SEQ ID NO: 11966 - DNA, 21 bp, Artificial sequence
  SiRNA target sequence
aactacctgtaatgtcgtcgt

SEQ ID NO: 11967 - DNA, 21 bp, Artificial sequence
  SiRNA target sequence
actacctgtaatgtcgtcgtg

SEQ ID NO: 11968 - DNA, 21 bp, Artificial sequence
  SiRNA target sequence
ctacctgtaatgtcgtcgtgt

SEQ ID NO: 11969 - DNA, 21 bp, Artificial sequence
  SiRNA target sequence
tacctgtaatgtcgtcgtgtt

SEQ ID NO: 11970 - DNA, 21 bp, Artificial sequence
  SiRNA target sequence
acctgtaatgtcgtcgtgttt

SEQ ID NO: 11971 - DNA, 21 bp, Artificial sequence
  SiRNA target sequence
cctgtaatgtcgtcgtgttta

SEQ ID NO: 11972 - DNA, 21 bp, Artificial sequence
  SiRNA target sequence
ctgtaatgtcgtcgtgtttat

SEQ ID NO: 11973 - DNA, 21 bp, Artificial sequence
  SiRNA target sequence
tgtaatgtcgtcgtgtttatt

SEQ ID NO: 11974 - DNA, 21 bp, Artificial sequence
  SiRNA target sequence
gtaatgtcgtcgtgtttatta

SEQ ID NO: 11975 - DNA, 21 bp, Artificial sequence
  SiRNA target sequence
taatgtcgtcgtgtttattaa

SEQ ID NO: 11976 - DNA, 21 bp, Artificial sequence
  SiRNA target sequence
aatgtcgtcgtgtttattaaa

SEQ ID NO: 11977 - DNA, 21 bp, Artificial sequence
  SiRNA target sequence
atgtcgtcgtgtttattaaat

SEQ ID NO: 11978 - DNA, 21 bp, Artificial sequence
  SiRNA target sequence
tgtcgtcgtgtttattaaatt

SEQ ID NO: 11979 - DNA, 21 bp, Artificial sequence
  SiRNA target sequence
gtcgtcgtgtttattaaatta

SEQ ID NO: 11980 - DNA, 21 bp, Artificial sequence
  SiRNA target sequence
tcgtcgtgtttattaaattaa

SEQ ID NO: 11981 - DNA, 21 bp, Artificial sequence
  SiRNA target sequence
cgtcgtgtttattaaattaaa

SEQ ID NO: 11982 - DNA, 21 bp, Artificial sequence
  SiRNA target sequence
gtcgtgtttattaaattaaat

SEQ ID NO: 11983 - DNA, 21 bp, Artificial sequence
  SiRNA target sequence
tcgtgtttattaaattaaata

SEQ ID NO: 11984 - DNA, 21 bp, Artificial sequence
  SiRNA target sequence
cgtgtttattaaattaaataa

SEQ ID NO: 11985 - DNA, 21 bp, Artificial sequence
  SiRNA target sequence
gtgtttattaaattaaataac

SEQ ID NO: 11986 - DNA, 21 bp, Artificial sequence
  SiRNA target sequence
tgtttattaaattaaataaca

SEQ ID NO: 11987 - DNA, 21 bp, Artificial sequence
  SiRNA target sequence
gtttattaaattaaataacag

SEQ ID NO: 11988 - DNA, 21 bp, Artificial sequence
  SiRNA target sequence
tttattaaattaaataacagc

SEQ ID NO: 11989 - DNA, 21 bp, Artificial sequence
  SiRNA target sequence
ttattaaattaaataacagcg

SEQ ID NO: 11990 - DNA, 21 bp, Artificial sequence
  SiRNA target sequence
tattaaattaaataacagcga

SEQ ID NO: 11991 - DNA, 21 bp, Artificial sequence
  SiRNA target sequence
attaaattaaataacagcgag

SEQ ID NO: 11992 - DNA, 21 bp, Artificial sequence
  SiRNA target sequence
ttaaattaaataacagcgagt

SEQ ID NO: 11993 - DNA, 21 bp, Artificial sequence
  SiRNA target sequence
taaattaaataacagcgagtt

SEQ ID NO: 11994 - DNA, 21 bp, Artificial sequence
  SiRNA target sequence
aaattaaataacagcgagttt

SEQ ID NO: 11995 - DNA, 21 bp, Artificial sequence
  SiRNA target sequence
aattaaataacagcgagttta

SEQ ID NO: 11996 - DNA, 21 bp, Artificial sequence
  SiRNA target sequence
attaaataacagcgagtttac

SEQ ID NO: 11997 - DNA, 21 bp, Artificial sequence
  SiRNA target sequence
ttaaataacagcgagtttaca

SEQ ID NO: 11998 - DNA, 21 bp, Artificial sequence
  SiRNA target sequence
taaataacagcgagtttacag

SEQ ID NO: 11999 - DNA, 21 bp, Artificial sequence
  SiRNA target sequence
aaataacagcgagtttacagg

SEQ ID NO: 12000 - DNA, 21 bp, Artificial sequence
  SiRNA target sequence
aataacagcgagtttacaggg

SEQ ID NO: 12001 - DNA, 21 bp, Artificial sequence
  SiRNA target sequence
ataacagcgagtttacaggga

SEQ ID NO: 12002 - DNA, 21 bp, Artificial sequence
  SiRNA target sequence
taacagcgagtttacagggac

SEQ ID NO: 12003 - DNA, 21 bp, Artificial sequence
  SiRNA target sequence
aacagcgagtttacagggact

SEQ ID NO: 12004 - DNA, 21 bp, Artificial sequence
  SiRNA target sequence
acagcgagtttacagggactt

SEQ ID NO: 12005 - DNA, 21 bp, Artificial sequence
  SiRNA target sequence
cagcgagtttacagggacttc

SEQ ID NO: 12006 - DNA, 21 bp, Artificial sequence
  SiRNA target sequence
agcgagtttacagggacttct

SEQ ID NO: 12007 - DNA, 21 bp, Artificial sequence
  SiRNA target sequence
gcgagtttacagggacttctt

SEQ ID NO: 12008 - DNA, 21 bp, Artificial sequence
  SiRNA target sequence
cgagtttacagggacttcttc

SEQ ID NO: 12009 - DNA, 21 bp, Artificial sequence
  SiRNA target sequence
gagtttacagggacttcttct

SEQ ID NO: 12010 - DNA, 21 bp, Artificial sequence
  SiRNA target sequence
agtttacagggacttcttctg

SEQ ID NO: 12011 - DNA, 21 bp, Artificial sequence
  SiRNA target sequence
gtttacagggacttcttctgg

SEQ ID NO: 12012 - DNA, 21 bp, Artificial sequence
  SiRNA target sequence
tttacagggacttcttctggt

SEQ ID NO: 12013 - DNA, 21 bp, Artificial sequence
  SiRNA target sequence
ttacagggacttcttctggta

SEQ ID NO: 12014 - DNA, 21 bp, Artificial sequence
  SiRNA target sequence
tacagggacttcttctggtaa

SEQ ID NO: 12015 - DNA, 21 bp, Artificial sequence
  SiRNA target sequence
acagggacttcttctggtaag

SEQ ID NO: 12016 - DNA, 21 bp, Artificial sequence
  SiRNA target sequence
cagggacttcttctggtaagt

SEQ ID NO: 12017 - DNA, 21 bp, Artificial sequence
  SiRNA target sequence
agggacttcttctggtaagtt

SEQ ID NO: 12018 - DNA, 21 bp, Artificial sequence
  SiRNA target sequence
gggacttcttctggtaagttt

SEQ ID NO: 12019 - DNA, 21 bp, Artificial sequence
  SiRNA target sequence
ggacttcttctggtaagtttt

SEQ ID NO: 12020 - DNA, 21 bp, Artificial sequence
  SiRNA target sequence
gacttcttctggtaagtttta

SEQ ID NO: 12021 - DNA, 21 bp, Artificial sequence
  SiRNA target sequence
acttcttctggtaagttttat

SEQ ID NO: 12022 - DNA, 21 bp, Artificial sequence
  SiRNA target sequence
cttcttctggtaagttttatg

SEQ ID NO: 12023 - DNA, 21 bp, Artificial sequence
  SiRNA target sequence
ttcttctggtaagttttatgc

SEQ ID NO: 12024 - DNA, 21 bp, Artificial sequence
  SiRNA target sequence
tcttctggtaagttttatgcg

SEQ ID NO: 12025 - DNA, 21 bp, Artificial sequence
  SiRNA target sequence
cttctggtaagttttatgcga

SEQ ID NO: 12026 - DNA, 21 bp, Artificial sequence
  SiRNA target sequence
ttctggtaagttttatgcgag

SEQ ID NO: 12027 - DNA, 21 bp, Artificial sequence
  SiRNA target sequence
tctggtaagttttatgcgagc

SEQ ID NO: 12028 - DNA, 21 bp, Artificial sequence
  SiRNA target sequence
ctggtaagttttatgcgagcc

SEQ ID NO: 12029 - DNA, 21 bp, Artificial sequence
  SiRNA target sequence
tggtaagttttatgcgagcca

SEQ ID NO: 12030 - DNA, 21 bp, Artificial sequence
  SiRNA target sequence
ggtaagttttatgcgagccaa

SEQ ID NO: 12031 - DNA, 21 bp, Artificial sequence
  SiRNA target sequence
gtaagttttatgcgagccaaa

SEQ ID NO: 12032 - DNA, 21 bp, Artificial sequence
  SiRNA target sequence
taagttttatgcgagccaaat

SEQ ID NO: 12033 - DNA, 21 bp, Artificial sequence
  SiRNA target sequence
aagttttatgcgagccaaatc

SEQ ID NO: 12034 - DNA, 21 bp, Artificial sequence
  SiRNA target sequence
agttttatgcgagccaaatca

SEQ ID NO: 12035 - DNA, 21 bp, Artificial sequence
  SiRNA target sequence
gttttatgcgagccaaatcag

SEQ ID NO: 12036 - DNA, 21 bp, Artificial sequence
  SiRNA target sequence
ttttatgcgagccaaatcagg

SEQ ID NO: 12037 - DNA, 21 bp, Artificial sequence
  SiRNA target sequence
tttatgcgagccaaatcaggg

SEQ ID NO: 12038 - DNA, 21 bp, Artificial sequence
  SiRNA target sequence
ttatgcgagccaaatcagggc

SEQ ID NO: 12039 - DNA, 21 bp, Artificial sequence
  SiRNA target sequence
tatgcgagccaaatcagggca

SEQ ID NO: 12040 - DNA, 21 bp, Artificial sequence
  SiRNA target sequence
atgcgagccaaatcagggcaa

SEQ ID NO: 12041 - DNA, 21 bp, Artificial sequence
  SiRNA target sequence
tgcgagccaaatcagggcaaa

SEQ ID NO: 12042 - DNA, 21 bp, Artificial sequence
  SiRNA target sequence
gcgagccaaatcagggcaaaa

SEQ ID NO: 12043 - DNA, 21 bp, Artificial sequence
  SiRNA target sequence
cgagccaaatcagggcaaaac

SEQ ID NO: 12044 - DNA, 21 bp, Artificial sequence
  SiRNA target sequence
gagccaaatcagggcaaaacc

SEQ ID NO: 12045 - DNA, 21 bp, Artificial sequence
  SiRNA target sequence
agccaaatcagggcaaaacct

SEQ ID NO: 12046 - DNA, 21 bp, Artificial sequence
  SiRNA target sequence
gccaaatcagggcaaaacctg

SEQ ID NO: 12047 - DNA, 21 bp, Artificial sequence
  SiRNA target sequence
ccaaatcagggcaaaacctga

SEQ ID NO: 12048 - DNA, 21 bp, Artificial sequence
  SiRNA target sequence
caaatcagggcaaaacctgag

SEQ ID NO: 12049 - DNA, 21 bp, Artificial sequence
  SiRNA target sequence
aaatcagggcaaaacctgaga

SEQ ID NO: 12050 - DNA, 21 bp, Artificial sequence
  SiRNA target sequence
aatcagggcaaaacctgagat

SEQ ID NO: 12051 - DNA, 21 bp, Artificial sequence
  SiRNA target sequence
atcagggcaaaacctgagatg

SEQ ID NO: 12052 - DNA, 21 bp, Artificial sequence
  SiRNA target sequence
tcagggcaaaacctgagatgg

SEQ ID NO: 12053 - DNA, 21 bp, Artificial sequence
  SiRNA target sequence
cagggcaaaacctgagatgga

SEQ ID NO: 12054 - DNA, 21 bp, Artificial sequence
  SiRNA target sequence
agggcaaaacctgagatggat

SEQ ID NO: 12055 - DNA, 21 bp, Artificial sequence
  SiRNA target sequence
gggcaaaacctgagatggatc

SEQ ID NO: 12056 - DNA, 21 bp, Artificial sequence
  SiRNA target sequence
ggcaaaacctgagatggatcg

SEQ ID NO: 12057 - DNA, 21 bp, Artificial sequence
  SiRNA target sequence
gcaaaacctgagatggatcgt

SEQ ID NO: 12058 - DNA, 21 bp, Artificial sequence
  SiRNA target sequence
caaaacctgagatggatcgta

SEQ ID NO: 12059 - DNA, 21 bp, Artificial sequence
  SiRNA target sequence
aaaacctgagatggatcgtat

SEQ ID NO: 12060 - DNA, 21 bp, Artificial sequence
  SiRNA target sequence
aaacctgagatggatcgtata

SEQ ID NO: 12061 - DNA, 21 bp, Artificial sequence
  SiRNA target sequence
aacctgagatggatcgtatat

SEQ ID NO: 12062 - DNA, 21 bp, Artificial sequence
  SiRNA target sequence
acctgagatggatcgtatatt

SEQ ID NO: 12063 - DNA, 21 bp, Artificial sequence
  SiRNA target sequence
cctgagatggatcgtatatta

SEQ ID NO: 12064 - DNA, 21 bp, Artificial sequence
  SiRNA target sequence
ctgagatggatcgtatattaa

SEQ ID NO: 12065 - DNA, 21 bp, Artificial sequence
  SiRNA target sequence
tgagatggatcgtatattaaa

SEQ ID NO: 12066 - DNA, 21 bp, Artificial sequence
  SiRNA target sequence
gagatggatcgtatattaaat

SEQ ID NO: 12067 - DNA, 21 bp, Artificial sequence
  SiRNA target sequence
agatggatcgtatattaaatt

SEQ ID NO: 12068 - DNA, 21 bp, Artificial sequence
  SiRNA target sequence
gatggatcgtatattaaattt

SEQ ID NO: 12069 - DNA, 21 bp, Artificial sequence
  SiRNA target sequence
atggatcgtatattaaatttg

SEQ ID NO: 12070 - DNA, 21 bp, Artificial sequence
  SiRNA target sequence
tggatcgtatattaaatttgg

SEQ ID NO: 12071 - DNA, 21 bp, Artificial sequence
  SiRNA target sequence
ggatcgtatattaaatttggc

SEQ ID NO: 12072 - DNA, 21 bp, Artificial sequence
  SiRNA target sequence
gatcgtatattaaatttggca

SEQ ID NO: 12073 - DNA, 21 bp, Artificial sequence
  SiRNA target sequence
atcgtatattaaatttggcag

SEQ ID NO: 12074 - DNA, 21 bp, Artificial sequence
  SiRNA target sequence
tcgtatattaaatttggcaga

SEQ ID NO: 12075 - DNA, 21 bp, Artificial sequence
  SiRNA target sequence
cgtatattaaatttggcagag

SEQ ID NO: 12076 - DNA, 21 bp, Artificial sequence
  SiRNA target sequence
gtatattaaatttggcagagg

SEQ ID NO: 12077 - DNA, 21 bp, Artificial sequence
  SiRNA target sequence
tatattaaatttggcagaggg

SEQ ID NO: 12078 - DNA, 21 bp, Artificial sequence
  SiRNA target sequence
atattaaatttggcagaggga

SEQ ID NO: 12079 - DNA, 21 bp, Artificial sequence
  SiRNA target sequence
tattaaatttggcagagggat

SEQ ID NO: 12080 - DNA, 21 bp, Artificial sequence
  SiRNA target sequence
attaaatttggcagagggatt

SEQ ID NO: 12081 - DNA, 21 bp, Artificial sequence
  SiRNA target sequence
ttaaatttggcagagggattg

SEQ ID NO: 12082 - DNA, 21 bp, Artificial sequence
  SiRNA target sequence
taaatttggcagagggattgt

SEQ ID NO: 12083 - DNA, 21 bp, Artificial sequence
  SiRNA target sequence
aaatttggcagagggattgtt

SEQ ID NO: 12084 - DNA, 21 bp, Artificial sequence
  SiRNA target sequence
aatttggcagagggattgttg

SEQ ID NO: 12085 - DNA, 21 bp, Artificial sequence
  SiRNA target sequence
atttggcagagggattgttga

SEQ ID NO: 12086 - DNA, 21 bp, Artificial sequence
  SiRNA target sequence
tttggcagagggattgttgaa

SEQ ID NO: 12087 - DNA, 21 bp, Artificial sequence
  SiRNA target sequence
ttggcagagggattgttgaat

SEQ ID NO: 12088 - DNA, 21 bp, Artificial sequence
  SiRNA target sequence
tggcagagggattgttgaata

SEQ ID NO: 12089 - DNA, 21 bp, Artificial sequence
  SiRNA target sequence
ggcagagggattgttgaataa

SEQ ID NO: 12090 - DNA, 21 bp, Artificial sequence
  SiRNA target sequence
gcagagggattgttgaataac

SEQ ID NO: 12091 - DNA, 21 bp, Artificial sequence
  SiRNA target sequence
cagagggattgttgaataaca

SEQ ID NO: 12092 - DNA, 21 bp, Artificial sequence
  SiRNA target sequence
agagggattgttgaataacac

SEQ ID NO: 12093 - DNA, 21 bp, Artificial sequence
  SiRNA target sequence
gagggattgttgaataacacg

SEQ ID NO: 12094 - DNA, 21 bp, Artificial sequence
  SiRNA target sequence
agggattgttgaataacacga

SEQ ID NO: 12095 - DNA, 21 bp, Artificial sequence
  SiRNA target sequence
gggattgttgaataacacgat

SEQ ID NO: 12096 - DNA, 21 bp, Artificial sequence
  SiRNA target sequence
ggattgttgaataacacgatt

SEQ ID NO: 12097 - DNA, 21 bp, Artificial sequence
  SiRNA target sequence
gattgttgaataacacgattg

SEQ ID NO: 12098 - DNA, 21 bp, Artificial sequence
  SiRNA target sequence
attgttgaataacacgattgg

SEQ ID NO: 12099 - DNA, 21 bp, Artificial sequence
  SiRNA target sequence
ttgttgaataacacgattggt

SEQ ID NO: 12100 - DNA, 21 bp, Artificial sequence
  SiRNA target sequence
tgttgaataacacgattggtg

SEQ ID NO: 12101 - DNA, 21 bp, Artificial sequence
  SiRNA target sequence
gttgaataacacgattggtgg

SEQ ID NO: 12102 - DNA, 21 bp, Artificial sequence
  SiRNA target sequence
ttgaataacacgattggtggt

SEQ ID NO: 12103 - DNA, 21 bp, Artificial sequence
  SiRNA target sequence
tgaataacacgattggtggta

SEQ ID NO: 12104 - DNA, 21 bp, Artificial sequence
  SiRNA target sequence
gaataacacgattggtggtaa

SEQ ID NO: 12105 - DNA, 21 bp, Artificial sequence
  SiRNA target sequence
aataacacgattggtggtaat

SEQ ID NO: 12106 - DNA, 21 bp, Artificial sequence
  SiRNA target sequence
ataacacgattggtggtaata

SEQ ID NO: 12107 - DNA, 21 bp, Artificial sequence
  SiRNA target sequence
taacacgattggtggtaataa

SEQ ID NO: 12108 - DNA, 21 bp, Artificial sequence
  SiRNA target sequence
aacacgattggtggtaataat

SEQ ID NO: 12109 - DNA, 21 bp, Artificial sequence
  SiRNA target sequence
acacgattggtggtaataata

SEQ ID NO: 12110 - DNA, 21 bp, Artificial sequence
  SiRNA target sequence
cacgattggtggtaataatat

SEQ ID NO: 12111 - DNA, 21 bp, Artificial sequence
  SiRNA target sequence
acgattggtggtaataatatg

SEQ ID NO: 12112 - DNA, 21 bp, Artificial sequence
  SiRNA target sequence
cgattggtggtaataatatgg

SEQ ID NO: 12113 - DNA, 21 bp, Artificial sequence
  SiRNA target sequence
gattggtggtaataatatgga

SEQ ID NO: 12114 - DNA, 21 bp, Artificial sequence
  SiRNA target sequence
attggtggtaataatatggat

SEQ ID NO: 12115 - DNA, 21 bp, Artificial sequence
  SiRNA target sequence
ttggtggtaataatatggata

SEQ ID NO: 12116 - DNA, 21 bp, Artificial sequence
  SiRNA target sequence
tggtggtaataatatggataa

SEQ ID NO: 12117 - DNA, 21 bp, Artificial sequence
  SiRNA target sequence
ggtggtaataatatggataat

SEQ ID NO: 12118 - DNA, 21 bp, Artificial sequence
  SiRNA target sequence
gtggtaataatatggataatc

SEQ ID NO: 12119 - DNA, 21 bp, Artificial sequence
  SiRNA target sequence
tggtaataatatggataatcc

SEQ ID NO: 12120 - DNA, 21 bp, Artificial sequence
  SiRNA target sequence
ggtaataatatggataatcct

SEQ ID NO: 12121 - DNA, 21 bp, Artificial sequence
  SiRNA target sequence
gtaataatatggataatcctt

SEQ ID NO: 12122 - DNA, 21 bp, Artificial sequence
  SiRNA target sequence
taataatatggataatccttc

SEQ ID NO: 12123 - DNA, 21 bp, Artificial sequence
  SiRNA target sequence
aataatatggataatccttct

SEQ ID NO: 12124 - DNA, 21 bp, Artificial sequence
  SiRNA target sequence
ataatatggataatccttctt

SEQ ID NO: 12125 - DNA, 21 bp, Artificial sequence
  SiRNA target sequence
taatatggataatccttctta

SEQ ID NO: 12126 - DNA, 21 bp, Artificial sequence
  SiRNA target sequence
aatatggataatccttcttat

SEQ ID NO: 12127 - DNA, 21 bp, Artificial sequence
  SiRNA target sequence
atatggataatccttcttatc

SEQ ID NO: 12128 - DNA, 21 bp, Artificial sequence
  SiRNA target sequence
tatggataatccttcttatca

SEQ ID NO: 12129 - DNA, 21 bp, Artificial sequence
  SiRNA target sequence
atggataatccttcttatcaa

SEQ ID NO: 12130 - DNA, 21 bp, Artificial sequence
  SiRNA target sequence
tggataatccttcttatcaac

SEQ ID NO: 12131 - DNA, 21 bp, Artificial sequence
  SiRNA target sequence
ggataatccttcttatcaaca

SEQ ID NO: 12132 - DNA, 21 bp, Artificial sequence
  SiRNA target sequence
gataatccttcttatcaacaa

SEQ ID NO: 12133 - DNA, 21 bp, Artificial sequence
  SiRNA target sequence
ataatccttcttatcaacaat

SEQ ID NO: 12134 - DNA, 21 bp, Artificial sequence
  SiRNA target sequence
taatccttcttatcaacaatc

SEQ ID NO: 12135 - DNA, 21 bp, Artificial sequence
  SiRNA target sequence
aatccttcttatcaacaatct

SEQ ID NO: 12136 - DNA, 21 bp, Artificial sequence
  SiRNA target sequence
atccttcttatcaacaatctc

SEQ ID NO: 12137 - DNA, 21 bp, Artificial sequence
  SiRNA target sequence
tccttcttatcaacaatctcc

SEQ ID NO: 12138 - DNA, 21 bp, Artificial sequence
  SiRNA target sequence
ccttcttatcaacaatctcct

SEQ ID NO: 12139 - DNA, 21 bp, Artificial sequence
  SiRNA target sequence
cttcttatcaacaatctcctc

SEQ ID NO: 12140 - DNA, 21 bp, Artificial sequence
  SiRNA target sequence
ttcttatcaacaatctcctcg

SEQ ID NO: 12141 - DNA, 21 bp, Artificial sequence
  SiRNA target sequence
tcttatcaacaatctcctcgt

SEQ ID NO: 12142 - DNA, 21 bp, Artificial sequence
  SiRNA target sequence
cttatcaacaatctcctcgtc

SEQ ID NO: 12143 - DNA, 21 bp, Artificial sequence
  SiRNA target sequence
ttatcaacaatctcctcgtca

SEQ ID NO: 12144 - DNA, 21 bp, Artificial sequence
  SiRNA target sequence
tatcaacaatctcctcgtcat

SEQ ID NO: 12145 - DNA, 21 bp, Artificial sequence
  SiRNA target sequence
atcaacaatctcctcgtcatt

SEQ ID NO: 12146 - DNA, 21 bp, Artificial sequence
  SiRNA target sequence
tcaacaatctcctcgtcattt

SEQ ID NO: 12147 - DNA, 21 bp, Artificial sequence
  SiRNA target sequence
caacaatctcctcgtcatttt

SEQ ID NO: 12148 - DNA, 21 bp, Artificial sequence
  SiRNA target sequence
aacaatctcctcgtcattttg

SEQ ID NO: 12149 - DNA, 21 bp, Artificial sequence
  SiRNA target sequence
acaatctcctcgtcattttgt

SEQ ID NO: 12150 - DNA, 21 bp, Artificial sequence
  SiRNA target sequence
caatctcctcgtcattttgtc

SEQ ID NO: 12151 - DNA, 21 bp, Artificial sequence
  SiRNA target sequence
aatctcctcgtcattttgtcc

SEQ ID NO: 12152 - DNA, 21 bp, Artificial sequence
  SiRNA target sequence
atctcctcgtcattttgtccc

SEQ ID NO: 12153 - DNA, 21 bp, Artificial sequence
  SiRNA target sequence
tctcctcgtcattttgtcccg

SEQ ID NO: 12154 - DNA, 21 bp, Artificial sequence
  SiRNA target sequence
ctcctcgtcattttgtcccga

SEQ ID NO: 12155 - DNA, 21 bp, Artificial sequence
  SiRNA target sequence
tcctcgtcattttgtcccgac

SEQ ID NO: 12156 - DNA, 21 bp, Artificial sequence
  SiRNA target sequence
cctcgtcattttgtcccgact

SEQ ID NO: 12157 - DNA, 21 bp, Artificial sequence
  SiRNA target sequence
ctcgtcattttgtcccgactg

SEQ ID NO: 12158 - DNA, 21 bp, Artificial sequence
  SiRNA target sequence
tcgtcattttgtcccgactgg

SEQ ID NO: 12159 - DNA, 21 bp, Artificial sequence
  SiRNA target sequence
cgtcattttgtcccgactggt

SEQ ID NO: 12160 - DNA, 21 bp, Artificial sequence
  SiRNA target sequence
gtcattttgtcccgactggta

SEQ ID NO: 12161 - DNA, 21 bp, Artificial sequence
  SiRNA target sequence
tcattttgtcccgactggtat

SEQ ID NO: 12162 - DNA, 21 bp, Artificial sequence
  SiRNA target sequence
cattttgtcccgactggtatg

SEQ ID NO: 12163 - DNA, 21 bp, Artificial sequence
  SiRNA target sequence
attttgtcccgactggtatgc

SEQ ID NO: 12164 - DNA, 21 bp, Artificial sequence
  SiRNA target sequence
ttttgtcccgactggtatgca

SEQ ID NO: 12165 - DNA, 21 bp, Artificial sequence
  SiRNA target sequence
tttgtcccgactggtatgcac

SEQ ID NO: 12166 - DNA, 21 bp, Artificial sequence
  SiRNA target sequence
ttgtcccgactggtatgcaca

SEQ ID NO: 12167 - DNA, 21 bp, Artificial sequence
  SiRNA target sequence
tgtcccgactggtatgcacag

SEQ ID NO: 12168 - DNA, 21 bp, Artificial sequence
  SiRNA target sequence
gtcccgactggtatgcacagc

SEQ ID NO: 12169 - DNA, 21 bp, Artificial sequence
  SiRNA target sequence
tcccgactggtatgcacagct

SEQ ID NO: 12170 - DNA, 21 bp, Artificial sequence
  SiRNA target sequence
cccgactggtatgcacagctt

SEQ ID NO: 12171 - DNA, 21 bp, Artificial sequence
  SiRNA target sequence
ccgactggtatgcacagctta

SEQ ID NO: 12172 - DNA, 21 bp, Artificial sequence
  SiRNA target sequence
cgactggtatgcacagcttag

SEQ ID NO: 12173 - DNA, 21 bp, Artificial sequence
  SiRNA target sequence
gactggtatgcacagcttagc

SEQ ID NO: 12174 - DNA, 21 bp, Artificial sequence
  SiRNA target sequence
actggtatgcacagcttagct

SEQ ID NO: 12175 - DNA, 21 bp, Artificial sequence
  SiRNA target sequence
ctggtatgcacagcttagctt

SEQ ID NO: 12176 - DNA, 21 bp, Artificial sequence
  SiRNA target sequence
tggtatgcacagcttagcttt

SEQ ID NO: 12177 - DNA, 21 bp, Artificial sequence
  SiRNA target sequence
ggtatgcacagcttagcttta

SEQ ID NO: 12178 - DNA, 21 bp, Artificial sequence
  SiRNA target sequence
gtatgcacagcttagctttag

SEQ ID NO: 12179 - DNA, 21 bp, Artificial sequence
  SiRNA target sequence
tatgcacagcttagctttagg

SEQ ID NO: 12180 - DNA, 21 bp, Artificial sequence
  SiRNA target sequence
atgcacagcttagctttaggt

SEQ ID NO: 12181 - DNA, 21 bp, Artificial sequence
  SiRNA target sequence
tgcacagcttagctttaggta

SEQ ID NO: 12182 - DNA, 21 bp, Artificial sequence
  SiRNA target sequence
gcacagcttagctttaggtac

SEQ ID NO: 12183 - DNA, 21 bp, Artificial sequence
  SiRNA target sequence
cacagcttagctttaggtact

SEQ ID NO: 12184 - DNA, 21 bp, Artificial sequence
  SiRNA target sequence
acagcttagctttaggtacta

SEQ ID NO: 12185 - DNA, 21 bp, Artificial sequence
  SiRNA target sequence
cagcttagctttaggtactaa

SEQ ID NO: 12186 - DNA, 21 bp, Artificial sequence
  SiRNA target sequence
agcttagctttaggtactaat

SEQ ID NO: 12187 - DNA, 21 bp, Artificial sequence
  SiRNA target sequence
gcttagctttaggtactaatt

SEQ ID NO: 12188 - DNA, 21 bp, Artificial sequence
  SiRNA target sequence
cttagctttaggtactaattt

SEQ ID NO: 12189 - DNA, 21 bp, Artificial sequence
  SiRNA target sequence
ttagctttaggtactaattta

SEQ ID NO: 12190 - DNA, 21 bp, Artificial sequence
  SiRNA target sequence
tagctttaggtactaatttag

SEQ ID NO: 12191 - DNA, 21 bp, Artificial sequence
  SiRNA target sequence
agctttaggtactaatttagt

SEQ ID NO: 12192 - DNA, 21 bp, Artificial sequence
  SiRNA target sequence
gctttaggtactaatttagtt

SEQ ID NO: 12193 - DNA, 21 bp, Artificial sequence
  SiRNA target sequence
ctttaggtactaatttagttg

SEQ ID NO: 12194 - DNA, 21 bp, Artificial sequence
  SiRNA target sequence
tttaggtactaatttagttga

SEQ ID NO: 12195 - DNA, 21 bp, Artificial sequence
  SiRNA target sequence
ttaggtactaatttagttgaa

SEQ ID NO: 12196 - DNA, 21 bp, Artificial sequence
  SiRNA target sequence
taggtactaatttagttgaac

SEQ ID NO: 12197 - DNA, 21 bp, Artificial sequence
  SiRNA target sequence
aggtactaatttagttgaacc

SEQ ID NO: 12198 - DNA, 21 bp, Artificial sequence
  SiRNA target sequence
ggtactaatttagttgaacca

SEQ ID NO: 12199 - DNA, 21 bp, Artificial sequence
  SiRNA target sequence
gtactaatttagttgaaccat

SEQ ID NO: 12200 - DNA, 21 bp, Artificial sequence
  SiRNA target sequence
tactaatttagttgaaccatt

SEQ ID NO: 12201 - DNA, 21 bp, Artificial sequence
  SiRNA target sequence
actaatttagttgaaccatta

SEQ ID NO: 12202 - DNA, 21 bp, Artificial sequence
  SiRNA target sequence
ctaatttagttgaaccattac

SEQ ID NO: 12203 - DNA, 21 bp, Artificial sequence
  SiRNA target sequence
taatttagttgaaccattaca

SEQ ID NO: 12204 - DNA, 21 bp, Artificial sequence
  SiRNA target sequence
aatttagttgaaccattacat

SEQ ID NO: 12205 - DNA, 21 bp, Artificial sequence
  SiRNA target sequence
atttagttgaaccattacatg

SEQ ID NO: 12206 - DNA, 21 bp, Artificial sequence
  SiRNA target sequence
tttagttgaaccattacatgc

SEQ ID NO: 12207 - DNA, 21 bp, Artificial sequence
  SiRNA target sequence
ttagttgaaccattacatgca

SEQ ID NO: 12208 - DNA, 21 bp, Artificial sequence
  SiRNA target sequence
tagttgaaccattacatgcat

SEQ ID NO: 12209 - DNA, 21 bp, Artificial sequence
  SiRNA target sequence
agttgaaccattacatgcatt

SEQ ID NO: 12210 - DNA, 21 bp, Artificial sequence
  SiRNA target sequence
gttgaaccattacatgcatta

SEQ ID NO: 12211 - DNA, 21 bp, Artificial sequence
  SiRNA target sequence
ttgaaccattacatgcattac

SEQ ID NO: 12212 - DNA, 21 bp, Artificial sequence
  SiRNA target sequence
tgaaccattacatgcattacg

SEQ ID NO: 12213 - DNA, 21 bp, Artificial sequence
  SiRNA target sequence
gaaccattacatgcattacgt

SEQ ID NO: 12214 - DNA, 21 bp, Artificial sequence
  SiRNA target sequence
aaccattacatgcattacgtt

SEQ ID NO: 12215 - DNA, 21 bp, Artificial sequence
  SiRNA target sequence
accattacatgcattacgttt

SEQ ID NO: 12216 - DNA, 21 bp, Artificial sequence
  SiRNA target sequence
  misc_feature (21)..(21): n is a, c, g, or t
ccattacatgcattacgtttn

SEQ ID NO: 12217 - DNA, 21 bp, Artificial sequence
  SiRNA target sequence
  misc_feature (20)..(20): n is a, c, g, or t
cattacatgcattacgtttng

SEQ ID NO: 12218 - DNA, 21 bp, Artificial sequence
  SiRNA target sequence
  misc_feature (19)..(19): n is a, c, g, or t
attacatgcattacgtttnga

SEQ ID NO: 12219 - DNA, 21 bp, Artificial sequence
  SiRNA target sequence
  misc_feature (18)..(18): n is a, c, g, or t
ttacatgcattacgtttngat

SEQ ID NO: 12220 - DNA, 21 bp, Artificial sequence
  SiRNA target sequence
  misc_feature (17)..(17): n is a, c, g, or t
tacatgcattacgtttngatg

SEQ ID NO: 12221 - DNA, 21 bp, Artificial sequence
  SiRNA target sequence
  misc_feature (16)..(16): n is a, c, g, or t
acatgcattacgtttngatgc

SEQ ID NO: 12222 - DNA, 21 bp, Artificial sequence
  SiRNA target sequence
  misc_feature (15)..(15): n is a, c, g, or t
catgcattacgtttngatgca

SEQ ID NO: 12223 - DNA, 21 bp, Artificial sequence
  SiRNA target sequence
  misc_feature (14)..(14): n is a, c, g, or t
atgcattacgtttngatgcag

SEQ ID NO: 12224 - DNA, 21 bp, Artificial sequence
  SiRNA target sequence
  misc_feature (13)..(13): n is a, c, g, or t
tgcattacgtttngatgcagc

SEQ ID NO: 12225 - DNA, 21 bp, Artificial sequence
  SiRNA target sequence
  misc_feature (12)..(12): n is a, c, g, or t
gcattacgtttngatgcagcc

SEQ ID NO: 12226 - DNA, 21 bp, Artificial sequence
  SiRNA target sequence
  misc_feature (11)..(11): n is a, c, g, or t
cattacgtttngatgcagccg

SEQ ID NO: 12227 - DNA, 21 bp, Artificial sequence
  SiRNA target sequence
  misc_feature (10)..(10): n is a, c, g, or t
attacgtttngatgcagccgg

SEQ ID NO: 12228 - DNA, 21 bp, Artificial sequence
  SiRNA target sequence
  misc_feature (9)..(9): n is a, c, g, or t
ttacgtttngatgcagccggt

SEQ ID NO: 12229 - DNA, 21 bp, Artificial sequence
  SiRNA target sequence
  misc_feature (8)..(8): n is a, c, g, or t
tacgtttngatgcagccggta

SEQ ID NO: 12230 - DNA, 21 bp, Artificial sequence
  SiRNA target sequence
  misc_feature (7)..(7): n is a, c, g, or t
acgtttngatgcagccggtac

SEQ ID NO: 12231 - DNA, 21 bp, Artificial sequence
  SiRNA target sequence
  misc_feature (6)..(6): n is a, c, g, or t
cgtttngatgcagccggtacg

SEQ ID NO: 12232 - DNA, 21 bp, Artificial sequence
  SiRNA target sequence
  misc_feature (5)..(5): n is a, c, g, or t
gtttngatgcagccggtacga

SEQ ID NO: 12233 - DNA, 21 bp, Artificial sequence
  SiRNA target sequence
  misc_feature (4)..(4): n is a, c, g, or t
tttngatgcagccggtacgac

SEQ ID NO: 12234 - DNA, 21 bp, Artificial sequence
  SiRNA target sequence
  misc_feature (3)..(3): n is a, c, g, or t
ttngatgcagccggtacgaca

SEQ ID NO: 12235 - DNA, 21 bp, Artificial sequence
  SiRNA target sequence
  misc_feature (2)..(2): n is a, c, g, or t
tngatgcagccggtacgacac

SEQ ID NO: 12236 - DNA, 21 bp, Artificial sequence
  SiRNA target sequence
  misc_feature (1)..(1): n is a, c, g, or t
ngatgcagccggtacgacaca

SEQ ID NO: 12237 - DNA, 21 bp, Artificial sequence
  SiRNA target sequence
gatgcagccggtacgacacaa

SEQ ID NO: 12238 - DNA, 21 bp, Artificial sequence
  SiRNA target sequence
atgcagccggtacgacacaac

SEQ ID NO: 12239 - DNA, 21 bp, Artificial sequence
  SiRNA target sequence
tgcagccggtacgacacaaca

SEQ ID NO: 12240 - DNA, 21 bp, Artificial sequence
  SiRNA target sequence
gcagccggtacgacacaacat

SEQ ID NO: 12241 - DNA, 21 bp, Artificial sequence
  SiRNA target sequence
cagccggtacgacacaacatc

SEQ ID NO: 12242 - DNA, 21 bp, Artificial sequence
  SiRNA target sequence
agccggtacgacacaacatcc

SEQ ID NO: 12243 - DNA, 21 bp, Artificial sequence
  SiRNA target sequence
gccggtacgacacaacatcct

SEQ ID NO: 12244 - DNA, 21 bp, Artificial sequence
  SiRNA target sequence
ccggtacgacacaacatcctg

SEQ ID NO: 12245 - DNA, 21 bp, Artificial sequence
  SiRNA target sequence
cggtacgacacaacatcctgt

SEQ ID NO: 12246 - DNA, 21 bp, Artificial sequence
  SiRNA target sequence
ggtacgacacaacatcctgta

SEQ ID NO: 12247 - DNA, 21 bp, Artificial sequence
  SiRNA target sequence
gtacgacacaacatcctgtag

SEQ ID NO: 12248 - DNA, 21 bp, Artificial sequence
  SiRNA target sequence
tacgacacaacatcctgtagg

SEQ ID NO: 12249 - DNA, 21 bp, Artificial sequence
  SiRNA target sequence
acgacacaacatcctgtaggt

SEQ ID NO: 12250 - DNA, 21 bp, Artificial sequence
  SiRNA target sequence
cgacacaacatcctgtaggtt

SEQ ID NO: 12251 - DNA, 21 bp, Artificial sequence
  SiRNA target sequence
gacacaacatcctgtaggttg

SEQ ID NO: 12252 - DNA, 21 bp, Artificial sequence
  SiRNA target sequence
acacaacatcctgtaggttgt

SEQ ID NO: 12253 - DNA, 21 bp, Artificial sequence
  SiRNA target sequence
cacaacatcctgtaggttgtg

SEQ ID NO: 12254 - DNA, 21 bp, Artificial sequence
  SiRNA target sequence
acaacatcctgtaggttgtgc

SEQ ID NO: 12255 - DNA, 21 bp, Artificial sequence
  SiRNA target sequence
caacatcctgtaggttgtgct

SEQ ID NO: 12256 - DNA, 21 bp, Artificial sequence
  SiRNA target sequence
aacatcctgtaggttgtgctc

SEQ ID NO: 12257 - DNA, 21 bp, Artificial sequence
  SiRNA target sequence
acatcctgtaggttgtgctcc

SEQ ID NO: 12258 - DNA, 21 bp, Artificial sequence
  SiRNA target sequence
catcctgtaggttgtgctcct

SEQ ID NO: 12259 - DNA, 21 bp, Artificial sequence
  SiRNA target sequence
atcctgtaggttgtgctcctg

SEQ ID NO: 12260 - DNA, 21 bp, Artificial sequence
  SiRNA target sequence
tcctgtaggttgtgctcctga

SEQ ID NO: 12261 - DNA, 21 bp, Artificial sequence
  SiRNA target sequence
cctgtaggttgtgctcctgat

SEQ ID NO: 12262 - DNA, 21 bp, Artificial sequence
  SiRNA target sequence
ctgtaggttgtgctcctgatg

SEQ ID NO: 12263 - DNA, 21 bp, Artificial sequence
  SiRNA target sequence
tgtaggttgtgctcctgatga

SEQ ID NO: 12264 - DNA, 21 bp, Artificial sequence
  SiRNA target sequence
gtaggttgtgctcctgatgaa

SEQ ID NO: 12265 - DNA, 21 bp, Artificial sequence
  SiRNA target sequence
taggttgtgctcctgatgaag

SEQ ID NO: 12266 - DNA, 21 bp, Artificial sequence
  SiRNA target sequence
aggttgtgctcctgatgaaga

SEQ ID NO: 12267 - DNA, 21 bp, Artificial sequence
  SiRNA target sequence
ggttgtgctcctgatgaagat

SEQ ID NO: 12268 - DNA, 21 bp, Artificial sequence
  SiRNA target sequence
gttgtgctcctgatgaagata

SEQ ID NO: 12269 - DNA, 21 bp, Artificial sequence
  SiRNA target sequence
ttgtgctcctgatgaagatat

SEQ ID NO: 12270 - DNA, 21 bp, Artificial sequence
  SiRNA target sequence
tgtgctcctgatgaagatatg

SEQ ID NO: 12271 - DNA, 21 bp, Artificial sequence
  SiRNA target sequence
gtgctcctgatgaagatatga

SEQ ID NO: 12272 - DNA, 21 bp, Artificial sequence
  SiRNA target sequence
tgctcctgatgaagatatgac

SEQ ID NO: 12273 - DNA, 21 bp, Artificial sequence
  SiRNA target sequence
gctcctgatgaagatatgact

SEQ ID NO: 12274 - DNA, 21 bp, Artificial sequence
  SiRNA target sequence
ctcctgatgaagatatgactg

SEQ ID NO: 12275 - DNA, 21 bp, Artificial sequence
  SiRNA target sequence
tcctgatgaagatatgactgt

SEQ ID NO: 12276 - DNA, 21 bp, Artificial sequence
  SiRNA target sequence
cctgatgaagatatgactgta

SEQ ID NO: 12277 - DNA, 21 bp, Artificial sequence
  SiRNA target sequence
ctgatgaagatatgactgtat

SEQ ID NO: 12278 - DNA, 21 bp, Artificial sequence
  SiRNA target sequence
tgatgaagatatgactgtatc

SEQ ID NO: 12279 - DNA, 21 bp, Artificial sequence
  SiRNA target sequence
gatgaagatatgactgtatcc

SEQ ID NO: 12280 - DNA, 21 bp, Artificial sequence
  SiRNA target sequence
atgaagatatgactgtatcct

SEQ ID NO: 12281 - DNA, 21 bp, Artificial sequence
  SiRNA target sequence
tgaagatatgactgtatcctc

SEQ ID NO: 12282 - DNA, 21 bp, Artificial sequence
  SiRNA target sequence
gaagatatgactgtatcctcc

SEQ ID NO: 12283 - DNA, 21 bp, Artificial sequence
  SiRNA target sequence
aagatatgactgtatcctcca

SEQ ID NO: 12284 - DNA, 21 bp, Artificial sequence
  SiRNA target sequence
agatatgactgtatcctccat

SEQ ID NO: 12285 - DNA, 21 bp, Artificial sequence
  SiRNA target sequence
gatatgactgtatcctccatt

SEQ ID NO: 12286 - DNA, 21 bp, Artificial sequence
  SiRNA target sequence
atatgactgtatcctccattg

SEQ ID NO: 12287 - DNA, 21 bp, Artificial sequence
  SiRNA target sequence
tatgactgtatcctccattgc

SEQ ID NO: 12288 - DNA, 21 bp, Artificial sequence
  SiRNA target sequence
atgactgtatcctccattgca

SEQ ID NO: 12289 - DNA, 21 bp, Artificial sequence
  SiRNA target sequence
tgactgtatcctccattgcat

SEQ ID NO: 12290 - DNA, 21 bp, Artificial sequence
  SiRNA target sequence
gactgtatcctccattgcatc

SEQ ID NO: 12291 - DNA, 21 bp, Artificial sequence
  SiRNA target sequence
actgtatcctccattgcatct

SEQ ID NO: 12292 - DNA, 21 bp, Artificial sequence
  SiRNA target sequence
ctgtatcctccattgcatctc

SEQ ID NO: 12293 - DNA, 21 bp, Artificial sequence
  SiRNA target sequence
tgtatcctccattgcatctcg

SEQ ID NO: 12294 - DNA, 21 bp, Artificial sequence
  SiRNA target sequence
gtatcctccattgcatctcga

SEQ ID NO: 12295 - DNA, 21 bp, Artificial sequence
  SiRNA target sequence
tatcctccattgcatctcgat

SEQ ID NO: 12296 - DNA, 21 bp, Artificial sequence
  SiRNA target sequence
atcctccattgcatctcgata

SEQ ID NO: 12297 - DNA, 21 bp, Artificial sequence
  SiRNA target sequence
tcctccattgcatctcgatat

SEQ ID NO: 12298 - DNA, 21 bp, Artificial sequence
  SiRNA target sequence
cctccattgcatctcgatatg

SEQ ID NO: 12299 - DNA, 21 bp, Artificial sequence
  SiRNA target sequence
ctccattgcatctcgatatgg

SEQ ID NO: 12300 - DNA, 21 bp, Artificial sequence
  SiRNA target sequence
tccattgcatctcgatatgga

SEQ ID NO: 12301 - DNA, 21 bp, Artificial sequence
  SiRNA target sequence
ccattgcatctcgatatggac

SEQ ID NO: 12302 - DNA, 21 bp, Artificial sequence
  SiRNA target sequence
cattgcatctcgatatggact

SEQ ID NO: 12303 - DNA, 21 bp, Artificial sequence
  SiRNA target sequence
attgcatctcgatatggacta

SEQ ID NO: 12304 - DNA, 21 bp, Artificial sequence
  SiRNA target sequence
ttgcatctcgatatggactaa

SEQ ID NO: 12305 - DNA, 21 bp, Artificial sequence
  SiRNA target sequence
tgcatctcgatatggactaat

SEQ ID NO: 12306 - DNA, 21 bp, Artificial sequence
  SiRNA target sequence
gcatctcgatatggactaatt

SEQ ID NO: 12307 - DNA, 21 bp, Artificial sequence
  SiRNA target sequence
catctcgatatggactaatta

SEQ ID NO: 12308 - DNA, 21 bp, Artificial sequence
  SiRNA target sequence
atctcgatatggactaattag

SEQ ID NO: 12309 - DNA, 21 bp, Artificial sequence
  SiRNA target sequence
tctcgatatggactaattaga

SEQ ID NO: 12310 - DNA, 21 bp, Artificial sequence
  SiRNA target sequence
ctcgatatggactaattagac

SEQ ID NO: 12311 - DNA, 21 bp, Artificial sequence
  SiRNA target sequence
tcgatatggactaattagacg

SEQ ID NO: 12312 - DNA, 21 bp, Artificial sequence
  SiRNA target sequence
cgatatggactaattagacgg

SEQ ID NO: 12313 - DNA, 21 bp, Artificial sequence
  SiRNA target sequence
gatatggactaattagacggg

SEQ ID NO: 12314 - DNA, 21 bp, Artificial sequence
  SiRNA target sequence
atatggactaattagacgggt

SEQ ID NO: 12315 - DNA, 21 bp, Artificial sequence
  SiRNA target sequence
tatggactaattagacgggta

SEQ ID NO: 12316 - DNA, 21 bp, Artificial sequence
  SiRNA target sequence
atggactaattagacgggtac

SEQ ID NO: 12317 - DNA, 21 bp, Artificial sequence
  SiRNA target sequence
tggactaattagacgggtaca

SEQ ID NO: 12318 - DNA, 21 bp, Artificial sequence
  SiRNA target sequence
ggactaattagacgggtacaa

SEQ ID NO: 12319 - DNA, 21 bp, Artificial sequence
  SiRNA target sequence
gactaattagacgggtacaat

SEQ ID NO: 12320 - DNA, 21 bp, Artificial sequence
  SiRNA target sequence
actaattagacgggtacaatg

SEQ ID NO: 12321 - DNA, 21 bp, Artificial sequence
  SiRNA target sequence
ctaattagacgggtacaatgg

SEQ ID NO: 12322 - DNA, 21 bp, Artificial sequence
  SiRNA target sequence
taattagacgggtacaatgga

SEQ ID NO: 12323 - DNA, 21 bp, Artificial sequence
  SiRNA target sequence
aattagacgggtacaatggaa

SEQ ID NO: 12324 - DNA, 21 bp, Artificial sequence
  SiRNA target sequence
attagacgggtacaatggaag

SEQ ID NO: 12325 - DNA, 21 bp, Artificial sequence
  SiRNA target sequence
ttagacgggtacaatggaaga

SEQ ID NO: 12326 - DNA, 21 bp, Artificial sequence
  SiRNA target sequence
tagacgggtacaatggaagaa

SEQ ID NO: 12327 - DNA, 21 bp, Artificial sequence
  SiRNA target sequence
agacgggtacaatggaagaaa

SEQ ID NO: 12328 - DNA, 21 bp, Artificial sequence
  SiRNA target sequence
gacgggtacaatggaagaaag

SEQ ID NO: 12329 - DNA, 21 bp, Artificial sequence
  SiRNA target sequence
acgggtacaatggaagaaaga

SEQ ID NO: 12330 - DNA, 21 bp, Artificial sequence
  SiRNA target sequence
cgggtacaatggaagaaagat

SEQ ID NO: 12331 - DNA, 21 bp, Artificial sequence
  SiRNA target sequence
gggtacaatggaagaaagatc

SEQ ID NO: 12332 - DNA, 21 bp, Artificial sequence
  SiRNA target sequence
ggtacaatggaagaaagatca

SEQ ID NO: 12333 - DNA, 21 bp, Artificial sequence
  SiRNA target sequence
gtacaatggaagaaagatcat

SEQ ID NO: 12334 - DNA, 21 bp, Artificial sequence
  SiRNA target sequence
tacaatggaagaaagatcatg

SEQ ID NO: 12335 - DNA, 21 bp, Artificial sequence
  SiRNA target sequence
acaatggaagaaagatcatgc

SEQ ID NO: 12336 - DNA, 21 bp, Artificial sequence
  SiRNA target sequence
caatggaagaaagatcatgct

SEQ ID NO: 12337 - DNA, 21 bp, Artificial sequence
  SiRNA target sequence
aatggaagaaagatcatgcta

SEQ ID NO: 12338 - DNA, 21 bp, Artificial sequence
  SiRNA target sequence
atggaagaaagatcatgctaa

SEQ ID NO: 12339 - DNA, 21 bp, Artificial sequence
  SiRNA target sequence
tggaagaaagatcatgctaaa

SEQ ID NO: 12340 - DNA, 21 bp, Artificial sequence
  SiRNA target sequence
ggaagaaagatcatgctaaag

SEQ ID NO: 12341 - DNA, 21 bp, Artificial sequence
  SiRNA target sequence
gaagaaagatcatgctaaagg

SEQ ID NO: 12342 - DNA, 21 bp, Artificial sequence
  SiRNA target sequence
aagaaagatcatgctaaagga

SEQ ID NO: 12343 - DNA, 21 bp, Artificial sequence
  SiRNA target sequence
agaaagatcatgctaaaggat

SEQ ID NO: 12344 - DNA, 21 bp, Artificial sequence
  SiRNA target sequence
gaaagatcatgctaaaggatc

SEQ ID NO: 12345 - DNA, 21 bp, Artificial sequence
  SiRNA target sequence
aaagatcatgctaaaggatca

SEQ ID NO: 12346 - DNA, 21 bp, Artificial sequence
  SiRNA target sequence
aagatcatgctaaaggatcac

SEQ ID NO: 12347 - DNA, 21 bp, Artificial sequence
  SiRNA target sequence
agatcatgctaaaggatcact

SEQ ID NO: 12348 - DNA, 21 bp, Artificial sequence
  SiRNA target sequence
gatcatgctaaaggatcactt

SEQ ID NO: 12349 - DNA, 21 bp, Artificial sequence
  SiRNA target sequence
atcatgctaaaggatcacttt

SEQ ID NO: 12350 - DNA, 21 bp, Artificial sequence
  SiRNA target sequence
tcatgctaaaggatcactttt

SEQ ID NO: 12351 - DNA, 21 bp, Artificial sequence
  SiRNA target sequence
catgctaaaggatcacttttg

SEQ ID NO: 12352 - DNA, 21 bp, Artificial sequence
  SiRNA target sequence
atgctaaaggatcacttttgt

SEQ ID NO: 12353 - DNA, 21 bp, Artificial sequence
  SiRNA target sequence
tgctaaaggatcacttttgtt

SEQ ID NO: 12354 - DNA, 21 bp, Artificial sequence
  SiRNA target sequence
gctaaaggatcacttttgtta

SEQ ID NO: 12355 - DNA, 21 bp, Artificial sequence
  SiRNA target sequence
ctaaaggatcacttttgttac

SEQ ID NO: 12356 - DNA, 21 bp, Artificial sequence
  SiRNA target sequence
taaaggatcacttttgttaca

SEQ ID NO: 12357 - DNA, 21 bp, Artificial sequence
  SiRNA target sequence
aaaggatcacttttgttacaa

SEQ ID NO: 12358 - DNA, 21 bp, Artificial sequence
  SiRNA target sequence
aaggatcacttttgttacaat

SEQ ID NO: 12359 - DNA, 21 bp, Artificial sequence
  SiRNA target sequence
aggatcacttttgttacaatt

SEQ ID NO: 12360 - DNA, 21 bp, Artificial sequence
  SiRNA target sequence
ggatcacttttgttacaatta

SEQ ID NO: 12361 - DNA, 21 bp, Artificial sequence
  SiRNA target sequence
gatcacttttgttacaattag

SEQ ID NO: 12362 - DNA, 21 bp, Artificial sequence
  SiRNA target sequence
atcacttttgttacaattaga

SEQ ID NO: 12363 - DNA, 21 bp, Artificial sequence
  SiRNA target sequence
tcacttttgttacaattagat

SEQ ID NO: 12364 - DNA, 21 bp, Artificial sequence
  SiRNA target sequence
cacttttgttacaattagatg

SEQ ID NO: 12365 - DNA, 21 bp, Artificial sequence
  SiRNA target sequence
acttttgttacaattagatgc

SEQ ID NO: 12366 - DNA, 21 bp, Artificial sequence
  SiRNA target sequence
cttttgttacaattagatgct

SEQ ID NO: 12367 - DNA, 21 bp, Artificial sequence
  SiRNA target sequence
ttttgttacaattagatgctg

SEQ ID NO: 12368 - DNA, 21 bp, Artificial sequence
  SiRNA target sequence
tttgttacaattagatgctga

SEQ ID NO: 12369 - DNA, 21 bp, Artificial sequence
  SiRNA target sequence
ttgttacaattagatgctgat

SEQ ID NO: 12370 - DNA, 21 bp, Artificial sequence
  SiRNA target sequence
tgttacaattagatgctgatc

SEQ ID NO: 12371 - DNA, 21 bp, Artificial sequence
  SiRNA target sequence
gttacaattagatgctgatcc

SEQ ID NO: 12372 - DNA, 21 bp, Artificial sequence
  SiRNA target sequence
ttacaattagatgctgatcca

SEQ ID NO: 12373 - DNA, 21 bp, Artificial sequence
  SiRNA target sequence
tacaattagatgctgatccat

SEQ ID NO: 12374 - DNA, 21 bp, Artificial sequence
  SiRNA target sequence
acaattagatgctgatccatt

SEQ ID NO: 12375 - DNA, 21 bp, Artificial sequence
  SiRNA target sequence
caattagatgctgatccattt

SEQ ID NO: 12376 - DNA, 21 bp, Artificial sequence
  SiRNA target sequence
aattagatgctgatccatttg

SEQ ID NO: 12377 - DNA, 21 bp, Artificial sequence
  SiRNA target sequence
attagatgctgatccatttgt

SEQ ID NO: 12378 - DNA, 21 bp, Artificial sequence
  SiRNA target sequence
ttagatgctgatccatttgtg

SEQ ID NO: 12379 - DNA, 21 bp, Artificial sequence
  SiRNA target sequence
tagatgctgatccatttgtgg

SEQ ID NO: 12380 - DNA, 21 bp, Artificial sequence
  SiRNA target sequence
agatgctgatccatttgtgga

SEQ ID NO: 12381 - DNA, 21 bp, Artificial sequence
  SiRNA target sequence
gatgctgatccatttgtggag

SEQ ID NO: 12382 - DNA, 21 bp, Artificial sequence
  SiRNA target sequence
atgctgatccatttgtggagc

SEQ ID NO: 12383 - DNA, 21 bp, Artificial sequence
  SiRNA target sequence
tgctgatccatttgtggagca

SEQ ID NO: 12384 - DNA, 21 bp, Artificial sequence
  SiRNA target sequence
gctgatccatttgtggagcaa

SEQ ID NO: 12385 - DNA, 21 bp, Artificial sequence
  SiRNA target sequence
ctgatccatttgtggagcaaa

SEQ ID NO: 12386 - DNA, 21 bp, Artificial sequence
  SiRNA target sequence
tgatccatttgtggagcaaag

SEQ ID NO: 12387 - DNA, 21 bp, Artificial sequence
  SiRNA target sequence
gatccatttgtggagcaaaga

SEQ ID NO: 12388 - DNA, 21 bp, Artificial sequence
  SiRNA target sequence
atccatttgtggagcaaagaa

SEQ ID NO: 12389 - DNA, 21 bp, Artificial sequence
  SiRNA target sequence
tccatttgtggagcaaagaat

SEQ ID NO: 12390 - DNA, 21 bp, Artificial sequence
  SiRNA target sequence
ccatttgtggagcaaagaatt

SEQ ID NO: 12391 - DNA, 21 bp, Artificial sequence
  SiRNA target sequence
catttgtggagcaaagaattg

SEQ ID NO: 12392 - DNA, 21 bp, Artificial sequence
  SiRNA target sequence
atttgtggagcaaagaattga

SEQ ID NO: 12393 - DNA, 21 bp, Artificial sequence
  SiRNA target sequence
tttgtggagcaaagaattgaa

SEQ ID NO: 12394 - DNA, 21 bp, Artificial sequence
  SiRNA target sequence
ttgtggagcaaagaattgaag

SEQ ID NO: 12395 - DNA, 21 bp, Artificial sequence
  SiRNA target sequence
tgtggagcaaagaattgaagg

SEQ ID NO: 12396 - DNA, 21 bp, Artificial sequence
  SiRNA target sequence
gtggagcaaagaattgaaggt

SEQ ID NO: 12397 - DNA, 21 bp, Artificial sequence
  SiRNA target sequence
tggagcaaagaattgaaggta

SEQ ID NO: 12398 - DNA, 21 bp, Artificial sequence
  SiRNA target sequence
ggagcaaagaattgaaggtac

SEQ ID NO: 12399 - DNA, 21 bp, Artificial sequence
  SiRNA target sequence
gagcaaagaattgaaggtacg

SEQ ID NO: 12400 - DNA, 21 bp, Artificial sequence
  SiRNA target sequence
agcaaagaattgaaggtacga

SEQ ID NO: 12401 - DNA, 21 bp, Artificial sequence
  SiRNA target sequence
gcaaagaattgaaggtacgaa

SEQ ID NO: 12402 - DNA, 21 bp, Artificial sequence
  SiRNA target sequence
caaagaattgaaggtacgaat

SEQ ID NO: 12403 - DNA, 21 bp, Artificial sequence
  SiRNA target sequence
aaagaattgaaggtacgaatc

SEQ ID NO: 12404 - DNA, 21 bp, Artificial sequence
  SiRNA target sequence
aagaattgaaggtacgaatcc

SEQ ID NO: 12405 - DNA, 21 bp, Artificial sequence
  SiRNA target sequence
agaattgaaggtacgaatcca

SEQ ID NO: 12406 - DNA, 21 bp, Artificial sequence
  SiRNA target sequence
gaattgaaggtacgaatccaa

SEQ ID NO: 12407 - DNA, 21 bp, Artificial sequence
  SiRNA target sequence
aattgaaggtacgaatccaat

SEQ ID NO: 12408 - DNA, 21 bp, Artificial sequence
  SiRNA target sequence
attgaaggtacgaatccaata

SEQ ID NO: 12409 - DNA, 21 bp, Artificial sequence
  SiRNA target sequence
ttgaaggtacgaatccaatat

SEQ ID NO: 12410 - DNA, 21 bp, Artificial sequence
  SiRNA target sequence
tgaaggtacgaatccaatatc

SEQ ID NO: 12411 - DNA, 21 bp, Artificial sequence
  SiRNA target sequence
  misc_feature (21)..(21): n is a, c, g, or t
gaaggtacgaatccaatatcn

SEQ ID NO: 12412 - DNA, 21 bp, Artificial sequence
  SiRNA target sequence
  misc_feature (20)..(20): n is a, c, g, or t
aaggtacgaatccaatatcnt

SEQ ID NO: 12413 - DNA, 21 bp, Artificial sequence
  SiRNA target sequence
  misc_feature (19)..(19): n is a, c, g, or t
aggtacgaatccaatatcntt

SEQ ID NO: 12414 - DNA, 21 bp, Artificial sequence
  SiRNA target sequence
  misc_feature (18)..(18): n is a, c, g, or t
ggtacgaatccaatatcnttg

SEQ ID NO: 12415 - DNA, 21 bp, Artificial sequence
  SiRNA target sequence
  misc_feature (17)..(17): n is a, c, g, or t
gtacgaatccaatatcnttgt

SEQ ID NO: 12416 - DNA, 21 bp, Artificial sequence
  SiRNA target sequence
  misc_feature (16)..(16): n is a, c, g, or t
tacgaatccaatatcnttgta

SEQ ID NO: 12417 - DNA, 21 bp, Artificial sequence
  SiRNA target sequence
  misc_feature (15)..(15): n is a, c, g, or t
acgaatccaatatcnttgtat

SEQ ID NO: 12418 - DNA, 21 bp, Artificial sequence
  SiRNA target sequence
  misc_feature (14)..(14): n is a, c, g, or t
cgaatccaatatcnttgtatt

SEQ ID NO: 12419 - DNA, 21 bp, Artificial sequence
  SiRNA target sequence
  misc_feature (13)..(13): n is a, c, g, or t
gaatccaatatcnttgtattg

SEQ ID NO: 12420 - DNA, 21 bp, Artificial sequence
  SiRNA target sequence
  misc_feature (12)..(12): n is a, c, g, or t
aatccaatatcnttgtattgg

SEQ ID NO: 12421 - DNA, 21 bp, Artificial sequence
  SiRNA target sequence
  misc_feature (11)..(11): n is a, c, g, or t
atccaatatcnttgtattggt

SEQ ID NO: 12422 - DNA, 21 bp, Artificial sequence
  SiRNA target sequence
  misc_feature (10)..(10): n is a, c, g, or t
tccaatatcnttgtattggtt

SEQ ID NO: 12423 - DNA, 21 bp, Artificial sequence
  SiRNA target sequence
  misc_feature (9)..(9): n is a, c, g, or t
ccaatatcnttgtattggttc

SEQ ID NO: 12424 - DNA, 21 bp, Artificial sequence
  SiRNA target sequence
  misc_feature (8)..(8): n is a, c, g, or t
caatatcnttgtattggttcg

SEQ ID NO: 12425 - DNA, 21 bp, Artificial sequence
  SiRNA target sequence
  misc_feature (7)..(7): n is a, c, g, or t
aatatcnttgtattggttcgc

SEQ ID NO: 12426 - DNA, 21 bp, Artificial sequence
  SiRNA target sequence
  misc_feature (6)..(6): n is a, c, g, or t
atatcnttgtattggttcgca

SEQ ID NO: 12427 - DNA, 21 bp, Artificial sequence
  SiRNA target sequence
  misc_feature (5)..(5): n is a, c, g, or t
tatcnttgtattggttcgcac

SEQ ID NO: 12428 - DNA, 21 bp, Artificial sequence
  SiRNA target sequence
  misc_feature (4)..(4): n is a, c, g, or t
atcnttgtattggttcgcacc

SEQ ID NO: 12429 - DNA, 21 bp, Artificial sequence
  SiRNA target sequence
  misc_feature (3)..(3): n is a, c, g, or t
tcnttgtattggttcgcaccc

SEQ ID NO: 12430 - DNA, 21 bp, Artificial sequence
  SiRNA target sequence
  misc_feature (2)..(2): n is a, c, g, or t
cnttgtattggttcgcacccg

SEQ ID NO: 12431 - DNA, 21 bp, Artificial sequence
  SiRNA target sequence
  misc_feature (1)..(1): n is a, c, g, or t
nttgtattggttcgcacccgt

SEQ ID NO: 12432 - DNA, 21 bp, Artificial sequence
  SiRNA target sequence
ttgtattggttcgcacccgtg

SEQ ID NO: 12433 - DNA, 21 bp, Artificial sequence
  SiRNA target sequence
tgtattggttcgcacccgtgg

SEQ ID NO: 12434 - DNA, 21 bp, Artificial sequence
  SiRNA target sequence
gtattggttcgcacccgtggg

SEQ ID NO: 12435 - DNA, 21 bp, Artificial sequence
  SiRNA target sequence
tattggttcgcacccgtgggt

SEQ ID NO: 12436 - DNA, 21 bp, Artificial sequence
  SiRNA target sequence
attggttcgcacccgtgggtg

SEQ ID NO: 12437 - DNA, 21 bp, Artificial sequence
  SiRNA target sequence
ttggttcgcacccgtgggtgt

SEQ ID NO: 12438 - DNA, 21 bp, Artificial sequence
  SiRNA target sequence
tggttcgcacccgtgggtgta

SEQ ID NO: 12439 - DNA, 21 bp, Artificial sequence
  SiRNA target sequence
ggttcgcacccgtgggtgtag

SEQ ID NO: 12440 - DNA, 21 bp, Artificial sequence
  SiRNA target sequence
gttcgcacccgtgggtgtagt

SEQ ID NO: 12441 - DNA, 21 bp, Artificial sequence
  SiRNA target sequence
ttcgcacccgtgggtgtagta

SEQ ID NO: 12442 - DNA, 21 bp, Artificial sequence
  SiRNA target sequence
tcgcacccgtgggtgtagtat

SEQ ID NO: 12443 - DNA, 21 bp, Artificial sequence
  SiRNA target sequence
cgcacccgtgggtgtagtatc

SEQ ID NO: 12444 - DNA, 21 bp, Artificial sequence
  SiRNA target sequence
gcacccgtgggtgtagtatct

SEQ ID NO: 12445 - DNA, 21 bp, Artificial sequence
  SiRNA target sequence
cacccgtgggtgtagtatcta

SEQ ID NO: 12446 - DNA, 21 bp, Artificial sequence
  SiRNA target sequence
acccgtgggtgtagtatctag

SEQ ID NO: 12447 - DNA, 21 bp, Artificial sequence
  SiRNA target sequence
cccgtgggtgtagtatctagt

SEQ ID NO: 12448 - DNA, 21 bp, Artificial sequence
  SiRNA target sequence
ccgtgggtgtagtatctagta

SEQ ID NO: 12449 - DNA, 21 bp, Artificial sequence
  SiRNA target sequence
cgtgggtgtagtatctagtat

SEQ ID NO: 12450 - DNA, 21 bp, Artificial sequence
  SiRNA target sequence
gtgggtgtagtatctagtatg

SEQ ID NO: 12451 - DNA, 21 bp, Artificial sequence
  SiRNA target sequence
tgggtgtagtatctagtatgt

SEQ ID NO: 12452 - DNA, 21 bp, Artificial sequence
  SiRNA target sequence
gggtgtagtatctagtatgtt

SEQ ID NO: 12453 - DNA, 21 bp, Artificial sequence
  SiRNA target sequence
ggtgtagtatctagtatgttt

SEQ ID NO: 12454 - DNA, 21 bp, Artificial sequence
  SiRNA target sequence
gtgtagtatctagtatgttta

SEQ ID NO: 12455 - DNA, 21 bp, Artificial sequence
  SiRNA target sequence
tgtagtatctagtatgtttat

SEQ ID NO: 12456 - DNA, 21 bp, Artificial sequence
  SiRNA target sequence
gtagtatctagtatgtttatg

SEQ ID NO: 12457 - DNA, 21 bp, Artificial sequence
  SiRNA target sequence
tagtatctagtatgtttatgc

SEQ ID NO: 12458 - DNA, 21 bp, Artificial sequence
  SiRNA target sequence
agtatctagtatgtttatgca

SEQ ID NO: 12459 - DNA, 21 bp, Artificial sequence
  SiRNA target sequence
gtatctagtatgtttatgcaa

SEQ ID NO: 12460 - DNA, 21 bp, Artificial sequence
  SiRNA target sequence
tatctagtatgtttatgcaat

SEQ ID NO: 12461 - DNA, 21 bp, Artificial sequence
  SiRNA target sequence
atctagtatgtttatgcaatg

SEQ ID NO: 12462 - DNA, 21 bp, Artificial sequence
  SiRNA target sequence
tctagtatgtttatgcaatgg

SEQ ID NO: 12463 - DNA, 21 bp, Artificial sequence
  SiRNA target sequence
ctagtatgtttatgcaatggc

SEQ ID NO: 12464 - DNA, 21 bp, Artificial sequence
  SiRNA target sequence
tagtatgtttatgcaatggcg

SEQ ID NO: 12465 - DNA, 21 bp, Artificial sequence
  SiRNA target sequence
agtatgtttatgcaatggcgc

SEQ ID NO: 12466 - DNA, 21 bp, Artificial sequence
  SiRNA target sequence
gtatgtttatgcaatggcgcg

SEQ ID NO: 12467 - DNA, 21 bp, Artificial sequence
  SiRNA target sequence
tatgtttatgcaatggcgcgg

SEQ ID NO: 12468 - DNA, 21 bp, Artificial sequence
  SiRNA target sequence
atgtttatgcaatggcgcggt

SEQ ID NO: 12469 - DNA, 21 bp, Artificial sequence
  SiRNA target sequence
tgtttatgcaatggcgcggtt

SEQ ID NO: 12470 - DNA, 21 bp, Artificial sequence
  SiRNA target sequence
gtttatgcaatggcgcggttc

SEQ ID NO: 12471 - DNA, 21 bp, Artificial sequence
  SiRNA target sequence
tttatgcaatggcgcggttca

SEQ ID NO: 12472 - DNA, 21 bp, Artificial sequence
  SiRNA target sequence
ttatgcaatggcgcggttcat

SEQ ID NO: 12473 - DNA, 21 bp, Artificial sequence
  SiRNA target sequence
tatgcaatggcgcggttcatt

SEQ ID NO: 12474 - DNA, 21 bp, Artificial sequence
  SiRNA target sequence
atgcaatggcgcggttcatta

SEQ ID NO: 12475 - DNA, 21 bp, Artificial sequence
  SiRNA target sequence
tgcaatggcgcggttcattag

SEQ ID NO: 12476 - DNA, 21 bp, Artificial sequence
  SiRNA target sequence
gcaatggcgcggttcattaga

SEQ ID NO: 12477 - DNA, 21 bp, Artificial sequence
  SiRNA target sequence
caatggcgcggttcattagaa

SEQ ID NO: 12478 - DNA, 21 bp, Artificial sequence
  SiRNA target sequence
aatggcgcggttcattagaat

SEQ ID NO: 12479 - DNA, 21 bp, Artificial sequence
  SiRNA target sequence
atggcgcggttcattagaata

SEQ ID NO: 12480 - DNA, 21 bp, Artificial sequence
  SiRNA target sequence
tggcgcggttcattagaatat

SEQ ID NO: 12481 - DNA, 21 bp, Artificial sequence
  SiRNA target sequence
ggcgcggttcattagaatata

SEQ ID NO: 12482 - DNA, 21 bp, Artificial sequence
  SiRNA target sequence
gcgcggttcattagaatatag

SEQ ID NO: 12483 - DNA, 21 bp, Artificial sequence
  SiRNA target sequence
cgcggttcattagaatatagg

SEQ ID NO: 12484 - DNA, 21 bp, Artificial sequence
  SiRNA target sequence
gcggttcattagaatataggt

SEQ ID NO: 12485 - DNA, 21 bp, Artificial sequence
  SiRNA target sequence
cggttcattagaatataggtt

SEQ ID NO: 12486 - DNA, 21 bp, Artificial sequence
  SiRNA target sequence
ggttcattagaatataggttt

SEQ ID NO: 12487 - DNA, 21 bp, Artificial sequence
  SiRNA target sequence
gttcattagaatataggtttg

SEQ ID NO: 12488 - DNA, 21 bp, Artificial sequence
  SiRNA target sequence
ttcattagaatataggtttga

SEQ ID NO: 12489 - DNA, 21 bp, Artificial sequence
  SiRNA target sequence
tcattagaatataggtttgat

SEQ ID NO: 12490 - DNA, 21 bp, Artificial sequence
  SiRNA target sequence
cattagaatataggtttgata

SEQ ID NO: 12491 - DNA, 21 bp, Artificial sequence
  SiRNA target sequence
attagaatataggtttgatat

SEQ ID NO: 12492 - DNA, 21 bp, Artificial sequence
  SiRNA target sequence
ttagaatataggtttgatatt

SEQ ID NO: 12493 - DNA, 21 bp, Artificial sequence
  SiRNA target sequence
tagaatataggtttgatatta

SEQ ID NO: 12494 - DNA, 21 bp, Artificial sequence
  SiRNA target sequence
agaatataggtttgatattat

SEQ ID NO: 12495 - DNA, 21 bp, Artificial sequence
  SiRNA target sequence
gaatataggtttgatattata

SEQ ID NO: 12496 - DNA, 21 bp, Artificial sequence
  SiRNA target sequence
aatataggtttgatattatag

SEQ ID NO: 12497 - DNA, 21 bp, Artificial sequence
  SiRNA target sequence
atataggtttgatattatagc

SEQ ID NO: 12498 - DNA, 21 bp, Artificial sequence
  SiRNA target sequence
tataggtttgatattatagca

SEQ ID NO: 12499 - DNA, 21 bp, Artificial sequence
  SiRNA target sequence
ataggtttgatattatagcat

SEQ ID NO: 12500 - DNA, 21 bp, Artificial sequence
  SiRNA target sequence
taggtttgatattatagcatc

SEQ ID NO: 12501 - DNA, 21 bp, Artificial sequence
  SiRNA target sequence
aggtttgatattatagcatcc

SEQ ID NO: 12502 - DNA, 21 bp, Artificial sequence
  SiRNA target sequence
ggtttgatattatagcatccc

SEQ ID NO: 12503 - DNA, 21 bp, Artificial sequence
  SiRNA target sequence
gtttgatattatagcatccca

SEQ ID NO: 12504 - DNA, 21 bp, Artificial sequence
  SiRNA target sequence
tttgatattatagcatcccaa

SEQ ID NO: 12505 - DNA, 21 bp, Artificial sequence
  SiRNA target sequence
ttgatattatagcatcccaat

SEQ ID NO: 12506 - DNA, 21 bp, Artificial sequence
  SiRNA target sequence
tgatattatagcatcccaatt

SEQ ID NO: 12507 - DNA, 21 bp, Artificial sequence
  SiRNA target sequence
gatattatagcatcccaattt

SEQ ID NO: 12508 - DNA, 21 bp, Artificial sequence
  SiRNA target sequence
atattatagcatcccaatttc

SEQ ID NO: 12509 - DNA, 21 bp, Artificial sequence
  SiRNA target sequence
tattatagcatcccaatttca

SEQ ID NO: 12510 - DNA, 21 bp, Artificial sequence
  SiRNA target sequence
attatagcatcccaatttcat

SEQ ID NO: 12511 - DNA, 21 bp, Artificial sequence
  SiRNA target sequence
ttatagcatcccaatttcata

SEQ ID NO: 12512 - DNA, 21 bp, Artificial sequence
  SiRNA target sequence
tatagcatcccaatttcatac

SEQ ID NO: 12513 - DNA, 21 bp, Artificial sequence
  SiRNA target sequence
atagcatcccaatttcatact

SEQ ID NO: 12514 - DNA, 21 bp, Artificial sequence
  SiRNA target sequence
tagcatcccaatttcatactg

SEQ ID NO: 12515 - DNA, 21 bp, Artificial sequence
  SiRNA target sequence
agcatcccaatttcatactgg

SEQ ID NO: 12516 - DNA, 21 bp, Artificial sequence
  SiRNA target sequence
gcatcccaatttcatactggt

SEQ ID NO: 12517 - DNA, 21 bp, Artificial sequence
  SiRNA target sequence
catcccaatttcatactggta

SEQ ID NO: 12518 - DNA, 21 bp, Artificial sequence
  SiRNA target sequence
atcccaatttcatactggtag

SEQ ID NO: 12519 - DNA, 21 bp, Artificial sequence
  SiRNA target sequence
tcccaatttcatactggtagg

SEQ ID NO: 12520 - DNA, 21 bp, Artificial sequence
  SiRNA target sequence
cccaatttcatactggtaggt

SEQ ID NO: 12521 - DNA, 21 bp, Artificial sequence
  SiRNA target sequence
ccaatttcatactggtaggtt

SEQ ID NO: 12522 - DNA, 21 bp, Artificial sequence
  SiRNA target sequence
caatttcatactggtaggtta

SEQ ID NO: 12523 - DNA, 21 bp, Artificial sequence
  SiRNA target sequence
aatttcatactggtaggttaa

SEQ ID NO: 12524 - DNA, 21 bp, Artificial sequence
  SiRNA target sequence
atttcatactggtaggttaat

SEQ ID NO: 12525 - DNA, 21 bp, Artificial sequence
  SiRNA target sequence
tttcatactggtaggttaatt

SEQ ID NO: 12526 - DNA, 21 bp, Artificial sequence
  SiRNA target sequence
ttcatactggtaggttaattg

SEQ ID NO: 12527 - DNA, 21 bp, Artificial sequence
  SiRNA target sequence
tcatactggtaggttaattgt

SEQ ID NO: 12528 - DNA, 21 bp, Artificial sequence
  SiRNA target sequence
catactggtaggttaattgta

SEQ ID NO: 12529 - DNA, 21 bp, Artificial sequence
  SiRNA target sequence
atactggtaggttaattgtag

SEQ ID NO: 12530 - DNA, 21 bp, Artificial sequence
  SiRNA target sequence
tactggtaggttaattgtagg

SEQ ID NO: 12531 - DNA, 21 bp, Artificial sequence
  SiRNA target sequence
actggtaggttaattgtaggt

SEQ ID NO: 12532 - DNA, 21 bp, Artificial sequence
  SiRNA target sequence
ctggtaggttaattgtaggtt

SEQ ID NO: 12533 - DNA, 21 bp, Artificial sequence
  SiRNA target sequence
tggtaggttaattgtaggtta

SEQ ID NO: 12534 - DNA, 21 bp, Artificial sequence
  SiRNA target sequence
ggtaggttaattgtaggttat

SEQ ID NO: 12535 - DNA, 21 bp, Artificial sequence
  SiRNA target sequence
gtaggttaattgtaggttatg

SEQ ID NO: 12536 - DNA, 21 bp, Artificial sequence
  SiRNA target sequence
taggttaattgtaggttatgt

SEQ ID NO: 12537 - DNA, 21 bp, Artificial sequence
  SiRNA target sequence
aggttaattgtaggttatgtg

SEQ ID NO: 12538 - DNA, 21 bp, Artificial sequence
  SiRNA target sequence
ggttaattgtaggttatgtgc

SEQ ID NO: 12539 - DNA, 21 bp, Artificial sequence
  SiRNA target sequence
gttaattgtaggttatgtgcc

SEQ ID NO: 12540 - DNA, 21 bp, Artificial sequence
  SiRNA target sequence
ttaattgtaggttatgtgccc

SEQ ID NO: 12541 - DNA, 21 bp, Artificial sequence
  SiRNA target sequence
taattgtaggttatgtgcccg

SEQ ID NO: 12542 - DNA, 21 bp, Artificial sequence
  SiRNA target sequence
aattgtaggttatgtgcccgg

SEQ ID NO: 12543 - DNA, 21 bp, Artificial sequence
  SiRNA target sequence
attgtaggttatgtgcccggt

SEQ ID NO: 12544 - DNA, 21 bp, Artificial sequence
  SiRNA target sequence
ttgtaggttatgtgcccggtt

SEQ ID NO: 12545 - DNA, 21 bp, Artificial sequence
  SiRNA target sequence
tgtaggttatgtgcccggttt

SEQ ID NO: 12546 - DNA, 21 bp, Artificial sequence
  SiRNA target sequence
gtaggttatgtgcccggtttg

SEQ ID NO: 12547 - DNA, 21 bp, Artificial sequence
  SiRNA target sequence
taggttatgtgcccggtttga

SEQ ID NO: 12548 - DNA, 21 bp, Artificial sequence
  SiRNA target sequence
aggttatgtgcccggtttgac

SEQ ID NO: 12549 - DNA, 21 bp, Artificial sequence
  SiRNA target sequence
ggttatgtgcccggtttgaca

SEQ ID NO: 12550 - DNA, 21 bp, Artificial sequence
  SiRNA target sequence
gttatgtgcccggtttgacag

SEQ ID NO: 12551 - DNA, 21 bp, Artificial sequence
  SiRNA target sequence
ttatgtgcccggtttgacagc

SEQ ID NO: 12552 - DNA, 21 bp, Artificial sequence
  SiRNA target sequence
tatgtgcccggtttgacagca

SEQ ID NO: 12553 - DNA, 21 bp, Artificial sequence
  SiRNA target sequence
atgtgcccggtttgacagcat

SEQ ID NO: 12554 - DNA, 21 bp, Artificial sequence
  SiRNA target sequence
tgtgcccggtttgacagcatc

SEQ ID NO: 12555 - DNA, 21 bp, Artificial sequence
  SiRNA target sequence
gtgcccggtttgacagcatct

SEQ ID NO: 12556 - DNA, 21 bp, Artificial sequence
  SiRNA target sequence
tgcccggtttgacagcatctt

SEQ ID NO: 12557 - DNA, 21 bp, Artificial sequence
  SiRNA target sequence
gcccggtttgacagcatcttt

SEQ ID NO: 12558 - DNA, 21 bp, Artificial sequence
  SiRNA target sequence
cccggtttgacagcatctttg

SEQ ID NO: 12559 - DNA, 21 bp, Artificial sequence
  SiRNA target sequence
ccggtttgacagcatctttgc

SEQ ID NO: 12560 - DNA, 21 bp, Artificial sequence
  SiRNA target sequence
cggtttgacagcatctttgca

SEQ ID NO: 12561 - DNA, 21 bp, Artificial sequence
  SiRNA target sequence
ggtttgacagcatctttgcaa

SEQ ID NO: 12562 - DNA, 21 bp, Artificial sequence
  SiRNA target sequence
gtttgacagcatctttgcaac

SEQ ID NO: 12563 - DNA, 21 bp, Artificial sequence
  SiRNA target sequence
tttgacagcatctttgcaact

SEQ ID NO: 12564 - DNA, 21 bp, Artificial sequence
  SiRNA target sequence
ttgacagcatctttgcaactt

SEQ ID NO: 12565 - DNA, 21 bp, Artificial sequence
  SiRNA target sequence
tgacagcatctttgcaacttc

SEQ ID NO: 12566 - DNA, 21 bp, Artificial sequence
  SiRNA target sequence
gacagcatctttgcaacttca

SEQ ID NO: 12567 - DNA, 21 bp, Artificial sequence
  SiRNA target sequence
acagcatctttgcaacttcaa

SEQ ID NO: 12568 - DNA, 21 bp, Artificial sequence
  SiRNA target sequence
cagcatctttgcaacttcaaa

SEQ ID NO: 12569 - DNA, 21 bp, Artificial sequence
  SiRNA target sequence
agcatctttgcaacttcaaat

SEQ ID NO: 12570 - DNA, 21 bp, Artificial sequence
  SiRNA target sequence
gcatctttgcaacttcaaatg

SEQ ID NO: 12571 - DNA, 21 bp, Artificial sequence
  SiRNA target sequence
catctttgcaacttcaaatgg

SEQ ID NO: 12572 - DNA, 21 bp, Artificial sequence
  SiRNA target sequence
atctttgcaacttcaaatgga

SEQ ID NO: 12573 - DNA, 21 bp, Artificial sequence
  SiRNA target sequence
tctttgcaacttcaaatggac

SEQ ID NO: 12574 - DNA, 21 bp, Artificial sequence
  SiRNA target sequence
ctttgcaacttcaaatggact

SEQ ID NO: 12575 - DNA, 21 bp, Artificial sequence
  SiRNA target sequence
tttgcaacttcaaatggacta

SEQ ID NO: 12576 - DNA, 21 bp, Artificial sequence
  SiRNA target sequence
ttgcaacttcaaatggactat

SEQ ID NO: 12577 - DNA, 21 bp, Artificial sequence
  SiRNA target sequence
tgcaacttcaaatggactata

SEQ ID NO: 12578 - DNA, 21 bp, Artificial sequence
  SiRNA target sequence
gcaacttcaaatggactatat

SEQ ID NO: 12579 - DNA, 21 bp, Artificial sequence
  SiRNA target sequence
caacttcaaatggactatatg

SEQ ID NO: 12580 - DNA, 21 bp, Artificial sequence
  SiRNA target sequence
aacttcaaatggactatatga

SEQ ID NO: 12581 - DNA, 21 bp, Artificial sequence
  SiRNA target sequence
acttcaaatggactatatgaa

SEQ ID NO: 12582 - DNA, 21 bp, Artificial sequence
  SiRNA target sequence
cttcaaatggactatatgaaa

SEQ ID NO: 12583 - DNA, 21 bp, Artificial sequence
  SiRNA target sequence
ttcaaatggactatatgaaat

SEQ ID NO: 12584 - DNA, 21 bp, Artificial sequence
  SiRNA target sequence
tcaaatggactatatgaaatt

SEQ ID NO: 12585 - DNA, 21 bp, Artificial sequence
  SiRNA target sequence
caaatggactatatgaaattg

SEQ ID NO: 12586 - DNA, 21 bp, Artificial sequence
  SiRNA target sequence
aaatggactatatgaaattga

SEQ ID NO: 12587 - DNA, 21 bp, Artificial sequence
  SiRNA target sequence
aatggactatatgaaattgaa

SEQ ID NO: 12588 - DNA, 21 bp, Artificial sequence
  SiRNA target sequence
atggactatatgaaattgaag

SEQ ID NO: 12589 - DNA, 21 bp, Artificial sequence
  SiRNA target sequence
tggactatatgaaattgaagt

SEQ ID NO: 12590 - DNA, 21 bp, Artificial sequence
  SiRNA target sequence
ggactatatgaaattgaagtc

SEQ ID NO: 12591 - DNA, 21 bp, Artificial sequence
  SiRNA target sequence
gactatatgaaattgaagtca

SEQ ID NO: 12592 - DNA, 21 bp, Artificial sequence
  SiRNA target sequence
actatatgaaattgaagtcat

SEQ ID NO: 12593 - DNA, 21 bp, Artificial sequence
  SiRNA target sequence
ctatatgaaattgaagtcatc

SEQ ID NO: 12594 - DNA, 21 bp, Artificial sequence
  SiRNA target sequence
tatatgaaattgaagtcatcg

SEQ ID NO: 12595 - DNA, 21 bp, Artificial sequence
  SiRNA target sequence
atatgaaattgaagtcatcga

SEQ ID NO: 12596 - DNA, 21 bp, Artificial sequence
  SiRNA target sequence
tatgaaattgaagtcatcgag

SEQ ID NO: 12597 - DNA, 21 bp, Artificial sequence
  SiRNA target sequence
atgaaattgaagtcatcgagt

SEQ ID NO: 12598 - DNA, 21 bp, Artificial sequence
  SiRNA target sequence
tgaaattgaagtcatcgagtt

SEQ ID NO: 12599 - DNA, 21 bp, Artificial sequence
  SiRNA target sequence
gaaattgaagtcatcgagtta

SEQ ID NO: 12600 - DNA, 21 bp, Artificial sequence
  SiRNA target sequence
aaattgaagtcatcgagttat

SEQ ID NO: 12601 - DNA, 21 bp, Artificial sequence
  SiRNA target sequence
aattgaagtcatcgagttatg

SEQ ID NO: 12602 - DNA, 21 bp, Artificial sequence
  SiRNA target sequence
attgaagtcatcgagttatgt

SEQ ID NO: 12603 - DNA, 21 bp, Artificial sequence
  SiRNA target sequence
ttgaagtcatcgagttatgta

SEQ ID NO: 12604 - DNA, 21 bp, Artificial sequence
  SiRNA target sequence
tgaagtcatcgagttatgtag

SEQ ID NO: 12605 - DNA, 21 bp, Artificial sequence
  SiRNA target sequence
gaagtcatcgagttatgtagt

SEQ ID NO: 12606 - DNA, 21 bp, Artificial sequence
  SiRNA target sequence
aagtcatcgagttatgtagta

SEQ ID NO: 12607 - DNA, 21 bp, Artificial sequence
  SiRNA target sequence
agtcatcgagttatgtagtat

SEQ ID NO: 12608 - DNA, 21 bp, Artificial sequence
  SiRNA target sequence
gtcatcgagttatgtagtatt

SEQ ID NO: 12609 - DNA, 21 bp, Artificial sequence
  SiRNA target sequence
tcatcgagttatgtagtattt

SEQ ID NO: 12610 - DNA, 21 bp, Artificial sequence
  SiRNA target sequence
catcgagttatgtagtatttg

SEQ ID NO: 12611 - DNA, 21 bp, Artificial sequence
  SiRNA target sequence
atcgagttatgtagtatttga

SEQ ID NO: 12612 - DNA, 21 bp, Artificial sequence
  SiRNA target sequence
tcgagttatgtagtatttgat

SEQ ID NO: 12613 - DNA, 21 bp, Artificial sequence
  SiRNA target sequence
cgagttatgtagtatttgatt

SEQ ID NO: 12614 - DNA, 21 bp, Artificial sequence
  SiRNA target sequence
gagttatgtagtatttgattt

SEQ ID NO: 12615 - DNA, 21 bp, Artificial sequence
  SiRNA target sequence
agttatgtagtatttgattta

SEQ ID NO: 12616 - DNA, 21 bp, Artificial sequence
  SiRNA target sequence
gttatgtagtatttgatttac

SEQ ID NO: 12617 - DNA, 21 bp, Artificial sequence
  SiRNA target sequence
ttatgtagtatttgatttaca

SEQ ID NO: 12618 - DNA, 21 bp, Artificial sequence
  SiRNA target sequence
tatgtagtatttgatttacaa

SEQ ID NO: 12619 - DNA, 21 bp, Artificial sequence
  SiRNA target sequence
atgtagtatttgatttacaag

SEQ ID NO: 12620 - DNA, 21 bp, Artificial sequence
  SiRNA target sequence
tgtagtatttgatttacaaga

SEQ ID NO: 12621 - DNA, 21 bp, Artificial sequence
  SiRNA target sequence
gtagtatttgatttacaagaa

SEQ ID NO: 12622 - DNA, 21 bp, Artificial sequence
  SiRNA target sequence
tagtatttgatttacaagaaa

SEQ ID NO: 12623 - DNA, 21 bp, Artificial sequence
  SiRNA target sequence
agtatttgatttacaagaaag

SEQ ID NO: 12624 - DNA, 21 bp, Artificial sequence
  SiRNA target sequence
gtatttgatttacaagaaagt

SEQ ID NO: 12625 - DNA, 21 bp, Artificial sequence
  SiRNA target sequence
tatttgatttacaagaaagta

SEQ ID NO: 12626 - DNA, 21 bp, Artificial sequence
  SiRNA target sequence
atttgatttacaagaaagtaa

SEQ ID NO: 12627 - DNA, 21 bp, Artificial sequence
  SiRNA target sequence
tttgatttacaagaaagtaat

SEQ ID NO: 12628 - DNA, 21 bp, Artificial sequence
  SiRNA target sequence
ttgatttacaagaaagtaata

SEQ ID NO: 12629 - DNA, 21 bp, Artificial sequence
  SiRNA target sequence
tgatttacaagaaagtaatag

SEQ ID NO: 12630 - DNA, 21 bp, Artificial sequence
  SiRNA target sequence
gatttacaagaaagtaatagc

SEQ ID NO: 12631 - DNA, 21 bp, Artificial sequence
  SiRNA target sequence
atttacaagaaagtaatagct

SEQ ID NO: 12632 - DNA, 21 bp, Artificial sequence
  SiRNA target sequence
tttacaagaaagtaatagctt

SEQ ID NO: 12633 - DNA, 21 bp, Artificial sequence
  SiRNA target sequence
ttacaagaaagtaatagcttc

SEQ ID NO: 12634 - DNA, 21 bp, Artificial sequence
  SiRNA target sequence
tacaagaaagtaatagcttca

SEQ ID NO: 12635 - DNA, 21 bp, Artificial sequence
  SiRNA target sequence
acaagaaagtaatagcttcac

SEQ ID NO: 12636 - DNA, 21 bp, Artificial sequence
  SiRNA target sequence
caagaaagtaatagcttcact

SEQ ID NO: 12637 - DNA, 21 bp, Artificial sequence
  SiRNA target sequence
aagaaagtaatagcttcactt

SEQ ID NO: 12638 - DNA, 21 bp, Artificial sequence
  SiRNA target sequence
agaaagtaatagcttcacttt

SEQ ID NO: 12639 - DNA, 21 bp, Artificial sequence
  SiRNA target sequence
gaaagtaatagcttcactttt

SEQ ID NO: 12640 - DNA, 21 bp, Artificial sequence
  SiRNA target sequence
aaagtaatagcttcacttttg

SEQ ID NO: 12641 - DNA, 21 bp, Artificial sequence
  SiRNA target sequence
aagtaatagcttcacttttga

SEQ ID NO: 12642 - DNA, 21 bp, Artificial sequence
  SiRNA target sequence
agtaatagcttcacttttgag

SEQ ID NO: 12643 - DNA, 21 bp, Artificial sequence
  SiRNA target sequence
gtaatagcttcacttttgagg

SEQ ID NO: 12644 - DNA, 21 bp, Artificial sequence
  SiRNA target sequence
taatagcttcacttttgaggt

SEQ ID NO: 12645 - DNA, 21 bp, Artificial sequence
  SiRNA target sequence
aatagcttcacttttgaggtg

SEQ ID NO: 12646 - DNA, 21 bp, Artificial sequence
  SiRNA target sequence
atagcttcacttttgaggtgc

SEQ ID NO: 12647 - DNA, 21 bp, Artificial sequence
  SiRNA target sequence
tagcttcacttttgaggtgcc

SEQ ID NO: 12648 - DNA, 21 bp, Artificial sequence
  SiRNA target sequence
agcttcacttttgaggtgcca

SEQ ID NO: 12649 - DNA, 21 bp, Artificial sequence
  SiRNA target sequence
gcttcacttttgaggtgccat

SEQ ID NO: 12650 - DNA, 21 bp, Artificial sequence
  SiRNA target sequence
cttcacttttgaggtgccata

SEQ ID NO: 12651 - DNA, 21 bp, Artificial sequence
  SiRNA target sequence
  misc_feature (21)..(21): n is a, c, g, or t
ttcacttttgaggtgccatan

SEQ ID NO: 12652 - DNA, 21 bp, Artificial sequence
  SiRNA target sequence
  misc_feature (20)..(20): n is a, c, g, or t
tcacttttgaggtgccatang

SEQ ID NO: 12653 - DNA, 21 bp, Artificial sequence
  SiRNA target sequence
  misc_feature (19)..(19): n is a, c, g, or t
cacttttgaggtgccatangt

SEQ ID NO: 12654 - DNA, 21 bp, Artificial sequence
  SiRNA target sequence
  misc_feature (18)..(18): n is a, c, g, or t
acttttgaggtgccatangtt

SEQ ID NO: 12655 - DNA, 21 bp, Artificial sequence
  SiRNA target sequence
  misc_feature (17)..(17): n is a, c, g, or t
cttttgaggtgccatangttt

SEQ ID NO: 12656 - DNA, 21 bp, Artificial sequence
  SiRNA target sequence
  misc_feature (16)..(16): n is a, c, g, or t
ttttgaggtgccatangtttc

SEQ ID NO: 12657 - DNA, 21 bp, Artificial sequence
  SiRNA target sequence
  misc_feature (15)..(15): n is a, c, g, or t
tttgaggtgccatangtttca

SEQ ID NO: 12658 - DNA, 21 bp, Artificial sequence
  SiRNA target sequence
  misc_feature (14)..(14): n is a, c, g, or t
ttgaggtgccatangtttcat

SEQ ID NO: 12659 - DNA, 21 bp, Artificial sequence
  SiRNA target sequence
  misc_feature (13)..(13): n is a, c, g, or t
tgaggtgccatangtttcata

SEQ ID NO: 12660 - DNA, 21 bp, Artificial sequence
  SiRNA target sequence
  misc_feature (12)..(12): n is a, c, g, or t
gaggtgccatangtttcatat

SEQ ID NO: 12661 - DNA, 21 bp, Artificial sequence
  SiRNA target sequence
  misc_feature (11)..(11): n is a, c, g, or t
aggtgccatangtttcatata

SEQ ID NO: 12662 - DNA, 21 bp, Artificial sequence
  SiRNA target sequence
  misc_feature (10)..(10): n is a, c, g, or t
ggtgccatangtttcatatag

SEQ ID NO: 12663 - DNA, 21 bp, Artificial sequence
  SiRNA target sequence
  misc_feature (9)..(9): n is a, c, g, or t
gtgccatangtttcatataga

SEQ ID NO: 12664 - DNA, 21 bp, Artificial sequence
  SiRNA target sequence
  misc_feature (8)..(8): n is a, c, g, or t
tgccatangtttcatatagac

SEQ ID NO: 12665 - DNA, 21 bp, Artificial sequence
  SiRNA target sequence
  misc_feature (7)..(7): n is a, c, g, or t
gccatangtttcatatagacc

SEQ ID NO: 12666 - DNA, 21 bp, Artificial sequence
  SiRNA target sequence
  misc_feature (6)..(6): n is a, c, g, or t
ccatangtttcatatagacca

SEQ ID NO: 12667 - DNA, 21 bp, Artificial sequence
  SiRNA target sequence
  misc_feature (5)..(5): n is a, c, g, or t
catangtttcatatagaccat

SEQ ID NO: 12668 - DNA, 21 bp, Artificial sequence
  SiRNA target sequence
  misc_feature (4)..(4): n is a, c, g, or t
atangtttcatatagaccatg

SEQ ID NO: 12669 - DNA, 21 bp, Artificial sequence
  SiRNA target sequence
  misc_feature (3)..(3): n is a, c, g, or t
tangtttcatatagaccatgg

SEQ ID NO: 12670 - DNA, 21 bp, Artificial sequence
  SiRNA target sequence
  misc_feature (2)..(2): n is a, c, g, or t
angtttcatatagaccatggt

SEQ ID NO: 12671 - DNA, 21 bp, Artificial sequence
  SiRNA target sequence
  misc_feature (1)..(1): n is a, c, g, or t
ngtttcatatagaccatggtg

SEQ ID NO: 12672 - DNA, 21 bp, Artificial sequence
  SiRNA target sequence
gtttcatatagaccatggtgg

SEQ ID NO: 12673 - DNA, 21 bp, Artificial sequence
  SiRNA target sequence
tttcatatagaccatggtggg

SEQ ID NO: 12674 - DNA, 21 bp, Artificial sequence
  SiRNA target sequence
ttcatatagaccatggtgggt

SEQ ID NO: 12675 - DNA, 21 bp, Artificial sequence
  SiRNA target sequence
tcatatagaccatggtgggtg

SEQ ID NO: 12676 - DNA, 21 bp, Artificial sequence
  SiRNA target sequence
catatagaccatggtgggtgc

SEQ ID NO: 12677 - DNA, 21 bp, Artificial sequence
  SiRNA target sequence
atatagaccatggtgggtgcg

SEQ ID NO: 12678 - DNA, 21 bp, Artificial sequence
  SiRNA target sequence
tatagaccatggtgggtgcgt

SEQ ID NO: 12679 - DNA, 21 bp, Artificial sequence
  SiRNA target sequence
atagaccatggtgggtgcgta

SEQ ID NO: 12680 - DNA, 21 bp, Artificial sequence
  SiRNA target sequence
tagaccatggtgggtgcgtaa

SEQ ID NO: 12681 - DNA, 21 bp, Artificial sequence
  SiRNA target sequence
agaccatggtgggtgcgtaaa

SEQ ID NO: 12682 - DNA, 21 bp, Artificial sequence
  SiRNA target sequence
gaccatggtgggtgcgtaaat

SEQ ID NO: 12683 - DNA, 21 bp, Artificial sequence
  SiRNA target sequence
accatggtgggtgcgtaaata

SEQ ID NO: 12684 - DNA, 21 bp, Artificial sequence
  SiRNA target sequence
ccatggtgggtgcgtaaatat

SEQ ID NO: 12685 - DNA, 21 bp, Artificial sequence
  SiRNA target sequence
catggtgggtgcgtaaatatg

SEQ ID NO: 12686 - DNA, 21 bp, Artificial sequence
  SiRNA target sequence
atggtgggtgcgtaaatatgg

SEQ ID NO: 12687 - DNA, 21 bp, Artificial sequence
  SiRNA target sequence
tggtgggtgcgtaaatatggt

SEQ ID NO: 12688 - DNA, 21 bp, Artificial sequence
  SiRNA target sequence
ggtgggtgcgtaaatatggtg

SEQ ID NO: 12689 - DNA, 21 bp, Artificial sequence
  SiRNA target sequence
gtgggtgcgtaaatatggtgg

SEQ ID NO: 12690 - DNA, 21 bp, Artificial sequence
  SiRNA target sequence
  misc_feature (21)..(21): n is a, c, g, or t
tgggtgcgtaaatatggtggn

SEQ ID NO: 12691 - DNA, 21 bp, Artificial sequence
  SiRNA target sequence
  misc_feature (20)..(20): n is a, c, g, or t
gggtgcgtaaatatggtggna

SEQ ID NO: 12692 - DNA, 21 bp, Artificial sequence
  SiRNA target sequence
  misc_feature (19)..(19): n is a, c, g, or t
ggtgcgtaaatatggtggnaa

SEQ ID NO: 12693 - DNA, 21 bp, Artificial sequence
  SiRNA target sequence
  misc_feature (18)..(18): n is a, c, g, or t
gtgcgtaaatatggtggnaat

SEQ ID NO: 12694 - DNA, 21 bp, Artificial sequence
  SiRNA target sequence
  misc_feature (17)..(17): n is a, c, g, or t
tgcgtaaatatggtggnaatt

SEQ ID NO: 12695 - DNA, 21 bp, Artificial sequence
  SiRNA target sequence
  misc_feature (16)..(16): n is a, c, g, or t
gcgtaaatatggtggnaatta

SEQ ID NO: 12696 - DNA, 21 bp, Artificial sequence
  SiRNA target sequence
  misc_feature (15)..(15): n is a, c, g, or t
cgtaaatatggtggnaattat

SEQ ID NO: 12697 - DNA, 21 bp, Artificial sequence
  SiRNA target sequence
  misc_feature (14)..(14): n is a, c, g, or t
gtaaatatggtggnaattatt

SEQ ID NO: 12698 - DNA, 21 bp, Artificial sequence
  SiRNA target sequence
  misc_feature (13)..(13): n is a, c, g, or t
taaatatggtggnaattattt

SEQ ID NO: 12699 - DNA, 21 bp, Artificial sequence
  SiRNA target sequence
  misc_feature (12)..(12): n is a, c, g, or t
aaatatggtggnaattattta

SEQ ID NO: 12700 - DNA, 21 bp, Artificial sequence
  SiRNA target sequence
  misc_feature (11)..(11): n is a, c, g, or t
aatatggtggnaattatttac

SEQ ID NO: 12701 - DNA, 21 bp, Artificial sequence
  SiRNA target sequence
  misc_feature (10)..(10): n is a, c, g, or t
atatggtggnaattatttacc

SEQ ID NO: 12702 - DNA, 21 bp, Artificial sequence
  SiRNA target sequence
  misc_feature (9)..(9): n is a, c, g, or t
tatggtggnaattatttaccc

SEQ ID NO: 12703 - DNA, 21 bp, Artificial sequence
  SiRNA target sequence
  misc_feature (8)..(8): n is a, c, g, or t
atggtggnaattatttaccct

SEQ ID NO: 12704 - DNA, 21 bp, Artificial sequence
  SiRNA target sequence
  misc_feature (7)..(7): n is a, c, g, or t
tggtggnaattatttaccctc

SEQ ID NO: 12705 - DNA, 21 bp, Artificial sequence
  SiRNA target sequence
  misc_feature (6)..(6): n is a, c, g, or t
ggtggnaattatttaccctcg

SEQ ID NO: 12706 - DNA, 21 bp, Artificial sequence
  SiRNA target sequence
  misc_feature (5)..(5): n is a, c, g, or t
gtggnaattatttaccctcgt

SEQ ID NO: 12707 - DNA, 21 bp, Artificial sequence
  SiRNA target sequence
  misc_feature (4)..(4): n is a, c, g, or t
tggnaattatttaccctcgtc

SEQ ID NO: 12708 - DNA, 21 bp, Artificial sequence
  SiRNA target sequence
  misc_feature (3)..(3): n is a, c, g, or t
ggnaattatttaccctcgtca

SEQ ID NO: 12709 - DNA, 21 bp, Artificial sequence
  SiRNA target sequence
  misc_feature (2)..(2): n is a, c, g, or t
gnaattatttaccctcgtcaa

SEQ ID NO: 12710 - DNA, 21 bp, Artificial sequence
  SiRNA target sequence
  misc_feature (1)..(1): n is a, c, g, or t
naattatttaccctcgtcaac

SEQ ID NO: 12711 - DNA, 21 bp, Artificial sequence
  SiRNA target sequence
aattatttaccctcgtcaact

SEQ ID NO: 12712 - DNA, 21 bp, Artificial sequence
  SiRNA target sequence
attatttaccctcgtcaactg

SEQ ID NO: 12713 - DNA, 21 bp, Artificial sequence
  SiRNA target sequence
ttatttaccctcgtcaactga

SEQ ID NO: 12714 - DNA, 21 bp, Artificial sequence
  SiRNA target sequence
tatttaccctcgtcaactgac

SEQ ID NO: 12715 - DNA, 21 bp, Artificial sequence
  SiRNA target sequence
atttaccctcgtcaactgacg

SEQ ID NO: 12716 - DNA, 21 bp, Artificial sequence
  SiRNA target sequence
tttaccctcgtcaactgacgc

SEQ ID NO: 12717 - DNA, 21 bp, Artificial sequence
  SiRNA target sequence
ttaccctcgtcaactgacgct

SEQ ID NO: 12718 - DNA, 21 bp, Artificial sequence
  SiRNA target sequence
taccctcgtcaactgacgctc

SEQ ID NO: 12719 - DNA, 21 bp, Artificial sequence
  SiRNA target sequence
accctcgtcaactgacgctcc

SEQ ID NO: 12720 - DNA, 21 bp, Artificial sequence
  SiRNA target sequence
ccctcgtcaactgacgctcct

SEQ ID NO: 12721 - DNA, 21 bp, Artificial sequence
  SiRNA target sequence
cctcgtcaactgacgctccta

SEQ ID NO: 12722 - DNA, 21 bp, Artificial sequence
  SiRNA target sequence
ctcgtcaactgacgctcctag

SEQ ID NO: 12723 - DNA, 21 bp, Artificial sequence
  SiRNA target sequence
tcgtcaactgacgctcctagt

SEQ ID NO: 12724 - DNA, 21 bp, Artificial sequence
  SiRNA target sequence
cgtcaactgacgctcctagta

SEQ ID NO: 12725 - DNA, 21 bp, Artificial sequence
  SiRNA target sequence
gtcaactgacgctcctagtac

SEQ ID NO: 12726 - DNA, 21 bp, Artificial sequence
  SiRNA target sequence
tcaactgacgctcctagtaca

SEQ ID NO: 12727 - DNA, 21 bp, Artificial sequence
  SiRNA target sequence
caactgacgctcctagtacat

SEQ ID NO: 12728 - DNA, 21 bp, Artificial sequence
  SiRNA target sequence
aactgacgctcctagtacatt

SEQ ID NO: 12729 - DNA, 21 bp, Artificial sequence
  SiRNA target sequence
actgacgctcctagtacatta

SEQ ID NO: 12730 - DNA, 21 bp, Artificial sequence
  SiRNA target sequence
ctgacgctcctagtacattat

SEQ ID NO: 12731 - DNA, 21 bp, Artificial sequence
  SiRNA target sequence
tgacgctcctagtacattatt

SEQ ID NO: 12732 - DNA, 21 bp, Artificial sequence
  SiRNA target sequence
gacgctcctagtacattattt

SEQ ID NO: 12733 - DNA, 21 bp, Artificial sequence
  SiRNA target sequence
acgctcctagtacattattta

SEQ ID NO: 12734 - DNA, 21 bp, Artificial sequence
  SiRNA target sequence
cgctcctagtacattatttat

SEQ ID NO: 12735 - DNA, 21 bp, Artificial sequence
  SiRNA target sequence
gctcctagtacattatttatg

SEQ ID NO: 12736 - DNA, 21 bp, Artificial sequence
  SiRNA target sequence
ctcctagtacattatttatgt

SEQ ID NO: 12737 - DNA, 21 bp, Artificial sequence
  SiRNA target sequence
tcctagtacattatttatgta

SEQ ID NO: 12738 - DNA, 21 bp, Artificial sequence
  SiRNA target sequence
cctagtacattatttatgtat

SEQ ID NO: 12739 - DNA, 21 bp, Artificial sequence
  SiRNA target sequence
ctagtacattatttatgtatg

SEQ ID NO: 12740 - DNA, 21 bp, Artificial sequence
  SiRNA target sequence
tagtacattatttatgtatgt

SEQ ID NO: 12741 - DNA, 21 bp, Artificial sequence
  SiRNA target sequence
  misc_feature (21)..(21): n is a, c, g, or t
agtacattatttatgtatgtn

SEQ ID NO: 12742 - DNA, 21 bp, Artificial sequence
  SiRNA target sequence
  misc_feature (20)..(20): n is a, c, g, or t
gtacattatttatgtatgtnc

SEQ ID NO: 12743 - DNA, 21 bp, Artificial sequence
  SiRNA target sequence
  misc_feature (19)..(19): n is a, c, g, or t
tacattatttatgtatgtnca

SEQ ID NO: 12744 - DNA, 21 bp, Artificial sequence
  SiRNA target sequence
  misc_feature (18)..(18): n is a, c, g, or t
acattatttatgtatgtncag

SEQ ID NO: 12745 - DNA, 21 bp, Artificial sequence
  SiRNA target sequence
  misc_feature (17)..(17): n is a, c, g, or t
cattatttatgtatgtncagg

SEQ ID NO: 12746 - DNA, 21 bp, Artificial sequence
  SiRNA target sequence
  misc_feature (16)..(16): n is a, c, g, or t
attatttatgtatgtncaggt

SEQ ID NO: 12747 - DNA, 21 bp, Artificial sequence
  SiRNA target sequence
  misc_feature (15)..(15): n is a, c, g, or t
  misc_feature (21)..(21): n is a, c, g, or t
ttatttatgtatgtncaggtn

SEQ ID NO: 12748 - DNA, 21 bp, Artificial sequence
  SiRNA target sequence
  misc_feature (14)..(14): n is a, c, g, or t
  misc_feature (20)..(20): n is a, c, g, or t
tatttatgtatgtncaggtnc

SEQ ID NO: 12749 - DNA, 21 bp, Artificial sequence
  SiRNA target sequence
  misc_feature (13)..(13): n is a, c, g, or t
  misc_feature (19)..(19): n is a, c, g, or t
atttatgtatgtncaggtncc

SEQ ID NO: 12750 - DNA, 21 bp, Artificial sequence
  SiRNA target sequence
  misc_feature (12)..(12): n is a, c, g, or t
  misc_feature (18)..(18): n is a, c, g, or t
  misc_feature (21)..(21): n is a, c, g, or t
tttatgtatgtncaggtnccn

SEQ ID NO: 12751 - DNA, 21 bp, Artificial sequence
  SiRNA target sequence
  misc_feature (11)..(11): n is a, c, g, or t
  misc_feature (17)..(17): n is a, c, g, or t
  misc_feature (20)..(20): n is a, c, g, or t
ttatgtatgtncaggtnccnt

SEQ ID NO: 12752 - DNA, 21 bp, Artificial sequence
  SiRNA target sequence
  misc_feature (10)..(10): n is a, c, g, or t
  misc_feature (16)..(16): n is a, c, g, or t
  misc_feature (19)..(19): n is a, c, g, or t
tatgtatgtncaggtnccntt

SEQ ID NO: 12753 - DNA, 21 bp, Artificial sequence
  SiRNA target sequence
  misc_feature (9)..(9): n is a, c, g, or t
  misc_feature (15)..(15): n is a, c, g, or t
  misc_feature (18)..(18): n is a, c, g, or t
atgtatgtncaggtnccnttg

SEQ ID NO: 12754 - DNA, 21 bp, Artificial sequence
  SiRNA target sequence
  misc_feature (8)..(8): n is a, c, g, or t
  misc_feature (14)..(14): n is a, c, g, or t
  misc_feature (17)..(17): n is a, c, g, or t
tgtatgtncaggtnccnttga

SEQ ID NO: 12755 - DNA, 21 bp, Artificial sequence
  SiRNA target sequence
  misc_feature (7)..(7): n is a, c, g, or t
  misc_feature (13)..(13): n is a, c, g, or t
  misc_feature (16)..(16): n is a, c, g, or t
gtatgtncaggtnccnttgat

SEQ ID NO: 12756 - DNA, 21 bp, Artificial sequence
  SiRNA target sequence
  misc_feature (6)..(6): n is a, c, g, or t
  misc_feature (12)..(12): n is a, c, g, or t
  misc_feature (15)..(15): n is a, c, g, or t
tatgtncaggtnccnttgata

SEQ ID NO: 12757 - DNA, 21 bp, Artificial sequence
  SiRNA target sequence
  misc_feature (5)..(5): n is a, c, g, or t
  misc_feature (11)..(11): n is a, c, g, or t
  misc_feature (14)..(14): n is a, c, g, or t
atgtncaggtnccnttgatac

SEQ ID NO: 12758 - DNA, 21 bp, Artificial sequence
  SiRNA target sequence
  misc_feature (4)..(4): n is a, c, g, or t
  misc_feature (10)..(10): n is a, c, g, or t
  misc_feature (13)..(13): n is a, c, g, or t
tgtncaggtnccnttgatacc

SEQ ID NO: 12759 - DNA, 21 bp, Artificial sequence
  SiRNA target sequence
  misc_feature (3)..(3): n is a, c, g, or t
  misc_feature (9)..(9): n is a, c, g, or t
  misc_feature (12)..(12): n is a, c, g, or t
gtncaggtnccnttgatacct

SEQ ID NO: 12760 - DNA, 21 bp, Artificial sequence
  SiRNA target sequence
  misc_feature (2)..(2): n is a, c, g, or t
  misc_feature (8)..(8): n is a, c, g, or t
  misc_feature (11)..(11): n is a, c, g, or t
tncaggtnccnttgataccta

SEQ ID NO: 12761 - DNA, 21 bp, Artificial sequence
  SiRNA target sequence
  misc_feature (1)..(1): n is a, c, g, or t
  misc_feature (7)..(7): n is a, c, g, or t
  misc_feature (10)..(10): n is a, c, g, or t
ncaggtnccnttgatacctat

SEQ ID NO: 12762 - DNA, 21 bp, Artificial sequence
  SiRNA target sequence
  misc_feature (6)..(6): n is a, c, g, or t
  misc_feature (9)..(9): n is a, c, g, or t
caggtnccnttgatacctatg

SEQ ID NO: 12763 - DNA, 21 bp, Artificial sequence
  SiRNA target sequence
  misc_feature (5)..(5): n is a, c, g, or t
  misc_feature (8)..(8): n is a, c, g, or t
aggtnccnttgatacctatgg

SEQ ID NO: 12764 - DNA, 21 bp, Artificial sequence
  SiRNA target sequence
  misc_feature (4)..(4): n is a, c, g, or t
  misc_feature (7)..(7): n is a, c, g, or t
ggtnccnttgatacctatgga

SEQ ID NO: 12765 - DNA, 21 bp, Artificial sequence
  SiRNA target sequence
  misc_feature (3)..(3): n is a, c, g, or t
  misc_feature (6)..(6): n is a, c, g, or t
gtnccnttgatacctatggaa

SEQ ID NO: 12766 - DNA, 21 bp, Artificial sequence
  SiRNA target sequence
  misc_feature (2)..(2): n is a, c, g, or t
  misc_feature (5)..(5): n is a, c, g, or t
tnccnttgatacctatggaag

SEQ ID NO: 12767 - DNA, 21 bp, Artificial sequence
  SiRNA target sequence
  misc_feature (1)..(1): n is a, c, g, or t
  misc_feature (4)..(4): n is a, c, g, or t
nccnttgatacctatggaagc

SEQ ID NO: 12768 - DNA, 21 bp, Artificial sequence
  SiRNA target sequence
  misc_feature (3)..(3): n is a, c, g, or t
ccnttgatacctatggaagct

SEQ ID NO: 12769 - DNA, 21 bp, Artificial sequence
  SiRNA target sequence
  misc_feature (2)..(2): n is a, c, g, or t
cnttgatacctatggaagctg

SEQ ID NO: 12770 - DNA, 21 bp, Artificial sequence
  SiRNA target sequence
  misc_feature (1)..(1): n is a, c, g, or t
nttgatacctatggaagctgt

SEQ ID NO: 12771 - DNA, 21 bp, Artificial sequence
  SiRNA target sequence
ttgatacctatggaagctgtt

SEQ ID NO: 12772 - DNA, 21 bp, Artificial sequence
  SiRNA target sequence
tgatacctatggaagctgttt

SEQ ID NO: 12773 - DNA, 21 bp, Artificial sequence
  SiRNA target sequence
gatacctatggaagctgtttc

SEQ ID NO: 12774 - DNA, 21 bp, Artificial sequence
  SiRNA target sequence
atacctatggaagctgtttca

SEQ ID NO: 12775 - DNA, 21 bp, Artificial sequence
  SiRNA target sequence
tacctatggaagctgtttcag

SEQ ID NO: 12776 - DNA, 21 bp, Artificial sequence
  SiRNA target sequence
acctatggaagctgtttcaga

SEQ ID NO: 12777 - DNA, 21 bp, Artificial sequence
  SiRNA target sequence
cctatggaagctgtttcagat

SEQ ID NO: 12778 - DNA, 21 bp, Artificial sequence
  SiRNA target sequence
ctatggaagctgtttcagata

SEQ ID NO: 12779 - DNA, 21 bp, Artificial sequence
  SiRNA target sequence
tatggaagctgtttcagatac

SEQ ID NO: 12780 - DNA, 21 bp, Artificial sequence
  SiRNA target sequence
atggaagctgtttcagatact

SEQ ID NO: 12781 - DNA, 21 bp, Artificial sequence
  SiRNA target sequence
tggaagctgtttcagatacta

SEQ ID NO: 12782 - DNA, 21 bp, Artificial sequence
  SiRNA target sequence
ggaagctgtttcagatactat

SEQ ID NO: 12783 - DNA, 21 bp, Artificial sequence
  SiRNA target sequence
gaagctgtttcagatactatt

SEQ ID NO: 12784 - DNA, 21 bp, Artificial sequence
  SiRNA target sequence
aagctgtttcagatactattg

SEQ ID NO: 12785 - DNA, 21 bp, Artificial sequence
  SiRNA target sequence
agctgtttcagatactattga

SEQ ID NO: 12786 - DNA, 21 bp, Artificial sequence
  SiRNA target sequence
gctgtttcagatactattgat

SEQ ID NO: 12787 - DNA, 21 bp, Artificial sequence
  SiRNA target sequence
ctgtttcagatactattgata

SEQ ID NO: 12788 - DNA, 21 bp, Artificial sequence
  SiRNA target sequence
tgtttcagatactattgatat

SEQ ID NO: 12789 - DNA, 21 bp, Artificial sequence
  SiRNA target sequence
gtttcagatactattgatatc

SEQ ID NO: 12790 - DNA, 21 bp, Artificial sequence
  SiRNA target sequence
tttcagatactattgatatca

SEQ ID NO: 12791 - DNA, 21 bp, Artificial sequence
  SiRNA target sequence
ttcagatactattgatatcaa

SEQ ID NO: 12792 - DNA, 21 bp, Artificial sequence
  SiRNA target sequence
tcagatactattgatatcaat

SEQ ID NO: 12793 - DNA, 21 bp, Artificial sequence
  SiRNA target sequence
cagatactattgatatcaatg

SEQ ID NO: 12794 - DNA, 21 bp, Artificial sequence
  SiRNA target sequence
agatactattgatatcaatgt

SEQ ID NO: 12795 - DNA, 21 bp, Artificial sequence
  SiRNA target sequence
gatactattgatatcaatgtg

SEQ ID NO: 12796 - DNA, 21 bp, Artificial sequence
  SiRNA target sequence
atactattgatatcaatgtgt

SEQ ID NO: 12797 - DNA, 21 bp, Artificial sequence
  SiRNA target sequence
tactattgatatcaatgtgta

SEQ ID NO: 12798 - DNA, 21 bp, Artificial sequence
  SiRNA target sequence
actattgatatcaatgtgtac

SEQ ID NO: 12799 - DNA, 21 bp, Artificial sequence
  SiRNA target sequence
ctattgatatcaatgtgtacg

SEQ ID NO: 12800 - DNA, 21 bp, Artificial sequence
  SiRNA target sequence
tattgatatcaatgtgtacgt

SEQ ID NO: 12801 - DNA, 21 bp, Artificial sequence
  SiRNA target sequence
attgatatcaatgtgtacgta

SEQ ID NO: 12802 - DNA, 21 bp, Artificial sequence
  SiRNA target sequence
ttgatatcaatgtgtacgtac

SEQ ID NO: 12803 - DNA, 21 bp, Artificial sequence
  SiRNA target sequence
tgatatcaatgtgtacgtacg

SEQ ID NO: 12804 - DNA, 21 bp, Artificial sequence
  SiRNA target sequence
gatatcaatgtgtacgtacgg

SEQ ID NO: 12805 - DNA, 21 bp, Artificial sequence
  SiRNA target sequence
atatcaatgtgtacgtacggg

SEQ ID NO: 12806 - DNA, 21 bp, Artificial sequence
  SiRNA target sequence
tatcaatgtgtacgtacgggg

SEQ ID NO: 12807 - DNA, 21 bp, Artificial sequence
  SiRNA target sequence
atcaatgtgtacgtacggggc

SEQ ID NO: 12808 - DNA, 21 bp, Artificial sequence
  SiRNA target sequence
tcaatgtgtacgtacggggcg

SEQ ID NO: 12809 - DNA, 21 bp, Artificial sequence
  SiRNA target sequence
caatgtgtacgtacggggcgg

SEQ ID NO: 12810 - DNA, 21 bp, Artificial sequence
  SiRNA target sequence
aatgtgtacgtacggggcggt

SEQ ID NO: 12811 - DNA, 21 bp, Artificial sequence
  SiRNA target sequence
atgtgtacgtacggggcggta

SEQ ID NO: 12812 - DNA, 21 bp, Artificial sequence
  SiRNA target sequence
tgtgtacgtacggggcggtag

SEQ ID NO: 12813 - DNA, 21 bp, Artificial sequence
  SiRNA target sequence
gtgtacgtacggggcggtagt

SEQ ID NO: 12814 - DNA, 21 bp, Artificial sequence
  SiRNA target sequence
tgtacgtacggggcggtagtt

SEQ ID NO: 12815 - DNA, 21 bp, Artificial sequence
  SiRNA target sequence
gtacgtacggggcggtagttc

SEQ ID NO: 12816 - DNA, 21 bp, Artificial sequence
  SiRNA target sequence
tacgtacggggcggtagttca

SEQ ID NO: 12817 - DNA, 21 bp, Artificial sequence
  SiRNA target sequence
acgtacggggcggtagttcat

SEQ ID NO: 12818 - DNA, 21 bp, Artificial sequence
  SiRNA target sequence
cgtacggggcggtagttcatt

SEQ ID NO: 12819 - DNA, 21 bp, Artificial sequence
  SiRNA target sequence
gtacggggcggtagttcattt

SEQ ID NO: 12820 - DNA, 21 bp, Artificial sequence
  SiRNA target sequence
tacggggcggtagttcatttg

SEQ ID NO: 12821 - DNA, 21 bp, Artificial sequence
  SiRNA target sequence
acggggcggtagttcatttga

SEQ ID NO: 12822 - DNA, 21 bp, Artificial sequence
  SiRNA target sequence
cggggcggtagttcatttgaa

SEQ ID NO: 12823 - DNA, 21 bp, Artificial sequence
  SiRNA target sequence
ggggcggtagttcatttgaag

SEQ ID NO: 12824 - DNA, 21 bp, Artificial sequence
  SiRNA target sequence
gggcggtagttcatttgaagt

SEQ ID NO: 12825 - DNA, 21 bp, Artificial sequence
  SiRNA target sequence
ggcggtagttcatttgaagtt

SEQ ID NO: 12826 - DNA, 21 bp, Artificial sequence
  SiRNA target sequence
gcggtagttcatttgaagttt

SEQ ID NO: 12827 - DNA, 21 bp, Artificial sequence
  SiRNA target sequence
cggtagttcatttgaagtttg

SEQ ID NO: 12828 - DNA, 21 bp, Artificial sequence
  SiRNA target sequence
ggtagttcatttgaagtttgt

SEQ ID NO: 12829 - DNA, 21 bp, Artificial sequence
  SiRNA target sequence
gtagttcatttgaagtttgtg

SEQ ID NO: 12830 - DNA, 21 bp, Artificial sequence
  SiRNA target sequence
tagttcatttgaagtttgtgt

SEQ ID NO: 12831 - DNA, 21 bp, Artificial sequence
  SiRNA target sequence
agttcatttgaagtttgtgtt

SEQ ID NO: 12832 - DNA, 21 bp, Artificial sequence
  SiRNA target sequence
gttcatttgaagtttgtgttc

SEQ ID NO: 12833 - DNA, 21 bp, Artificial sequence
  SiRNA target sequence
ttcatttgaagtttgtgttcc

SEQ ID NO: 12834 - DNA, 21 bp, Artificial sequence
  SiRNA target sequence
tcatttgaagtttgtgttcca

SEQ ID NO: 12835 - DNA, 21 bp, Artificial sequence
  SiRNA target sequence
catttgaagtttgtgttccag

SEQ ID NO: 12836 - DNA, 21 bp, Artificial sequence
  SiRNA target sequence
atttgaagtttgtgttccagt

SEQ ID NO: 12837 - DNA, 21 bp, Artificial sequence
  SiRNA target sequence
tttgaagtttgtgttccagtc

SEQ ID NO: 12838 - DNA, 21 bp, Artificial sequence
  SiRNA target sequence
ttgaagtttgtgttccagtcc

SEQ ID NO: 12839 - DNA, 21 bp, Artificial sequence
  SiRNA target sequence
tgaagtttgtgttccagtcca

SEQ ID NO: 12840 - DNA, 21 bp, Artificial sequence
  SiRNA target sequence
gaagtttgtgttccagtccaa

SEQ ID NO: 12841 - DNA, 21 bp, Artificial sequence
  SiRNA target sequence
aagtttgtgttccagtccaac

SEQ ID NO: 12842 - DNA, 21 bp, Artificial sequence
  SiRNA target sequence
agtttgtgttccagtccaacc

SEQ ID NO: 12843 - DNA, 21 bp, Artificial sequence
  SiRNA target sequence
gtttgtgttccagtccaacct

SEQ ID NO: 12844 - DNA, 21 bp, Artificial sequence
  SiRNA target sequence
tttgtgttccagtccaaccta

SEQ ID NO: 12845 - DNA, 21 bp, Artificial sequence
  SiRNA target sequence
ttgtgttccagtccaacctag

SEQ ID NO: 12846 - DNA, 21 bp, Artificial sequence
  SiRNA target sequence
tgtgttccagtccaacctagt

SEQ ID NO: 12847 - DNA, 21 bp, Artificial sequence
  SiRNA target sequence
gtgttccagtccaacctagtt

SEQ ID NO: 12848 - DNA, 21 bp, Artificial sequence
  SiRNA target sequence
tgttccagtccaacctagttt

SEQ ID NO: 12849 - DNA, 21 bp, Artificial sequence
  SiRNA target sequence
gttccagtccaacctagttta

SEQ ID NO: 12850 - DNA, 21 bp, Artificial sequence
  SiRNA target sequence
ttccagtccaacctagtttag

SEQ ID NO: 12851 - DNA, 21 bp, Artificial sequence
  SiRNA target sequence
tccagtccaacctagtttagg

SEQ ID NO: 12852 - DNA, 21 bp, Artificial sequence
  SiRNA target sequence
ccagtccaacctagtttaggt

SEQ ID NO: 12853 - DNA, 21 bp, Artificial sequence
  SiRNA target sequence
cagtccaacctagtttaggtt

SEQ ID NO: 12854 - DNA, 21 bp, Artificial sequence
  SiRNA target sequence
agtccaacctagtttaggttt

SEQ ID NO: 12855 - DNA, 21 bp, Artificial sequence
  SiRNA target sequence
gtccaacctagtttaggtttg

SEQ ID NO: 12856 - DNA, 21 bp, Artificial sequence
  SiRNA target sequence
tccaacctagtttaggtttga

SEQ ID NO: 12857 - DNA, 21 bp, Artificial sequence
  SiRNA target sequence
ccaacctagtttaggtttgaa

SEQ ID NO: 12858 - DNA, 21 bp, Artificial sequence
  SiRNA target sequence
caacctagtttaggtttgaat

SEQ ID NO: 12859 - DNA, 21 bp, Artificial sequence
  SiRNA target sequence
aacctagtttaggtttgaatt

SEQ ID NO: 12860 - DNA, 21 bp, Artificial sequence
  SiRNA target sequence
acctagtttaggtttgaattg

SEQ ID NO: 12861 - DNA, 21 bp, Artificial sequence
  SiRNA target sequence
cctagtttaggtttgaattgg

SEQ ID NO: 12862 - DNA, 21 bp, Artificial sequence
  SiRNA target sequence
ctagtttaggtttgaattgga

SEQ ID NO: 12863 - DNA, 21 bp, Artificial sequence
  SiRNA target sequence
tagtttaggtttgaattggaa

SEQ ID NO: 12864 - DNA, 21 bp, Artificial sequence
  SiRNA target sequence
agtttaggtttgaattggaat

SEQ ID NO: 12865 - DNA, 21 bp, Artificial sequence
  SiRNA target sequence
gtttaggtttgaattggaata

SEQ ID NO: 12866 - DNA, 21 bp, Artificial sequence
  SiRNA target sequence
tttaggtttgaattggaatac

SEQ ID NO: 12867 - DNA, 21 bp, Artificial sequence
  SiRNA target sequence
ttaggtttgaattggaataca

SEQ ID NO: 12868 - DNA, 21 bp, Artificial sequence
  SiRNA target sequence
taggtttgaattggaatacag

SEQ ID NO: 12869 - DNA, 21 bp, Artificial sequence
  SiRNA target sequence
aggtttgaattggaatacaga

SEQ ID NO: 12870 - DNA, 21 bp, Artificial sequence
  SiRNA target sequence
ggtttgaattggaatacagac

SEQ ID NO: 12871 - DNA, 21 bp, Artificial sequence
  SiRNA target sequence
gtttgaattggaatacagact

SEQ ID NO: 12872 - DNA, 21 bp, Artificial sequence
  SiRNA target sequence
tttgaattggaatacagactt

SEQ ID NO: 12873 - DNA, 21 bp, Artificial sequence
  SiRNA target sequence
ttgaattggaatacagacttt

SEQ ID NO: 12874 - DNA, 21 bp, Artificial sequence
  SiRNA target sequence
tgaattggaatacagacttta

SEQ ID NO: 12875 - DNA, 21 bp, Artificial sequence
  SiRNA target sequence
gaattggaatacagactttat

SEQ ID NO: 12876 - DNA, 21 bp, Artificial sequence
  SiRNA target sequence
aattggaatacagactttatt

SEQ ID NO: 12877 - DNA, 21 bp, Artificial sequence
  SiRNA target sequence
attggaatacagactttattt

SEQ ID NO: 12878 - DNA, 21 bp, Artificial sequence
  SiRNA target sequence
ttggaatacagactttatttt

SEQ ID NO: 12879 - DNA, 21 bp, Artificial sequence
  SiRNA target sequence
tggaatacagactttatttta

SEQ ID NO: 12880 - DNA, 21 bp, Artificial sequence
  SiRNA target sequence
ggaatacagactttattttac

SEQ ID NO: 12881 - DNA, 21 bp, Artificial sequence
  SiRNA target sequence
gaatacagactttattttacg

SEQ ID NO: 12882 - DNA, 21 bp, Artificial sequence
  SiRNA target sequence
aatacagactttattttacgt

SEQ ID NO: 12883 - DNA, 21 bp, Artificial sequence
  SiRNA target sequence
atacagactttattttacgta

SEQ ID NO: 12884 - DNA, 21 bp, Artificial sequence
  SiRNA target sequence
tacagactttattttacgtaa

SEQ ID NO: 12885 - DNA, 21 bp, Artificial sequence
  SiRNA target sequence
acagactttattttacgtaat

SEQ ID NO: 12886 - DNA, 21 bp, Artificial sequence
  SiRNA target sequence
cagactttattttacgtaatg

SEQ ID NO: 12887 - DNA, 21 bp, Artificial sequence
  SiRNA target sequence
agactttattttacgtaatga

SEQ ID NO: 12888 - DNA, 21 bp, Artificial sequence
  SiRNA target sequence
  misc_feature (21)..(21): n is a, c, g, or t
gactttattttacgtaatgan

SEQ ID NO: 12889 - DNA, 21 bp, Artificial sequence
  SiRNA target sequence
  misc_feature (20)..(20): n is a, c, g, or t
actttattttacgtaatgang

SEQ ID NO: 12890 - DNA, 21 bp, Artificial sequence
  SiRNA target sequence
  misc_feature (19)..(19): n is a, c, g, or t
ctttattttacgtaatganga

SEQ ID NO: 12891 - DNA, 21 bp, Artificial sequence
  SiRNA target sequence
  misc_feature (18)..(18): n is a, c, g, or t
tttattttacgtaatgangaa

SEQ ID NO: 12892 - DNA, 21 bp, Artificial sequence
  SiRNA target sequence
  misc_feature (17)..(17): n is a, c, g, or t
ttattttacgtaatgangaag

SEQ ID NO: 12893 - DNA, 21 bp, Artificial sequence
  SiRNA target sequence
  misc_feature (16)..(16): n is a, c, g, or t
tattttacgtaatgangaaga

SEQ ID NO: 12894 - DNA, 21 bp, Artificial sequence
  SiRNA target sequence
  misc_feature (15)..(15): n is a, c, g, or t
attttacgtaatgangaagaa

SEQ ID NO: 12895 - DNA, 21 bp, Artificial sequence
  SiRNA target sequence
  misc_feature (14)..(14): n is a, c, g, or t
ttttacgtaatgangaagaat

SEQ ID NO: 12896 - DNA, 21 bp, Artificial sequence
  SiRNA target sequence
  misc_feature (13)..(13): n is a, c, g, or t
tttacgtaatgangaagaata

SEQ ID NO: 12897 - DNA, 21 bp, Artificial sequence
  SiRNA target sequence
  misc_feature (12)..(12): n is a, c, g, or t
ttacgtaatgangaagaatac

SEQ ID NO: 12898 - DNA, 21 bp, Artificial sequence
  SiRNA target sequence
  misc_feature (11)..(11): n is a, c, g, or t
tacgtaatgangaagaataca

SEQ ID NO: 12899 - DNA, 21 bp, Artificial sequence
  SiRNA target sequence
  misc_feature (10)..(10): n is a, c, g, or t
acgtaatgangaagaatacag

SEQ ID NO: 12900 - DNA, 21 bp, Artificial sequence
  SiRNA target sequence
  misc_feature (9)..(9): n is a, c, g, or t
cgtaatgangaagaatacagg

SEQ ID NO: 12901 - DNA, 21 bp, Artificial sequence
  SiRNA target sequence
  misc_feature (8)..(8): n is a, c, g, or t
gtaatgangaagaatacaggg

SEQ ID NO: 12902 - DNA, 21 bp, Artificial sequence
  SiRNA target sequence
  misc_feature (7)..(7): n is a, c, g, or t
taatgangaagaatacagggc

SEQ ID NO: 12903 - DNA, 21 bp, Artificial sequence
  SiRNA target sequence
  misc_feature (6)..(6): n is a, c, g, or t
aatgangaagaatacagggct

SEQ ID NO: 12904 - DNA, 21 bp, Artificial sequence
  SiRNA target sequence
  misc_feature (5)..(5): n is a, c, g, or t
atgangaagaatacagggcta

SEQ ID NO: 12905 - DNA, 21 bp, Artificial sequence
  SiRNA target sequence
  misc_feature (4)..(4): n is a, c, g, or t
tgangaagaatacagggctaa

SEQ ID NO: 12906 - DNA, 21 bp, Artificial sequence
  SiRNA target sequence
  misc_feature (3)..(3): n is a, c, g, or t
gangaagaatacagggctaag

SEQ ID NO: 12907 - DNA, 21 bp, Artificial sequence
  SiRNA target sequence
  misc_feature (2)..(2): n is a, c, g, or t
angaagaatacagggctaaga

SEQ ID NO: 12908 - DNA, 21 bp, Artificial sequence
  SiRNA target sequence
  misc_feature (1)..(1): n is a, c, g, or t
ngaagaatacagggctaagac

SEQ ID NO: 12909 - DNA, 21 bp, Artificial sequence
  SiRNA target sequence
gaagaatacagggctaagaca

SEQ ID NO: 12910 - DNA, 21 bp, Artificial sequence
  SiRNA target sequence
aagaatacagggctaagacag

SEQ ID NO: 12911 - DNA, 21 bp, Artificial sequence
  SiRNA target sequence
agaatacagggctaagacagg

SEQ ID NO: 12912 - DNA, 21 bp, Artificial sequence
  SiRNA target sequence
gaatacagggctaagacaggt

SEQ ID NO: 12913 - DNA, 21 bp, Artificial sequence
  SiRNA target sequence
aatacagggctaagacaggtt

SEQ ID NO: 12914 - DNA, 21 bp, Artificial sequence
  SiRNA target sequence
atacagggctaagacaggtta

SEQ ID NO: 12915 - DNA, 21 bp, Artificial sequence
  SiRNA target sequence
tacagggctaagacaggttat

SEQ ID NO: 12916 - DNA, 21 bp, Artificial sequence
  SiRNA target sequence
acagggctaagacaggttatg

SEQ ID NO: 12917 - DNA, 21 bp, Artificial sequence
  SiRNA target sequence
cagggctaagacaggttatgc

SEQ ID NO: 12918 - DNA, 21 bp, Artificial sequence
  SiRNA target sequence
agggctaagacaggttatgca

SEQ ID NO: 12919 - DNA, 21 bp, Artificial sequence
  SiRNA target sequence
gggctaagacaggttatgcac

SEQ ID NO: 12920 - DNA, 21 bp, Artificial sequence
  SiRNA target sequence
ggctaagacaggttatgcacc

SEQ ID NO: 12921 - DNA, 21 bp, Artificial sequence
  SiRNA target sequence
gctaagacaggttatgcacca

SEQ ID NO: 12922 - DNA, 21 bp, Artificial sequence
  SiRNA target sequence
ctaagacaggttatgcaccat

SEQ ID NO: 12923 - DNA, 21 bp, Artificial sequence
  SiRNA target sequence
taagacaggttatgcaccata

SEQ ID NO: 12924 - DNA, 21 bp, Artificial sequence
  SiRNA target sequence
aagacaggttatgcaccatat

SEQ ID NO: 12925 - DNA, 21 bp, Artificial sequence
  SiRNA target sequence
agacaggttatgcaccatatt

SEQ ID NO: 12926 - DNA, 21 bp, Artificial sequence
  SiRNA target sequence
gacaggttatgcaccatatta

SEQ ID NO: 12927 - DNA, 21 bp, Artificial sequence
  SiRNA target sequence
acaggttatgcaccatattat

SEQ ID NO: 12928 - DNA, 21 bp, Artificial sequence
  SiRNA target sequence
caggttatgcaccatattatg

SEQ ID NO: 12929 - DNA, 21 bp, Artificial sequence
  SiRNA target sequence
aggttatgcaccatattatgc

SEQ ID NO: 12930 - DNA, 21 bp, Artificial sequence
  SiRNA target sequence
ggttatgcaccatattatgct

SEQ ID NO: 12931 - DNA, 21 bp, Artificial sequence
  SiRNA target sequence
gttatgcaccatattatgctg

SEQ ID NO: 12932 - DNA, 21 bp, Artificial sequence
  SiRNA target sequence
ttatgcaccatattatgctgg

SEQ ID NO: 12933 - DNA, 21 bp, Artificial sequence
  SiRNA target sequence
tatgcaccatattatgctgga

SEQ ID NO: 12934 - DNA, 21 bp, Artificial sequence
  SiRNA target sequence
atgcaccatattatgctggag

SEQ ID NO: 12935 - DNA, 21 bp, Artificial sequence
  SiRNA target sequence
tgcaccatattatgctggagt

SEQ ID NO: 12936 - DNA, 21 bp, Artificial sequence
  SiRNA target sequence
gcaccatattatgctggagtg

SEQ ID NO: 12937 - DNA, 21 bp, Artificial sequence
  SiRNA target sequence
caccatattatgctggagtgt

SEQ ID NO: 12938 - DNA, 21 bp, Artificial sequence
  SiRNA target sequence
accatattatgctggagtgtg

SEQ ID NO: 12939 - DNA, 21 bp, Artificial sequence
  SiRNA target sequence
ccatattatgctggagtgtgg

SEQ ID NO: 12940 - DNA, 21 bp, Artificial sequence
  SiRNA target sequence
catattatgctggagtgtggc

SEQ ID NO: 12941 - DNA, 21 bp, Artificial sequence
  SiRNA target sequence
atattatgctggagtgtggca

SEQ ID NO: 12942 - DNA, 21 bp, Artificial sequence
  SiRNA target sequence
tattatgctggagtgtggcat

SEQ ID NO: 12943 - DNA, 21 bp, Artificial sequence
  SiRNA target sequence
attatgctggagtgtggcata

SEQ ID NO: 12944 - DNA, 21 bp, Artificial sequence
  SiRNA target sequence
ttatgctggagtgtggcatag

SEQ ID NO: 12945 - DNA, 21 bp, Artificial sequence
  SiRNA target sequence
tatgctggagtgtggcatagc

SEQ ID NO: 12946 - DNA, 21 bp, Artificial sequence
  SiRNA target sequence
atgctggagtgtggcatagct

SEQ ID NO: 12947 - DNA, 21 bp, Artificial sequence
  SiRNA target sequence
tgctggagtgtggcatagctt

SEQ ID NO: 12948 - DNA, 21 bp, Artificial sequence
  SiRNA target sequence
gctggagtgtggcatagcttc

SEQ ID NO: 12949 - DNA, 21 bp, Artificial sequence
  SiRNA target sequence
ctggagtgtggcatagcttca

SEQ ID NO: 12950 - DNA, 21 bp, Artificial sequence
  SiRNA target sequence
tggagtgtggcatagcttcaa

SEQ ID NO: 12951 - DNA, 21 bp, Artificial sequence
  SiRNA target sequence
ggagtgtggcatagcttcaat

SEQ ID NO: 12952 - DNA, 21 bp, Artificial sequence
  SiRNA target sequence
gagtgtggcatagcttcaata

SEQ ID NO: 12953 - DNA, 21 bp, Artificial sequence
  SiRNA target sequence
agtgtggcatagcttcaataa

SEQ ID NO: 12954 - DNA, 21 bp, Artificial sequence
  SiRNA target sequence
gtgtggcatagcttcaataat

SEQ ID NO: 12955 - DNA, 21 bp, Artificial sequence
  SiRNA target sequence
tgtggcatagcttcaataata

SEQ ID NO: 12956 - DNA, 21 bp, Artificial sequence
  SiRNA target sequence
gtggcatagcttcaataatag

SEQ ID NO: 12957 - DNA, 21 bp, Artificial sequence
  SiRNA target sequence
tggcatagcttcaataatagt

SEQ ID NO: 12958 - DNA, 21 bp, Artificial sequence
  SiRNA target sequence
ggcatagcttcaataatagta

SEQ ID NO: 12959 - DNA, 21 bp, Artificial sequence
  SiRNA target sequence
gcatagcttcaataatagtaa

SEQ ID NO: 12960 - DNA, 21 bp, Artificial sequence
  SiRNA target sequence
catagcttcaataatagtaat

SEQ ID NO: 12961 - DNA, 21 bp, Artificial sequence
  SiRNA target sequence
atagcttcaataatagtaatt

SEQ ID NO: 12962 - DNA, 21 bp, Artificial sequence
  SiRNA target sequence
tagcttcaataatagtaattc

SEQ ID NO: 12963 - DNA, 21 bp, Artificial sequence
  SiRNA target sequence
agcttcaataatagtaattct

SEQ ID NO: 12964 - DNA, 21 bp, Artificial sequence
  SiRNA target sequence
gcttcaataatagtaattctc

SEQ ID NO: 12965 - DNA, 21 bp, Artificial sequence
  SiRNA target sequence
cttcaataatagtaattctct

SEQ ID NO: 12966 - DNA, 21 bp, Artificial sequence
  SiRNA target sequence
ttcaataatagtaattctctt

SEQ ID NO: 12967 - DNA, 21 bp, Artificial sequence
  SiRNA target sequence
tcaataatagtaattctcttg

SEQ ID NO: 12968 - DNA, 21 bp, Artificial sequence
  SiRNA target sequence
caataatagtaattctcttgt

SEQ ID NO: 12969 - DNA, 21 bp, Artificial sequence
  SiRNA target sequence
aataatagtaattctcttgtt

SEQ ID NO: 12970 - DNA, 21 bp, Artificial sequence
  SiRNA target sequence
ataatagtaattctcttgttt

SEQ ID NO: 12971 - DNA, 21 bp, Artificial sequence
  SiRNA target sequence
taatagtaattctcttgtttt

SEQ ID NO: 12972 - DNA, 21 bp, Artificial sequence
  SiRNA target sequence
aatagtaattctcttgttttt

SEQ ID NO: 12973 - DNA, 21 bp, Artificial sequence
  SiRNA target sequence
atagtaattctcttgttttta

SEQ ID NO: 12974 - DNA, 21 bp, Artificial sequence
  SiRNA target sequence
tagtaattctcttgtttttag

SEQ ID NO: 12975 - DNA, 21 bp, Artificial sequence
  SiRNA target sequence
agtaattctcttgtttttagg

SEQ ID NO: 12976 - DNA, 21 bp, Artificial sequence
  SiRNA target sequence
gtaattctcttgtttttaggt

SEQ ID NO: 12977 - DNA, 21 bp, Artificial sequence
  SiRNA target sequence
taattctcttgtttttaggtg

SEQ ID NO: 12978 - DNA, 21 bp, Artificial sequence
  SiRNA target sequence
aattctcttgtttttaggtgg

SEQ ID NO: 12979 - DNA, 21 bp, Artificial sequence
  SiRNA target sequence
attctcttgtttttaggtggg

SEQ ID NO: 12980 - DNA, 21 bp, Artificial sequence
  SiRNA target sequence
ttctcttgtttttaggtgggg

SEQ ID NO: 12981 - DNA, 21 bp, Artificial sequence
  SiRNA target sequence
tctcttgtttttaggtgggga

SEQ ID NO: 12982 - DNA, 21 bp, Artificial sequence
  SiRNA target sequence
ctcttgtttttaggtggggat

SEQ ID NO: 12983 - DNA, 21 bp, Artificial sequence
  SiRNA target sequence
tcttgtttttaggtggggatc

SEQ ID NO: 12984 - DNA, 21 bp, Artificial sequence
  SiRNA target sequence
cttgtttttaggtggggatct

SEQ ID NO: 12985 - DNA, 21 bp, Artificial sequence
  SiRNA target sequence
ttgtttttaggtggggatctg

SEQ ID NO: 12986 - DNA, 21 bp, Artificial sequence
  SiRNA target sequence
  misc_feature (21)..(21): n is a, c, g, or t
tgtttttaggtggggatctgn

SEQ ID NO: 12987 - DNA, 21 bp, Artificial sequence
  SiRNA target sequence
  misc_feature (20)..(20): n is a, c, g, or t
gtttttaggtggggatctgnt

SEQ ID NO: 12988 - DNA, 21 bp, Artificial sequence
  SiRNA target sequence
  misc_feature (19)..(19): n is a, c, g, or t
tttttaggtggggatctgntt

SEQ ID NO: 12989 - DNA, 21 bp, Artificial sequence
  SiRNA target sequence
  misc_feature (18)..(18): n is a, c, g, or t
ttttaggtggggatctgnttc

SEQ ID NO: 12990 - DNA, 21 bp, Artificial sequence
  SiRNA target sequence
  misc_feature (17)..(17): n is a, c, g, or t
tttaggtggggatctgnttcc

SEQ ID NO: 12991 - DNA, 21 bp, Artificial sequence
  SiRNA target sequence
  misc_feature (16)..(16): n is a, c, g, or t
ttaggtggggatctgnttccg

SEQ ID NO: 12992 - DNA, 21 bp, Artificial sequence
  SiRNA target sequence
  misc_feature (15)..(15): n is a, c, g, or t
taggtggggatctgnttccga

SEQ ID NO: 12993 - DNA, 21 bp, Artificial sequence
  SiRNA target sequence
  misc_feature (14)..(14): n is a, c, g, or t
  misc_feature (21)..(21): n is a, c, g, or t
aggtggggatctgnttccgan

SEQ ID NO: 12994 - DNA, 21 bp, Artificial sequence
  SiRNA target sequence
  misc_feature (13)..(13): n is a, c, g, or t
  misc_feature (20)..(20): n is a, c, g, or t
ggtggggatctgnttccganc

SEQ ID NO: 12995 - DNA, 21 bp, Artificial sequence
  SiRNA target sequence
  misc_feature (12)..(12): n is a, c, g, or t
  misc_feature (19)..(19): n is a, c, g, or t
gtggggatctgnttccganca

SEQ ID NO: 12996 - DNA, 21 bp, Artificial sequence
  SiRNA target sequence
  misc_feature (11)..(11): n is a, c, g, or t
  misc_feature (18)..(18): n is a, c, g, or t
tggggatctgnttccgancaa

SEQ ID NO: 12997 - DNA, 21 bp, Artificial sequence
  SiRNA target sequence
  misc_feature (10)..(10): n is a, c, g, or t
  misc_feature (17)..(17): n is a, c, g, or t
ggggatctgnttccgancaaa

SEQ ID NO: 12998 - DNA, 21 bp, Artificial sequence
  SiRNA target sequence
  misc_feature (9)..(9): n is a, c, g, or t
  misc_feature (16)..(16): n is a, c, g, or t
gggatctgnttccgancaaat

SEQ ID NO: 12999 - DNA, 21 bp, Artificial sequence
  SiRNA target sequence
  misc_feature (8)..(8): n is a, c, g, or t
  misc_feature (15)..(15): n is a, c, g, or t
ggatctgnttccgancaaatt

SEQ ID NO: 13000 - DNA, 21 bp, Artificial sequence
  SiRNA target sequence
  misc_feature (7)..(7): n is a, c, g, or t
  misc_feature (14)..(14): n is a, c, g, or t
gatctgnttccgancaaattg

SEQ ID NO: 13001 - DNA, 21 bp, Artificial sequence
  SiRNA target sequence
  misc_feature (6)..(6): n is a, c, g, or t
  misc_feature (13)..(13): n is a, c, g, or t
atctgnttccgancaaattgc

SEQ ID NO: 13002 - DNA, 21 bp, Artificial sequence
  SiRNA target sequence
  misc_feature (5)..(5): n is a, c, g, or t
  misc_feature (12)..(12): n is a, c, g, or t
tctgnttccgancaaattgct

SEQ ID NO: 13003 - DNA, 21 bp, Artificial sequence
  SiRNA target sequence
  misc_feature (4)..(4): n is a, c, g, or t
  misc_feature (11)..(11): n is a, c, g, or t
ctgnttccgancaaattgctc

SEQ ID NO: 13004 - DNA, 21 bp, Artificial sequence
  SiRNA target sequence
  misc_feature (3)..(3): n is a, c, g, or t
  misc_feature (10)..(10): n is a, c, g, or t
tgnttccgancaaattgctca

SEQ ID NO: 13005 - DNA, 21 bp, Artificial sequence
  SiRNA target sequence
  misc_feature (2)..(2): n is a, c, g, or t
  misc_feature (9)..(9): n is a, c, g, or t
gnttccgancaaattgctcag

SEQ ID NO: 13006 - DNA, 21 bp, Artificial sequence
  SiRNA target sequence
  misc_feature (1)..(1): n is a, c, g, or t
  misc_feature (8)..(8): n is a, c, g, or t
nttccgancaaattgctcagt

SEQ ID NO: 13007 - DNA, 21 bp, Artificial sequence
  SiRNA target sequence
  misc_feature (7)..(7): n is a, c, g, or t
ttccgancaaattgctcagtg

SEQ ID NO: 13008 - DNA, 21 bp, Artificial sequence
  SiRNA target sequence
  misc_feature (6)..(6): n is a, c, g, or t
tccgancaaattgctcagtgg

SEQ ID NO: 13009 - DNA, 21 bp, Artificial sequence
  SiRNA target sequence
  misc_feature (5)..(5): n is a, c, g, or t
ccgancaaattgctcagtggc

SEQ ID NO: 13010 - DNA, 21 bp, Artificial sequence
  SiRNA target sequence
  misc_feature (4)..(4): n is a, c, g, or t
cgancaaattgctcagtggcc

SEQ ID NO: 13011 - DNA, 21 bp, Artificial sequence
  SiRNA target sequence
  misc_feature (3)..(3): n is a, c, g, or t
gancaaattgctcagtggccg

SEQ ID NO: 13012 - DNA, 21 bp, Artificial sequence
  SiRNA target sequence
  misc_feature (2)..(2): n is a, c, g, or t
ancaaattgctcagtggccga

SEQ ID NO: 13013 - DNA, 21 bp, Artificial sequence
  SiRNA target sequence
  misc_feature (1)..(1): n is a, c, g, or t
ncaaattgctcagtggccgac

SEQ ID NO: 13014 - DNA, 21 bp, Artificial sequence
  SiRNA target sequence
caaattgctcagtggccgaca

SEQ ID NO: 13015 - DNA, 21 bp, Artificial sequence
  SiRNA target sequence
aaattgctcagtggccgacaa

SEQ ID NO: 13016 - DNA, 21 bp, Artificial sequence
  SiRNA target sequence
aattgctcagtggccgacaat

SEQ ID NO: 13017 - DNA, 21 bp, Artificial sequence
  SiRNA target sequence
attgctcagtggccgacaatt

SEQ ID NO: 13018 - DNA, 21 bp, Artificial sequence
  SiRNA target sequence
ttgctcagtggccgacaattt

SEQ ID NO: 13019 - DNA, 21 bp, Artificial sequence
  SiRNA target sequence
tgctcagtggccgacaatttc

SEQ ID NO: 13020 - DNA, 21 bp, Artificial sequence
  SiRNA target sequence
gctcagtggccgacaatttca

SEQ ID NO: 13021 - DNA, 21 bp, Artificial sequence
  SiRNA target sequence
ctcagtggccgacaatttcag

SEQ ID NO: 13022 - DNA, 21 bp, Artificial sequence
  SiRNA target sequence
tcagtggccgacaatttcagt

SEQ ID NO: 13023 - DNA, 21 bp, Artificial sequence
  SiRNA target sequence
cagtggccgacaatttcagta

SEQ ID NO: 13024 - DNA, 21 bp, Artificial sequence
  SiRNA target sequence
agtggccgacaatttcagtac

SEQ ID NO: 13025 - DNA, 21 bp, Artificial sequence
  SiRNA target sequence
gtggccgacaatttcagtacc

SEQ ID NO: 13026 - DNA, 21 bp, Artificial sequence
  SiRNA target sequence
tggccgacaatttcagtacca

SEQ ID NO: 13027 - DNA, 21 bp, Artificial sequence
  SiRNA target sequence
ggccgacaatttcagtaccaa

SEQ ID NO: 13028 - DNA, 21 bp, Artificial sequence
  SiRNA target sequence
gccgacaatttcagtaccaag

SEQ ID NO: 13029 - DNA, 21 bp, Artificial sequence
  SiRNA target sequence
ccgacaatttcagtaccaaga

SEQ ID NO: 13030 - DNA, 21 bp, Artificial sequence
  SiRNA target sequence
cgacaatttcagtaccaagag

SEQ ID NO: 13031 - DNA, 21 bp, Artificial sequence
  SiRNA target sequence
gacaatttcagtaccaagagg

SEQ ID NO: 13032 - DNA, 21 bp, Artificial sequence
  SiRNA target sequence
acaatttcagtaccaagaggt

SEQ ID NO: 13033 - DNA, 21 bp, Artificial sequence
  SiRNA target sequence
caatttcagtaccaagaggtg

SEQ ID NO: 13034 - DNA, 21 bp, Artificial sequence
  SiRNA target sequence
aatttcagtaccaagaggtga

SEQ ID NO: 13035 - DNA, 21 bp, Artificial sequence
  SiRNA target sequence
atttcagtaccaagaggtgag

SEQ ID NO: 13036 - DNA, 21 bp, Artificial sequence
  SiRNA target sequence
tttcagtaccaagaggtgagc

SEQ ID NO: 13037 - DNA, 21 bp, Artificial sequence
  SiRNA target sequence
ttcagtaccaagaggtgagct

SEQ ID NO: 13038 - DNA, 21 bp, Artificial sequence
  SiRNA target sequence
tcagtaccaagaggtgagcta

SEQ ID NO: 13039 - DNA, 21 bp, Artificial sequence
  SiRNA target sequence
cagtaccaagaggtgagctag

SEQ ID NO: 13040 - DNA, 21 bp, Artificial sequence
  SiRNA target sequence
agtaccaagaggtgagctagc

SEQ ID NO: 13041 - DNA, 21 bp, Artificial sequence
  SiRNA target sequence
gtaccaagaggtgagctagct

SEQ ID NO: 13042 - DNA, 21 bp, Artificial sequence
  SiRNA target sequence
taccaagaggtgagctagctt

SEQ ID NO: 13043 - DNA, 21 bp, Artificial sequence
  SiRNA target sequence
accaagaggtgagctagcttt

SEQ ID NO: 13044 - DNA, 21 bp, Artificial sequence
  SiRNA target sequence
ccaagaggtgagctagctttc

SEQ ID NO: 13045 - DNA, 21 bp, Artificial sequence
  SiRNA target sequence
caagaggtgagctagctttct

SEQ ID NO: 13046 - DNA, 21 bp, Artificial sequence
  SiRNA target sequence
aagaggtgagctagctttctt

SEQ ID NO: 13047 - DNA, 21 bp, Artificial sequence
  SiRNA target sequence
agaggtgagctagctttctta

SEQ ID NO: 13048 - DNA, 21 bp, Artificial sequence
  SiRNA target sequence
gaggtgagctagctttcttac

SEQ ID NO: 13049 - DNA, 21 bp, Artificial sequence
  SiRNA target sequence
aggtgagctagctttcttacg

SEQ ID NO: 13050 - DNA, 21 bp, Artificial sequence
  SiRNA target sequence
ggtgagctagctttcttacga

SEQ ID NO: 13051 - DNA, 21 bp, Artificial sequence
  SiRNA target sequence
gtgagctagctttcttacgaa

SEQ ID NO: 13052 - DNA, 21 bp, Artificial sequence
  SiRNA target sequence
tgagctagctttcttacgaat

SEQ ID NO: 13053 - DNA, 21 bp, Artificial sequence
  SiRNA target sequence
gagctagctttcttacgaatt

SEQ ID NO: 13054 - DNA, 21 bp, Artificial sequence
  SiRNA target sequence
agctagctttcttacgaatta

SEQ ID NO: 13055 - DNA, 21 bp, Artificial sequence
  SiRNA target sequence
gctagctttcttacgaattaa

SEQ ID NO: 13056 - DNA, 21 bp, Artificial sequence
  SiRNA target sequence
ctagctttcttacgaattaag

SEQ ID NO: 13057 - DNA, 21 bp, Artificial sequence
  SiRNA target sequence
tagctttcttacgaattaagg

SEQ ID NO: 13058 - DNA, 21 bp, Artificial sequence
  SiRNA target sequence
agctttcttacgaattaagga

SEQ ID NO: 13059 - DNA, 21 bp, Artificial sequence
  SiRNA target sequence
gctttcttacgaattaaggat

SEQ ID NO: 13060 - DNA, 21 bp, Artificial sequence
  SiRNA target sequence
ctttcttacgaattaaggatg

SEQ ID NO: 13061 - DNA, 21 bp, Artificial sequence
  SiRNA target sequence
tttcttacgaattaaggatgg

SEQ ID NO: 13062 - DNA, 21 bp, Artificial sequence
  SiRNA target sequence
ttcttacgaattaaggatgga

SEQ ID NO: 13063 - DNA, 21 bp, Artificial sequence
  SiRNA target sequence
tcttacgaattaaggatggaa

SEQ ID NO: 13064 - DNA, 21 bp, Artificial sequence
  SiRNA target sequence
cttacgaattaaggatggaaa

SEQ ID NO: 13065 - DNA, 21 bp, Artificial sequence
  SiRNA target sequence
ttacgaattaaggatggaaag

SEQ ID NO: 13066 - DNA, 21 bp, Artificial sequence
  SiRNA target sequence
tacgaattaaggatggaaagc

SEQ ID NO: 13067 - DNA, 21 bp, Artificial sequence
  SiRNA target sequence
acgaattaaggatggaaagca

SEQ ID NO: 13068 - DNA, 21 bp, Artificial sequence
  SiRNA target sequence
cgaattaaggatggaaagcaa

SEQ ID NO: 13069 - DNA, 21 bp, Artificial sequence
  SiRNA target sequence
gaattaaggatggaaagcaag

SEQ ID NO: 13070 - DNA, 21 bp, Artificial sequence
  SiRNA target sequence
aattaaggatggaaagcaagc

SEQ ID NO: 13071 - DNA, 21 bp, Artificial sequence
  SiRNA target sequence
attaaggatggaaagcaagct

SEQ ID NO: 13072 - DNA, 21 bp, Artificial sequence
  SiRNA target sequence
ttaaggatggaaagcaagctg

SEQ ID NO: 13073 - DNA, 21 bp, Artificial sequence
  SiRNA target sequence
taaggatggaaagcaagctgc

SEQ ID NO: 13074 - DNA, 21 bp, Artificial sequence
  SiRNA target sequence
aaggatggaaagcaagctgct

SEQ ID NO: 13075 - DNA, 21 bp, Artificial sequence
  SiRNA target sequence
aggatggaaagcaagctgctg

SEQ ID NO: 13076 - DNA, 21 bp, Artificial sequence
  SiRNA target sequence
ggatggaaagcaagctgctgt

SEQ ID NO: 13077 - DNA, 21 bp, Artificial sequence
  SiRNA target sequence
gatggaaagcaagctgctgta

SEQ ID NO: 13078 - DNA, 21 bp, Artificial sequence
  SiRNA target sequence
atggaaagcaagctgctgtag

SEQ ID NO: 13079 - DNA, 21 bp, Artificial sequence
  SiRNA target sequence
tggaaagcaagctgctgtagg

SEQ ID NO: 13080 - DNA, 21 bp, Artificial sequence
  SiRNA target sequence
ggaaagcaagctgctgtagga

SEQ ID NO: 13081 - DNA, 21 bp, Artificial sequence
  SiRNA target sequence
gaaagcaagctgctgtaggaa

SEQ ID NO: 13082 - DNA, 21 bp, Artificial sequence
  SiRNA target sequence
aaagcaagctgctgtaggaac

SEQ ID NO: 13083 - DNA, 21 bp, Artificial sequence
  SiRNA target sequence
  misc_feature (21)..(21): n is a, c, g, or t
aagcaagctgctgtaggaacn

SEQ ID NO: 13084 - DNA, 21 bp, Artificial sequence
  SiRNA target sequence
  misc_feature (20)..(20): n is a, c, g, or t
agcaagctgctgtaggaacnc

SEQ ID NO: 13085 - DNA, 21 bp, Artificial sequence
  SiRNA target sequence
  misc_feature (19)..(19): n is a, c, g, or t
gcaagctgctgtaggaacnca

SEQ ID NO: 13086 - DNA, 21 bp, Artificial sequence
  SiRNA target sequence
  misc_feature (18)..(18): n is a, c, g, or t
caagctgctgtaggaacncaa

SEQ ID NO: 13087 - DNA, 21 bp, Artificial sequence
  SiRNA target sequence
  misc_feature (17)..(17): n is a, c, g, or t
aagctgctgtaggaacncaac

SEQ ID NO: 13088 - DNA, 21 bp, Artificial sequence
  SiRNA target sequence
  misc_feature (16)..(16): n is a, c, g, or t
agctgctgtaggaacncaacc

SEQ ID NO: 13089 - DNA, 21 bp, Artificial sequence
  SiRNA target sequence
  misc_feature (15)..(15): n is a, c, g, or t
gctgctgtaggaacncaacct

SEQ ID NO: 13090 - DNA, 21 bp, Artificial sequence
  SiRNA target sequence
  misc_feature (14)..(14): n is a, c, g, or t
ctgctgtaggaacncaacctt

SEQ ID NO: 13091 - DNA, 21 bp, Artificial sequence
  SiRNA target sequence
  misc_feature (13)..(13): n is a, c, g, or t
tgctgtaggaacncaaccttg

SEQ ID NO: 13092 - DNA, 21 bp, Artificial sequence
  SiRNA target sequence
  misc_feature (12)..(12): n is a, c, g, or t
gctgtaggaacncaaccttgg

SEQ ID NO: 13093 - DNA, 21 bp, Artificial sequence
  SiRNA target sequence
  misc_feature (11)..(11): n is a, c, g, or t
ctgtaggaacncaaccttggc

SEQ ID NO: 13094 - DNA, 21 bp, Artificial sequence
  SiRNA target sequence
  misc_feature (10)..(10): n is a, c, g, or t
tgtaggaacncaaccttggcg

SEQ ID NO: 13095 - DNA, 21 bp, Artificial sequence
  SiRNA target sequence
  misc_feature (9)..(9): n is a, c, g, or t
gtaggaacncaaccttggcgt

SEQ ID NO: 13096 - DNA, 21 bp, Artificial sequence
  SiRNA target sequence
  misc_feature (8)..(8): n is a, c, g, or t
taggaacncaaccttggcgta

SEQ ID NO: 13097 - DNA, 21 bp, Artificial sequence
  SiRNA target sequence
  misc_feature (7)..(7): n is a, c, g, or t
aggaacncaaccttggcgtac

SEQ ID NO: 13098 - DNA, 21 bp, Artificial sequence
  SiRNA target sequence
  misc_feature (6)..(6): n is a, c, g, or t
ggaacncaaccttggcgtacg

SEQ ID NO: 13099 - DNA, 21 bp, Artificial sequence
  SiRNA target sequence
  misc_feature (5)..(5): n is a, c, g, or t
gaacncaaccttggcgtacga

SEQ ID NO: 13100 - DNA, 21 bp, Artificial sequence
  SiRNA target sequence
  misc_feature (4)..(4): n is a, c, g, or t
aacncaaccttggcgtacgat

SEQ ID NO: 13101 - DNA, 21 bp, Artificial sequence
  SiRNA target sequence
  misc_feature (3)..(3): n is a, c, g, or t
acncaaccttggcgtacgatg

SEQ ID NO: 13102 - DNA, 21 bp, Artificial sequence
  SiRNA target sequence
  misc_feature (2)..(2): n is a, c, g, or t
cncaaccttggcgtacgatgg

SEQ ID NO: 13103 - DNA, 21 bp, Artificial sequence
  SiRNA target sequence
  misc_feature (1)..(1): n is a, c, g, or t
ncaaccttggcgtacgatggt

SEQ ID NO: 13104 - DNA, 21 bp, Artificial sequence
  SiRNA target sequence
caaccttggcgtacgatggtt

SEQ ID NO: 13105 - DNA, 21 bp, Artificial sequence
  SiRNA target sequence
aaccttggcgtacgatggttg

SEQ ID NO: 13106 - DNA, 21 bp, Artificial sequence
  SiRNA target sequence
accttggcgtacgatggttgt

SEQ ID NO: 13107 - DNA, 21 bp, Artificial sequence
  SiRNA target sequence
ccttggcgtacgatggttgtt

SEQ ID NO: 13108 - DNA, 21 bp, Artificial sequence
  SiRNA target sequence
cttggcgtacgatggttgttt

SEQ ID NO: 13109 - DNA, 21 bp, Artificial sequence
  SiRNA target sequence
ttggcgtacgatggttgtttg

SEQ ID NO: 13110 - DNA, 21 bp, Artificial sequence
  SiRNA target sequence
tggcgtacgatggttgtttgg

SEQ ID NO: 13111 - DNA, 21 bp, Artificial sequence
  SiRNA target sequence
ggcgtacgatggttgtttggc

SEQ ID NO: 13112 - DNA, 21 bp, Artificial sequence
  SiRNA target sequence
gcgtacgatggttgtttggcc

SEQ ID NO: 13113 - DNA, 21 bp, Artificial sequence
  SiRNA target sequence
cgtacgatggttgtttggcct

SEQ ID NO: 13114 - DNA, 21 bp, Artificial sequence
  SiRNA target sequence
gtacgatggttgtttggcctt

SEQ ID NO: 13115 - DNA, 21 bp, Artificial sequence
  SiRNA target sequence
tacgatggttgtttggccttc

SEQ ID NO: 13116 - DNA, 21 bp, Artificial sequence
  SiRNA target sequence
acgatggttgtttggccttct

SEQ ID NO: 13117 - DNA, 21 bp, Artificial sequence
  SiRNA target sequence
cgatggttgtttggccttctg

SEQ ID NO: 13118 - DNA, 21 bp, Artificial sequence
  SiRNA target sequence
gatggttgtttggccttctgg

SEQ ID NO: 13119 - DNA, 21 bp, Artificial sequence
  SiRNA target sequence
  misc_feature (21)..(21): n is a, c, g, or t
atggttgtttggccttctggn

SEQ ID NO: 13120 - DNA, 21 bp, Artificial sequence
  SiRNA target sequence
  misc_feature (20)..(20): n is a, c, g, or t
tggttgtttggccttctggnc

SEQ ID NO: 13121 - DNA, 21 bp, Artificial sequence
  SiRNA target sequence
  misc_feature (19)..(19): n is a, c, g, or t
ggttgtttggccttctggnca

SEQ ID NO: 13122 - DNA, 21 bp, Artificial sequence
  SiRNA target sequence
  misc_feature (18)..(18): n is a, c, g, or t
gttgtttggccttctggncat

SEQ ID NO: 13123 - DNA, 21 bp, Artificial sequence
  SiRNA target sequence
  misc_feature (17)..(17): n is a, c, g, or t
ttgtttggccttctggncatg

SEQ ID NO: 13124 - DNA, 21 bp, Artificial sequence
  SiRNA target sequence
  misc_feature (16)..(16): n is a, c, g, or t
tgtttggccttctggncatgg

SEQ ID NO: 13125 - DNA, 21 bp, Artificial sequence
  SiRNA target sequence
  misc_feature (15)..(15): n is a, c, g, or t
gtttggccttctggncatggt

SEQ ID NO: 13126 - DNA, 21 bp, Artificial sequence
  SiRNA target sequence
  misc_feature (14)..(14): n is a, c, g, or t
tttggccttctggncatggtt

SEQ ID NO: 13127 - DNA, 21 bp, Artificial sequence
  SiRNA target sequence
  misc_feature (13)..(13): n is a, c, g, or t
ttggccttctggncatggtta

SEQ ID NO: 13128 - DNA, 21 bp, Artificial sequence
  SiRNA target sequence
  misc_feature (12)..(12): n is a, c, g, or t
tggccttctggncatggttat

SEQ ID NO: 13129 - DNA, 21 bp, Artificial sequence
  SiRNA target sequence
  misc_feature (11)..(11): n is a, c, g, or t
ggccttctggncatggttata

SEQ ID NO: 13130 - DNA, 21 bp, Artificial sequence
  SiRNA target sequence
  misc_feature (10)..(10): n is a, c, g, or t
gccttctggncatggttataa

SEQ ID NO: 13131 - DNA, 21 bp, Artificial sequence
  SiRNA target sequence
  misc_feature (9)..(9): n is a, c, g, or t
ccttctggncatggttataat

SEQ ID NO: 13132 - DNA, 21 bp, Artificial sequence
  SiRNA target sequence
  misc_feature (8)..(8): n is a, c, g, or t
cttctggncatggttataata

SEQ ID NO: 13133 - DNA, 21 bp, Artificial sequence
  SiRNA target sequence
  misc_feature (7)..(7): n is a, c, g, or t
ttctggncatggttataatat

SEQ ID NO: 13134 - DNA, 21 bp, Artificial sequence
  SiRNA target sequence
  misc_feature (6)..(6): n is a, c, g, or t
tctggncatggttataatatt

SEQ ID NO: 13135 - DNA, 21 bp, Artificial sequence
  SiRNA target sequence
  misc_feature (5)..(5): n is a, c, g, or t
ctggncatggttataatattg

SEQ ID NO: 13136 - DNA, 21 bp, Artificial sequence
  SiRNA target sequence
  misc_feature (4)..(4): n is a, c, g, or t
tggncatggttataatattgg

SEQ ID NO: 13137 - DNA, 21 bp, Artificial sequence
  SiRNA target sequence
  misc_feature (3)..(3): n is a, c, g, or t
ggncatggttataatattggt

SEQ ID NO: 13138 - DNA, 21 bp, Artificial sequence
  SiRNA target sequence
  misc_feature (2)..(2): n is a, c, g, or t
gncatggttataatattggta

SEQ ID NO: 13139 - DNA, 21 bp, Artificial sequence
  SiRNA target sequence
  misc_feature (1)..(1): n is a, c, g, or t
ncatggttataatattggtat

SEQ ID NO: 13140 - DNA, 21 bp, Artificial sequence
  SiRNA target sequence
catggttataatattggtata

SEQ ID NO: 13141 - DNA, 21 bp, Artificial sequence
  SiRNA target sequence
atggttataatattggtatac

SEQ ID NO: 13142 - DNA, 21 bp, Artificial sequence
  SiRNA target sequence
tggttataatattggtatacc

SEQ ID NO: 13143 - DNA, 21 bp, Artificial sequence
  SiRNA target sequence
ggttataatattggtatacct

SEQ ID NO: 13144 - DNA, 21 bp, Artificial sequence
  SiRNA target sequence
gttataatattggtataccta

SEQ ID NO: 13145 - DNA, 21 bp, Artificial sequence
  SiRNA target sequence
ttataatattggtatacctac

SEQ ID NO: 13146 - DNA, 21 bp, Artificial sequence
  SiRNA target sequence
tataatattggtatacctacg

SEQ ID NO: 13147 - DNA, 21 bp, Artificial sequence
  SiRNA target sequence
ataatattggtatacctacgt

SEQ ID NO: 13148 - DNA, 21 bp, Artificial sequence
  SiRNA target sequence
taatattggtatacctacgta

SEQ ID NO: 13149 - DNA, 21 bp, Artificial sequence
  SiRNA target sequence
aatattggtatacctacgtat

SEQ ID NO: 13150 - DNA, 21 bp, Artificial sequence
  SiRNA target sequence
atattggtatacctacgtata

SEQ ID NO: 13151 - DNA, 21 bp, Artificial sequence
  SiRNA target sequence
tattggtatacctacgtataa

SEQ ID NO: 13152 - DNA, 21 bp, Artificial sequence
  SiRNA target sequence
attggtatacctacgtataat

SEQ ID NO: 13153 - DNA, 21 bp, Artificial sequence
  SiRNA target sequence
ttggtatacctacgtataatg

SEQ ID NO: 13154 - DNA, 21 bp, Artificial sequence
  SiRNA target sequence
tggtatacctacgtataatgc

SEQ ID NO: 13155 - DNA, 21 bp, Artificial sequence
  SiRNA target sequence
ggtatacctacgtataatgct

SEQ ID NO: 13156 - DNA, 21 bp, Artificial sequence
  SiRNA target sequence
gtatacctacgtataatgctg

SEQ ID NO: 13157 - DNA, 21 bp, Artificial sequence
  SiRNA target sequence
tatacctacgtataatgctga

SEQ ID NO: 13158 - DNA, 21 bp, Artificial sequence
  SiRNA target sequence
atacctacgtataatgctgaa

SEQ ID NO: 13159 - DNA, 21 bp, Artificial sequence
  SiRNA target sequence
tacctacgtataatgctgaac

SEQ ID NO: 13160 - DNA, 21 bp, Artificial sequence
  SiRNA target sequence
acctacgtataatgctgaacg

SEQ ID NO: 13161 - DNA, 21 bp, Artificial sequence
  SiRNA target sequence
cctacgtataatgctgaacga

SEQ ID NO: 13162 - DNA, 21 bp, Artificial sequence
  SiRNA target sequence
ctacgtataatgctgaacgag

SEQ ID NO: 13163 - DNA, 21 bp, Artificial sequence
  SiRNA target sequence
tacgtataatgctgaacgagc

SEQ ID NO: 13164 - DNA, 21 bp, Artificial sequence
  SiRNA target sequence
acgtataatgctgaacgagct

SEQ ID NO: 13165 - DNA, 21 bp, Artificial sequence
  SiRNA target sequence
cgtataatgctgaacgagctc

SEQ ID NO: 13166 - DNA, 21 bp, Artificial sequence
  SiRNA target sequence
gtataatgctgaacgagctcg

SEQ ID NO: 13167 - DNA, 21 bp, Artificial sequence
  SiRNA target sequence
tataatgctgaacgagctcgc

SEQ ID NO: 13168 - DNA, 21 bp, Artificial sequence
  SiRNA target sequence
ataatgctgaacgagctcgcc

SEQ ID NO: 13169 - DNA, 21 bp, Artificial sequence
  SiRNA target sequence
taatgctgaacgagctcgcca

SEQ ID NO: 13170 - DNA, 21 bp, Artificial sequence
  SiRNA target sequence
aatgctgaacgagctcgccag

SEQ ID NO: 13171 - DNA, 21 bp, Artificial sequence
  SiRNA target sequence
atgctgaacgagctcgccagc

SEQ ID NO: 13172 - DNA, 21 bp, Artificial sequence
  SiRNA target sequence
tgctgaacgagctcgccagct

SEQ ID NO: 13173 - DNA, 21 bp, Artificial sequence
  SiRNA target sequence
gctgaacgagctcgccagctt

SEQ ID NO: 13174 - DNA, 21 bp, Artificial sequence
  SiRNA target sequence
ctgaacgagctcgccagcttg

SEQ ID NO: 13175 - DNA, 21 bp, Artificial sequence
  SiRNA target sequence
tgaacgagctcgccagcttgc

SEQ ID NO: 13176 - DNA, 21 bp, Artificial sequence
  SiRNA target sequence
gaacgagctcgccagcttgca

SEQ ID NO: 13177 - DNA, 21 bp, Artificial sequence
  SiRNA target sequence
aacgagctcgccagcttgcac

SEQ ID NO: 13178 - DNA, 21 bp, Artificial sequence
  SiRNA target sequence
acgagctcgccagcttgcaca

SEQ ID NO: 13179 - DNA, 21 bp, Artificial sequence
  SiRNA target sequence
cgagctcgccagcttgcacaa

SEQ ID NO: 13180 - DNA, 21 bp, Artificial sequence
  SiRNA target sequence
gagctcgccagcttgcacaac

SEQ ID NO: 13181 - DNA, 21 bp, Artificial sequence
  SiRNA target sequence
agctcgccagcttgcacaaca

SEQ ID NO: 13182 - DNA, 21 bp, Artificial sequence
  SiRNA target sequence
gctcgccagcttgcacaacac

SEQ ID NO: 13183 - DNA, 21 bp, Artificial sequence
  SiRNA target sequence
ctcgccagcttgcacaacact

SEQ ID NO: 13184 - DNA, 21 bp, Artificial sequence
  SiRNA target sequence
tcgccagcttgcacaacactt

SEQ ID NO: 13185 - DNA, 21 bp, Artificial sequence
  SiRNA target sequence
cgccagcttgcacaacactta

SEQ ID NO: 13186 - DNA, 21 bp, Artificial sequence
  SiRNA target sequence
gccagcttgcacaacacttat

SEQ ID NO: 13187 - DNA, 21 bp, Artificial sequence
  SiRNA target sequence
ccagcttgcacaacacttata

SEQ ID NO: 13188 - DNA, 21 bp, Artificial sequence
  SiRNA target sequence
cagcttgcacaacacttatat

SEQ ID NO: 13189 - DNA, 21 bp, Artificial sequence
  SiRNA target sequence
agcttgcacaacacttatatg

SEQ ID NO: 13190 - DNA, 21 bp, Artificial sequence
  SiRNA target sequence
gcttgcacaacacttatatgg

SEQ ID NO: 13191 - DNA, 21 bp, Artificial sequence
  SiRNA target sequence
cttgcacaacacttatatggt

SEQ ID NO: 13192 - DNA, 21 bp, Artificial sequence
  SiRNA target sequence
ttgcacaacacttatatggtg

SEQ ID NO: 13193 - DNA, 21 bp, Artificial sequence
  SiRNA target sequence
tgcacaacacttatatggtgg

SEQ ID NO: 13194 - DNA, 21 bp, Artificial sequence
  SiRNA target sequence
gcacaacacttatatggtggt

SEQ ID NO: 13195 - DNA, 21 bp, Artificial sequence
  SiRNA target sequence
cacaacacttatatggtggtg

SEQ ID NO: 13196 - DNA, 21 bp, Artificial sequence
  SiRNA target sequence
acaacacttatatggtggtgg

SEQ ID NO: 13197 - DNA, 21 bp, Artificial sequence
  SiRNA target sequence
caacacttatatggtggtgga

SEQ ID NO: 13198 - DNA, 21 bp, Artificial sequence
  SiRNA target sequence
aacacttatatggtggtggat

SEQ ID NO: 13199 - DNA, 21 bp, Artificial sequence
  SiRNA target sequence
acacttatatggtggtggatc

SEQ ID NO: 13200 - DNA, 21 bp, Artificial sequence
  SiRNA target sequence
cacttatatggtggtggatca

SEQ ID NO: 13201 - DNA, 21 bp, Artificial sequence
  SiRNA target sequence
acttatatggtggtggatcat

SEQ ID NO: 13202 - DNA, 21 bp, Artificial sequence
  SiRNA target sequence
cttatatggtggtggatcatt

SEQ ID NO: 13203 - DNA, 21 bp, Artificial sequence
  SiRNA target sequence
ttatatggtggtggatcatta

SEQ ID NO: 13204 - DNA, 21 bp, Artificial sequence
  SiRNA target sequence
tatatggtggtggatcattaa

SEQ ID NO: 13205 - DNA, 21 bp, Artificial sequence
  SiRNA target sequence
atatggtggtggatcattaac

SEQ ID NO: 13206 - DNA, 21 bp, Artificial sequence
  SiRNA target sequence
tatggtggtggatcattaact

SEQ ID NO: 13207 - DNA, 21 bp, Artificial sequence
  SiRNA target sequence
atggtggtggatcattaactg

SEQ ID NO: 13208 - DNA, 21 bp, Artificial sequence
  SiRNA target sequence
tggtggtggatcattaactga

SEQ ID NO: 13209 - DNA, 21 bp, Artificial sequence
  SiRNA target sequence
ggtggtggatcattaactgat

SEQ ID NO: 13210 - DNA, 21 bp, Artificial sequence
  SiRNA target sequence
gtggtggatcattaactgatg

SEQ ID NO: 13211 - DNA, 21 bp, Artificial sequence
  SiRNA target sequence
tggtggatcattaactgatga

SEQ ID NO: 13212 - DNA, 21 bp, Artificial sequence
  SiRNA target sequence
ggtggatcattaactgatgag

SEQ ID NO: 13213 - DNA, 21 bp, Artificial sequence
  SiRNA target sequence
gtggatcattaactgatgaga

SEQ ID NO: 13214 - DNA, 21 bp, Artificial sequence
  SiRNA target sequence
tggatcattaactgatgagaa

SEQ ID NO: 13215 - DNA, 21 bp, Artificial sequence
  SiRNA target sequence
ggatcattaactgatgagaag

SEQ ID NO: 13216 - DNA, 21 bp, Artificial sequence
  SiRNA target sequence
gatcattaactgatgagaagg

SEQ ID NO: 13217 - DNA, 21 bp, Artificial sequence
  SiRNA target sequence
atcattaactgatgagaaggc

SEQ ID NO: 13218 - DNA, 21 bp, Artificial sequence
  SiRNA target sequence
tcattaactgatgagaaggcc

SEQ ID NO: 13219 - DNA, 21 bp, Artificial sequence
  SiRNA target sequence
cattaactgatgagaaggcca

SEQ ID NO: 13220 - DNA, 21 bp, Artificial sequence
  SiRNA target sequence
attaactgatgagaaggccaa

SEQ ID NO: 13221 - DNA, 21 bp, Artificial sequence
  SiRNA target sequence
ttaactgatgagaaggccaaa

SEQ ID NO: 13222 - DNA, 21 bp, Artificial sequence
  SiRNA target sequence
taactgatgagaaggccaaac

SEQ ID NO: 13223 - DNA, 21 bp, Artificial sequence
  SiRNA target sequence
aactgatgagaaggccaaaca

SEQ ID NO: 13224 - DNA, 21 bp, Artificial sequence
  SiRNA target sequence
actgatgagaaggccaaacaa

SEQ ID NO: 13225 - DNA, 21 bp, Artificial sequence
  SiRNA target sequence
ctgatgagaaggccaaacaat

SEQ ID NO: 13226 - DNA, 21 bp, Artificial sequence
  SiRNA target sequence
tgatgagaaggccaaacaatt

SEQ ID NO: 13227 - DNA, 21 bp, Artificial sequence
  SiRNA target sequence
gatgagaaggccaaacaatta

SEQ ID NO: 13228 - DNA, 21 bp, Artificial sequence
  SiRNA target sequence
atgagaaggccaaacaattat

SEQ ID NO: 13229 - DNA, 21 bp, Artificial sequence
  SiRNA target sequence
tgagaaggccaaacaattatt

SEQ ID NO: 13230 - DNA, 21 bp, Artificial sequence
  SiRNA target sequence
gagaaggccaaacaattattt

SEQ ID NO: 13231 - DNA, 21 bp, Artificial sequence
  SiRNA target sequence
agaaggccaaacaattatttg

SEQ ID NO: 13232 - DNA, 21 bp, Artificial sequence
  SiRNA target sequence
gaaggccaaacaattatttgt

SEQ ID NO: 13233 - DNA, 21 bp, Artificial sequence
  SiRNA target sequence
aaggccaaacaattatttgtt

SEQ ID NO: 13234 - DNA, 21 bp, Artificial sequence
  SiRNA target sequence
aggccaaacaattatttgttc

SEQ ID NO: 13235 - DNA, 21 bp, Artificial sequence
  SiRNA target sequence
ggccaaacaattatttgttcc

SEQ ID NO: 13236 - DNA, 21 bp, Artificial sequence
  SiRNA target sequence
gccaaacaattatttgttcct

SEQ ID NO: 13237 - DNA, 21 bp, Artificial sequence
  SiRNA target sequence
ccaaacaattatttgttcctg

SEQ ID NO: 13238 - DNA, 21 bp, Artificial sequence
  SiRNA target sequence
caaacaattatttgttcctgc

SEQ ID NO: 13239 - DNA, 21 bp, Artificial sequence
  SiRNA target sequence
aaacaattatttgttcctgct

SEQ ID NO: 13240 - DNA, 21 bp, Artificial sequence
  SiRNA target sequence
aacaattatttgttcctgcta

SEQ ID NO: 13241 - DNA, 21 bp, Artificial sequence
  SiRNA target sequence
acaattatttgttcctgctaa

SEQ ID NO: 13242 - DNA, 21 bp, Artificial sequence
  SiRNA target sequence
caattatttgttcctgctaat

SEQ ID NO: 13243 - DNA, 21 bp, Artificial sequence
  SiRNA target sequence
aattatttgttcctgctaatc

SEQ ID NO: 13244 - DNA, 21 bp, Artificial sequence
  SiRNA target sequence
attatttgttcctgctaatca

SEQ ID NO: 13245 - DNA, 21 bp, Artificial sequence
  SiRNA target sequence
ttatttgttcctgctaatcaa

SEQ ID NO: 13246 - DNA, 21 bp, Artificial sequence
  SiRNA target sequence
tatttgttcctgctaatcaac

SEQ ID NO: 13247 - DNA, 21 bp, Artificial sequence
  SiRNA target sequence
atttgttcctgctaatcaaca

SEQ ID NO: 13248 - DNA, 21 bp, Artificial sequence
  SiRNA target sequence
tttgttcctgctaatcaacaa

SEQ ID NO: 13249 - DNA, 21 bp, Artificial sequence
  SiRNA target sequence
ttgttcctgctaatcaacaag

SEQ ID NO: 13250 - DNA, 21 bp, Artificial sequence
  SiRNA target sequence
tgttcctgctaatcaacaagg

SEQ ID NO: 13251 - DNA, 21 bp, Artificial sequence
  SiRNA target sequence
gttcctgctaatcaacaagga

SEQ ID NO: 13252 - DNA, 21 bp, Artificial sequence
  SiRNA target sequence
ttcctgctaatcaacaaggac

SEQ ID NO: 13253 - DNA, 21 bp, Artificial sequence
  SiRNA target sequence
tcctgctaatcaacaaggacc

SEQ ID NO: 13254 - DNA, 21 bp, Artificial sequence
  SiRNA target sequence
cctgctaatcaacaaggacct

SEQ ID NO: 13255 - DNA, 21 bp, Artificial sequence
  SiRNA target sequence
ctgctaatcaacaaggacctg

SEQ ID NO: 13256 - DNA, 21 bp, Artificial sequence
  SiRNA target sequence
tgctaatcaacaaggacctgg

SEQ ID NO: 13257 - DNA, 21 bp, Artificial sequence
  SiRNA target sequence
gctaatcaacaaggacctggt

SEQ ID NO: 13258 - DNA, 21 bp, Artificial sequence
  SiRNA target sequence
ctaatcaacaaggacctggta

SEQ ID NO: 13259 - DNA, 21 bp, Artificial sequence
  SiRNA target sequence
taatcaacaaggacctggtaa

SEQ ID NO: 13260 - DNA, 21 bp, Artificial sequence
  SiRNA target sequence
aatcaacaaggacctggtaag

SEQ ID NO: 13261 - DNA, 21 bp, Artificial sequence
  SiRNA target sequence
atcaacaaggacctggtaagg

SEQ ID NO: 13262 - DNA, 21 bp, Artificial sequence
  SiRNA target sequence
tcaacaaggacctggtaaggt

SEQ ID NO: 13263 - DNA, 21 bp, Artificial sequence
  SiRNA target sequence
caacaaggacctggtaaggta

SEQ ID NO: 13264 - DNA, 21 bp, Artificial sequence
  SiRNA target sequence
aacaaggacctggtaaggtaa

SEQ ID NO: 13265 - DNA, 21 bp, Artificial sequence
  SiRNA target sequence
acaaggacctggtaaggtaag

SEQ ID NO: 13266 - DNA, 21 bp, Artificial sequence
  SiRNA target sequence
caaggacctggtaaggtaagt

SEQ ID NO: 13267 - DNA, 21 bp, Artificial sequence
  SiRNA target sequence
aaggacctggtaaggtaagta

SEQ ID NO: 13268 - DNA, 21 bp, Artificial sequence
  SiRNA target sequence
aggacctggtaaggtaagtaa

SEQ ID NO: 13269 - DNA, 21 bp, Artificial sequence
  SiRNA target sequence
ggacctggtaaggtaagtaat

SEQ ID NO: 13270 - DNA, 21 bp, Artificial sequence
  SiRNA target sequence
gacctggtaaggtaagtaatg

SEQ ID NO: 13271 - DNA, 21 bp, Artificial sequence
  SiRNA target sequence
acctggtaaggtaagtaatgg

SEQ ID NO: 13272 - DNA, 21 bp, Artificial sequence
  SiRNA target sequence
cctggtaaggtaagtaatgga

SEQ ID NO: 13273 - DNA, 21 bp, Artificial sequence
  SiRNA target sequence
ctggtaaggtaagtaatggaa

SEQ ID NO: 13274 - DNA, 21 bp, Artificial sequence
  SiRNA target sequence
tggtaaggtaagtaatggaaa

SEQ ID NO: 13275 - DNA, 21 bp, Artificial sequence
  SiRNA target sequence
ggtaaggtaagtaatggaaat

SEQ ID NO: 13276 - DNA, 21 bp, Artificial sequence
  SiRNA target sequence
gtaaggtaagtaatggaaatc

SEQ ID NO: 13277 - DNA, 21 bp, Artificial sequence
  SiRNA target sequence
taaggtaagtaatggaaatcc

SEQ ID NO: 13278 - DNA, 21 bp, Artificial sequence
  SiRNA target sequence
aaggtaagtaatggaaatccg

SEQ ID NO: 13279 - DNA, 21 bp, Artificial sequence
  SiRNA target sequence
aggtaagtaatggaaatccgg

SEQ ID NO: 13280 - DNA, 21 bp, Artificial sequence
  SiRNA target sequence
ggtaagtaatggaaatccggt

SEQ ID NO: 13281 - DNA, 21 bp, Artificial sequence
  SiRNA target sequence
gtaagtaatggaaatccggta

SEQ ID NO: 13282 - DNA, 21 bp, Artificial sequence
  SiRNA target sequence
taagtaatggaaatccggtat

SEQ ID NO: 13283 - DNA, 21 bp, Artificial sequence
  SiRNA target sequence
aagtaatggaaatccggtatg

SEQ ID NO: 13284 - DNA, 21 bp, Artificial sequence
  SiRNA target sequence
agtaatggaaatccggtatgg

SEQ ID NO: 13285 - DNA, 21 bp, Artificial sequence
  SiRNA target sequence
gtaatggaaatccggtatggg

SEQ ID NO: 13286 - DNA, 21 bp, Artificial sequence
  SiRNA target sequence
taatggaaatccggtatggga

SEQ ID NO: 13287 - DNA, 21 bp, Artificial sequence
  SiRNA target sequence
aatggaaatccggtatgggaa

SEQ ID NO: 13288 - DNA, 21 bp, Artificial sequence
  SiRNA target sequence
atggaaatccggtatgggaag

SEQ ID NO: 13289 - DNA, 21 bp, Artificial sequence
  SiRNA target sequence
tggaaatccggtatgggaagt

SEQ ID NO: 13290 - DNA, 21 bp, Artificial sequence
  SiRNA target sequence
ggaaatccggtatgggaagtc

SEQ ID NO: 13291 - DNA, 21 bp, Artificial sequence
  SiRNA target sequence
gaaatccggtatgggaagtca

SEQ ID NO: 13292 - DNA, 21 bp, Artificial sequence
  SiRNA target sequence
aaatccggtatgggaagtcat

SEQ ID NO: 13293 - DNA, 21 bp, Artificial sequence
  SiRNA target sequence
aatccggtatgggaagtcatg

SEQ ID NO: 13294 - DNA, 21 bp, Artificial sequence
  SiRNA target sequence
atccggtatgggaagtcatgc

SEQ ID NO: 13295 - DNA, 21 bp, Artificial sequence
  SiRNA target sequence
tccggtatgggaagtcatgcg

SEQ ID NO: 13296 - DNA, 21 bp, Artificial sequence
  SiRNA target sequence
ccggtatgggaagtcatgcgt

SEQ ID NO: 13297 - DNA, 21 bp, Artificial sequence
  SiRNA target sequence
cggtatgggaagtcatgcgtg

SEQ ID NO: 13298 - DNA, 21 bp, Artificial sequence
  SiRNA target sequence
ggtatgggaagtcatgcgtgc

SEQ ID NO: 13299 - DNA, 21 bp, Artificial sequence
  SiRNA target sequence
gtatgggaagtcatgcgtgca

SEQ ID NO: 13300 - DNA, 21 bp, Artificial sequence
  SiRNA target sequence
tatgggaagtcatgcgtgcac

SEQ ID NO: 13301 - DNA, 21 bp, Artificial sequence
  SiRNA target sequence
atgggaagtcatgcgtgcacc

SEQ ID NO: 13302 - DNA, 21 bp, Artificial sequence
  SiRNA target sequence
tgggaagtcatgcgtgcacca

SEQ ID NO: 13303 - DNA, 21 bp, Artificial sequence
  SiRNA target sequence
gggaagtcatgcgtgcaccat

SEQ ID NO: 13304 - DNA, 21 bp, Artificial sequence
  SiRNA target sequence
ggaagtcatgcgtgcaccatt

SEQ ID NO: 13305 - DNA, 21 bp, Artificial sequence
  SiRNA target sequence
gaagtcatgcgtgcaccattg

SEQ ID NO: 13306 - DNA, 21 bp, Artificial sequence
  SiRNA target sequence
aagtcatgcgtgcaccattgg

SEQ ID NO: 13307 - DNA, 21 bp, Artificial sequence
  SiRNA target sequence
agtcatgcgtgcaccattggc

SEQ ID NO: 13308 - DNA, 21 bp, Artificial sequence
  SiRNA target sequence
gtcatgcgtgcaccattggca

SEQ ID NO: 13309 - DNA, 21 bp, Artificial sequence
  SiRNA target sequence
tcatgcgtgcaccattggcaa

SEQ ID NO: 13310 - DNA, 21 bp, Artificial sequence
  SiRNA target sequence
catgcgtgcaccattggcaac

SEQ ID NO: 13311 - DNA, 21 bp, Artificial sequence
  SiRNA target sequence
atgcgtgcaccattggcaaca

SEQ ID NO: 13312 - DNA, 21 bp, Artificial sequence
  SiRNA target sequence
tgcgtgcaccattggcaacac

SEQ ID NO: 13313 - DNA, 21 bp, Artificial sequence
  SiRNA target sequence
gcgtgcaccattggcaacaca

SEQ ID NO: 13314 - DNA, 21 bp, Artificial sequence
  SiRNA target sequence
cgtgcaccattggcaacacag

SEQ ID NO: 13315 - DNA, 21 bp, Artificial sequence
  SiRNA target sequence
gtgcaccattggcaacacagc

SEQ ID NO: 13316 - DNA, 21 bp, Artificial sequence
  SiRNA target sequence
tgcaccattggcaacacagcg

SEQ ID NO: 13317 - DNA, 21 bp, Artificial sequence
  SiRNA target sequence
gcaccattggcaacacagcgt

SEQ ID NO: 13318 - DNA, 21 bp, Artificial sequence
  SiRNA target sequence
caccattggcaacacagcgtg

SEQ ID NO: 13319 - DNA, 21 bp, Artificial sequence
  SiRNA target sequence
accattggcaacacagcgtgc

SEQ ID NO: 13320 - DNA, 21 bp, Artificial sequence
  SiRNA target sequence
ccattggcaacacagcgtgcg

SEQ ID NO: 13321 - DNA, 21 bp, Artificial sequence
  SiRNA target sequence
cattggcaacacagcgtgcgc

SEQ ID NO: 13322 - DNA, 21 bp, Artificial sequence
  SiRNA target sequence
attggcaacacagcgtgcgca

SEQ ID NO: 13323 - DNA, 21 bp, Artificial sequence
  SiRNA target sequence
ttggcaacacagcgtgcgcat

SEQ ID NO: 13324 - DNA, 21 bp, Artificial sequence
  SiRNA target sequence
tggcaacacagcgtgcgcata

SEQ ID NO: 13325 - DNA, 21 bp, Artificial sequence
  SiRNA target sequence
ggcaacacagcgtgcgcatat

SEQ ID NO: 13326 - DNA, 21 bp, Artificial sequence
  SiRNA target sequence
gcaacacagcgtgcgcatatt

SEQ ID NO: 13327 - DNA, 21 bp, Artificial sequence
  SiRNA target sequence
caacacagcgtgcgcatattc

SEQ ID NO: 13328 - DNA, 21 bp, Artificial sequence
  SiRNA target sequence
aacacagcgtgcgcatattca

SEQ ID NO: 13329 - DNA, 21 bp, Artificial sequence
  SiRNA target sequence
acacagcgtgcgcatattcaa

SEQ ID NO: 13330 - DNA, 21 bp, Artificial sequence
  SiRNA target sequence
cacagcgtgcgcatattcaag

SEQ ID NO: 13331 - DNA, 21 bp, Artificial sequence
  SiRNA target sequence
acagcgtgcgcatattcaaga

SEQ ID NO: 13332 - DNA, 21 bp, Artificial sequence
  SiRNA target sequence
cagcgtgcgcatattcaagat

SEQ ID NO: 13333 - DNA, 21 bp, Artificial sequence
  SiRNA target sequence
agcgtgcgcatattcaagatt

SEQ ID NO: 13334 - DNA, 21 bp, Artificial sequence
  SiRNA target sequence
gcgtgcgcatattcaagattt

SEQ ID NO: 13335 - DNA, 21 bp, Artificial sequence
  SiRNA target sequence
cgtgcgcatattcaagatttt

SEQ ID NO: 13336 - DNA, 21 bp, Artificial sequence
  SiRNA target sequence
gtgcgcatattcaagattttg

SEQ ID NO: 13337 - DNA, 21 bp, Artificial sequence
  SiRNA target sequence
tgcgcatattcaagattttga

SEQ ID NO: 13338 - DNA, 21 bp, Artificial sequence
  SiRNA target sequence
gcgcatattcaagattttgaa

SEQ ID NO: 13339 - DNA, 21 bp, Artificial sequence
  SiRNA target sequence
cgcatattcaagattttgaat

SEQ ID NO: 13340 - DNA, 21 bp, Artificial sequence
  SiRNA target sequence
gcatattcaagattttgaatt

SEQ ID NO: 13341 - DNA, 21 bp, Artificial sequence
  SiRNA target sequence
catattcaagattttgaattt

SEQ ID NO: 13342 - DNA, 21 bp, Artificial sequence
  SiRNA target sequence
atattcaagattttgaattta

SEQ ID NO: 13343 - DNA, 21 bp, Artificial sequence
  SiRNA target sequence
tattcaagattttgaatttat

SEQ ID NO: 13344 - DNA, 21 bp, Artificial sequence
  SiRNA target sequence
attcaagattttgaatttatt

SEQ ID NO: 13345 - DNA, 21 bp, Artificial sequence
  SiRNA target sequence
ttcaagattttgaatttattg

SEQ ID NO: 13346 - DNA, 21 bp, Artificial sequence
  SiRNA target sequence
tcaagattttgaatttattga

SEQ ID NO: 13347 - DNA, 21 bp, Artificial sequence
  SiRNA target sequence
caagattttgaatttattgaa

SEQ ID NO: 13348 - DNA, 21 bp, Artificial sequence
  SiRNA target sequence
aagattttgaatttattgaag

SEQ ID NO: 13349 - DNA, 21 bp, Artificial sequence
  SiRNA target sequence
agattttgaatttattgaagc

SEQ ID NO: 13350 - DNA, 21 bp, Artificial sequence
  SiRNA target sequence
gattttgaatttattgaagct

SEQ ID NO: 13351 - DNA, 21 bp, Artificial sequence
  SiRNA target sequence
attttgaatttattgaagcta

SEQ ID NO: 13352 - DNA, 21 bp, Artificial sequence
  SiRNA target sequence
ttttgaatttattgaagctat

SEQ ID NO: 13353 - DNA, 21 bp, Artificial sequence
  SiRNA target sequence
tttgaatttattgaagctatt

SEQ ID NO: 13354 - DNA, 21 bp, Artificial sequence
  SiRNA target sequence
ttgaatttattgaagctattc

SEQ ID NO: 13355 - DNA, 21 bp, Artificial sequence
  SiRNA target sequence
tgaatttattgaagctattcc

SEQ ID NO: 13356 - DNA, 21 bp, Artificial sequence
  SiRNA target sequence
gaatttattgaagctattcca

SEQ ID NO: 13357 - DNA, 21 bp, Artificial sequence
  SiRNA target sequence
aatttattgaagctattccag

SEQ ID NO: 13358 - DNA, 21 bp, Artificial sequence
  SiRNA target sequence
atttattgaagctattccaga

SEQ ID NO: 13359 - DNA, 21 bp, Artificial sequence
  SiRNA target sequence
tttattgaagctattccagaa

SEQ ID NO: 13360 - DNA, 21 bp, Artificial sequence
  SiRNA target sequence
ttattgaagctattccagaag

SEQ ID NO: 13361 - DNA, 21 bp, Artificial sequence
  SiRNA target sequence
tattgaagctattccagaagg

SEQ ID NO: 13362 - DNA, 21 bp, Artificial sequence
  SiRNA target sequence
attgaagctattccagaagga

SEQ ID NO: 13363 - DNA, 21 bp, Artificial sequence
  SiRNA target sequence
ttgaagctattccagaaggag

SEQ ID NO: 13364 - DNA, 21 bp, Artificial sequence
  SiRNA target sequence
tgaagctattccagaaggaga

SEQ ID NO: 13365 - DNA, 21 bp, Artificial sequence
  SiRNA target sequence
gaagctattccagaaggagag

SEQ ID NO: 13366 - DNA, 21 bp, Artificial sequence
  SiRNA target sequence
aagctattccagaaggagagg

SEQ ID NO: 13367 - DNA, 21 bp, Artificial sequence
  SiRNA target sequence
agctattccagaaggagagga

SEQ ID NO: 13368 - DNA, 21 bp, Artificial sequence
  SiRNA target sequence
gctattccagaaggagaggag

SEQ ID NO: 13369 - DNA, 21 bp, Artificial sequence
  SiRNA target sequence
ctattccagaaggagaggagt

SEQ ID NO: 13370 - DNA, 21 bp, Artificial sequence
  SiRNA target sequence
tattccagaaggagaggagtc

SEQ ID NO: 13371 - DNA, 21 bp, Artificial sequence
  SiRNA target sequence
attccagaaggagaggagtct

SEQ ID NO: 13372 - DNA, 21 bp, Artificial sequence
  SiRNA target sequence
ttccagaaggagaggagtctc

SEQ ID NO: 13373 - DNA, 21 bp, Artificial sequence
  SiRNA target sequence
tccagaaggagaggagtctcg

SEQ ID NO: 13374 - DNA, 21 bp, Artificial sequence
  SiRNA target sequence
ccagaaggagaggagtctcgt

SEQ ID NO: 13375 - DNA, 21 bp, Artificial sequence
  SiRNA target sequence
cagaaggagaggagtctcgta

SEQ ID NO: 13376 - DNA, 21 bp, Artificial sequence
  SiRNA target sequence
agaaggagaggagtctcgtaa

SEQ ID NO: 13377 - DNA, 21 bp, Artificial sequence
  SiRNA target sequence
gaaggagaggagtctcgtaat

SEQ ID NO: 13378 - DNA, 21 bp, Artificial sequence
  SiRNA target sequence
aaggagaggagtctcgtaata

SEQ ID NO: 13379 - DNA, 21 bp, Artificial sequence
  SiRNA target sequence
aggagaggagtctcgtaatac

SEQ ID NO: 13380 - DNA, 21 bp, Artificial sequence
  SiRNA target sequence
ggagaggagtctcgtaatact

SEQ ID NO: 13381 - DNA, 21 bp, Artificial sequence
  SiRNA target sequence
gagaggagtctcgtaatacta

SEQ ID NO: 13382 - DNA, 21 bp, Artificial sequence
  SiRNA target sequence
agaggagtctcgtaatactac

SEQ ID NO: 13383 - DNA, 21 bp, Artificial sequence
  SiRNA target sequence
gaggagtctcgtaatactaca

SEQ ID NO: 13384 - DNA, 21 bp, Artificial sequence
  SiRNA target sequence
aggagtctcgtaatactacag

SEQ ID NO: 13385 - DNA, 21 bp, Artificial sequence
  SiRNA target sequence
ggagtctcgtaatactacagt

SEQ ID NO: 13386 - DNA, 21 bp, Artificial sequence
  SiRNA target sequence
gagtctcgtaatactacagtc

SEQ ID NO: 13387 - DNA, 21 bp, Artificial sequence
  SiRNA target sequence
agtctcgtaatactacagtct

SEQ ID NO: 13388 - DNA, 21 bp, Artificial sequence
  SiRNA target sequence
gtctcgtaatactacagtctt

SEQ ID NO: 13389 - DNA, 21 bp, Artificial sequence
  SiRNA target sequence
tctcgtaatactacagtcttg

SEQ ID NO: 13390 - DNA, 21 bp, Artificial sequence
  SiRNA target sequence
ctcgtaatactacagtcttgg

SEQ ID NO: 13391 - DNA, 21 bp, Artificial sequence
  SiRNA target sequence
tcgtaatactacagtcttgga

SEQ ID NO: 13392 - DNA, 21 bp, Artificial sequence
  SiRNA target sequence
cgtaatactacagtcttggat

SEQ ID NO: 13393 - DNA, 21 bp, Artificial sequence
  SiRNA target sequence
gtaatactacagtcttggata

SEQ ID NO: 13394 - DNA, 21 bp, Artificial sequence
  SiRNA target sequence
taatactacagtcttggatac

SEQ ID NO: 13395 - DNA, 21 bp, Artificial sequence
  SiRNA target sequence
aatactacagtcttggatacg

SEQ ID NO: 13396 - DNA, 21 bp, Artificial sequence
  SiRNA target sequence
atactacagtcttggatacga

SEQ ID NO: 13397 - DNA, 21 bp, Artificial sequence
  SiRNA target sequence
tactacagtcttggatacgac

SEQ ID NO: 13398 - DNA, 21 bp, Artificial sequence
  SiRNA target sequence
actacagtcttggatacgacc

SEQ ID NO: 13399 - DNA, 21 bp, Artificial sequence
  SiRNA target sequence
ctacagtcttggatacgacca

SEQ ID NO: 13400 - DNA, 21 bp, Artificial sequence
  SiRNA target sequence
tacagtcttggatacgaccac

SEQ ID NO: 13401 - DNA, 21 bp, Artificial sequence
  SiRNA target sequence
acagtcttggatacgaccact

SEQ ID NO: 13402 - DNA, 21 bp, Artificial sequence
  SiRNA target sequence
cagtcttggatacgaccacta

SEQ ID NO: 13403 - DNA, 21 bp, Artificial sequence
  SiRNA target sequence
agtcttggatacgaccactac

SEQ ID NO: 13404 - DNA, 21 bp, Artificial sequence
  SiRNA target sequence
gtcttggatacgaccactact

SEQ ID NO: 13405 - DNA, 21 bp, Artificial sequence
  SiRNA target sequence
tcttggatacgaccactactt

SEQ ID NO: 13406 - DNA, 21 bp, Artificial sequence
  SiRNA target sequence
cttggatacgaccactacttt

SEQ ID NO: 13407 - DNA, 21 bp, Artificial sequence
  SiRNA target sequence
ttggatacgaccactacttta

SEQ ID NO: 13408 - DNA, 21 bp, Artificial sequence
  SiRNA target sequence
tggatacgaccactactttac

SEQ ID NO: 13409 - DNA, 21 bp, Artificial sequence
  SiRNA target sequence
ggatacgaccactactttaca

SEQ ID NO: 13410 - DNA, 21 bp, Artificial sequence
  SiRNA target sequence
gatacgaccactactttacag

SEQ ID NO: 13411 - DNA, 21 bp, Artificial sequence
  SiRNA target sequence
atacgaccactactttacagt

SEQ ID NO: 13412 - DNA, 21 bp, Artificial sequence
  SiRNA target sequence
tacgaccactactttacagtc

SEQ ID NO: 13413 - DNA, 21 bp, Artificial sequence
  SiRNA target sequence
acgaccactactttacagtcg

SEQ ID NO: 13414 - DNA, 21 bp, Artificial sequence
  SiRNA target sequence
cgaccactactttacagtcga

SEQ ID NO: 13415 - DNA, 21 bp, Artificial sequence
  SiRNA target sequence
gaccactactttacagtcgag

SEQ ID NO: 13416 - DNA, 21 bp, Artificial sequence
  SiRNA target sequence
accactactttacagtcgagt

SEQ ID NO: 13417 - DNA, 21 bp, Artificial sequence
  SiRNA target sequence
ccactactttacagtcgagtg

SEQ ID NO: 13418 - DNA, 21 bp, Artificial sequence
  SiRNA target sequence
cactactttacagtcgagtgg

SEQ ID NO: 13419 - DNA, 21 bp, Artificial sequence
  SiRNA target sequence
actactttacagtcgagtgga

SEQ ID NO: 13420 - DNA, 21 bp, Artificial sequence
  SiRNA target sequence
ctactttacagtcgagtggat

SEQ ID NO: 13421 - DNA, 21 bp, Artificial sequence
  SiRNA target sequence
tactttacagtcgagtggatt

SEQ ID NO: 13422 - DNA, 21 bp, Artificial sequence
  SiRNA target sequence
actttacagtcgagtggattt

SEQ ID NO: 13423 - DNA, 21 bp, Artificial sequence
  SiRNA target sequence
ctttacagtcgagtggatttg

SEQ ID NO: 13424 - DNA, 21 bp, Artificial sequence
  SiRNA target sequence
tttacagtcgagtggatttgg

SEQ ID NO: 13425 - DNA, 21 bp, Artificial sequence
  SiRNA target sequence
ttacagtcgagtggatttggt

SEQ ID NO: 13426 - DNA, 21 bp, Artificial sequence
  SiRNA target sequence
tacagtcgagtggatttggtc

SEQ ID NO: 13427 - DNA, 21 bp, Artificial sequence
  SiRNA target sequence
acagtcgagtggatttggtcg

SEQ ID NO: 13428 - DNA, 21 bp, Artificial sequence
  SiRNA target sequence
cagtcgagtggatttggtcgc

SEQ ID NO: 13429 - DNA, 21 bp, Artificial sequence
  SiRNA target sequence
agtcgagtggatttggtcgcg

SEQ ID NO: 13430 - DNA, 21 bp, Artificial sequence
  SiRNA target sequence
gtcgagtggatttggtcgcgc

SEQ ID NO: 13431 - DNA, 21 bp, Artificial sequence
  SiRNA target sequence
  misc_feature (21)..(21): n is a, c, g, or t
tcgagtggatttggtcgcgcn

SEQ ID NO: 13432 - DNA, 21 bp, Artificial sequence
  SiRNA target sequence
  misc_feature (20)..(20): n is a, c, g, or t
cgagtggatttggtcgcgcnt

SEQ ID NO: 13433 - DNA, 21 bp, Artificial sequence
  SiRNA target sequence
  misc_feature (19)..(19): n is a, c, g, or t
gagtggatttggtcgcgcntt

SEQ ID NO: 13434 - DNA, 21 bp, Artificial sequence
  SiRNA target sequence
  misc_feature (18)..(18): n is a, c, g, or t
agtggatttggtcgcgcnttc

SEQ ID NO: 13435 - DNA, 21 bp, Artificial sequence
  SiRNA target sequence
  misc_feature (17)..(17): n is a, c, g, or t
gtggatttggtcgcgcnttct

SEQ ID NO: 13436 - DNA, 21 bp, Artificial sequence
  SiRNA target sequence
  misc_feature (16)..(16): n is a, c, g, or t
tggatttggtcgcgcnttctt

SEQ ID NO: 13437 - DNA, 21 bp, Artificial sequence
  SiRNA target sequence
  misc_feature (15)..(15): n is a, c, g, or t
ggatttggtcgcgcnttcttt

SEQ ID NO: 13438 - DNA, 21 bp, Artificial sequence
  SiRNA target sequence
  misc_feature (14)..(14): n is a, c, g, or t
gatttggtcgcgcnttctttg

SEQ ID NO: 13439 - DNA, 21 bp, Artificial sequence
  SiRNA target sequence
  misc_feature (13)..(13): n is a, c, g, or t
atttggtcgcgcnttctttgg

SEQ ID NO: 13440 - DNA, 21 bp, Artificial sequence
  SiRNA target sequence
  misc_feature (12)..(12): n is a, c, g, or t
tttggtcgcgcnttctttgga

SEQ ID NO: 13441 - DNA, 21 bp, Artificial sequence
  SiRNA target sequence
  misc_feature (11)..(11): n is a, c, g, or t
ttggtcgcgcnttctttggag

SEQ ID NO: 13442 - DNA, 21 bp, Artificial sequence
  SiRNA target sequence
  misc_feature (10)..(10): n is a, c, g, or t
tggtcgcgcnttctttggaga

SEQ ID NO: 13443 - DNA, 21 bp, Artificial sequence
  SiRNA target sequence
  misc_feature (9)..(9): n is a, c, g, or t
ggtcgcgcnttctttggagaa

SEQ ID NO: 13444 - DNA, 21 bp, Artificial sequence
  SiRNA target sequence
  misc_feature (8)..(8): n is a, c, g, or t
gtcgcgcnttctttggagaag

SEQ ID NO: 13445 - DNA, 21 bp, Artificial sequence
  SiRNA target sequence
  misc_feature (7)..(7): n is a, c, g, or t
tcgcgcnttctttggagaagc

SEQ ID NO: 13446 - DNA, 21 bp, Artificial sequence
  SiRNA target sequence
  misc_feature (6)..(6): n is a, c, g, or t
cgcgcnttctttggagaagct

SEQ ID NO: 13447 - DNA, 21 bp, Artificial sequence
  SiRNA target sequence
  misc_feature (5)..(5): n is a, c, g, or t
gcgcnttctttggagaagctt

SEQ ID NO: 13448 - DNA, 21 bp, Artificial sequence
  SiRNA target sequence
  misc_feature (4)..(4): n is a, c, g, or t
cgcnttctttggagaagcttt

SEQ ID NO: 13449 - DNA, 21 bp, Artificial sequence
  SiRNA target sequence
  misc_feature (3)..(3): n is a, c, g, or t
gcnttctttggagaagctttt

SEQ ID NO: 13450 - DNA, 21 bp, Artificial sequence
  SiRNA target sequence
  misc_feature (2)..(2): n is a, c, g, or t
cnttctttggagaagctttta

SEQ ID NO: 13451 - DNA, 21 bp, Artificial sequence
  SiRNA target sequence
  misc_feature (1)..(1): n is a, c, g, or t
nttctttggagaagcttttaa

SEQ ID NO: 13452 - DNA, 21 bp, Artificial sequence
  SiRNA target sequence
ttctttggagaagcttttaat

SEQ ID NO: 13453 - DNA, 21 bp, Artificial sequence
  SiRNA target sequence
tctttggagaagcttttaatg

SEQ ID NO: 13454 - DNA, 21 bp, Artificial sequence
  SiRNA target sequence
ctttggagaagcttttaatga

SEQ ID NO: 13455 - DNA, 21 bp, Artificial sequence
  SiRNA target sequence
  misc_feature (21)..(21): n is a, c, g, or t
tttggagaagcttttaatgan

SEQ ID NO: 13456 - DNA, 21 bp, Artificial sequence
  SiRNA target sequence
  misc_feature (20)..(20): n is a, c, g, or t
ttggagaagcttttaatganc

SEQ ID NO: 13457 - DNA, 21 bp, Artificial sequence
  SiRNA target sequence
  misc_feature (19)..(19): n is a, c, g, or t
tggagaagcttttaatganct

SEQ ID NO: 13458 - DNA, 21 bp, Artificial sequence
  SiRNA target sequence
  misc_feature (18)..(18): n is a, c, g, or t
ggagaagcttttaatganctt

SEQ ID NO: 13459 - DNA, 21 bp, Artificial sequence
  SiRNA target sequence
  misc_feature (17)..(17): n is a, c, g, or t
gagaagcttttaatganctta

SEQ ID NO: 13460 - DNA, 21 bp, Artificial sequence
  SiRNA target sequence
  misc_feature (16)..(16): n is a, c, g, or t
agaagcttttaatgancttaa

SEQ ID NO: 13461 - DNA, 21 bp, Artificial sequence
  SiRNA target sequence
  misc_feature (15)..(15): n is a, c, g, or t
gaagcttttaatgancttaaa

SEQ ID NO: 13462 - DNA, 21 bp, Artificial sequence
  SiRNA target sequence
  misc_feature (14)..(14): n is a, c, g, or t
aagcttttaatgancttaaaa

SEQ ID NO: 13463 - DNA, 21 bp, Artificial sequence
  SiRNA target sequence
  misc_feature (13)..(13): n is a, c, g, or t
agcttttaatgancttaaaac

SEQ ID NO: 13464 - DNA, 21 bp, Artificial sequence
  SiRNA target sequence
  misc_feature (12)..(12): n is a, c, g, or t
gcttttaatgancttaaaacg

SEQ ID NO: 13465 - DNA, 21 bp, Artificial sequence
  SiRNA target sequence
  misc_feature (11)..(11): n is a, c, g, or t
cttttaatgancttaaaacgt

SEQ ID NO: 13466 - DNA, 21 bp, Artificial sequence
  SiRNA target sequence
  misc_feature (10)..(10): n is a, c, g, or t
ttttaatgancttaaaacgtt

SEQ ID NO: 13467 - DNA, 21 bp, Artificial sequence
  SiRNA target sequence
  misc_feature (9)..(9): n is a, c, g, or t
tttaatgancttaaaacgtta

SEQ ID NO: 13468 - DNA, 21 bp, Artificial sequence
  SiRNA target sequence
  misc_feature (8)..(8): n is a, c, g, or t
ttaatgancttaaaacgttaa

SEQ ID NO: 13469 - DNA, 21 bp, Artificial sequence
  SiRNA target sequence
  misc_feature (7)..(7): n is a, c, g, or t
taatgancttaaaacgttaat

SEQ ID NO: 13470 - DNA, 21 bp, Artificial sequence
  SiRNA target sequence
  misc_feature (6)..(6): n is a, c, g, or t
aatgancttaaaacgttaatg

SEQ ID NO: 13471 - DNA, 21 bp, Artificial sequence
  SiRNA target sequence
  misc_feature (5)..(5): n is a, c, g, or t
atgancttaaaacgttaatgc

SEQ ID NO: 13472 - DNA, 21 bp, Artificial sequence
  SiRNA target sequence
  misc_feature (4)..(4): n is a, c, g, or t
tgancttaaaacgttaatgcg

SEQ ID NO: 13473 - DNA, 21 bp, Artificial sequence
  SiRNA target sequence
  misc_feature (3)..(3): n is a, c, g, or t
gancttaaaacgttaatgcga

SEQ ID NO: 13474 - DNA, 21 bp, Artificial sequence
  SiRNA target sequence
  misc_feature (2)..(2): n is a, c, g, or t
ancttaaaacgttaatgcgac

SEQ ID NO: 13475 - DNA, 21 bp, Artificial sequence
  SiRNA target sequence
  misc_feature (1)..(1): n is a, c, g, or t
ncttaaaacgttaatgcgacg

SEQ ID NO: 13476 - DNA, 21 bp, Artificial sequence
  SiRNA target sequence
cttaaaacgttaatgcgacga

SEQ ID NO: 13477 - DNA, 21 bp, Artificial sequence
  SiRNA target sequence
ttaaaacgttaatgcgacgat

SEQ ID NO: 13478 - DNA, 21 bp, Artificial sequence
  SiRNA target sequence
taaaacgttaatgcgacgata

SEQ ID NO: 13479 - DNA, 21 bp, Artificial sequence
  SiRNA target sequence
aaaacgttaatgcgacgatat

SEQ ID NO: 13480 - DNA, 21 bp, Artificial sequence
  SiRNA target sequence
aaacgttaatgcgacgatatc

SEQ ID NO: 13481 - DNA, 21 bp, Artificial sequence
  SiRNA target sequence
aacgttaatgcgacgatatca

SEQ ID NO: 13482 - DNA, 21 bp, Artificial sequence
  SiRNA target sequence
acgttaatgcgacgatatcaa

SEQ ID NO: 13483 - DNA, 21 bp, Artificial sequence
  SiRNA target sequence
cgttaatgcgacgatatcaat

SEQ ID NO: 13484 - DNA, 21 bp, Artificial sequence
  SiRNA target sequence
gttaatgcgacgatatcaatt

SEQ ID NO: 13485 - DNA, 21 bp, Artificial sequence
  SiRNA target sequence
ttaatgcgacgatatcaatta

SEQ ID NO: 13486 - DNA, 21 bp, Artificial sequence
  SiRNA target sequence
taatgcgacgatatcaattat

SEQ ID NO: 13487 - DNA, 21 bp, Artificial sequence
  SiRNA target sequence
aatgcgacgatatcaattata

SEQ ID NO: 13488 - DNA, 21 bp, Artificial sequence
  SiRNA target sequence
atgcgacgatatcaattatat

SEQ ID NO: 13489 - DNA, 21 bp, Artificial sequence
  SiRNA target sequence
tgcgacgatatcaattatatg

SEQ ID NO: 13490 - DNA, 21 bp, Artificial sequence
  SiRNA target sequence
gcgacgatatcaattatatgg

SEQ ID NO: 13491 - DNA, 21 bp, Artificial sequence
  SiRNA target sequence
cgacgatatcaattatatggt

SEQ ID NO: 13492 - DNA, 21 bp, Artificial sequence
  SiRNA target sequence
gacgatatcaattatatggtc

SEQ ID NO: 13493 - DNA, 21 bp, Artificial sequence
  SiRNA target sequence
acgatatcaattatatggtca

SEQ ID NO: 13494 - DNA, 21 bp, Artificial sequence
  SiRNA target sequence
cgatatcaattatatggtcaa

SEQ ID NO: 13495 - DNA, 21 bp, Artificial sequence
  SiRNA target sequence
gatatcaattatatggtcaat

SEQ ID NO: 13496 - DNA, 21 bp, Artificial sequence
  SiRNA target sequence
atatcaattatatggtcaatt

SEQ ID NO: 13497 - DNA, 21 bp, Artificial sequence
  SiRNA target sequence
tatcaattatatggtcaatta

SEQ ID NO: 13498 - DNA, 21 bp, Artificial sequence
  SiRNA target sequence
atcaattatatggtcaattat

SEQ ID NO: 13499 - DNA, 21 bp, Artificial sequence
  SiRNA target sequence
tcaattatatggtcaattatt

SEQ ID NO: 13500 - DNA, 21 bp, Artificial sequence
  SiRNA target sequence
caattatatggtcaattatta

SEQ ID NO: 13501 - DNA, 21 bp, Artificial sequence
  SiRNA target sequence
aattatatggtcaattattat

SEQ ID NO: 13502 - DNA, 21 bp, Artificial sequence
  SiRNA target sequence
attatatggtcaattattatt

SEQ ID NO: 13503 - DNA, 21 bp, Artificial sequence
  SiRNA target sequence
ttatatggtcaattattattg

SEQ ID NO: 13504 - DNA, 21 bp, Artificial sequence
  SiRNA target sequence
tatatggtcaattattattgt

SEQ ID NO: 13505 - DNA, 21 bp, Artificial sequence
  SiRNA target sequence
atatggtcaattattattgtc

SEQ ID NO: 13506 - DNA, 21 bp, Artificial sequence
  SiRNA target sequence
tatggtcaattattattgtcc

SEQ ID NO: 13507 - DNA, 21 bp, Artificial sequence
  SiRNA target sequence
atggtcaattattattgtccg

SEQ ID NO: 13508 - DNA, 21 bp, Artificial sequence
  SiRNA target sequence
tggtcaattattattgtccgt

SEQ ID NO: 13509 - DNA, 21 bp, Artificial sequence
  SiRNA target sequence
ggtcaattattattgtccgtt

SEQ ID NO: 13510 - DNA, 21 bp, Artificial sequence
  SiRNA target sequence
gtcaattattattgtccgtta

SEQ ID NO: 13511 - DNA, 21 bp, Artificial sequence
  SiRNA target sequence
tcaattattattgtccgttac

SEQ ID NO: 13512 - DNA, 21 bp, Artificial sequence
  SiRNA target sequence
caattattattgtccgttact

SEQ ID NO: 13513 - DNA, 21 bp, Artificial sequence
  SiRNA target sequence
aattattattgtccgttacta

SEQ ID NO: 13514 - DNA, 21 bp, Artificial sequence
  SiRNA target sequence
attattattgtccgttactac

SEQ ID NO: 13515 - DNA, 21 bp, Artificial sequence
  SiRNA target sequence
ttattattgtccgttactacg

SEQ ID NO: 13516 - DNA, 21 bp, Artificial sequence
  SiRNA target sequence
tattattgtccgttactacgg

SEQ ID NO: 13517 - DNA, 21 bp, Artificial sequence
  SiRNA target sequence
attattgtccgttactacgga

SEQ ID NO: 13518 - DNA, 21 bp, Artificial sequence
  SiRNA target sequence
ttattgtccgttactacggat

SEQ ID NO: 13519 - DNA, 21 bp, Artificial sequence
  SiRNA target sequence
tattgtccgttactacggata

SEQ ID NO: 13520 - DNA, 21 bp, Artificial sequence
  SiRNA target sequence
attgtccgttactacggataa

SEQ ID NO: 13521 - DNA, 21 bp, Artificial sequence
  SiRNA target sequence
ttgtccgttactacggataag

SEQ ID NO: 13522 - DNA, 21 bp, Artificial sequence
  SiRNA target sequence
tgtccgttactacggataagg

SEQ ID NO: 13523 - DNA, 21 bp, Artificial sequence
  SiRNA target sequence
gtccgttactacggataagga

SEQ ID NO: 13524 - DNA, 21 bp, Artificial sequence
  SiRNA target sequence
tccgttactacggataaggat

SEQ ID NO: 13525 - DNA, 21 bp, Artificial sequence
  SiRNA target sequence
ccgttactacggataaggata

SEQ ID NO: 13526 - DNA, 21 bp, Artificial sequence
  SiRNA target sequence
cgttactacggataaggatat

SEQ ID NO: 13527 - DNA, 21 bp, Artificial sequence
  SiRNA target sequence
gttactacggataaggatatt

SEQ ID NO: 13528 - DNA, 21 bp, Artificial sequence
  SiRNA target sequence
ttactacggataaggatattg

SEQ ID NO: 13529 - DNA, 21 bp, Artificial sequence
  SiRNA target sequence
tactacggataaggatattga

SEQ ID NO: 13530 - DNA, 21 bp, Artificial sequence
  SiRNA target sequence
actacggataaggatattgat

SEQ ID NO: 13531 - DNA, 21 bp, Artificial sequence
  SiRNA target sequence
ctacggataaggatattgatc

SEQ ID NO: 13532 - DNA, 21 bp, Artificial sequence
  SiRNA target sequence
tacggataaggatattgatca

SEQ ID NO: 13533 - DNA, 21 bp, Artificial sequence
  SiRNA target sequence
acggataaggatattgatcat

SEQ ID NO: 13534 - DNA, 21 bp, Artificial sequence
  SiRNA target sequence
cggataaggatattgatcatt

SEQ ID NO: 13535 - DNA, 21 bp, Artificial sequence
  SiRNA target sequence
ggataaggatattgatcattg

SEQ ID NO: 13536 - DNA, 21 bp, Artificial sequence
  SiRNA target sequence
gataaggatattgatcattgt

SEQ ID NO: 13537 - DNA, 21 bp, Artificial sequence
  SiRNA target sequence
ataaggatattgatcattgta

SEQ ID NO: 13538 - DNA, 21 bp, Artificial sequence
  SiRNA target sequence
taaggatattgatcattgtat

SEQ ID NO: 13539 - DNA, 21 bp, Artificial sequence
  SiRNA target sequence
aaggatattgatcattgtatg

SEQ ID NO: 13540 - DNA, 21 bp, Artificial sequence
  SiRNA target sequence
aggatattgatcattgtatgt

SEQ ID NO: 13541 - DNA, 21 bp, Artificial sequence
  SiRNA target sequence
ggatattgatcattgtatgtt

SEQ ID NO: 13542 - DNA, 21 bp, Artificial sequence
  SiRNA target sequence
gatattgatcattgtatgttt

SEQ ID NO: 13543 - DNA, 21 bp, Artificial sequence
  SiRNA target sequence
atattgatcattgtatgttta

SEQ ID NO: 13544 - DNA, 21 bp, Artificial sequence
  SiRNA target sequence
tattgatcattgtatgtttac

SEQ ID NO: 13545 - DNA, 21 bp, Artificial sequence
  SiRNA target sequence
attgatcattgtatgtttacc

SEQ ID NO: 13546 - DNA, 21 bp, Artificial sequence
  SiRNA target sequence
ttgatcattgtatgtttacct

SEQ ID NO: 13547 - DNA, 21 bp, Artificial sequence
  SiRNA target sequence
tgatcattgtatgtttacctt

SEQ ID NO: 13548 - DNA, 21 bp, Artificial sequence
  SiRNA target sequence
gatcattgtatgtttaccttc

SEQ ID NO: 13549 - DNA, 21 bp, Artificial sequence
  SiRNA target sequence
atcattgtatgtttaccttcc

SEQ ID NO: 13550 - DNA, 21 bp, Artificial sequence
  SiRNA target sequence
tcattgtatgtttaccttccc

SEQ ID NO: 13551 - DNA, 21 bp, Artificial sequence
  SiRNA target sequence
cattgtatgtttaccttccct

SEQ ID NO: 13552 - DNA, 21 bp, Artificial sequence
  SiRNA target sequence
attgtatgtttaccttccctt

SEQ ID NO: 13553 - DNA, 21 bp, Artificial sequence
  SiRNA target sequence
ttgtatgtttaccttcccttg

SEQ ID NO: 13554 - DNA, 21 bp, Artificial sequence
  SiRNA target sequence
tgtatgtttaccttcccttgt

SEQ ID NO: 13555 - DNA, 21 bp, Artificial sequence
  SiRNA target sequence
gtatgtttaccttcccttgtt

SEQ ID NO: 13556 - DNA, 21 bp, Artificial sequence
  SiRNA target sequence
tatgtttaccttcccttgttt

SEQ ID NO: 13557 - DNA, 21 bp, Artificial sequence
  SiRNA target sequence
atgtttaccttcccttgttta

SEQ ID NO: 13558 - DNA, 21 bp, Artificial sequence
  SiRNA target sequence
tgtttaccttcccttgtttac

SEQ ID NO: 13559 - DNA, 21 bp, Artificial sequence
  SiRNA target sequence
gtttaccttcccttgtttacc

SEQ ID NO: 13560 - DNA, 21 bp, Artificial sequence
  SiRNA target sequence
tttaccttcccttgtttacca

SEQ ID NO: 13561 - DNA, 21 bp, Artificial sequence
  SiRNA target sequence
ttaccttcccttgtttaccac

SEQ ID NO: 13562 - DNA, 21 bp, Artificial sequence
  SiRNA target sequence
taccttcccttgtttaccaca

SEQ ID NO: 13563 - DNA, 21 bp, Artificial sequence
  SiRNA target sequence
accttcccttgtttaccacaa

SEQ ID NO: 13564 - DNA, 21 bp, Artificial sequence
  SiRNA target sequence
ccttcccttgtttaccacaag

SEQ ID NO: 13565 - DNA, 21 bp, Artificial sequence
  SiRNA target sequence
cttcccttgtttaccacaagg

SEQ ID NO: 13566 - DNA, 21 bp, Artificial sequence
  SiRNA target sequence
ttcccttgtttaccacaaggg

SEQ ID NO: 13567 - DNA, 21 bp, Artificial sequence
  SiRNA target sequence
tcccttgtttaccacaagggt

SEQ ID NO: 13568 - DNA, 21 bp, Artificial sequence
  SiRNA target sequence
cccttgtttaccacaagggtt

SEQ ID NO: 13569 - DNA, 21 bp, Artificial sequence
  SiRNA target sequence
ccttgtttaccacaagggtta

SEQ ID NO: 13570 - DNA, 21 bp, Artificial sequence
  SiRNA target sequence
cttgtttaccacaagggttag

SEQ ID NO: 13571 - DNA, 21 bp, Artificial sequence
  SiRNA target sequence
ttgtttaccacaagggttagc

SEQ ID NO: 13572 - DNA, 21 bp, Artificial sequence
  SiRNA target sequence
tgtttaccacaagggttagcg

SEQ ID NO: 13573 - DNA, 21 bp, Artificial sequence
  SiRNA target sequence
gtttaccacaagggttagcgt

SEQ ID NO: 13574 - DNA, 21 bp, Artificial sequence
  SiRNA target sequence
tttaccacaagggttagcgtt

SEQ ID NO: 13575 - DNA, 21 bp, Artificial sequence
  SiRNA target sequence
ttaccacaagggttagcgtta

SEQ ID NO: 13576 - DNA, 21 bp, Artificial sequence
  SiRNA target sequence
taccacaagggttagcgttag

SEQ ID NO: 13577 - DNA, 21 bp, Artificial sequence
  SiRNA target sequence
accacaagggttagcgttaga

SEQ ID NO: 13578 - DNA, 21 bp, Artificial sequence
  SiRNA target sequence
ccacaagggttagcgttagac

SEQ ID NO: 13579 - DNA, 21 bp, Artificial sequence
  SiRNA target sequence
cacaagggttagcgttagaca

SEQ ID NO: 13580 - DNA, 21 bp, Artificial sequence
  SiRNA target sequence
acaagggttagcgttagacat

SEQ ID NO: 13581 - DNA, 21 bp, Artificial sequence
  SiRNA target sequence
caagggttagcgttagacatt

SEQ ID NO: 13582 - DNA, 21 bp, Artificial sequence
  SiRNA target sequence
aagggttagcgttagacattg

SEQ ID NO: 13583 - DNA, 21 bp, Artificial sequence
  SiRNA target sequence
agggttagcgttagacattgg

SEQ ID NO: 13584 - DNA, 21 bp, Artificial sequence
  SiRNA target sequence
gggttagcgttagacattggt

SEQ ID NO: 13585 - DNA, 21 bp, Artificial sequence
  SiRNA target sequence
ggttagcgttagacattggtt

SEQ ID NO: 13586 - DNA, 21 bp, Artificial sequence
  SiRNA target sequence
gttagcgttagacattggttc

SEQ ID NO: 13587 - DNA, 21 bp, Artificial sequence
  SiRNA target sequence
ttagcgttagacattggttct

SEQ ID NO: 13588 - DNA, 21 bp, Artificial sequence
  SiRNA target sequence
tagcgttagacattggttctg

SEQ ID NO: 13589 - DNA, 21 bp, Artificial sequence
  SiRNA target sequence
agcgttagacattggttctgc

SEQ ID NO: 13590 - DNA, 21 bp, Artificial sequence
  SiRNA target sequence
gcgttagacattggttctgct

SEQ ID NO: 13591 - DNA, 21 bp, Artificial sequence
  SiRNA target sequence
cgttagacattggttctgctg

SEQ ID NO: 13592 - DNA, 21 bp, Artificial sequence
  SiRNA target sequence
gttagacattggttctgctgg

SEQ ID NO: 13593 - DNA, 21 bp, Artificial sequence
  SiRNA target sequence
ttagacattggttctgctggc

SEQ ID NO: 13594 - DNA, 21 bp, Artificial sequence
  SiRNA target sequence
tagacattggttctgctggct

SEQ ID NO: 13595 - DNA, 21 bp, Artificial sequence
  SiRNA target sequence
agacattggttctgctggctc

SEQ ID NO: 13596 - DNA, 21 bp, Artificial sequence
  SiRNA target sequence
gacattggttctgctggctct

SEQ ID NO: 13597 - DNA, 21 bp, Artificial sequence
  SiRNA target sequence
acattggttctgctggctctc

SEQ ID NO: 13598 - DNA, 21 bp, Artificial sequence
  SiRNA target sequence
cattggttctgctggctctcc

SEQ ID NO: 13599 - DNA, 21 bp, Artificial sequence
  SiRNA target sequence
attggttctgctggctctcca

SEQ ID NO: 13600 - DNA, 21 bp, Artificial sequence
  SiRNA target sequence
ttggttctgctggctctccac

SEQ ID NO: 13601 - DNA, 21 bp, Artificial sequence
  SiRNA target sequence
tggttctgctggctctccaca

SEQ ID NO: 13602 - DNA, 21 bp, Artificial sequence
  SiRNA target sequence
ggttctgctggctctccacat

SEQ ID NO: 13603 - DNA, 21 bp, Artificial sequence
  SiRNA target sequence
gttctgctggctctccacatg

SEQ ID NO: 13604 - DNA, 21 bp, Artificial sequence
  SiRNA target sequence
ttctgctggctctccacatga

SEQ ID NO: 13605 - DNA, 21 bp, Artificial sequence
  SiRNA target sequence
tctgctggctctccacatgaa

SEQ ID NO: 13606 - DNA, 21 bp, Artificial sequence
  SiRNA target sequence
ctgctggctctccacatgaaa

SEQ ID NO: 13607 - DNA, 21 bp, Artificial sequence
  SiRNA target sequence
tgctggctctccacatgaaat

SEQ ID NO: 13608 - DNA, 21 bp, Artificial sequence
  SiRNA target sequence
gctggctctccacatgaaatc

SEQ ID NO: 13609 - DNA, 21 bp, Artificial sequence
  SiRNA target sequence
ctggctctccacatgaaatct

SEQ ID NO: 13610 - DNA, 21 bp, Artificial sequence
  SiRNA target sequence
tggctctccacatgaaatctt

SEQ ID NO: 13611 - DNA, 21 bp, Artificial sequence
  SiRNA target sequence
ggctctccacatgaaatcttt

SEQ ID NO: 13612 - DNA, 21 bp, Artificial sequence
  SiRNA target sequence
gctctccacatgaaatcttta

SEQ ID NO: 13613 - DNA, 21 bp, Artificial sequence
  SiRNA target sequence
ctctccacatgaaatctttaa

SEQ ID NO: 13614 - DNA, 21 bp, Artificial sequence
  SiRNA target sequence
tctccacatgaaatctttaat

SEQ ID NO: 13615 - DNA, 21 bp, Artificial sequence
  SiRNA target sequence
ctccacatgaaatctttaata

SEQ ID NO: 13616 - DNA, 21 bp, Artificial sequence
  SiRNA target sequence
tccacatgaaatctttaatag

SEQ ID NO: 13617 - DNA, 21 bp, Artificial sequence
  SiRNA target sequence
ccacatgaaatctttaataga

SEQ ID NO: 13618 - DNA, 21 bp, Artificial sequence
  SiRNA target sequence
cacatgaaatctttaatagat

SEQ ID NO: 13619 - DNA, 21 bp, Artificial sequence
  SiRNA target sequence
acatgaaatctttaatagatg

SEQ ID NO: 13620 - DNA, 21 bp, Artificial sequence
  SiRNA target sequence
catgaaatctttaatagatgt

SEQ ID NO: 13621 - DNA, 21 bp, Artificial sequence
  SiRNA target sequence
atgaaatctttaatagatgtc

SEQ ID NO: 13622 - DNA, 21 bp, Artificial sequence
  SiRNA target sequence
tgaaatctttaatagatgtcg

SEQ ID NO: 13623 - DNA, 21 bp, Artificial sequence
  SiRNA target sequence
gaaatctttaatagatgtcgt

SEQ ID NO: 13624 - DNA, 21 bp, Artificial sequence
  SiRNA target sequence
aaatctttaatagatgtcgtg

SEQ ID NO: 13625 - DNA, 21 bp, Artificial sequence
  SiRNA target sequence
aatctttaatagatgtcgtga

SEQ ID NO: 13626 - DNA, 21 bp, Artificial sequence
  SiRNA target sequence
atctttaatagatgtcgtgat

SEQ ID NO: 13627 - DNA, 21 bp, Artificial sequence
  SiRNA target sequence
tctttaatagatgtcgtgatg

SEQ ID NO: 13628 - DNA, 21 bp, Artificial sequence
  SiRNA target sequence
ctttaatagatgtcgtgatgg

SEQ ID NO: 13629 - DNA, 21 bp, Artificial sequence
  SiRNA target sequence
tttaatagatgtcgtgatggt

SEQ ID NO: 13630 - DNA, 21 bp, Artificial sequence
  SiRNA target sequence
ttaatagatgtcgtgatggta

SEQ ID NO: 13631 - DNA, 21 bp, Artificial sequence
  SiRNA target sequence
taatagatgtcgtgatggtat

SEQ ID NO: 13632 - DNA, 21 bp, Artificial sequence
  SiRNA target sequence
aatagatgtcgtgatggtatt

SEQ ID NO: 13633 - DNA, 21 bp, Artificial sequence
  SiRNA target sequence
atagatgtcgtgatggtatta

SEQ ID NO: 13634 - DNA, 21 bp, Artificial sequence
  SiRNA target sequence
tagatgtcgtgatggtattat

SEQ ID NO: 13635 - DNA, 21 bp, Artificial sequence
  SiRNA target sequence
agatgtcgtgatggtattata

SEQ ID NO: 13636 - DNA, 21 bp, Artificial sequence
  SiRNA target sequence
gatgtcgtgatggtattatac

SEQ ID NO: 13637 - DNA, 21 bp, Artificial sequence
  SiRNA target sequence
atgtcgtgatggtattatacc

SEQ ID NO: 13638 - DNA, 21 bp, Artificial sequence
  SiRNA target sequence
tgtcgtgatggtattatacca

SEQ ID NO: 13639 - DNA, 21 bp, Artificial sequence
  SiRNA target sequence
gtcgtgatggtattataccat

SEQ ID NO: 13640 - DNA, 21 bp, Artificial sequence
  SiRNA target sequence
tcgtgatggtattataccatt

SEQ ID NO: 13641 - DNA, 21 bp, Artificial sequence
  SiRNA target sequence
cgtgatggtattataccatta

SEQ ID NO: 13642 - DNA, 21 bp, Artificial sequence
  SiRNA target sequence
gtgatggtattataccattaa

SEQ ID NO: 13643 - DNA, 21 bp, Artificial sequence
  SiRNA target sequence
tgatggtattataccattaat

SEQ ID NO: 13644 - DNA, 21 bp, Artificial sequence
  SiRNA target sequence
gatggtattataccattaatt

SEQ ID NO: 13645 - DNA, 21 bp, Artificial sequence
  SiRNA target sequence
atggtattataccattaattg

SEQ ID NO: 13646 - DNA, 21 bp, Artificial sequence
  SiRNA target sequence
tggtattataccattaattgc

SEQ ID NO: 13647 - DNA, 21 bp, Artificial sequence
  SiRNA target sequence
ggtattataccattaattgca

SEQ ID NO: 13648 - DNA, 21 bp, Artificial sequence
  SiRNA target sequence
gtattataccattaattgcat

SEQ ID NO: 13649 - DNA, 21 bp, Artificial sequence
  SiRNA target sequence
tattataccattaattgcatc

SEQ ID NO: 13650 - DNA, 21 bp, Artificial sequence
  SiRNA target sequence
attataccattaattgcatct

SEQ ID NO: 13651 - DNA, 21 bp, Artificial sequence
  SiRNA target sequence
ttataccattaattgcatctg

SEQ ID NO: 13652 - DNA, 21 bp, Artificial sequence
  SiRNA target sequence
tataccattaattgcatctgg

SEQ ID NO: 13653 - DNA, 21 bp, Artificial sequence
  SiRNA target sequence
ataccattaattgcatctgga

SEQ ID NO: 13654 - DNA, 21 bp, Artificial sequence
  SiRNA target sequence
taccattaattgcatctggat

SEQ ID NO: 13655 - DNA, 21 bp, Artificial sequence
  SiRNA target sequence
accattaattgcatctggata

SEQ ID NO: 13656 - DNA, 21 bp, Artificial sequence
  SiRNA target sequence
ccattaattgcatctggatat

SEQ ID NO: 13657 - DNA, 21 bp, Artificial sequence
  SiRNA target sequence
cattaattgcatctggatata

SEQ ID NO: 13658 - DNA, 21 bp, Artificial sequence
  SiRNA target sequence
attaattgcatctggatatag

SEQ ID NO: 13659 - DNA, 21 bp, Artificial sequence
  SiRNA target sequence
ttaattgcatctggatataga

SEQ ID NO: 13660 - DNA, 21 bp, Artificial sequence
  SiRNA target sequence
taattgcatctggatatagat

SEQ ID NO: 13661 - DNA, 21 bp, Artificial sequence
  SiRNA target sequence
aattgcatctggatatagatt

SEQ ID NO: 13662 - DNA, 21 bp, Artificial sequence
  SiRNA target sequence
attgcatctggatatagattt

SEQ ID NO: 13663 - DNA, 21 bp, Artificial sequence
  SiRNA target sequence
ttgcatctggatatagatttt

SEQ ID NO: 13664 - DNA, 21 bp, Artificial sequence
  SiRNA target sequence
tgcatctggatatagatttta

SEQ ID NO: 13665 - DNA, 21 bp, Artificial sequence
  SiRNA target sequence
gcatctggatatagattttat

SEQ ID NO: 13666 - DNA, 21 bp, Artificial sequence
  SiRNA target sequence
catctggatatagattttata

SEQ ID NO: 13667 - DNA, 21 bp, Artificial sequence
  SiRNA target sequence
atctggatatagattttatag

SEQ ID NO: 13668 - DNA, 21 bp, Artificial sequence
  SiRNA target sequence
tctggatatagattttataga

SEQ ID NO: 13669 - DNA, 21 bp, Artificial sequence
  SiRNA target sequence
ctggatatagattttatagag

SEQ ID NO: 13670 - DNA, 21 bp, Artificial sequence
  SiRNA target sequence
tggatatagattttatagagg

SEQ ID NO: 13671 - DNA, 21 bp, Artificial sequence
  SiRNA target sequence
ggatatagattttatagagga

SEQ ID NO: 13672 - DNA, 21 bp, Artificial sequence
  SiRNA target sequence
gatatagattttatagaggag

SEQ ID NO: 13673 - DNA, 21 bp, Artificial sequence
  SiRNA target sequence
atatagattttatagaggaga

SEQ ID NO: 13674 - DNA, 21 bp, Artificial sequence
  SiRNA target sequence
tatagattttatagaggagat

SEQ ID NO: 13675 - DNA, 21 bp, Artificial sequence
  SiRNA target sequence
atagattttatagaggagatt

SEQ ID NO: 13676 - DNA, 21 bp, Artificial sequence
  SiRNA target sequence
tagattttatagaggagattt

SEQ ID NO: 13677 - DNA, 21 bp, Artificial sequence
  SiRNA target sequence
agattttatagaggagatttg

SEQ ID NO: 13678 - DNA, 21 bp, Artificial sequence
  SiRNA target sequence
gattttatagaggagatttgc

SEQ ID NO: 13679 - DNA, 21 bp, Artificial sequence
  SiRNA target sequence
attttatagaggagatttgcg

SEQ ID NO: 13680 - DNA, 21 bp, Artificial sequence
  SiRNA target sequence
ttttatagaggagatttgcgt

SEQ ID NO: 13681 - DNA, 21 bp, Artificial sequence
  SiRNA target sequence
tttatagaggagatttgcgtt

SEQ ID NO: 13682 - DNA, 21 bp, Artificial sequence
  SiRNA target sequence
ttatagaggagatttgcgtta

SEQ ID NO: 13683 - DNA, 21 bp, Artificial sequence
  SiRNA target sequence
tatagaggagatttgcgttat

SEQ ID NO: 13684 - DNA, 21 bp, Artificial sequence
  SiRNA target sequence
atagaggagatttgcgttata

SEQ ID NO: 13685 - DNA, 21 bp, Artificial sequence
  SiRNA target sequence
tagaggagatttgcgttataa

SEQ ID NO: 13686 - DNA, 21 bp, Artificial sequence
  SiRNA target sequence
agaggagatttgcgttataag

SEQ ID NO: 13687 - DNA, 21 bp, Artificial sequence
  SiRNA target sequence
gaggagatttgcgttataaga

SEQ ID NO: 13688 - DNA, 21 bp, Artificial sequence
  SiRNA target sequence
aggagatttgcgttataagat

SEQ ID NO: 13689 - DNA, 21 bp, Artificial sequence
  SiRNA target sequence
ggagatttgcgttataagatt

SEQ ID NO: 13690 - DNA, 21 bp, Artificial sequence
  SiRNA target sequence
gagatttgcgttataagattg

SEQ ID NO: 13691 - DNA, 21 bp, Artificial sequence
  SiRNA target sequence
agatttgcgttataagattgt

SEQ ID NO: 13692 - DNA, 21 bp, Artificial sequence
  SiRNA target sequence
gatttgcgttataagattgtt

SEQ ID NO: 13693 - DNA, 21 bp, Artificial sequence
  SiRNA target sequence
atttgcgttataagattgttt

SEQ ID NO: 13694 - DNA, 21 bp, Artificial sequence
  SiRNA target sequence
tttgcgttataagattgtttt

SEQ ID NO: 13695 - DNA, 21 bp, Artificial sequence
  SiRNA target sequence
ttgcgttataagattgttttt

SEQ ID NO: 13696 - DNA, 21 bp, Artificial sequence
  SiRNA target sequence
tgcgttataagattgtttttc

SEQ ID NO: 13697 - DNA, 21 bp, Artificial sequence
  SiRNA target sequence
gcgttataagattgtttttcc

SEQ ID NO: 13698 - DNA, 21 bp, Artificial sequence
  SiRNA target sequence
cgttataagattgtttttcca

SEQ ID NO: 13699 - DNA, 21 bp, Artificial sequence
  SiRNA target sequence
gttataagattgtttttccaa

SEQ ID NO: 13700 - DNA, 21 bp, Artificial sequence
  SiRNA target sequence
ttataagattgtttttccaag

SEQ ID NO: 13701 - DNA, 21 bp, Artificial sequence
  SiRNA target sequence
tataagattgtttttccaagt

SEQ ID NO: 13702 - DNA, 21 bp, Artificial sequence
  SiRNA target sequence
ataagattgtttttccaagta

SEQ ID NO: 13703 - DNA, 21 bp, Artificial sequence
  SiRNA target sequence
taagattgtttttccaagtaa

SEQ ID NO: 13704 - DNA, 21 bp, Artificial sequence
  SiRNA target sequence
aagattgtttttccaagtaat

SEQ ID NO: 13705 - DNA, 21 bp, Artificial sequence
  SiRNA target sequence
agattgtttttccaagtaatg

SEQ ID NO: 13706 - DNA, 21 bp, Artificial sequence
  SiRNA target sequence
gattgtttttccaagtaatgt

SEQ ID NO: 13707 - DNA, 21 bp, Artificial sequence
  SiRNA target sequence
attgtttttccaagtaatgtt

SEQ ID NO: 13708 - DNA, 21 bp, Artificial sequence
  SiRNA target sequence
ttgtttttccaagtaatgtta

SEQ ID NO: 13709 - DNA, 21 bp, Artificial sequence
  SiRNA target sequence
tgtttttccaagtaatgttaa

SEQ ID NO: 13710 - DNA, 21 bp, Artificial sequence
  SiRNA target sequence
gtttttccaagtaatgttaat

SEQ ID NO: 13711 - DNA, 21 bp, Artificial sequence
  SiRNA target sequence
tttttccaagtaatgttaata

SEQ ID NO: 13712 - DNA, 21 bp, Artificial sequence
  SiRNA target sequence
ttttccaagtaatgttaatag

SEQ ID NO: 13713 - DNA, 21 bp, Artificial sequence
  SiRNA target sequence
tttccaagtaatgttaatagc

SEQ ID NO: 13714 - DNA, 21 bp, Artificial sequence
  SiRNA target sequence
ttccaagtaatgttaatagca

SEQ ID NO: 13715 - DNA, 21 bp, Artificial sequence
  SiRNA target sequence
tccaagtaatgttaatagcaa

SEQ ID NO: 13716 - DNA, 21 bp, Artificial sequence
  SiRNA target sequence
ccaagtaatgttaatagcaac

SEQ ID NO: 13717 - DNA, 21 bp, Artificial sequence
  SiRNA target sequence
caagtaatgttaatagcaaca

SEQ ID NO: 13718 - DNA, 21 bp, Artificial sequence
  SiRNA target sequence
aagtaatgttaatagcaacat

SEQ ID NO: 13719 - DNA, 21 bp, Artificial sequence
  SiRNA target sequence
agtaatgttaatagcaacatt

SEQ ID NO: 13720 - DNA, 21 bp, Artificial sequence
  SiRNA target sequence
gtaatgttaatagcaacattt

SEQ ID NO: 13721 - DNA, 21 bp, Artificial sequence
  SiRNA target sequence
taatgttaatagcaacatttg

SEQ ID NO: 13722 - DNA, 21 bp, Artificial sequence
  SiRNA target sequence
aatgttaatagcaacatttgg

SEQ ID NO: 13723 - DNA, 21 bp, Artificial sequence
  SiRNA target sequence
atgttaatagcaacatttggg

SEQ ID NO: 13724 - DNA, 21 bp, Artificial sequence
  SiRNA target sequence
tgttaatagcaacatttgggt

SEQ ID NO: 13725 - DNA, 21 bp, Artificial sequence
  SiRNA target sequence
gttaatagcaacatttgggta

SEQ ID NO: 13726 - DNA, 21 bp, Artificial sequence
  SiRNA target sequence
ttaatagcaacatttgggtac

SEQ ID NO: 13727 - DNA, 21 bp, Artificial sequence
  SiRNA target sequence
taatagcaacatttgggtaca

SEQ ID NO: 13728 - DNA, 21 bp, Artificial sequence
  SiRNA target sequence
aatagcaacatttgggtacaa

SEQ ID NO: 13729 - DNA, 21 bp, Artificial sequence
  SiRNA target sequence
atagcaacatttgggtacaac

SEQ ID NO: 13730 - DNA, 21 bp, Artificial sequence
  SiRNA target sequence
tagcaacatttgggtacaaca

SEQ ID NO: 13731 - DNA, 21 bp, Artificial sequence
  SiRNA target sequence
agcaacatttgggtacaacat

SEQ ID NO: 13732 - DNA, 21 bp, Artificial sequence
  SiRNA target sequence
gcaacatttgggtacaacatc

SEQ ID NO: 13733 - DNA, 21 bp, Artificial sequence
  SiRNA target sequence
caacatttgggtacaacatcg

SEQ ID NO: 13734 - DNA, 21 bp, Artificial sequence
  SiRNA target sequence
aacatttgggtacaacatcga

SEQ ID NO: 13735 - DNA, 21 bp, Artificial sequence
  SiRNA target sequence
acatttgggtacaacatcgac

SEQ ID NO: 13736 - DNA, 21 bp, Artificial sequence
  SiRNA target sequence
catttgggtacaacatcgacc

SEQ ID NO: 13737 - DNA, 21 bp, Artificial sequence
  SiRNA target sequence
atttgggtacaacatcgaccg

SEQ ID NO: 13738 - DNA, 21 bp, Artificial sequence
  SiRNA target sequence
tttgggtacaacatcgaccgg

SEQ ID NO: 13739 - DNA, 21 bp, Artificial sequence
  SiRNA target sequence
ttgggtacaacatcgaccgga

SEQ ID NO: 13740 - DNA, 21 bp, Artificial sequence
  SiRNA target sequence
tgggtacaacatcgaccggat

SEQ ID NO: 13741 - DNA, 21 bp, Artificial sequence
  SiRNA target sequence
gggtacaacatcgaccggatc

SEQ ID NO: 13742 - DNA, 21 bp, Artificial sequence
  SiRNA target sequence
ggtacaacatcgaccggatcg

SEQ ID NO: 13743 - DNA, 21 bp, Artificial sequence
  SiRNA target sequence
gtacaacatcgaccggatcgt

SEQ ID NO: 13744 - DNA, 21 bp, Artificial sequence
  SiRNA target sequence
tacaacatcgaccggatcgta

SEQ ID NO: 13745 - DNA, 21 bp, Artificial sequence
  SiRNA target sequence
acaacatcgaccggatcgtag

SEQ ID NO: 13746 - DNA, 21 bp, Artificial sequence
  SiRNA target sequence
caacatcgaccggatcgtaga

SEQ ID NO: 13747 - DNA, 21 bp, Artificial sequence
  SiRNA target sequence
aacatcgaccggatcgtagac

SEQ ID NO: 13748 - DNA, 21 bp, Artificial sequence
  SiRNA target sequence
acatcgaccggatcgtagact

SEQ ID NO: 13749 - DNA, 21 bp, Artificial sequence
  SiRNA target sequence
catcgaccggatcgtagactg

SEQ ID NO: 13750 - DNA, 21 bp, Artificial sequence
  SiRNA target sequence
atcgaccggatcgtagactgg

SEQ ID NO: 13751 - DNA, 21 bp, Artificial sequence
  SiRNA target sequence
tcgaccggatcgtagactgga

SEQ ID NO: 13752 - DNA, 21 bp, Artificial sequence
  SiRNA target sequence
cgaccggatcgtagactggaa

SEQ ID NO: 13753 - DNA, 21 bp, Artificial sequence
  SiRNA target sequence
gaccggatcgtagactggaag

SEQ ID NO: 13754 - DNA, 21 bp, Artificial sequence
  SiRNA target sequence
accggatcgtagactggaagg

SEQ ID NO: 13755 - DNA, 21 bp, Artificial sequence
  SiRNA target sequence
ccggatcgtagactggaagga

SEQ ID NO: 13756 - DNA, 21 bp, Artificial sequence
  SiRNA target sequence
cggatcgtagactggaaggat

SEQ ID NO: 13757 - DNA, 21 bp, Artificial sequence
  SiRNA target sequence
ggatcgtagactggaaggatg

SEQ ID NO: 13758 - DNA, 21 bp, Artificial sequence
  SiRNA target sequence
gatcgtagactggaaggatgg

SEQ ID NO: 13759 - DNA, 21 bp, Artificial sequence
  SiRNA target sequence
atcgtagactggaaggatggt

SEQ ID NO: 13760 - DNA, 21 bp, Artificial sequence
  SiRNA target sequence
tcgtagactggaaggatggtc

SEQ ID NO: 13761 - DNA, 21 bp, Artificial sequence
  SiRNA target sequence
cgtagactggaaggatggtcc

SEQ ID NO: 13762 - DNA, 21 bp, Artificial sequence
  SiRNA target sequence
gtagactggaaggatggtccg

SEQ ID NO: 13763 - DNA, 21 bp, Artificial sequence
  SiRNA target sequence
tagactggaaggatggtccgc

SEQ ID NO: 13764 - DNA, 21 bp, Artificial sequence
  SiRNA target sequence
agactggaaggatggtccgcg

SEQ ID NO: 13765 - DNA, 21 bp, Artificial sequence
  SiRNA target sequence
gactggaaggatggtccgcgg

SEQ ID NO: 13766 - DNA, 21 bp, Artificial sequence
  SiRNA target sequence
actggaaggatggtccgcggc

SEQ ID NO: 13767 - DNA, 21 bp, Artificial sequence
  SiRNA target sequence
ctggaaggatggtccgcggct

SEQ ID NO: 13768 - DNA, 21 bp, Artificial sequence
  SiRNA target sequence
tggaaggatggtccgcggcta

SEQ ID NO: 13769 - DNA, 21 bp, Artificial sequence
  SiRNA target sequence
ggaaggatggtccgcggctaa

SEQ ID NO: 13770 - DNA, 21 bp, Artificial sequence
  SiRNA target sequence
gaaggatggtccgcggctaag

SEQ ID NO: 13771 - DNA, 21 bp, Artificial sequence
  SiRNA target sequence
aaggatggtccgcggctaaga

SEQ ID NO: 13772 - DNA, 21 bp, Artificial sequence
  SiRNA target sequence
aggatggtccgcggctaagat

SEQ ID NO: 13773 - DNA, 21 bp, Artificial sequence
  SiRNA target sequence
ggatggtccgcggctaagatt

SEQ ID NO: 13774 - DNA, 21 bp, Artificial sequence
  SiRNA target sequence
gatggtccgcggctaagattg

SEQ ID NO: 13775 - DNA, 21 bp, Artificial sequence
  SiRNA target sequence
atggtccgcggctaagattgt

SEQ ID NO: 13776 - DNA, 21 bp, Artificial sequence
  SiRNA target sequence
tggtccgcggctaagattgta

SEQ ID NO: 13777 - DNA, 21 bp, Artificial sequence
  SiRNA target sequence
ggtccgcggctaagattgtaa

SEQ ID NO: 13778 - DNA, 21 bp, Artificial sequence
  SiRNA target sequence
gtccgcggctaagattgtaaa

SEQ ID NO: 13779 - DNA, 21 bp, Artificial sequence
  SiRNA target sequence
tccgcggctaagattgtaaat

SEQ ID NO: 13780 - DNA, 21 bp, Artificial sequence
  SiRNA target sequence
ccgcggctaagattgtaaatt

SEQ ID NO: 13781 - DNA, 21 bp, Artificial sequence
  SiRNA target sequence
cgcggctaagattgtaaattg

SEQ ID NO: 13782 - DNA, 21 bp, Artificial sequence
  SiRNA target sequence
gcggctaagattgtaaattgt

SEQ ID NO: 13783 - DNA, 21 bp, Artificial sequence
  SiRNA target sequence
cggctaagattgtaaattgtg

SEQ ID NO: 13784 - DNA, 21 bp, Artificial sequence
  SiRNA target sequence
ggctaagattgtaaattgtga

SEQ ID NO: 13785 - DNA, 21 bp, Artificial sequence
  SiRNA target sequence
gctaagattgtaaattgtgat

SEQ ID NO: 13786 - DNA, 21 bp, Artificial sequence
  SiRNA target sequence
ctaagattgtaaattgtgatg

SEQ ID NO: 13787 - DNA, 21 bp, Artificial sequence
  SiRNA target sequence
taagattgtaaattgtgatgc

SEQ ID NO: 13788 - DNA, 21 bp, Artificial sequence
  SiRNA target sequence
aagattgtaaattgtgatgct

SEQ ID NO: 13789 - DNA, 21 bp, Artificial sequence
  SiRNA target sequence
agattgtaaattgtgatgctg

SEQ ID NO: 13790 - DNA, 21 bp, Artificial sequence
  SiRNA target sequence
gattgtaaattgtgatgctgt

SEQ ID NO: 13791 - DNA, 21 bp, Artificial sequence
  SiRNA target sequence
attgtaaattgtgatgctgtg

SEQ ID NO: 13792 - DNA, 21 bp, Artificial sequence
  SiRNA target sequence
ttgtaaattgtgatgctgtgt

SEQ ID NO: 13793 - DNA, 21 bp, Artificial sequence
  SiRNA target sequence
tgtaaattgtgatgctgtgtc

SEQ ID NO: 13794 - DNA, 21 bp, Artificial sequence
  SiRNA target sequence
gtaaattgtgatgctgtgtct

SEQ ID NO: 13795 - DNA, 21 bp, Artificial sequence
  SiRNA target sequence
taaattgtgatgctgtgtcta

SEQ ID NO: 13796 - DNA, 21 bp, Artificial sequence
  SiRNA target sequence
aaattgtgatgctgtgtctac

SEQ ID NO: 13797 - DNA, 21 bp, Artificial sequence
  SiRNA target sequence
aattgtgatgctgtgtctact

SEQ ID NO: 13798 - DNA, 21 bp, Artificial sequence
  SiRNA target sequence
attgtgatgctgtgtctactg

SEQ ID NO: 13799 - DNA, 21 bp, Artificial sequence
  SiRNA target sequence
ttgtgatgctgtgtctactgg

SEQ ID NO: 13800 - DNA, 21 bp, Artificial sequence
  SiRNA target sequence
tgtgatgctgtgtctactggt

SEQ ID NO: 13801 - DNA, 21 bp, Artificial sequence
  SiRNA target sequence
gtgatgctgtgtctactggtc

SEQ ID NO: 13802 - DNA, 21 bp, Artificial sequence
  SiRNA target sequence
tgatgctgtgtctactggtca

SEQ ID NO: 13803 - DNA, 21 bp, Artificial sequence
  SiRNA target sequence
gatgctgtgtctactggtcaa

SEQ ID NO: 13804 - DNA, 21 bp, Artificial sequence
  SiRNA target sequence
atgctgtgtctactggtcaag

SEQ ID NO: 13805 - DNA, 21 bp, Artificial sequence
  SiRNA target sequence
tgctgtgtctactggtcaagg

SEQ ID NO: 13806 - DNA, 21 bp, Artificial sequence
  SiRNA target sequence
gctgtgtctactggtcaaggg

SEQ ID NO: 13807 - DNA, 21 bp, Artificial sequence
  SiRNA target sequence
ctgtgtctactggtcaagggg

SEQ ID NO: 13808 - DNA, 21 bp, Artificial sequence
  SiRNA target sequence
tgtgtctactggtcaaggggt

SEQ ID NO: 13809 - DNA, 21 bp, Artificial sequence
  SiRNA target sequence
gtgtctactggtcaaggggtg

SEQ ID NO: 13810 - DNA, 21 bp, Artificial sequence
  SiRNA target sequence
tgtctactggtcaaggggtgt

SEQ ID NO: 13811 - DNA, 21 bp, Artificial sequence
  SiRNA target sequence
gtctactggtcaaggggtgta

SEQ ID NO: 13812 - DNA, 21 bp, Artificial sequence
  SiRNA target sequence
tctactggtcaaggggtgtat

SEQ ID NO: 13813 - DNA, 21 bp, Artificial sequence
  SiRNA target sequence
ctactggtcaaggggtgtata

SEQ ID NO: 13814 - DNA, 21 bp, Artificial sequence
  SiRNA target sequence
tactggtcaaggggtgtataa

SEQ ID NO: 13815 - DNA, 21 bp, Artificial sequence
  SiRNA target sequence
actggtcaaggggtgtataat

SEQ ID NO: 13816 - DNA, 21 bp, Artificial sequence
  SiRNA target sequence
ctggtcaaggggtgtataatc

SEQ ID NO: 13817 - DNA, 21 bp, Artificial sequence
  SiRNA target sequence
tggtcaaggggtgtataatca

SEQ ID NO: 13818 - DNA, 21 bp, Artificial sequence
  SiRNA target sequence
ggtcaaggggtgtataatcat

SEQ ID NO: 13819 - DNA, 21 bp, Artificial sequence
  SiRNA target sequence
gtcaaggggtgtataatcatg

SEQ ID NO: 13820 - DNA, 21 bp, Artificial sequence
  SiRNA target sequence
tcaaggggtgtataatcatgg

SEQ ID NO: 13821 - DNA, 21 bp, Artificial sequence
  SiRNA target sequence
caaggggtgtataatcatggt

SEQ ID NO: 13822 - DNA, 21 bp, Artificial sequence
  SiRNA target sequence
aaggggtgtataatcatggtt

SEQ ID NO: 13823 - DNA, 21 bp, Artificial sequence
  SiRNA target sequence
aggggtgtataatcatggtta

SEQ ID NO: 13824 - DNA, 21 bp, Artificial sequence
  SiRNA target sequence
ggggtgtataatcatggttat

SEQ ID NO: 13825 - DNA, 21 bp, Artificial sequence
  SiRNA target sequence
gggtgtataatcatggttatg

SEQ ID NO: 13826 - DNA, 21 bp, Artificial sequence
  SiRNA target sequence
ggtgtataatcatggttatgc

SEQ ID NO: 13827 - DNA, 21 bp, Artificial sequence
  SiRNA target sequence
gtgtataatcatggttatgct

SEQ ID NO: 13828 - DNA, 21 bp, Artificial sequence
  SiRNA target sequence
tgtataatcatggttatgcta

SEQ ID NO: 13829 - DNA, 21 bp, Artificial sequence
  SiRNA target sequence
gtataatcatggttatgctag

SEQ ID NO: 13830 - DNA, 21 bp, Artificial sequence
  SiRNA target sequence
tataatcatggttatgctagt

SEQ ID NO: 13831 - DNA, 21 bp, Artificial sequence
  SiRNA target sequence
ataatcatggttatgctagtc

SEQ ID NO: 13832 - DNA, 21 bp, Artificial sequence
  SiRNA target sequence
taatcatggttatgctagtca

SEQ ID NO: 13833 - DNA, 21 bp, Artificial sequence
  SiRNA target sequence
aatcatggttatgctagtcac

SEQ ID NO: 13834 - DNA, 21 bp, Artificial sequence
  SiRNA target sequence
atcatggttatgctagtcaca

SEQ ID NO: 13835 - DNA, 21 bp, Artificial sequence
  SiRNA target sequence
tcatggttatgctagtcacat

SEQ ID NO: 13836 - DNA, 21 bp, Artificial sequence
  SiRNA target sequence
catggttatgctagtcacatt

SEQ ID NO: 13837 - DNA, 21 bp, Artificial sequence
  SiRNA target sequence
atggttatgctagtcacattc

SEQ ID NO: 13838 - DNA, 21 bp, Artificial sequence
  SiRNA target sequence
tggttatgctagtcacattca

SEQ ID NO: 13839 - DNA, 21 bp, Artificial sequence
  SiRNA target sequence
ggttatgctagtcacattcaa

SEQ ID NO: 13840 - DNA, 21 bp, Artificial sequence
  SiRNA target sequence
gttatgctagtcacattcaaa

SEQ ID NO: 13841 - DNA, 21 bp, Artificial sequence
  SiRNA target sequence
ttatgctagtcacattcaaat

SEQ ID NO: 13842 - DNA, 21 bp, Artificial sequence
  SiRNA target sequence
tatgctagtcacattcaaatc

SEQ ID NO: 13843 - DNA, 21 bp, Artificial sequence
  SiRNA target sequence
atgctagtcacattcaaatca

SEQ ID NO: 13844 - DNA, 21 bp, Artificial sequence
  SiRNA target sequence
tgctagtcacattcaaatcac

SEQ ID NO: 13845 - DNA, 21 bp, Artificial sequence
  SiRNA target sequence
gctagtcacattcaaatcacg

SEQ ID NO: 13846 - DNA, 21 bp, Artificial sequence
  SiRNA target sequence
ctagtcacattcaaatcacgc

SEQ ID NO: 13847 - DNA, 21 bp, Artificial sequence
  SiRNA target sequence
tagtcacattcaaatcacgcg

SEQ ID NO: 13848 - DNA, 21 bp, Artificial sequence
  SiRNA target sequence
agtcacattcaaatcacgcgt

SEQ ID NO: 13849 - DNA, 21 bp, Artificial sequence
  SiRNA target sequence
gtcacattcaaatcacgcgtg

SEQ ID NO: 13850 - DNA, 21 bp, Artificial sequence
  SiRNA target sequence
tcacattcaaatcacgcgtgt

SEQ ID NO: 13851 - DNA, 21 bp, Artificial sequence
  SiRNA target sequence
cacattcaaatcacgcgtgta

SEQ ID NO: 13852 - DNA, 21 bp, Artificial sequence
  SiRNA target sequence
acattcaaatcacgcgtgtaa

SEQ ID NO: 13853 - DNA, 21 bp, Artificial sequence
  SiRNA target sequence
cattcaaatcacgcgtgtaaa

SEQ ID NO: 13854 - DNA, 21 bp, Artificial sequence
  SiRNA target sequence
attcaaatcacgcgtgtaaat

SEQ ID NO: 13855 - DNA, 21 bp, Artificial sequence
  SiRNA target sequence
ttcaaatcacgcgtgtaaata

SEQ ID NO: 13856 - DNA, 21 bp, Artificial sequence
  SiRNA target sequence
tcaaatcacgcgtgtaaataa

SEQ ID NO: 13857 - DNA, 21 bp, Artificial sequence
  SiRNA target sequence
caaatcacgcgtgtaaataat

SEQ ID NO: 13858 - DNA, 21 bp, Artificial sequence
  SiRNA target sequence
aaatcacgcgtgtaaataatg

SEQ ID NO: 13859 - DNA, 21 bp, Artificial sequence
  SiRNA target sequence
aatcacgcgtgtaaataatgt

SEQ ID NO: 13860 - DNA, 21 bp, Artificial sequence
  SiRNA target sequence
atcacgcgtgtaaataatgtt

SEQ ID NO: 13861 - DNA, 21 bp, Artificial sequence
  SiRNA target sequence
tcacgcgtgtaaataatgtta

SEQ ID NO: 13862 - DNA, 21 bp, Artificial sequence
  SiRNA target sequence
cacgcgtgtaaataatgttat

SEQ ID NO: 13863 - DNA, 21 bp, Artificial sequence
  SiRNA target sequence
acgcgtgtaaataatgttata

SEQ ID NO: 13864 - DNA, 21 bp, Artificial sequence
  SiRNA target sequence
cgcgtgtaaataatgttatag

SEQ ID NO: 13865 - DNA, 21 bp, Artificial sequence
  SiRNA target sequence
gcgtgtaaataatgttataga

SEQ ID NO: 13866 - DNA, 21 bp, Artificial sequence
  SiRNA target sequence
cgtgtaaataatgttatagaa

SEQ ID NO: 13867 - DNA, 21 bp, Artificial sequence
  SiRNA target sequence
gtgtaaataatgttatagaat

SEQ ID NO: 13868 - DNA, 21 bp, Artificial sequence
  SiRNA target sequence
tgtaaataatgttatagaatt

SEQ ID NO: 13869 - DNA, 21 bp, Artificial sequence
  SiRNA target sequence
gtaaataatgttatagaattg

SEQ ID NO: 13870 - DNA, 21 bp, Artificial sequence
  SiRNA target sequence
taaataatgttatagaattgg

SEQ ID NO: 13871 - DNA, 21 bp, Artificial sequence
  SiRNA target sequence
aaataatgttatagaattgga

SEQ ID NO: 13872 - DNA, 21 bp, Artificial sequence
  SiRNA target sequence
aataatgttatagaattggaa

SEQ ID NO: 13873 - DNA, 21 bp, Artificial sequence
  SiRNA target sequence
ataatgttatagaattggaag

SEQ ID NO: 13874 - DNA, 21 bp, Artificial sequence
  SiRNA target sequence
taatgttatagaattggaagt

SEQ ID NO: 13875 - DNA, 21 bp, Artificial sequence
  SiRNA target sequence
aatgttatagaattggaagtt

SEQ ID NO: 13876 - DNA, 21 bp, Artificial sequence
  SiRNA target sequence
atgttatagaattggaagttc

SEQ ID NO: 13877 - DNA, 21 bp, Artificial sequence
  SiRNA target sequence
tgttatagaattggaagttcc

SEQ ID NO: 13878 - DNA, 21 bp, Artificial sequence
  SiRNA target sequence
gttatagaattggaagttcca

SEQ ID NO: 13879 - DNA, 21 bp, Artificial sequence
  SiRNA target sequence
ttatagaattggaagttccat

SEQ ID NO: 13880 - DNA, 21 bp, Artificial sequence
  SiRNA target sequence
tatagaattggaagttccatt

SEQ ID NO: 13881 - DNA, 21 bp, Artificial sequence
  SiRNA target sequence
atagaattggaagttccattt

SEQ ID NO: 13882 - DNA, 21 bp, Artificial sequence
  SiRNA target sequence
tagaattggaagttccatttt

SEQ ID NO: 13883 - DNA, 21 bp, Artificial sequence
  SiRNA target sequence
agaattggaagttccatttta

SEQ ID NO: 13884 - DNA, 21 bp, Artificial sequence
  SiRNA target sequence
gaattggaagttccattttat

SEQ ID NO: 13885 - DNA, 21 bp, Artificial sequence
  SiRNA target sequence
aattggaagttccattttata

SEQ ID NO: 13886 - DNA, 21 bp, Artificial sequence
  SiRNA target sequence
attggaagttccattttataa

SEQ ID NO: 13887 - DNA, 21 bp, Artificial sequence
  SiRNA target sequence
ttggaagttccattttataat

SEQ ID NO: 13888 - DNA, 21 bp, Artificial sequence
  SiRNA target sequence
tggaagttccattttataatg

SEQ ID NO: 13889 - DNA, 21 bp, Artificial sequence
  SiRNA target sequence
ggaagttccattttataatgc

SEQ ID NO: 13890 - DNA, 21 bp, Artificial sequence
  SiRNA target sequence
gaagttccattttataatgct

SEQ ID NO: 13891 - DNA, 21 bp, Artificial sequence
  SiRNA target sequence
aagttccattttataatgcta

SEQ ID NO: 13892 - DNA, 21 bp, Artificial sequence
  SiRNA target sequence
agttccattttataatgctac

SEQ ID NO: 13893 - DNA, 21 bp, Artificial sequence
  SiRNA target sequence
gttccattttataatgctact

SEQ ID NO: 13894 - DNA, 21 bp, Artificial sequence
  SiRNA target sequence
ttccattttataatgctactt

SEQ ID NO: 13895 - DNA, 21 bp, Artificial sequence
  SiRNA target sequence
tccattttataatgctacttg

SEQ ID NO: 13896 - DNA, 21 bp, Artificial sequence
  SiRNA target sequence
ccattttataatgctacttgt

SEQ ID NO: 13897 - DNA, 21 bp, Artificial sequence
  SiRNA target sequence
cattttataatgctacttgtt

SEQ ID NO: 13898 - DNA, 21 bp, Artificial sequence
  SiRNA target sequence
attttataatgctacttgtta

SEQ ID NO: 13899 - DNA, 21 bp, Artificial sequence
  SiRNA target sequence
ttttataatgctacttgttat

SEQ ID NO: 13900 - DNA, 21 bp, Artificial sequence
  SiRNA target sequence
tttataatgctacttgttata

SEQ ID NO: 13901 - DNA, 21 bp, Artificial sequence
  SiRNA target sequence
ttataatgctacttgttataa

SEQ ID NO: 13902 - DNA, 21 bp, Artificial sequence
  SiRNA target sequence
tataatgctacttgttataat

SEQ ID NO: 13903 - DNA, 21 bp, Artificial sequence
  SiRNA target sequence
ataatgctacttgttataatt

SEQ ID NO: 13904 - DNA, 21 bp, Artificial sequence
  SiRNA target sequence
taatgctacttgttataatta

SEQ ID NO: 13905 - DNA, 21 bp, Artificial sequence
  SiRNA target sequence
aatgctacttgttataattat

SEQ ID NO: 13906 - DNA, 21 bp, Artificial sequence
  SiRNA target sequence
atgctacttgttataattatt

SEQ ID NO: 13907 - DNA, 21 bp, Artificial sequence
  SiRNA target sequence
tgctacttgttataattattt

SEQ ID NO: 13908 - DNA, 21 bp, Artificial sequence
  SiRNA target sequence
gctacttgttataattattta

SEQ ID NO: 13909 - DNA, 21 bp, Artificial sequence
  SiRNA target sequence
ctacttgttataattatttac

SEQ ID NO: 13910 - DNA, 21 bp, Artificial sequence
  SiRNA target sequence
tacttgttataattatttaca

SEQ ID NO: 13911 - DNA, 21 bp, Artificial sequence
  SiRNA target sequence
acttgttataattatttacag

SEQ ID NO: 13912 - DNA, 21 bp, Artificial sequence
  SiRNA target sequence
cttgttataattatttacagg

SEQ ID NO: 13913 - DNA, 21 bp, Artificial sequence
  SiRNA target sequence
ttgttataattatttacaggc

SEQ ID NO: 13914 - DNA, 21 bp, Artificial sequence
  SiRNA target sequence
tgttataattatttacaggcg

SEQ ID NO: 13915 - DNA, 21 bp, Artificial sequence
  SiRNA target sequence
gttataattatttacaggcgt

SEQ ID NO: 13916 - DNA, 21 bp, Artificial sequence
  SiRNA target sequence
ttataattatttacaggcgtt

SEQ ID NO: 13917 - DNA, 21 bp, Artificial sequence
  SiRNA target sequence
tataattatttacaggcgttt

SEQ ID NO: 13918 - DNA, 21 bp, Artificial sequence
  SiRNA target sequence
ataattatttacaggcgttta

SEQ ID NO: 13919 - DNA, 21 bp, Artificial sequence
  SiRNA target sequence
taattatttacaggcgtttaa

SEQ ID NO: 13920 - DNA, 21 bp, Artificial sequence
  SiRNA target sequence
aattatttacaggcgtttaat

SEQ ID NO: 13921 - DNA, 21 bp, Artificial sequence
  SiRNA target sequence
attatttacaggcgtttaatg

SEQ ID NO: 13922 - DNA, 21 bp, Artificial sequence
  SiRNA target sequence
ttatttacaggcgtttaatgc

SEQ ID NO: 13923 - DNA, 21 bp, Artificial sequence
  SiRNA target sequence
tatttacaggcgtttaatgcg

SEQ ID NO: 13924 - DNA, 21 bp, Artificial sequence
  SiRNA target sequence
atttacaggcgtttaatgcgt

SEQ ID NO: 13925 - DNA, 21 bp, Artificial sequence
  SiRNA target sequence
tttacaggcgtttaatgcgtc

SEQ ID NO: 13926 - DNA, 21 bp, Artificial sequence
  SiRNA target sequence
ttacaggcgtttaatgcgtct

SEQ ID NO: 13927 - DNA, 21 bp, Artificial sequence
  SiRNA target sequence
tacaggcgtttaatgcgtcta

SEQ ID NO: 13928 - DNA, 21 bp, Artificial sequence
  SiRNA target sequence
acaggcgtttaatgcgtctag

SEQ ID NO: 13929 - DNA, 21 bp, Artificial sequence
  SiRNA target sequence
caggcgtttaatgcgtctagc

SEQ ID NO: 13930 - DNA, 21 bp, Artificial sequence
  SiRNA target sequence
aggcgtttaatgcgtctagcg

SEQ ID NO: 13931 - DNA, 21 bp, Artificial sequence
  SiRNA target sequence
ggcgtttaatgcgtctagcgc

SEQ ID NO: 13932 - DNA, 21 bp, Artificial sequence
  SiRNA target sequence
gcgtttaatgcgtctagcgct

SEQ ID NO: 13933 - DNA, 21 bp, Artificial sequence
  SiRNA target sequence
cgtttaatgcgtctagcgctg

SEQ ID NO: 13934 - DNA, 21 bp, Artificial sequence
  SiRNA target sequence
gtttaatgcgtctagcgctgc

SEQ ID NO: 13935 - DNA, 21 bp, Artificial sequence
  SiRNA target sequence
tttaatgcgtctagcgctgca

SEQ ID NO: 13936 - DNA, 21 bp, Artificial sequence
  SiRNA target sequence
ttaatgcgtctagcgctgcat

SEQ ID NO: 13937 - DNA, 21 bp, Artificial sequence
  SiRNA target sequence
taatgcgtctagcgctgcatc

SEQ ID NO: 13938 - DNA, 21 bp, Artificial sequence
  SiRNA target sequence
aatgcgtctagcgctgcatct

SEQ ID NO: 13939 - DNA, 21 bp, Artificial sequence
  SiRNA target sequence
atgcgtctagcgctgcatcta

SEQ ID NO: 13940 - DNA, 21 bp, Artificial sequence
  SiRNA target sequence
tgcgtctagcgctgcatctag

SEQ ID NO: 13941 - DNA, 21 bp, Artificial sequence
  SiRNA target sequence
gcgtctagcgctgcatctagt

SEQ ID NO: 13942 - DNA, 21 bp, Artificial sequence
  SiRNA target sequence
cgtctagcgctgcatctagtt

SEQ ID NO: 13943 - DNA, 21 bp, Artificial sequence
  SiRNA target sequence
gtctagcgctgcatctagtta

SEQ ID NO: 13944 - DNA, 21 bp, Artificial sequence
  SiRNA target sequence
tctagcgctgcatctagttat

SEQ ID NO: 13945 - DNA, 21 bp, Artificial sequence
  SiRNA target sequence
ctagcgctgcatctagttatg

SEQ ID NO: 13946 - DNA, 21 bp, Artificial sequence
  SiRNA target sequence
tagcgctgcatctagttatgc

SEQ ID NO: 13947 - DNA, 21 bp, Artificial sequence
  SiRNA target sequence
agcgctgcatctagttatgca

SEQ ID NO: 13948 - DNA, 21 bp, Artificial sequence
  SiRNA target sequence
gcgctgcatctagttatgcag

SEQ ID NO: 13949 - DNA, 21 bp, Artificial sequence
  SiRNA target sequence
cgctgcatctagttatgcagt

SEQ ID NO: 13950 - DNA, 21 bp, Artificial sequence
  SiRNA target sequence
gctgcatctagttatgcagta

SEQ ID NO: 13951 - DNA, 21 bp, Artificial sequence
  SiRNA target sequence
ctgcatctagttatgcagtat

SEQ ID NO: 13952 - DNA, 21 bp, Artificial sequence
  SiRNA target sequence
tgcatctagttatgcagtatc

SEQ ID NO: 13953 - DNA, 21 bp, Artificial sequence
  SiRNA target sequence
gcatctagttatgcagtatct

SEQ ID NO: 13954 - DNA, 21 bp, Artificial sequence
  SiRNA target sequence
catctagttatgcagtatctt

SEQ ID NO: 13955 - DNA, 21 bp, Artificial sequence
  SiRNA target sequence
atctagttatgcagtatcttt

SEQ ID NO: 13956 - DNA, 21 bp, Artificial sequence
  SiRNA target sequence
tctagttatgcagtatcttta

SEQ ID NO: 13957 - DNA, 21 bp, Artificial sequence
  SiRNA target sequence
ctagttatgcagtatctttag

SEQ ID NO: 13958 - DNA, 21 bp, Artificial sequence
  SiRNA target sequence
tagttatgcagtatctttagg

SEQ ID NO: 13959 - DNA, 21 bp, Artificial sequence
  SiRNA target sequence
agttatgcagtatctttagga

SEQ ID NO: 13960 - DNA, 21 bp, Artificial sequence
  SiRNA target sequence
gttatgcagtatctttaggag

SEQ ID NO: 13961 - DNA, 21 bp, Artificial sequence
  SiRNA target sequence
ttatgcagtatctttaggaga

SEQ ID NO: 13962 - DNA, 21 bp, Artificial sequence
  SiRNA target sequence
tatgcagtatctttaggagaa

SEQ ID NO: 13963 - DNA, 21 bp, Artificial sequence
  SiRNA target sequence
atgcagtatctttaggagaaa

SEQ ID NO: 13964 - DNA, 21 bp, Artificial sequence
  SiRNA target sequence
tgcagtatctttaggagaaat

SEQ ID NO: 13965 - DNA, 21 bp, Artificial sequence
  SiRNA target sequence
gcagtatctttaggagaaata

SEQ ID NO: 13966 - DNA, 21 bp, Artificial sequence
  SiRNA target sequence
cagtatctttaggagaaatat

SEQ ID NO: 13967 - DNA, 21 bp, Artificial sequence
  SiRNA target sequence
agtatctttaggagaaatatc

SEQ ID NO: 13968 - DNA, 21 bp, Artificial sequence
  SiRNA target sequence
gtatctttaggagaaatatcg

SEQ ID NO: 13969 - DNA, 21 bp, Artificial sequence
  SiRNA target sequence
tatctttaggagaaatatcgg

SEQ ID NO: 13970 - DNA, 21 bp, Artificial sequence
  SiRNA target sequence
atctttaggagaaatatcggt

SEQ ID NO: 13971 - DNA, 21 bp, Artificial sequence
  SiRNA target sequence
tctttaggagaaatatcggtt

SEQ ID NO: 13972 - DNA, 21 bp, Artificial sequence
  SiRNA target sequence
ctttaggagaaatatcggttg

SEQ ID NO: 13973 - DNA, 21 bp, Artificial sequence
  SiRNA target sequence
tttaggagaaatatcggttgg

SEQ ID NO: 13974 - DNA, 21 bp, Artificial sequence
  SiRNA target sequence
ttaggagaaatatcggttggt

SEQ ID NO: 13975 - DNA, 21 bp, Artificial sequence
  SiRNA target sequence
taggagaaatatcggttggtt

SEQ ID NO: 13976 - DNA, 21 bp, Artificial sequence
  SiRNA target sequence
aggagaaatatcggttggttt

SEQ ID NO: 13977 - DNA, 21 bp, Artificial sequence
  SiRNA target sequence
ggagaaatatcggttggtttt

SEQ ID NO: 13978 - DNA, 21 bp, Artificial sequence
  SiRNA target sequence
gagaaatatcggttggttttc

SEQ ID NO: 13979 - DNA, 21 bp, Artificial sequence
  SiRNA target sequence
agaaatatcggttggttttca

SEQ ID NO: 13980 - DNA, 21 bp, Artificial sequence
  SiRNA target sequence
gaaatatcggttggttttcaa

SEQ ID NO: 13981 - DNA, 21 bp, Artificial sequence
  SiRNA target sequence
aaatatcggttggttttcaag

SEQ ID NO: 13982 - DNA, 21 bp, Artificial sequence
  SiRNA target sequence
aatatcggttggttttcaagc

SEQ ID NO: 13983 - DNA, 21 bp, Artificial sequence
  SiRNA target sequence
atatcggttggttttcaagct

SEQ ID NO: 13984 - DNA, 21 bp, Artificial sequence
  SiRNA target sequence
tatcggttggttttcaagcta

SEQ ID NO: 13985 - DNA, 21 bp, Artificial sequence
  SiRNA target sequence
atcggttggttttcaagctac

SEQ ID NO: 13986 - DNA, 21 bp, Artificial sequence
  SiRNA target sequence
tcggttggttttcaagctaca

SEQ ID NO: 13987 - DNA, 21 bp, Artificial sequence
  SiRNA target sequence
cggttggttttcaagctacaa

SEQ ID NO: 13988 - DNA, 21 bp, Artificial sequence
  SiRNA target sequence
ggttggttttcaagctacaag

SEQ ID NO: 13989 - DNA, 21 bp, Artificial sequence
  SiRNA target sequence
gttggttttcaagctacaagt

SEQ ID NO: 13990 - DNA, 21 bp, Artificial sequence
  SiRNA target sequence
ttggttttcaagctacaagtg

SEQ ID NO: 13991 - DNA, 21 bp, Artificial sequence
  SiRNA target sequence
tggttttcaagctacaagtga

SEQ ID NO: 13992 - DNA, 21 bp, Artificial sequence
  SiRNA target sequence
ggttttcaagctacaagtgat

SEQ ID NO: 13993 - DNA, 21 bp, Artificial sequence
  SiRNA target sequence
gttttcaagctacaagtgatg

SEQ ID NO: 13994 - DNA, 21 bp, Artificial sequence
  SiRNA target sequence
ttttcaagctacaagtgatga

SEQ ID NO: 13995 - DNA, 21 bp, Artificial sequence
  SiRNA target sequence
tttcaagctacaagtgatgat

SEQ ID NO: 13996 - DNA, 21 bp, Artificial sequence
  SiRNA target sequence
ttcaagctacaagtgatgata

SEQ ID NO: 13997 - DNA, 21 bp, Artificial sequence
  SiRNA target sequence
tcaagctacaagtgatgatat

SEQ ID NO: 13998 - DNA, 21 bp, Artificial sequence
  SiRNA target sequence
caagctacaagtgatgatatt

SEQ ID NO: 13999 - DNA, 21 bp, Artificial sequence
  SiRNA target sequence
aagctacaagtgatgatattg

SEQ ID NO: 14000 - DNA, 21 bp, Artificial sequence
  SiRNA target sequence
agctacaagtgatgatattgc

SEQ ID NO: 14001 - DNA, 21 bp, Artificial sequence
  SiRNA target sequence
gctacaagtgatgatattgca

SEQ ID NO: 14002 - DNA, 21 bp, Artificial sequence
  SiRNA target sequence
ctacaagtgatgatattgcat

SEQ ID NO: 14003 - DNA, 21 bp, Artificial sequence
  SiRNA target sequence
tacaagtgatgatattgcatc

SEQ ID NO: 14004 - DNA, 21 bp, Artificial sequence
  SiRNA target sequence
acaagtgatgatattgcatct

SEQ ID NO: 14005 - DNA, 21 bp, Artificial sequence
  SiRNA target sequence
caagtgatgatattgcatcta

SEQ ID NO: 14006 - DNA, 21 bp, Artificial sequence
  SiRNA target sequence
aagtgatgatattgcatctat

SEQ ID NO: 14007 - DNA, 21 bp, Artificial sequence
  SiRNA target sequence
agtgatgatattgcatctatt

SEQ ID NO: 14008 - DNA, 21 bp, Artificial sequence
  SiRNA target sequence
gtgatgatattgcatctattg

SEQ ID NO: 14009 - DNA, 21 bp, Artificial sequence
  SiRNA target sequence
tgatgatattgcatctattgt

SEQ ID NO: 14010 - DNA, 21 bp, Artificial sequence
  SiRNA target sequence
gatgatattgcatctattgtt

SEQ ID NO: 14011 - DNA, 21 bp, Artificial sequence
  SiRNA target sequence
atgatattgcatctattgtta

SEQ ID NO: 14012 - DNA, 21 bp, Artificial sequence
  SiRNA target sequence
tgatattgcatctattgttaa

SEQ ID NO: 14013 - DNA, 21 bp, Artificial sequence
  SiRNA target sequence
gatattgcatctattgttaac

SEQ ID NO: 14014 - DNA, 21 bp, Artificial sequence
  SiRNA target sequence
atattgcatctattgttaaca

SEQ ID NO: 14015 - DNA, 21 bp, Artificial sequence
  SiRNA target sequence
tattgcatctattgttaacaa

SEQ ID NO: 14016 - DNA, 21 bp, Artificial sequence
  SiRNA target sequence
attgcatctattgttaacaaa

SEQ ID NO: 14017 - DNA, 21 bp, Artificial sequence
  SiRNA target sequence
ttgcatctattgttaacaaac

SEQ ID NO: 14018 - DNA, 21 bp, Artificial sequence
  SiRNA target sequence
tgcatctattgttaacaaacc

SEQ ID NO: 14019 - DNA, 21 bp, Artificial sequence
  SiRNA target sequence
gcatctattgttaacaaacct

SEQ ID NO: 14020 - DNA, 21 bp, Artificial sequence
  SiRNA target sequence
catctattgttaacaaacctg

SEQ ID NO: 14021 - DNA, 21 bp, Artificial sequence
  SiRNA target sequence
atctattgttaacaaacctgt

SEQ ID NO: 14022 - DNA, 21 bp, Artificial sequence
  SiRNA target sequence
tctattgttaacaaacctgtt

SEQ ID NO: 14023 - DNA, 21 bp, Artificial sequence
  SiRNA target sequence
ctattgttaacaaacctgtta

SEQ ID NO: 14024 - DNA, 21 bp, Artificial sequence
  SiRNA target sequence
tattgttaacaaacctgttac

SEQ ID NO: 14025 - DNA, 21 bp, Artificial sequence
  SiRNA target sequence
attgttaacaaacctgttact

SEQ ID NO: 14026 - DNA, 21 bp, Artificial sequence
  SiRNA target sequence
ttgttaacaaacctgttacta

SEQ ID NO: 14027 - DNA, 21 bp, Artificial sequence
  SiRNA target sequence
tgttaacaaacctgttactat

SEQ ID NO: 14028 - DNA, 21 bp, Artificial sequence
  SiRNA target sequence
gttaacaaacctgttactatt

SEQ ID NO: 14029 - DNA, 21 bp, Artificial sequence
  SiRNA target sequence
ttaacaaacctgttactattt

SEQ ID NO: 14030 - DNA, 21 bp, Artificial sequence
  SiRNA target sequence
taacaaacctgttactattta

SEQ ID NO: 14031 - DNA, 21 bp, Artificial sequence
  SiRNA target sequence
aacaaacctgttactatttat

SEQ ID NO: 14032 - DNA, 21 bp, Artificial sequence
  SiRNA target sequence
acaaacctgttactatttatt

SEQ ID NO: 14033 - DNA, 21 bp, Artificial sequence
  SiRNA target sequence
caaacctgttactatttatta

SEQ ID NO: 14034 - DNA, 21 bp, Artificial sequence
  SiRNA target sequence
aaacctgttactatttattat

SEQ ID NO: 14035 - DNA, 21 bp, Artificial sequence
  SiRNA target sequence
aacctgttactatttattata

SEQ ID NO: 14036 - DNA, 21 bp, Artificial sequence
  SiRNA target sequence
acctgttactatttattatag

SEQ ID NO: 14037 - DNA, 21 bp, Artificial sequence
  SiRNA target sequence
cctgttactatttattatagt

SEQ ID NO: 14038 - DNA, 21 bp, Artificial sequence
  SiRNA target sequence
ctgttactatttattatagta

SEQ ID NO: 14039 - DNA, 21 bp, Artificial sequence
  SiRNA target sequence
tgttactatttattatagtat

SEQ ID NO: 14040 - DNA, 21 bp, Artificial sequence
  SiRNA target sequence
gttactatttattatagtatt

SEQ ID NO: 14041 - DNA, 21 bp, Artificial sequence
  SiRNA target sequence
ttactatttattatagtattg

SEQ ID NO: 14042 - DNA, 21 bp, Artificial sequence
  SiRNA target sequence
tactatttattatagtattgg

SEQ ID NO: 14043 - DNA, 21 bp, Artificial sequence
  SiRNA target sequence
actatttattatagtattgga

SEQ ID NO: 14044 - DNA, 21 bp, Artificial sequence
  SiRNA target sequence
ctatttattatagtattggag

SEQ ID NO: 14045 - DNA, 21 bp, Artificial sequence
  SiRNA target sequence
tatttattatagtattggaga

SEQ ID NO: 14046 - DNA, 21 bp, Artificial sequence
  SiRNA target sequence
atttattatagtattggagat

SEQ ID NO: 14047 - DNA, 21 bp, Artificial sequence
  SiRNA target sequence
tttattatagtattggagatg

SEQ ID NO: 14048 - DNA, 21 bp, Artificial sequence
  SiRNA target sequence
ttattatagtattggagatgg

SEQ ID NO: 14049 - DNA, 21 bp, Artificial sequence
  SiRNA target sequence
tattatagtattggagatggt

SEQ ID NO: 14050 - DNA, 21 bp, Artificial sequence
  SiRNA target sequence
attatagtattggagatggta

SEQ ID NO: 14051 - DNA, 21 bp, Artificial sequence
  SiRNA target sequence
ttatagtattggagatggtat

SEQ ID NO: 14052 - DNA, 21 bp, Artificial sequence
  SiRNA target sequence
tatagtattggagatggtatg

SEQ ID NO: 14053 - DNA, 21 bp, Artificial sequence
  SiRNA target sequence
atagtattggagatggtatgc

SEQ ID NO: 14054 - DNA, 21 bp, Artificial sequence
  SiRNA target sequence
tagtattggagatggtatgca

SEQ ID NO: 14055 - DNA, 21 bp, Artificial sequence
  SiRNA target sequence
agtattggagatggtatgcaa

SEQ ID NO: 14056 - DNA, 21 bp, Artificial sequence
  SiRNA target sequence
gtattggagatggtatgcaat

SEQ ID NO: 14057 - DNA, 21 bp, Artificial sequence
  SiRNA target sequence
tattggagatggtatgcaatt

SEQ ID NO: 14058 - DNA, 21 bp, Artificial sequence
  SiRNA target sequence
attggagatggtatgcaattt

SEQ ID NO: 14059 - DNA, 21 bp, Artificial sequence
  SiRNA target sequence
ttggagatggtatgcaatttt

SEQ ID NO: 14060 - DNA, 21 bp, Artificial sequence
  SiRNA target sequence
tggagatggtatgcaattttc

SEQ ID NO: 14061 - DNA, 21 bp, Artificial sequence
  SiRNA target sequence
ggagatggtatgcaattttct

SEQ ID NO: 14062 - DNA, 21 bp, Artificial sequence
  SiRNA target sequence
gagatggtatgcaattttctc

SEQ ID NO: 14063 - DNA, 21 bp, Artificial sequence
  SiRNA target sequence
agatggtatgcaattttctca

SEQ ID NO: 14064 - DNA, 21 bp, Artificial sequence
  SiRNA target sequence
gatggtatgcaattttctcag

SEQ ID NO: 14065 - DNA, 21 bp, Artificial sequence
  SiRNA target sequence
atggtatgcaattttctcagt

SEQ ID NO: 14066 - DNA, 21 bp, Artificial sequence
  SiRNA target sequence
tggtatgcaattttctcagtg

SEQ ID NO: 14067 - DNA, 21 bp, Artificial sequence
  SiRNA target sequence
ggtatgcaattttctcagtgg

SEQ ID NO: 14068 - DNA, 21 bp, Artificial sequence
  SiRNA target sequence
gtatgcaattttctcagtggg

SEQ ID NO: 14069 - DNA, 21 bp, Artificial sequence
  SiRNA target sequence
tatgcaattttctcagtgggt

SEQ ID NO: 14070 - DNA, 21 bp, Artificial sequence
  SiRNA target sequence
atgcaattttctcagtgggtt

SEQ ID NO: 14071 - DNA, 21 bp, Artificial sequence
  SiRNA target sequence
tgcaattttctcagtgggttg

SEQ ID NO: 14072 - DNA, 21 bp, Artificial sequence
  SiRNA target sequence
gcaattttctcagtgggttgg

SEQ ID NO: 14073 - DNA, 21 bp, Artificial sequence
  SiRNA target sequence
caattttctcagtgggttgga

SEQ ID NO: 14074 - DNA, 21 bp, Artificial sequence
  SiRNA target sequence
aattttctcagtgggttggat

SEQ ID NO: 14075 - DNA, 21 bp, Artificial sequence
  SiRNA target sequence
attttctcagtgggttggata

SEQ ID NO: 14076 - DNA, 21 bp, Artificial sequence
  SiRNA target sequence
ttttctcagtgggttggatat

SEQ ID NO: 14077 - DNA, 21 bp, Artificial sequence
  SiRNA target sequence
tttctcagtgggttggatatc

SEQ ID NO: 14078 - DNA, 21 bp, Artificial sequence
  SiRNA target sequence
ttctcagtgggttggatatca

SEQ ID NO: 14079 - DNA, 21 bp, Artificial sequence
  SiRNA target sequence
tctcagtgggttggatatcaa

SEQ ID NO: 14080 - DNA, 21 bp, Artificial sequence
  SiRNA target sequence
ctcagtgggttggatatcaac

SEQ ID NO: 14081 - DNA, 21 bp, Artificial sequence
  SiRNA target sequence
tcagtgggttggatatcaacc

SEQ ID NO: 14082 - DNA, 21 bp, Artificial sequence
  SiRNA target sequence
cagtgggttggatatcaaccg

SEQ ID NO: 14083 - DNA, 21 bp, Artificial sequence
  SiRNA target sequence
agtgggttggatatcaaccga

SEQ ID NO: 14084 - DNA, 21 bp, Artificial sequence
  SiRNA target sequence
gtgggttggatatcaaccgat

SEQ ID NO: 14085 - DNA, 21 bp, Artificial sequence
  SiRNA target sequence
tgggttggatatcaaccgatg

SEQ ID NO: 14086 - DNA, 21 bp, Artificial sequence
  SiRNA target sequence
gggttggatatcaaccgatga

SEQ ID NO: 14087 - DNA, 21 bp, Artificial sequence
  SiRNA target sequence
ggttggatatcaaccgatgat

SEQ ID NO: 14088 - DNA, 21 bp, Artificial sequence
  SiRNA target sequence
gttggatatcaaccgatgatg

SEQ ID NO: 14089 - DNA, 21 bp, Artificial sequence
  SiRNA target sequence
ttggatatcaaccgatgatga

SEQ ID NO: 14090 - DNA, 21 bp, Artificial sequence
  SiRNA target sequence
tggatatcaaccgatgatgat

SEQ ID NO: 14091 - DNA, 21 bp, Artificial sequence
  SiRNA target sequence
ggatatcaaccgatgatgatc

SEQ ID NO: 14092 - DNA, 21 bp, Artificial sequence
  SiRNA target sequence
gatatcaaccgatgatgatcc

SEQ ID NO: 14093 - DNA, 21 bp, Artificial sequence
  SiRNA target sequence
atatcaaccgatgatgatcct

SEQ ID NO: 14094 - DNA, 21 bp, Artificial sequence
  SiRNA target sequence
tatcaaccgatgatgatccta

SEQ ID NO: 14095 - DNA, 21 bp, Artificial sequence
  SiRNA target sequence
atcaaccgatgatgatcctag

SEQ ID NO: 14096 - DNA, 21 bp, Artificial sequence
  SiRNA target sequence
tcaaccgatgatgatcctaga

SEQ ID NO: 14097 - DNA, 21 bp, Artificial sequence
  SiRNA target sequence
caaccgatgatgatcctagat

SEQ ID NO: 14098 - DNA, 21 bp, Artificial sequence
  SiRNA target sequence
aaccgatgatgatcctagatc

SEQ ID NO: 14099 - DNA, 21 bp, Artificial sequence
  SiRNA target sequence
accgatgatgatcctagatca

SEQ ID NO: 14100 - DNA, 21 bp, Artificial sequence
  SiRNA target sequence
ccgatgatgatcctagatcag

SEQ ID NO: 14101 - DNA, 21 bp, Artificial sequence
  SiRNA target sequence
cgatgatgatcctagatcagc

SEQ ID NO: 14102 - DNA, 21 bp, Artificial sequence
  SiRNA target sequence
gatgatgatcctagatcagct

SEQ ID NO: 14103 - DNA, 21 bp, Artificial sequence
  SiRNA target sequence
  misc_feature (21)..(21): n is a, c, g, or t
atgatgatcctagatcagctn

SEQ ID NO: 14104 - DNA, 21 bp, Artificial sequence
  SiRNA target sequence
  misc_feature (20)..(20): n is a, c, g, or t
tgatgatcctagatcagctnc

SEQ ID NO: 14105 - DNA, 21 bp, Artificial sequence
  SiRNA target sequence
  misc_feature (19)..(19): n is a, c, g, or t
gatgatcctagatcagctncc

SEQ ID NO: 14106 - DNA, 21 bp, Artificial sequence
  SiRNA target sequence
  misc_feature (18)..(18): n is a, c, g, or t
atgatcctagatcagctncct

SEQ ID NO: 14107 - DNA, 21 bp, Artificial sequence
  SiRNA target sequence
  misc_feature (17)..(17): n is a, c, g, or t
tgatcctagatcagctncctg

SEQ ID NO: 14108 - DNA, 21 bp, Artificial sequence
  SiRNA target sequence
  misc_feature (16)..(16): n is a, c, g, or t
gatcctagatcagctncctgc

SEQ ID NO: 14109 - DNA, 21 bp, Artificial sequence
  SiRNA target sequence
  misc_feature (15)..(15): n is a, c, g, or t
atcctagatcagctncctgca

SEQ ID NO: 14110 - DNA, 21 bp, Artificial sequence
  SiRNA target sequence
  misc_feature (14)..(14): n is a, c, g, or t
tcctagatcagctncctgcac

SEQ ID NO: 14111 - DNA, 21 bp, Artificial sequence
  SiRNA target sequence
  misc_feature (13)..(13): n is a, c, g, or t
cctagatcagctncctgcacc

SEQ ID NO: 14112 - DNA, 21 bp, Artificial sequence
  SiRNA target sequence
  misc_feature (12)..(12): n is a, c, g, or t
ctagatcagctncctgcacca

SEQ ID NO: 14113 - DNA, 21 bp, Artificial sequence
  SiRNA target sequence
  misc_feature (11)..(11): n is a, c, g, or t
tagatcagctncctgcaccag

SEQ ID NO: 14114 - DNA, 21 bp, Artificial sequence
  SiRNA target sequence
  misc_feature (10)..(10): n is a, c, g, or t
agatcagctncctgcaccagt

SEQ ID NO: 14115 - DNA, 21 bp, Artificial sequence
  SiRNA target sequence
  misc_feature (9)..(9): n is a, c, g, or t
gatcagctncctgcaccagta

SEQ ID NO: 14116 - DNA, 21 bp, Artificial sequence
  SiRNA target sequence
  misc_feature (8)..(8): n is a, c, g, or t
atcagctncctgcaccagtag

SEQ ID NO: 14117 - DNA, 21 bp, Artificial sequence
  SiRNA target sequence
  misc_feature (7)..(7): n is a, c, g, or t
tcagctncctgcaccagtagt

SEQ ID NO: 14118 - DNA, 21 bp, Artificial sequence
  SiRNA target sequence
  misc_feature (6)..(6): n is a, c, g, or t
cagctncctgcaccagtagta

SEQ ID NO: 14119 - DNA, 21 bp, Artificial sequence
  SiRNA target sequence
  misc_feature (5)..(5): n is a, c, g, or t
agctncctgcaccagtagtaa

SEQ ID NO: 14120 - DNA, 21 bp, Artificial sequence
  SiRNA target sequence
  misc_feature (4)..(4): n is a, c, g, or t
gctncctgcaccagtagtaag

SEQ ID NO: 14121 - DNA, 21 bp, Artificial sequence
  SiRNA target sequence
  misc_feature (3)..(3): n is a, c, g, or t
ctncctgcaccagtagtaagg

SEQ ID NO: 14122 - DNA, 21 bp, Artificial sequence
  SiRNA target sequence
  misc_feature (2)..(2): n is a, c, g, or t
tncctgcaccagtagtaaggg

SEQ ID NO: 14123 - DNA, 21 bp, Artificial sequence
  SiRNA target sequence
  misc_feature (1)..(1): n is a, c, g, or t
ncctgcaccagtagtaagggc

SEQ ID NO: 14124 - DNA, 21 bp, Artificial sequence
  SiRNA target sequence
cctgcaccagtagtaagggcc

SEQ ID NO: 14125 - DNA, 21 bp, Artificial sequence
  SiRNA target sequence
ctgcaccagtagtaagggccg

SEQ ID NO: 14126 - DNA, 21 bp, Artificial sequence
  SiRNA target sequence
tgcaccagtagtaagggccgt

SEQ ID NO: 14127 - DNA, 21 bp, Artificial sequence
  SiRNA target sequence
gcaccagtagtaagggccgtg

SEQ ID NO: 14128 - DNA, 21 bp, Artificial sequence
  SiRNA target sequence
caccagtagtaagggccgtgc

SEQ ID NO: 14129 - DNA, 21 bp, Artificial sequence
  SiRNA target sequence
accagtagtaagggccgtgcc

SEQ ID NO: 14130 - DNA, 21 bp, Artificial sequence
  SiRNA target sequence
ccagtagtaagggccgtgcct

SEQ ID NO: 14131 - DNA, 21 bp, Artificial sequence
  SiRNA target sequence
cagtagtaagggccgtgcctg

SEQ ID NO: 14132 - DNA, 21 bp, Artificial sequence
  SiRNA target sequence
agtagtaagggccgtgcctga

SEQ ID NO: 14133 - DNA, 21 bp, Artificial sequence
  SiRNA target sequence
gtagtaagggccgtgcctgag

SEQ ID NO: 14134 - DNA, 21 bp, Artificial sequence
  SiRNA target sequence
tagtaagggccgtgcctgagg

SEQ ID NO: 14135 - DNA, 21 bp, Artificial sequence
  SiRNA target sequence
agtaagggccgtgcctgaggg

SEQ ID NO: 14136 - DNA, 21 bp, Artificial sequence
  SiRNA target sequence
gtaagggccgtgcctgagggc

SEQ ID NO: 14137 - DNA, 21 bp, Artificial sequence
  SiRNA target sequence
taagggccgtgcctgagggcc

SEQ ID NO: 14138 - DNA, 21 bp, Artificial sequence
  SiRNA target sequence
aagggccgtgcctgagggccc

SEQ ID NO: 14139 - DNA, 21 bp, Artificial sequence
  SiRNA target sequence
agggccgtgcctgagggccct

SEQ ID NO: 14140 - DNA, 21 bp, Artificial sequence
  SiRNA target sequence
gggccgtgcctgagggcccta

SEQ ID NO: 14141 - DNA, 21 bp, Artificial sequence
  SiRNA target sequence
ggccgtgcctgagggccctat

SEQ ID NO: 14142 - DNA, 21 bp, Artificial sequence
  SiRNA target sequence
gccgtgcctgagggccctatt

SEQ ID NO: 14143 - DNA, 21 bp, Artificial sequence
  SiRNA target sequence
ccgtgcctgagggccctattg

SEQ ID NO: 14144 - DNA, 21 bp, Artificial sequence
  SiRNA target sequence
cgtgcctgagggccctattgc

SEQ ID NO: 14145 - DNA, 21 bp, Artificial sequence
  SiRNA target sequence
gtgcctgagggccctattgcg

SEQ ID NO: 14146 - DNA, 21 bp, Artificial sequence
  SiRNA target sequence
tgcctgagggccctattgcga

SEQ ID NO: 14147 - DNA, 21 bp, Artificial sequence
  SiRNA target sequence
gcctgagggccctattgcgaa

SEQ ID NO: 14148 - DNA, 21 bp, Artificial sequence
  SiRNA target sequence
cctgagggccctattgcgaag

SEQ ID NO: 14149 - DNA, 21 bp, Artificial sequence
  SiRNA target sequence
ctgagggccctattgcgaaga

SEQ ID NO: 14150 - DNA, 21 bp, Artificial sequence
  SiRNA target sequence
tgagggccctattgcgaagat

SEQ ID NO: 14151 - DNA, 21 bp, Artificial sequence
  SiRNA target sequence
gagggccctattgcgaagatt

SEQ ID NO: 14152 - DNA, 21 bp, Artificial sequence
  SiRNA target sequence
agggccctattgcgaagatta

SEQ ID NO: 14153 - DNA, 21 bp, Artificial sequence
  SiRNA target sequence
gggccctattgcgaagattaa

SEQ ID NO: 14154 - DNA, 21 bp, Artificial sequence
  SiRNA target sequence
ggccctattgcgaagattaaa

SEQ ID NO: 14155 - DNA, 21 bp, Artificial sequence
  SiRNA target sequence
gccctattgcgaagattaaaa

SEQ ID NO: 14156 - DNA, 21 bp, Artificial sequence
  SiRNA target sequence
ccctattgcgaagattaaaaa

SEQ ID NO: 14157 - DNA, 21 bp, Artificial sequence
  SiRNA target sequence
cctattgcgaagattaaaaac

SEQ ID NO: 14158 - DNA, 21 bp, Artificial sequence
  SiRNA target sequence
ctattgcgaagattaaaaact

SEQ ID NO: 14159 - DNA, 21 bp, Artificial sequence
  SiRNA target sequence
tattgcgaagattaaaaactt

SEQ ID NO: 14160 - DNA, 21 bp, Artificial sequence
  SiRNA target sequence
attgcgaagattaaaaacttc

SEQ ID NO: 14161 - DNA, 21 bp, Artificial sequence
  SiRNA target sequence
ttgcgaagattaaaaacttct

SEQ ID NO: 14162 - DNA, 21 bp, Artificial sequence
  SiRNA target sequence
tgcgaagattaaaaacttctt

SEQ ID NO: 14163 - DNA, 21 bp, Artificial sequence
  SiRNA target sequence
gcgaagattaaaaacttcttc

SEQ ID NO: 14164 - DNA, 21 bp, Artificial sequence
  SiRNA target sequence
cgaagattaaaaacttcttcc

SEQ ID NO: 14165 - DNA, 21 bp, Artificial sequence
  SiRNA target sequence
gaagattaaaaacttcttcca

SEQ ID NO: 14166 - DNA, 21 bp, Artificial sequence
  SiRNA target sequence
aagattaaaaacttcttccat

SEQ ID NO: 14167 - DNA, 21 bp, Artificial sequence
  SiRNA target sequence
agattaaaaacttcttccatc

SEQ ID NO: 14168 - DNA, 21 bp, Artificial sequence
  SiRNA target sequence
gattaaaaacttcttccatca

SEQ ID NO: 14169 - DNA, 21 bp, Artificial sequence
  SiRNA target sequence
attaaaaacttcttccatcaa

SEQ ID NO: 14170 - DNA, 21 bp, Artificial sequence
  SiRNA target sequence
ttaaaaacttcttccatcaaa

SEQ ID NO: 14171 - DNA, 21 bp, Artificial sequence
  SiRNA target sequence
taaaaacttcttccatcaaac

SEQ ID NO: 14172 - DNA, 21 bp, Artificial sequence
  SiRNA target sequence
aaaaacttcttccatcaaaca

SEQ ID NO: 14173 - DNA, 21 bp, Artificial sequence
  SiRNA target sequence
aaaacttcttccatcaaacag

SEQ ID NO: 14174 - DNA, 21 bp, Artificial sequence
  SiRNA target sequence
aaacttcttccatcaaacagc

SEQ ID NO: 14175 - DNA, 21 bp, Artificial sequence
  SiRNA target sequence
aacttcttccatcaaacagcc

SEQ ID NO: 14176 - DNA, 21 bp, Artificial sequence
  SiRNA target sequence
acttcttccatcaaacagccg

SEQ ID NO: 14177 - DNA, 21 bp, Artificial sequence
  SiRNA target sequence
cttcttccatcaaacagccga

SEQ ID NO: 14178 - DNA, 21 bp, Artificial sequence
  SiRNA target sequence
  misc_feature (21)..(21): n is a, c, g, or t
ttcttccatcaaacagccgan

SEQ ID NO: 14179 - DNA, 21 bp, Artificial sequence
  SiRNA target sequence
  misc_feature (20)..(20): n is a, c, g, or t
tcttccatcaaacagccgang

SEQ ID NO: 14180 - DNA, 21 bp, Artificial sequence
  SiRNA target sequence
  misc_feature (19)..(19): n is a, c, g, or t
cttccatcaaacagccganga

SEQ ID NO: 14181 - DNA, 21 bp, Artificial sequence
  SiRNA target sequence
  misc_feature (18)..(18): n is a, c, g, or t
ttccatcaaacagccgangaa

SEQ ID NO: 14182 - DNA, 21 bp, Artificial sequence
  SiRNA target sequence
  misc_feature (17)..(17): n is a, c, g, or t
tccatcaaacagccgangaag

SEQ ID NO: 14183 - DNA, 21 bp, Artificial sequence
  SiRNA target sequence
  misc_feature (16)..(16): n is a, c, g, or t
ccatcaaacagccgangaagt

SEQ ID NO: 14184 - DNA, 21 bp, Artificial sequence
  SiRNA target sequence
  misc_feature (15)..(15): n is a, c, g, or t
catcaaacagccgangaagtt

SEQ ID NO: 14185 - DNA, 21 bp, Artificial sequence
  SiRNA target sequence
  misc_feature (14)..(14): n is a, c, g, or t
atcaaacagccgangaagtta

SEQ ID NO: 14186 - DNA, 21 bp, Artificial sequence
  SiRNA target sequence
  misc_feature (13)..(13): n is a, c, g, or t
tcaaacagccgangaagttag

SEQ ID NO: 14187 - DNA, 21 bp, Artificial sequence
  SiRNA target sequence
  misc_feature (12)..(12): n is a, c, g, or t
caaacagccgangaagttaga

SEQ ID NO: 14188 - DNA, 21 bp, Artificial sequence
  SiRNA target sequence
  misc_feature (11)..(11): n is a, c, g, or t
aaacagccgangaagttagag

SEQ ID NO: 14189 - DNA, 21 bp, Artificial sequence
  SiRNA target sequence
  misc_feature (10)..(10): n is a, c, g, or t
aacagccgangaagttagaga

SEQ ID NO: 14190 - DNA, 21 bp, Artificial sequence
  SiRNA target sequence
  misc_feature (9)..(9): n is a, c, g, or t
acagccgangaagttagagaa

SEQ ID NO: 14191 - DNA, 21 bp, Artificial sequence
  SiRNA target sequence
  misc_feature (8)..(8): n is a, c, g, or t
cagccgangaagttagagaag

SEQ ID NO: 14192 - DNA, 21 bp, Artificial sequence
  SiRNA target sequence
  misc_feature (7)..(7): n is a, c, g, or t
agccgangaagttagagaagc

SEQ ID NO: 14193 - DNA, 21 bp, Artificial sequence
  SiRNA target sequence
  misc_feature (6)..(6): n is a, c, g, or t
gccgangaagttagagaagct

SEQ ID NO: 14194 - DNA, 21 bp, Artificial sequence
  SiRNA target sequence
  misc_feature (5)..(5): n is a, c, g, or t
ccgangaagttagagaagctc

SEQ ID NO: 14195 - DNA, 21 bp, Artificial sequence
  SiRNA target sequence
  misc_feature (4)..(4): n is a, c, g, or t
cgangaagttagagaagctca

SEQ ID NO: 14196 - DNA, 21 bp, Artificial sequence
  SiRNA target sequence
  misc_feature (3)..(3): n is a, c, g, or t
gangaagttagagaagctcag

SEQ ID NO: 14197 - DNA, 21 bp, Artificial sequence
  SiRNA target sequence
  misc_feature (2)..(2): n is a, c, g, or t
angaagttagagaagctcagg

SEQ ID NO: 14198 - DNA, 21 bp, Artificial sequence
  SiRNA target sequence
  misc_feature (1)..(1): n is a, c, g, or t
ngaagttagagaagctcaggc

SEQ ID NO: 14199 - DNA, 21 bp, Artificial sequence
  SiRNA target sequence
gaagttagagaagctcaggca

SEQ ID NO: 14200 - DNA, 21 bp, Artificial sequence
  SiRNA target sequence
aagttagagaagctcaggcag

SEQ ID NO: 14201 - DNA, 21 bp, Artificial sequence
  SiRNA target sequence
agttagagaagctcaggcagc

SEQ ID NO: 14202 - DNA, 21 bp, Artificial sequence
  SiRNA target sequence
gttagagaagctcaggcagca

SEQ ID NO: 14203 - DNA, 21 bp, Artificial sequence
  SiRNA target sequence
ttagagaagctcaggcagcaa

SEQ ID NO: 14204 - DNA, 21 bp, Artificial sequence
  SiRNA target sequence
tagagaagctcaggcagcaaa

SEQ ID NO: 14205 - DNA, 21 bp, Artificial sequence
  SiRNA target sequence
agagaagctcaggcagcaaag

SEQ ID NO: 14206 - DNA, 21 bp, Artificial sequence
  SiRNA target sequence
gagaagctcaggcagcaaaga

SEQ ID NO: 14207 - DNA, 21 bp, Artificial sequence
  SiRNA target sequence
agaagctcaggcagcaaagat

SEQ ID NO: 14208 - DNA, 21 bp, Artificial sequence
  SiRNA target sequence
gaagctcaggcagcaaagatg

SEQ ID NO: 14209 - DNA, 21 bp, Artificial sequence
  SiRNA target sequence
aagctcaggcagcaaagatgc

SEQ ID NO: 14210 - DNA, 21 bp, Artificial sequence
  SiRNA target sequence
agctcaggcagcaaagatgcg

SEQ ID NO: 14211 - DNA, 21 bp, Artificial sequence
  SiRNA target sequence
gctcaggcagcaaagatgcgt

SEQ ID NO: 14212 - DNA, 21 bp, Artificial sequence
  SiRNA target sequence
ctcaggcagcaaagatgcgtg

SEQ ID NO: 14213 - DNA, 21 bp, Artificial sequence
  SiRNA target sequence
tcaggcagcaaagatgcgtga

SEQ ID NO: 14214 - DNA, 21 bp, Artificial sequence
  SiRNA target sequence
caggcagcaaagatgcgtgaa

SEQ ID NO: 14215 - DNA, 21 bp, Artificial sequence
  SiRNA target sequence
aggcagcaaagatgcgtgaag

SEQ ID NO: 14216 - DNA, 21 bp, Artificial sequence
  SiRNA target sequence
ggcagcaaagatgcgtgaaga

SEQ ID NO: 14217 - DNA, 21 bp, Artificial sequence
  SiRNA target sequence
gcagcaaagatgcgtgaagat

SEQ ID NO: 14218 - DNA, 21 bp, Artificial sequence
  SiRNA target sequence
cagcaaagatgcgtgaagata

SEQ ID NO: 14219 - DNA, 21 bp, Artificial sequence
  SiRNA target sequence
agcaaagatgcgtgaagatat

SEQ ID NO: 14220 - DNA, 21 bp, Artificial sequence
  SiRNA target sequence
gcaaagatgcgtgaagatatg

SEQ ID NO: 14221 - DNA, 21 bp, Artificial sequence
  SiRNA target sequence
caaagatgcgtgaagatatgg

SEQ ID NO: 14222 - DNA, 21 bp, Artificial sequence
  SiRNA target sequence
aaagatgcgtgaagatatggg

SEQ ID NO: 14223 - DNA, 21 bp, Artificial sequence
  SiRNA target sequence
aagatgcgtgaagatatgggt

SEQ ID NO: 14224 - DNA, 21 bp, Artificial sequence
  SiRNA target sequence
agatgcgtgaagatatgggta

SEQ ID NO: 14225 - DNA, 21 bp, Artificial sequence
  SiRNA target sequence
gatgcgtgaagatatgggtat

SEQ ID NO: 14226 - DNA, 21 bp, Artificial sequence
  SiRNA target sequence
atgcgtgaagatatgggtatg

SEQ ID NO: 14227 - DNA, 21 bp, Artificial sequence
  SiRNA target sequence
tgcgtgaagatatgggtatgg

SEQ ID NO: 14228 - DNA, 21 bp, Artificial sequence
  SiRNA target sequence
gcgtgaagatatgggtatggt

SEQ ID NO: 14229 - DNA, 21 bp, Artificial sequence
  SiRNA target sequence
cgtgaagatatgggtatggtt

SEQ ID NO: 14230 - DNA, 21 bp, Artificial sequence
  SiRNA target sequence
gtgaagatatgggtatggttg

SEQ ID NO: 14231 - DNA, 21 bp, Artificial sequence
  SiRNA target sequence
tgaagatatgggtatggttgt

SEQ ID NO: 14232 - DNA, 21 bp, Artificial sequence
  SiRNA target sequence
gaagatatgggtatggttgtc

SEQ ID NO: 14233 - DNA, 21 bp, Artificial sequence
  SiRNA target sequence
aagatatgggtatggttgtcc

SEQ ID NO: 14234 - DNA, 21 bp, Artificial sequence
  SiRNA target sequence
agatatgggtatggttgtcca

SEQ ID NO: 14235 - DNA, 21 bp, Artificial sequence
  SiRNA target sequence
gatatgggtatggttgtccaa

SEQ ID NO: 14236 - DNA, 21 bp, Artificial sequence
  SiRNA target sequence
atatgggtatggttgtccaag

SEQ ID NO: 14237 - DNA, 21 bp, Artificial sequence
  SiRNA target sequence
tatgggtatggttgtccaaga

SEQ ID NO: 14238 - DNA, 21 bp, Artificial sequence
  SiRNA target sequence
atgggtatggttgtccaagat

SEQ ID NO: 14239 - DNA, 21 bp, Artificial sequence
  SiRNA target sequence
tgggtatggttgtccaagatg

SEQ ID NO: 14240 - DNA, 21 bp, Artificial sequence
  SiRNA target sequence
gggtatggttgtccaagatgt

SEQ ID NO: 14241 - DNA, 21 bp, Artificial sequence
  SiRNA target sequence
ggtatggttgtccaagatgtt

SEQ ID NO: 14242 - DNA, 21 bp, Artificial sequence
  SiRNA target sequence
gtatggttgtccaagatgtta

SEQ ID NO: 14243 - DNA, 21 bp, Artificial sequence
  SiRNA target sequence
tatggttgtccaagatgttat

SEQ ID NO: 14244 - DNA, 21 bp, Artificial sequence
  SiRNA target sequence
atggttgtccaagatgttatt

SEQ ID NO: 14245 - DNA, 21 bp, Artificial sequence
  SiRNA target sequence
tggttgtccaagatgttattg

SEQ ID NO: 14246 - DNA, 21 bp, Artificial sequence
  SiRNA target sequence
ggttgtccaagatgttattgg

SEQ ID NO: 14247 - DNA, 21 bp, Artificial sequence
  SiRNA target sequence
gttgtccaagatgttattgga

SEQ ID NO: 14248 - DNA, 21 bp, Artificial sequence
  SiRNA target sequence
ttgtccaagatgttattggag

SEQ ID NO: 14249 - DNA, 21 bp, Artificial sequence
  SiRNA target sequence
tgtccaagatgttattggaga

SEQ ID NO: 14250 - DNA, 21 bp, Artificial sequence
  SiRNA target sequence
gtccaagatgttattggagaa

SEQ ID NO: 14251 - DNA, 21 bp, Artificial sequence
  SiRNA target sequence
tccaagatgttattggagaac

SEQ ID NO: 14252 - DNA, 21 bp, Artificial sequence
  SiRNA target sequence
ccaagatgttattggagaact

SEQ ID NO: 14253 - DNA, 21 bp, Artificial sequence
  SiRNA target sequence
caagatgttattggagaactt

SEQ ID NO: 14254 - DNA, 21 bp, Artificial sequence
  SiRNA target sequence
aagatgttattggagaactta

SEQ ID NO: 14255 - DNA, 21 bp, Artificial sequence
  SiRNA target sequence
agatgttattggagaacttag

SEQ ID NO: 14256 - DNA, 21 bp, Artificial sequence
  SiRNA target sequence
gatgttattggagaacttagc

SEQ ID NO: 14257 - DNA, 21 bp, Artificial sequence
  SiRNA target sequence
atgttattggagaacttagcc

SEQ ID NO: 14258 - DNA, 21 bp, Artificial sequence
  SiRNA target sequence
tgttattggagaacttagcca

SEQ ID NO: 14259 - DNA, 21 bp, Artificial sequence
  SiRNA target sequence
gttattggagaacttagccag

SEQ ID NO: 14260 - DNA, 21 bp, Artificial sequence
  SiRNA target sequence
ttattggagaacttagccagg

SEQ ID NO: 14261 - DNA, 21 bp, Artificial sequence
  SiRNA target sequence
tattggagaacttagccaggc

SEQ ID NO: 14262 - DNA, 21 bp, Artificial sequence
  SiRNA target sequence
  misc_feature (21)..(21): n is a, c, g, or t
attggagaacttagccaggcn

SEQ ID NO: 14263 - DNA, 21 bp, Artificial sequence
  SiRNA target sequence
  misc_feature (20)..(20): n is a, c, g, or t
ttggagaacttagccaggcna

SEQ ID NO: 14264 - DNA, 21 bp, Artificial sequence
  SiRNA target sequence
  misc_feature (19)..(19): n is a, c, g, or t
tggagaacttagccaggcnat

SEQ ID NO: 14265 - DNA, 21 bp, Artificial sequence
  SiRNA target sequence
  misc_feature (18)..(18): n is a, c, g, or t
ggagaacttagccaggcnata

SEQ ID NO: 14266 - DNA, 21 bp, Artificial sequence
  SiRNA target sequence
  misc_feature (17)..(17): n is a, c, g, or t
gagaacttagccaggcnatac

SEQ ID NO: 14267 - DNA, 21 bp, Artificial sequence
  SiRNA target sequence
  misc_feature (16)..(16): n is a, c, g, or t
agaacttagccaggcnatacc

SEQ ID NO: 14268 - DNA, 21 bp, Artificial sequence
  SiRNA target sequence
  misc_feature (15)..(15): n is a, c, g, or t
gaacttagccaggcnataccg

SEQ ID NO: 14269 - DNA, 21 bp, Artificial sequence
  SiRNA target sequence
  misc_feature (14)..(14): n is a, c, g, or t
aacttagccaggcnataccgg

SEQ ID NO: 14270 - DNA, 21 bp, Artificial sequence
  SiRNA target sequence
  misc_feature (13)..(13): n is a, c, g, or t
acttagccaggcnataccgga

SEQ ID NO: 14271 - DNA, 21 bp, Artificial sequence
  SiRNA target sequence
  misc_feature (12)..(12): n is a, c, g, or t
cttagccaggcnataccggat

SEQ ID NO: 14272 - DNA, 21 bp, Artificial sequence
  SiRNA target sequence
  misc_feature (11)..(11): n is a, c, g, or t
ttagccaggcnataccggatc

SEQ ID NO: 14273 - DNA, 21 bp, Artificial sequence
  SiRNA target sequence
  misc_feature (10)..(10): n is a, c, g, or t
tagccaggcnataccggatct

SEQ ID NO: 14274 - DNA, 21 bp, Artificial sequence
  SiRNA target sequence
  misc_feature (9)..(9): n is a, c, g, or t
agccaggcnataccggatctt

SEQ ID NO: 14275 - DNA, 21 bp, Artificial sequence
  SiRNA target sequence
  misc_feature (8)..(8): n is a, c, g, or t
gccaggcnataccggatcttc

SEQ ID NO: 14276 - DNA, 21 bp, Artificial sequence
  SiRNA target sequence
  misc_feature (7)..(7): n is a, c, g, or t
ccaggcnataccggatcttca

SEQ ID NO: 14277 - DNA, 21 bp, Artificial sequence
  SiRNA target sequence
  misc_feature (6)..(6): n is a, c, g, or t
caggcnataccggatcttcaa

SEQ ID NO: 14278 - DNA, 21 bp, Artificial sequence
  SiRNA target sequence
  misc_feature (5)..(5): n is a, c, g, or t
aggcnataccggatcttcaac

SEQ ID NO: 14279 - DNA, 21 bp, Artificial sequence
  SiRNA target sequence
  misc_feature (4)..(4): n is a, c, g, or t
ggcnataccggatcttcaaca

SEQ ID NO: 14280 - DNA, 21 bp, Artificial sequence
  SiRNA target sequence
  misc_feature (3)..(3): n is a, c, g, or t
gcnataccggatcttcaacaa

SEQ ID NO: 14281 - DNA, 21 bp, Artificial sequence
  SiRNA target sequence
  misc_feature (2)..(2): n is a, c, g, or t
cnataccggatcttcaacaac

SEQ ID NO: 14282 - DNA, 21 bp, Artificial sequence
  SiRNA target sequence
  misc_feature (1)..(1): n is a, c, g, or t
nataccggatcttcaacaacc

SEQ ID NO: 14283 - DNA, 21 bp, Artificial sequence
  SiRNA target sequence
ataccggatcttcaacaaccg

SEQ ID NO: 14284 - DNA, 21 bp, Artificial sequence
  SiRNA target sequence
taccggatcttcaacaaccgg

SEQ ID NO: 14285 - DNA, 21 bp, Artificial sequence
  SiRNA target sequence
accggatcttcaacaaccgga

SEQ ID NO: 14286 - DNA, 21 bp, Artificial sequence
  SiRNA target sequence
ccggatcttcaacaaccggag

SEQ ID NO: 14287 - DNA, 21 bp, Artificial sequence
  SiRNA target sequence
cggatcttcaacaaccggagg

SEQ ID NO: 14288 - DNA, 21 bp, Artificial sequence
  SiRNA target sequence
ggatcttcaacaaccggaggt

SEQ ID NO: 14289 - DNA, 21 bp, Artificial sequence
  SiRNA target sequence
gatcttcaacaaccggaggtt

SEQ ID NO: 14290 - DNA, 21 bp, Artificial sequence
  SiRNA target sequence
atcttcaacaaccggaggttc

SEQ ID NO: 14291 - DNA, 21 bp, Artificial sequence
  SiRNA target sequence
tcttcaacaaccggaggttca

SEQ ID NO: 14292 - DNA, 21 bp, Artificial sequence
  SiRNA target sequence
cttcaacaaccggaggttcaa

SEQ ID NO: 14293 - DNA, 21 bp, Artificial sequence
  SiRNA target sequence
ttcaacaaccggaggttcaag

SEQ ID NO: 14294 - DNA, 21 bp, Artificial sequence
  SiRNA target sequence
tcaacaaccggaggttcaagc

SEQ ID NO: 14295 - DNA, 21 bp, Artificial sequence
  SiRNA target sequence
caacaaccggaggttcaagca

SEQ ID NO: 14296 - DNA, 21 bp, Artificial sequence
  SiRNA target sequence
aacaaccggaggttcaagcaa

SEQ ID NO: 14297 - DNA, 21 bp, Artificial sequence
  SiRNA target sequence
acaaccggaggttcaagcaaa

SEQ ID NO: 14298 - DNA, 21 bp, Artificial sequence
  SiRNA target sequence
caaccggaggttcaagcaaat

SEQ ID NO: 14299 - DNA, 21 bp, Artificial sequence
  SiRNA target sequence
aaccggaggttcaagcaaatg

SEQ ID NO: 14300 - DNA, 21 bp, Artificial sequence
  SiRNA target sequence
accggaggttcaagcaaatgt

SEQ ID NO: 14301 - DNA, 21 bp, Artificial sequence
  SiRNA target sequence
ccggaggttcaagcaaatgtc

SEQ ID NO: 14302 - DNA, 21 bp, Artificial sequence
  SiRNA target sequence
cggaggttcaagcaaatgtct

SEQ ID NO: 14303 - DNA, 21 bp, Artificial sequence
  SiRNA target sequence
ggaggttcaagcaaatgtctt

SEQ ID NO: 14304 - DNA, 21 bp, Artificial sequence
  SiRNA target sequence
gaggttcaagcaaatgtcttc

SEQ ID NO: 14305 - DNA, 21 bp, Artificial sequence
  SiRNA target sequence
aggttcaagcaaatgtcttct

SEQ ID NO: 14306 - DNA, 21 bp, Artificial sequence
  SiRNA target sequence
ggttcaagcaaatgtcttctc

SEQ ID NO: 14307 - DNA, 21 bp, Artificial sequence
  SiRNA target sequence
gttcaagcaaatgtcttctca

SEQ ID NO: 14308 - DNA, 21 bp, Artificial sequence
  SiRNA target sequence
ttcaagcaaatgtcttctcac

SEQ ID NO: 14309 - DNA, 21 bp, Artificial sequence
  SiRNA target sequence
tcaagcaaatgtcttctcact

SEQ ID NO: 14310 - DNA, 21 bp, Artificial sequence
  SiRNA target sequence
caagcaaatgtcttctcactg

SEQ ID NO: 14311 - DNA, 21 bp, Artificial sequence
  SiRNA target sequence
aagcaaatgtcttctcactgg

SEQ ID NO: 14312 - DNA, 21 bp, Artificial sequence
  SiRNA target sequence
agcaaatgtcttctcactggt

SEQ ID NO: 14313 - DNA, 21 bp, Artificial sequence
  SiRNA target sequence
gcaaatgtcttctcactggtg

SEQ ID NO: 14314 - DNA, 21 bp, Artificial sequence
  SiRNA target sequence
caaatgtcttctcactggtgt

SEQ ID NO: 14315 - DNA, 21 bp, Artificial sequence
  SiRNA target sequence
aaatgtcttctcactggtgtc

SEQ ID NO: 14316 - DNA, 21 bp, Artificial sequence
  SiRNA target sequence
aatgtcttctcactggtgtct

SEQ ID NO: 14317 - DNA, 21 bp, Artificial sequence
  SiRNA target sequence
atgtcttctcactggtgtctc

SEQ ID NO: 14318 - DNA, 21 bp, Artificial sequence
  SiRNA target sequence
tgtcttctcactggtgtctca

SEQ ID NO: 14319 - DNA, 21 bp, Artificial sequence
  SiRNA target sequence
gtcttctcactggtgtctcag

SEQ ID NO: 14320 - DNA, 21 bp, Artificial sequence
  SiRNA target sequence
tcttctcactggtgtctcagt

SEQ ID NO: 14321 - DNA, 21 bp, Artificial sequence
  SiRNA target sequence
cttctcactggtgtctcagtt

SEQ ID NO: 14322 - DNA, 21 bp, Artificial sequence
  SiRNA target sequence
ttctcactggtgtctcagtta

SEQ ID NO: 14323 - DNA, 21 bp, Artificial sequence
  SiRNA target sequence
tctcactggtgtctcagttag

SEQ ID NO: 14324 - DNA, 21 bp, Artificial sequence
  SiRNA target sequence
ctcactggtgtctcagttagt

SEQ ID NO: 14325 - DNA, 21 bp, Artificial sequence
  SiRNA target sequence
tcactggtgtctcagttagtg

SEQ ID NO: 14326 - DNA, 21 bp, Artificial sequence
  SiRNA target sequence
cactggtgtctcagttagtgc

SEQ ID NO: 14327 - DNA, 21 bp, Artificial sequence
  SiRNA target sequence
actggtgtctcagttagtgca

SEQ ID NO: 14328 - DNA, 21 bp, Artificial sequence
  SiRNA target sequence
ctggtgtctcagttagtgcat

SEQ ID NO: 14329 - DNA, 21 bp, Artificial sequence
  SiRNA target sequence
tggtgtctcagttagtgcatg

SEQ ID NO: 14330 - DNA, 21 bp, Artificial sequence
  SiRNA target sequence
ggtgtctcagttagtgcatgc

SEQ ID NO: 14331 - DNA, 21 bp, Artificial sequence
  SiRNA target sequence
gtgtctcagttagtgcatgct

SEQ ID NO: 14332 - DNA, 21 bp, Artificial sequence
  SiRNA target sequence
tgtctcagttagtgcatgcta

SEQ ID NO: 14333 - DNA, 21 bp, Artificial sequence
  SiRNA target sequence
gtctcagttagtgcatgctat

SEQ ID NO: 14334 - DNA, 21 bp, Artificial sequence
  SiRNA target sequence
tctcagttagtgcatgctatt

SEQ ID NO: 14335 - DNA, 21 bp, Artificial sequence
  SiRNA target sequence
ctcagttagtgcatgctatta

SEQ ID NO: 14336 - DNA, 21 bp, Artificial sequence
  SiRNA target sequence
tcagttagtgcatgctattat

SEQ ID NO: 14337 - DNA, 21 bp, Artificial sequence
  SiRNA target sequence
cagttagtgcatgctattata

SEQ ID NO: 14338 - DNA, 21 bp, Artificial sequence
  SiRNA target sequence
agttagtgcatgctattatag

SEQ ID NO: 14339 - DNA, 21 bp, Artificial sequence
  SiRNA target sequence
gttagtgcatgctattatagg

SEQ ID NO: 14340 - DNA, 21 bp, Artificial sequence
  SiRNA target sequence
ttagtgcatgctattataggt

SEQ ID NO: 14341 - DNA, 21 bp, Artificial sequence
  SiRNA target sequence
tagtgcatgctattataggta

SEQ ID NO: 14342 - DNA, 21 bp, Artificial sequence
  SiRNA target sequence
agtgcatgctattataggtac

SEQ ID NO: 14343 - DNA, 21 bp, Artificial sequence
  SiRNA target sequence
gtgcatgctattataggtact

SEQ ID NO: 14344 - DNA, 21 bp, Artificial sequence
  SiRNA target sequence
tgcatgctattataggtacta

SEQ ID NO: 14345 - DNA, 21 bp, Artificial sequence
  SiRNA target sequence
gcatgctattataggtactag

SEQ ID NO: 14346 - DNA, 21 bp, Artificial sequence
  SiRNA target sequence
catgctattataggtactagt

SEQ ID NO: 14347 - DNA, 21 bp, Artificial sequence
  SiRNA target sequence
atgctattataggtactagtt

SEQ ID NO: 14348 - DNA, 21 bp, Artificial sequence
  SiRNA target sequence
tgctattataggtactagttt

SEQ ID NO: 14349 - DNA, 21 bp, Artificial sequence
  SiRNA target sequence
gctattataggtactagtttg

SEQ ID NO: 14350 - DNA, 21 bp, Artificial sequence
  SiRNA target sequence
ctattataggtactagtttga

SEQ ID NO: 14351 - DNA, 21 bp, Artificial sequence
  SiRNA target sequence
tattataggtactagtttgaa

SEQ ID NO: 14352 - DNA, 21 bp, Artificial sequence
  SiRNA target sequence
attataggtactagtttgaag

SEQ ID NO: 14353 - DNA, 21 bp, Artificial sequence
  SiRNA target sequence
ttataggtactagtttgaaga

SEQ ID NO: 14354 - DNA, 21 bp, Artificial sequence
  SiRNA target sequence
tataggtactagtttgaagac

SEQ ID NO: 14355 - DNA, 21 bp, Artificial sequence
  SiRNA target sequence
ataggtactagtttgaagaca

SEQ ID NO: 14356 - DNA, 21 bp, Artificial sequence
  SiRNA target sequence
taggtactagtttgaagacag

SEQ ID NO: 14357 - DNA, 21 bp, Artificial sequence
  SiRNA target sequence
aggtactagtttgaagacagt

SEQ ID NO: 14358 - DNA, 21 bp, Artificial sequence
  SiRNA target sequence
ggtactagtttgaagacagtt

SEQ ID NO: 14359 - DNA, 21 bp, Artificial sequence
  SiRNA target sequence
gtactagtttgaagacagttg

SEQ ID NO: 14360 - DNA, 21 bp, Artificial sequence
  SiRNA target sequence
tactagtttgaagacagttgc

SEQ ID NO: 14361 - DNA, 21 bp, Artificial sequence
  SiRNA target sequence
actagtttgaagacagttgct

SEQ ID NO: 14362 - DNA, 21 bp, Artificial sequence
  SiRNA target sequence
ctagtttgaagacagttgctt

SEQ ID NO: 14363 - DNA, 21 bp, Artificial sequence
  SiRNA target sequence
tagtttgaagacagttgcttg

SEQ ID NO: 14364 - DNA, 21 bp, Artificial sequence
  SiRNA target sequence
agtttgaagacagttgcttgg

SEQ ID NO: 14365 - DNA, 21 bp, Artificial sequence
  SiRNA target sequence
gtttgaagacagttgcttggg

SEQ ID NO: 14366 - DNA, 21 bp, Artificial sequence
  SiRNA target sequence
tttgaagacagttgcttgggc

SEQ ID NO: 14367 - DNA, 21 bp, Artificial sequence
  SiRNA target sequence
ttgaagacagttgcttgggcg

SEQ ID NO: 14368 - DNA, 21 bp, Artificial sequence
  SiRNA target sequence
tgaagacagttgcttgggcga

SEQ ID NO: 14369 - DNA, 21 bp, Artificial sequence
  SiRNA target sequence
gaagacagttgcttgggcgat

SEQ ID NO: 14370 - DNA, 21 bp, Artificial sequence
  SiRNA target sequence
aagacagttgcttgggcgatt

SEQ ID NO: 14371 - DNA, 21 bp, Artificial sequence
  SiRNA target sequence
agacagttgcttgggcgattg

SEQ ID NO: 14372 - DNA, 21 bp, Artificial sequence
  SiRNA target sequence
gacagttgcttgggcgattgt

SEQ ID NO: 14373 - DNA, 21 bp, Artificial sequence
  SiRNA target sequence
acagttgcttgggcgattgtt

SEQ ID NO: 14374 - DNA, 21 bp, Artificial sequence
  SiRNA target sequence
cagttgcttgggcgattgttt

SEQ ID NO: 14375 - DNA, 21 bp, Artificial sequence
  SiRNA target sequence
agttgcttgggcgattgtttc

SEQ ID NO: 14376 - DNA, 21 bp, Artificial sequence
  SiRNA target sequence
gttgcttgggcgattgtttcg

SEQ ID NO: 14377 - DNA, 21 bp, Artificial sequence
  SiRNA target sequence
ttgcttgggcgattgtttcga

SEQ ID NO: 14378 - DNA, 21 bp, Artificial sequence
  SiRNA target sequence
tgcttgggcgattgtttcgat

SEQ ID NO: 14379 - DNA, 21 bp, Artificial sequence
  SiRNA target sequence
gcttgggcgattgtttcgatt

SEQ ID NO: 14380 - DNA, 21 bp, Artificial sequence
  SiRNA target sequence
cttgggcgattgtttcgattt

SEQ ID NO: 14381 - DNA, 21 bp, Artificial sequence
  SiRNA target sequence
ttgggcgattgtttcgatttt

SEQ ID NO: 14382 - DNA, 21 bp, Artificial sequence
  SiRNA target sequence
tgggcgattgtttcgattttt

SEQ ID NO: 14383 - DNA, 21 bp, Artificial sequence
  SiRNA target sequence
gggcgattgtttcgatttttg

SEQ ID NO: 14384 - DNA, 21 bp, Artificial sequence
  SiRNA target sequence
ggcgattgtttcgatttttgt

SEQ ID NO: 14385 - DNA, 21 bp, Artificial sequence
  SiRNA target sequence
gcgattgtttcgatttttgtg

SEQ ID NO: 14386 - DNA, 21 bp, Artificial sequence
  SiRNA target sequence
cgattgtttcgatttttgtga

SEQ ID NO: 14387 - DNA, 21 bp, Artificial sequence
  SiRNA target sequence
gattgtttcgatttttgtgac

SEQ ID NO: 14388 - DNA, 21 bp, Artificial sequence
  SiRNA target sequence
attgtttcgatttttgtgact

SEQ ID NO: 14389 - DNA, 21 bp, Artificial sequence
  SiRNA target sequence
ttgtttcgatttttgtgactt

SEQ ID NO: 14390 - DNA, 21 bp, Artificial sequence
  SiRNA target sequence
tgtttcgatttttgtgacttt

SEQ ID NO: 14391 - DNA, 21 bp, Artificial sequence
  SiRNA target sequence
gtttcgatttttgtgacttta

SEQ ID NO: 14392 - DNA, 21 bp, Artificial sequence
  SiRNA target sequence
tttcgatttttgtgactttag

SEQ ID NO: 14393 - DNA, 21 bp, Artificial sequence
  SiRNA target sequence
ttcgatttttgtgactttagg

SEQ ID NO: 14394 - DNA, 21 bp, Artificial sequence
  SiRNA target sequence
tcgatttttgtgactttagga

SEQ ID NO: 14395 - DNA, 21 bp, Artificial sequence
  SiRNA target sequence
cgatttttgtgactttaggat

SEQ ID NO: 14396 - DNA, 21 bp, Artificial sequence
  SiRNA target sequence
gatttttgtgactttaggatt

SEQ ID NO: 14397 - DNA, 21 bp, Artificial sequence
  SiRNA target sequence
atttttgtgactttaggatta

SEQ ID NO: 14398 - DNA, 21 bp, Artificial sequence
  SiRNA target sequence
tttttgtgactttaggattaa

SEQ ID NO: 14399 - DNA, 21 bp, Artificial sequence
  SiRNA target sequence
ttttgtgactttaggattaat

SEQ ID NO: 14400 - DNA, 21 bp, Artificial sequence
  SiRNA target sequence
tttgtgactttaggattaatt

SEQ ID NO: 14401 - DNA, 21 bp, Artificial sequence
  SiRNA target sequence
ttgtgactttaggattaattg

SEQ ID NO: 14402 - DNA, 21 bp, Artificial sequence
  SiRNA target sequence
tgtgactttaggattaattgg

SEQ ID NO: 14403 - DNA, 21 bp, Artificial sequence
  SiRNA target sequence
gtgactttaggattaattgga

SEQ ID NO: 14404 - DNA, 21 bp, Artificial sequence
  SiRNA target sequence
tgactttaggattaattggac

SEQ ID NO: 14405 - DNA, 21 bp, Artificial sequence
  SiRNA target sequence
gactttaggattaattggacg

SEQ ID NO: 14406 - DNA, 21 bp, Artificial sequence
  SiRNA target sequence
actttaggattaattggacgc

SEQ ID NO: 14407 - DNA, 21 bp, Artificial sequence
  SiRNA target sequence
ctttaggattaattggacgcg

SEQ ID NO: 14408 - DNA, 21 bp, Artificial sequence
  SiRNA target sequence
tttaggattaattggacgcga

SEQ ID NO: 14409 - DNA, 21 bp, Artificial sequence
  SiRNA target sequence
ttaggattaattggacgcgaa

SEQ ID NO: 14410 - DNA, 21 bp, Artificial sequence
  SiRNA target sequence
taggattaattggacgcgaaa

SEQ ID NO: 14411 - DNA, 21 bp, Artificial sequence
  SiRNA target sequence
aggattaattggacgcgaaat

SEQ ID NO: 14412 - DNA, 21 bp, Artificial sequence
  SiRNA target sequence
ggattaattggacgcgaaatg

SEQ ID NO: 14413 - DNA, 21 bp, Artificial sequence
  SiRNA target sequence
gattaattggacgcgaaatga

SEQ ID NO: 14414 - DNA, 21 bp, Artificial sequence
  SiRNA target sequence
attaattggacgcgaaatgat

SEQ ID NO: 14415 - DNA, 21 bp, Artificial sequence
  SiRNA target sequence
ttaattggacgcgaaatgatg

SEQ ID NO: 14416 - DNA, 21 bp, Artificial sequence
  SiRNA target sequence
taattggacgcgaaatgatgc

SEQ ID NO: 14417 - DNA, 21 bp, Artificial sequence
  SiRNA target sequence
aattggacgcgaaatgatgca

SEQ ID NO: 14418 - DNA, 21 bp, Artificial sequence
  SiRNA target sequence
attggacgcgaaatgatgcat

SEQ ID NO: 14419 - DNA, 21 bp, Artificial sequence
  SiRNA target sequence
ttggacgcgaaatgatgcatt

SEQ ID NO: 14420 - DNA, 21 bp, Artificial sequence
  SiRNA target sequence
tggacgcgaaatgatgcattc

SEQ ID NO: 14421 - DNA, 21 bp, Artificial sequence
  SiRNA target sequence
ggacgcgaaatgatgcattca

SEQ ID NO: 14422 - DNA, 21 bp, Artificial sequence
  SiRNA target sequence
gacgcgaaatgatgcattcag

SEQ ID NO: 14423 - DNA, 21 bp, Artificial sequence
  SiRNA target sequence
acgcgaaatgatgcattcagt

SEQ ID NO: 14424 - DNA, 21 bp, Artificial sequence
  SiRNA target sequence
cgcgaaatgatgcattcagtt

SEQ ID NO: 14425 - DNA, 21 bp, Artificial sequence
  SiRNA target sequence
gcgaaatgatgcattcagtta

SEQ ID NO: 14426 - DNA, 21 bp, Artificial sequence
  SiRNA target sequence
cgaaatgatgcattcagttat

SEQ ID NO: 14427 - DNA, 21 bp, Artificial sequence
  SiRNA target sequence
gaaatgatgcattcagttatt

SEQ ID NO: 14428 - DNA, 21 bp, Artificial sequence
  SiRNA target sequence
aaatgatgcattcagttatta

SEQ ID NO: 14429 - DNA, 21 bp, Artificial sequence
  SiRNA target sequence
aatgatgcattcagttattac

SEQ ID NO: 14430 - DNA, 21 bp, Artificial sequence
  SiRNA target sequence
atgatgcattcagttattact

SEQ ID NO: 14431 - DNA, 21 bp, Artificial sequence
  SiRNA target sequence
tgatgcattcagttattactg

SEQ ID NO: 14432 - DNA, 21 bp, Artificial sequence
  SiRNA target sequence
gatgcattcagttattactgt

SEQ ID NO: 14433 - DNA, 21 bp, Artificial sequence
  SiRNA target sequence
atgcattcagttattactgta

SEQ ID NO: 14434 - DNA, 21 bp, Artificial sequence
  SiRNA target sequence
tgcattcagttattactgtag

SEQ ID NO: 14435 - DNA, 21 bp, Artificial sequence
  SiRNA target sequence
gcattcagttattactgtagt

SEQ ID NO: 14436 - DNA, 21 bp, Artificial sequence
  SiRNA target sequence
cattcagttattactgtagtc

SEQ ID NO: 14437 - DNA, 21 bp, Artificial sequence
  SiRNA target sequence
attcagttattactgtagtca

SEQ ID NO: 14438 - DNA, 21 bp, Artificial sequence
  SiRNA target sequence
ttcagttattactgtagtcaa

SEQ ID NO: 14439 - DNA, 21 bp, Artificial sequence
  SiRNA target sequence
tcagttattactgtagtcaag

SEQ ID NO: 14440 - DNA, 21 bp, Artificial sequence
  SiRNA target sequence
cagttattactgtagtcaagc

SEQ ID NO: 14441 - DNA, 21 bp, Artificial sequence
  SiRNA target sequence
agttattactgtagtcaagcg

SEQ ID NO: 14442 - DNA, 21 bp, Artificial sequence
  SiRNA target sequence
gttattactgtagtcaagcgg

SEQ ID NO: 14443 - DNA, 21 bp, Artificial sequence
  SiRNA target sequence
ttattactgtagtcaagcggt

SEQ ID NO: 14444 - DNA, 21 bp, Artificial sequence
  SiRNA target sequence
tattactgtagtcaagcggtt

SEQ ID NO: 14445 - DNA, 21 bp, Artificial sequence
  SiRNA target sequence
attactgtagtcaagcggtta

SEQ ID NO: 14446 - DNA, 21 bp, Artificial sequence
  SiRNA target sequence
ttactgtagtcaagcggttac

SEQ ID NO: 14447 - DNA, 21 bp, Artificial sequence
  SiRNA target sequence
tactgtagtcaagcggttact

SEQ ID NO: 14448 - DNA, 21 bp, Artificial sequence
  SiRNA target sequence
actgtagtcaagcggttactt

SEQ ID NO: 14449 - DNA, 21 bp, Artificial sequence
  SiRNA target sequence
ctgtagtcaagcggttacttg

SEQ ID NO: 14450 - DNA, 21 bp, Artificial sequence
  SiRNA target sequence
tgtagtcaagcggttacttga

SEQ ID NO: 14451 - DNA, 21 bp, Artificial sequence
  SiRNA target sequence
gtagtcaagcggttacttgag

SEQ ID NO: 14452 - DNA, 21 bp, Artificial sequence
  SiRNA target sequence
tagtcaagcggttacttgaga

SEQ ID NO: 14453 - DNA, 21 bp, Artificial sequence
  SiRNA target sequence
agtcaagcggttacttgagaa

SEQ ID NO: 14454 - DNA, 21 bp, Artificial sequence
  SiRNA target sequence
gtcaagcggttacttgagaaa

SEQ ID NO: 14455 - DNA, 21 bp, Artificial sequence
  SiRNA target sequence
tcaagcggttacttgagaaat

SEQ ID NO: 14456 - DNA, 21 bp, Artificial sequence
  SiRNA target sequence
caagcggttacttgagaaata

SEQ ID NO: 14457 - DNA, 21 bp, Artificial sequence
  SiRNA target sequence
aagcggttacttgagaaatat

SEQ ID NO: 14458 - DNA, 21 bp, Artificial sequence
  SiRNA target sequence
agcggttacttgagaaatatc

SEQ ID NO: 14459 - DNA, 21 bp, Artificial sequence
  SiRNA target sequence
gcggttacttgagaaatatca

SEQ ID NO: 14460 - DNA, 21 bp, Artificial sequence
  SiRNA target sequence
cggttacttgagaaatatcac

SEQ ID NO: 14461 - DNA, 21 bp, Artificial sequence
  SiRNA target sequence
ggttacttgagaaatatcact

SEQ ID NO: 14462 - DNA, 21 bp, Artificial sequence
  SiRNA target sequence
gttacttgagaaatatcactt

SEQ ID NO: 14463 - DNA, 21 bp, Artificial sequence
  SiRNA target sequence
ttacttgagaaatatcacttg

SEQ ID NO: 14464 - DNA, 21 bp, Artificial sequence
  SiRNA target sequence
tacttgagaaatatcacttgg

SEQ ID NO: 14465 - DNA, 21 bp, Artificial sequence
  SiRNA target sequence
acttgagaaatatcacttggc

SEQ ID NO: 14466 - DNA, 21 bp, Artificial sequence
  SiRNA target sequence
cttgagaaatatcacttggcg

SEQ ID NO: 14467 - DNA, 21 bp, Artificial sequence
  SiRNA target sequence
ttgagaaatatcacttggcga

SEQ ID NO: 14468 - DNA, 21 bp, Artificial sequence
  SiRNA target sequence
tgagaaatatcacttggcgac

SEQ ID NO: 14469 - DNA, 21 bp, Artificial sequence
  SiRNA target sequence
gagaaatatcacttggcgacg

SEQ ID NO: 14470 - DNA, 21 bp, Artificial sequence
  SiRNA target sequence
agaaatatcacttggcgacgc

SEQ ID NO: 14471 - DNA, 21 bp, Artificial sequence
  SiRNA target sequence
gaaatatcacttggcgacgca

SEQ ID NO: 14472 - DNA, 21 bp, Artificial sequence
  SiRNA target sequence
aaatatcacttggcgacgcaa

SEQ ID NO: 14473 - DNA, 21 bp, Artificial sequence
  SiRNA target sequence
aatatcacttggcgacgcaac

SEQ ID NO: 14474 - DNA, 21 bp, Artificial sequence
  SiRNA target sequence
atatcacttggcgacgcaacc

SEQ ID NO: 14475 - DNA, 21 bp, Artificial sequence
  SiRNA target sequence
tatcacttggcgacgcaaccc

SEQ ID NO: 14476 - DNA, 21 bp, Artificial sequence
  SiRNA target sequence
atcacttggcgacgcaacccc

SEQ ID NO: 14477 - DNA, 21 bp, Artificial sequence
  SiRNA target sequence
tcacttggcgacgcaacccca

SEQ ID NO: 14478 - DNA, 21 bp, Artificial sequence
  SiRNA target sequence
cacttggcgacgcaaccccag

SEQ ID NO: 14479 - DNA, 21 bp, Artificial sequence
  SiRNA target sequence
acttggcgacgcaaccccagg

SEQ ID NO: 14480 - DNA, 21 bp, Artificial sequence
  SiRNA target sequence
cttggcgacgcaaccccagga

SEQ ID NO: 14481 - DNA, 21 bp, Artificial sequence
  SiRNA target sequence
ttggcgacgcaaccccaggaa

SEQ ID NO: 14482 - DNA, 21 bp, Artificial sequence
  SiRNA target sequence
tggcgacgcaaccccaggaat

SEQ ID NO: 14483 - DNA, 21 bp, Artificial sequence
  SiRNA target sequence
ggcgacgcaaccccaggaatc

SEQ ID NO: 14484 - DNA, 21 bp, Artificial sequence
  SiRNA target sequence
gcgacgcaaccccaggaatcc

SEQ ID NO: 14485 - DNA, 21 bp, Artificial sequence
  SiRNA target sequence
cgacgcaaccccaggaatccg

SEQ ID NO: 14486 - DNA, 21 bp, Artificial sequence
  SiRNA target sequence
gacgcaaccccaggaatccgc

SEQ ID NO: 14487 - DNA, 21 bp, Artificial sequence
  SiRNA target sequence
acgcaaccccaggaatccgcc

SEQ ID NO: 14488 - DNA, 21 bp, Artificial sequence
  SiRNA target sequence
cgcaaccccaggaatccgcca

SEQ ID NO: 14489 - DNA, 21 bp, Artificial sequence
  SiRNA target sequence
gcaaccccaggaatccgccag

SEQ ID NO: 14490 - DNA, 21 bp, Artificial sequence
  SiRNA target sequence
caaccccaggaatccgccagt

SEQ ID NO: 14491 - DNA, 21 bp, Artificial sequence
  SiRNA target sequence
aaccccaggaatccgccagtt

SEQ ID NO: 14492 - DNA, 21 bp, Artificial sequence
  SiRNA target sequence
accccaggaatccgccagttc

SEQ ID NO: 14493 - DNA, 21 bp, Artificial sequence
  SiRNA target sequence
ccccaggaatccgccagttca

SEQ ID NO: 14494 - DNA, 21 bp, Artificial sequence
  SiRNA target sequence
cccaggaatccgccagttcaa

SEQ ID NO: 14495 - DNA, 21 bp, Artificial sequence
  SiRNA target sequence
ccaggaatccgccagttcaag

SEQ ID NO: 14496 - DNA, 21 bp, Artificial sequence
  SiRNA target sequence
caggaatccgccagttcaagt

SEQ ID NO: 14497 - DNA, 21 bp, Artificial sequence
  SiRNA target sequence
aggaatccgccagttcaagta

SEQ ID NO: 14498 - DNA, 21 bp, Artificial sequence
  SiRNA target sequence
ggaatccgccagttcaagtac

SEQ ID NO: 14499 - DNA, 21 bp, Artificial sequence
  SiRNA target sequence
gaatccgccagttcaagtact

SEQ ID NO: 14500 - DNA, 21 bp, Artificial sequence
  SiRNA target sequence
aatccgccagttcaagtactg

SEQ ID NO: 14501 - DNA, 21 bp, Artificial sequence
  SiRNA target sequence
atccgccagttcaagtactgt

SEQ ID NO: 14502 - DNA, 21 bp, Artificial sequence
  SiRNA target sequence
tccgccagttcaagtactgtt

SEQ ID NO: 14503 - DNA, 21 bp, Artificial sequence
  SiRNA target sequence
ccgccagttcaagtactgtta

SEQ ID NO: 14504 - DNA, 21 bp, Artificial sequence
  SiRNA target sequence
cgccagttcaagtactgttat

SEQ ID NO: 14505 - DNA, 21 bp, Artificial sequence
  SiRNA target sequence
gccagttcaagtactgttata

SEQ ID NO: 14506 - DNA, 21 bp, Artificial sequence
  SiRNA target sequence
ccagttcaagtactgttatat

SEQ ID NO: 14507 - DNA, 21 bp, Artificial sequence
  SiRNA target sequence
cagttcaagtactgttatatc

SEQ ID NO: 14508 - DNA, 21 bp, Artificial sequence
  SiRNA target sequence
agttcaagtactgttatatct

SEQ ID NO: 14509 - DNA, 21 bp, Artificial sequence
  SiRNA target sequence
gttcaagtactgttatatctg

SEQ ID NO: 14510 - DNA, 21 bp, Artificial sequence
  SiRNA target sequence
ttcaagtactgttatatctgc

SEQ ID NO: 14511 - DNA, 21 bp, Artificial sequence
  SiRNA target sequence
tcaagtactgttatatctgcc

SEQ ID NO: 14512 - DNA, 21 bp, Artificial sequence
  SiRNA target sequence
caagtactgttatatctgccg

SEQ ID NO: 14513 - DNA, 21 bp, Artificial sequence
  SiRNA target sequence
aagtactgttatatctgccgt

SEQ ID NO: 14514 - DNA, 21 bp, Artificial sequence
  SiRNA target sequence
agtactgttatatctgccgtt

SEQ ID NO: 14515 - DNA, 21 bp, Artificial sequence
  SiRNA target sequence
gtactgttatatctgccgttc

SEQ ID NO: 14516 - DNA, 21 bp, Artificial sequence
  SiRNA target sequence
tactgttatatctgccgttcc

SEQ ID NO: 14517 - DNA, 21 bp, Artificial sequence
  SiRNA target sequence
actgttatatctgccgttcca

SEQ ID NO: 14518 - DNA, 21 bp, Artificial sequence
  SiRNA target sequence
ctgttatatctgccgttccag

SEQ ID NO: 14519 - DNA, 21 bp, Artificial sequence
  SiRNA target sequence
tgttatatctgccgttccaga

SEQ ID NO: 14520 - DNA, 21 bp, Artificial sequence
  SiRNA target sequence
gttatatctgccgttccagaa

SEQ ID NO: 14521 - DNA, 21 bp, Artificial sequence
  SiRNA target sequence
ttatatctgccgttccagaag

SEQ ID NO: 14522 - DNA, 21 bp, Artificial sequence
  SiRNA target sequence
tatatctgccgttccagaagc

SEQ ID NO: 14523 - DNA, 21 bp, Artificial sequence
  SiRNA target sequence
atatctgccgttccagaagct

SEQ ID NO: 14524 - DNA, 21 bp, Artificial sequence
  SiRNA target sequence
tatctgccgttccagaagctc

SEQ ID NO: 14525 - DNA, 21 bp, Artificial sequence
  SiRNA target sequence
atctgccgttccagaagctcc

SEQ ID NO: 14526 - DNA, 21 bp, Artificial sequence
  SiRNA target sequence
tctgccgttccagaagctccc

SEQ ID NO: 14527 - DNA, 21 bp, Artificial sequence
  SiRNA target sequence
ctgccgttccagaagctccca

SEQ ID NO: 14528 - DNA, 21 bp, Artificial sequence
  SiRNA target sequence
tgccgttccagaagctcccaa

SEQ ID NO: 14529 - DNA, 21 bp, Artificial sequence
  SiRNA target sequence
gccgttccagaagctcccaat

SEQ ID NO: 14530 - DNA, 21 bp, Artificial sequence
  SiRNA target sequence
ccgttccagaagctcccaatg

SEQ ID NO: 14531 - DNA, 21 bp, Artificial sequence
  SiRNA target sequence
cgttccagaagctcccaatgc

SEQ ID NO: 14532 - DNA, 21 bp, Artificial sequence
  SiRNA target sequence
gttccagaagctcccaatgct

SEQ ID NO: 14533 - DNA, 21 bp, Artificial sequence
  SiRNA target sequence
ttccagaagctcccaatgctg

SEQ ID NO: 14534 - DNA, 21 bp, Artificial sequence
  SiRNA target sequence
tccagaagctcccaatgctga

SEQ ID NO: 14535 - DNA, 21 bp, Artificial sequence
  SiRNA target sequence
ccagaagctcccaatgctgaa

SEQ ID NO: 14536 - DNA, 21 bp, Artificial sequence
  SiRNA target sequence
cagaagctcccaatgctgaag

SEQ ID NO: 14537 - DNA, 21 bp, Artificial sequence
  SiRNA target sequence
agaagctcccaatgctgaagc

SEQ ID NO: 14538 - DNA, 21 bp, Artificial sequence
  SiRNA target sequence
gaagctcccaatgctgaagcg

SEQ ID NO: 14539 - DNA, 21 bp, Artificial sequence
  SiRNA target sequence
aagctcccaatgctgaagcgg

SEQ ID NO: 14540 - DNA, 21 bp, Artificial sequence
  SiRNA target sequence
agctcccaatgctgaagcgga

SEQ ID NO: 14541 - DNA, 21 bp, Artificial sequence
  SiRNA target sequence
gctcccaatgctgaagcggag

SEQ ID NO: 14542 - DNA, 21 bp, Artificial sequence
  SiRNA target sequence
ctcccaatgctgaagcggagg

SEQ ID NO: 14543 - DNA, 21 bp, Artificial sequence
  SiRNA target sequence
tcccaatgctgaagcggagga

SEQ ID NO: 14544 - DNA, 21 bp, Artificial sequence
  SiRNA target sequence
cccaatgctgaagcggaggag

SEQ ID NO: 14545 - DNA, 21 bp, Artificial sequence
  SiRNA target sequence
ccaatgctgaagcggaggagg

SEQ ID NO: 14546 - DNA, 21 bp, Artificial sequence
  SiRNA target sequence
caatgctgaagcggaggaggc

SEQ ID NO: 14547 - DNA, 21 bp, Artificial sequence
  SiRNA target sequence
aatgctgaagcggaggaggca

SEQ ID NO: 14548 - DNA, 21 bp, Artificial sequence
  SiRNA target sequence
atgctgaagcggaggaggcaa

SEQ ID NO: 14549 - DNA, 21 bp, Artificial sequence
  SiRNA target sequence
tgctgaagcggaggaggcaag

SEQ ID NO: 14550 - DNA, 21 bp, Artificial sequence
  SiRNA target sequence
gctgaagcggaggaggcaagt

SEQ ID NO: 14551 - DNA, 21 bp, Artificial sequence
  SiRNA target sequence
ctgaagcggaggaggcaagtg

SEQ ID NO: 14552 - DNA, 21 bp, Artificial sequence
  SiRNA target sequence
tgaagcggaggaggcaagtgc

SEQ ID NO: 14553 - DNA, 21 bp, Artificial sequence
  SiRNA target sequence
gaagcggaggaggcaagtgct

SEQ ID NO: 14554 - DNA, 21 bp, Artificial sequence
  SiRNA target sequence
aagcggaggaggcaagtgctt

SEQ ID NO: 14555 - DNA, 21 bp, Artificial sequence
  SiRNA target sequence
agcggaggaggcaagtgcttg

SEQ ID NO: 14556 - DNA, 21 bp, Artificial sequence
  SiRNA target sequence
gcggaggaggcaagtgcttgg

SEQ ID NO: 14557 - DNA, 21 bp, Artificial sequence
  SiRNA target sequence
cggaggaggcaagtgcttggg

SEQ ID NO: 14558 - DNA, 21 bp, Artificial sequence
  SiRNA target sequence
ggaggaggcaagtgcttgggt

SEQ ID NO: 14559 - DNA, 21 bp, Artificial sequence
  SiRNA target sequence
gaggaggcaagtgcttgggta

SEQ ID NO: 14560 - DNA, 21 bp, Artificial sequence
  SiRNA target sequence
aggaggcaagtgcttgggtat

SEQ ID NO: 14561 - DNA, 21 bp, Artificial sequence
  SiRNA target sequence
ggaggcaagtgcttgggtatc

SEQ ID NO: 14562 - DNA, 21 bp, Artificial sequence
  SiRNA target sequence
gaggcaagtgcttgggtatcc

SEQ ID NO: 14563 - DNA, 21 bp, Artificial sequence
  SiRNA target sequence
aggcaagtgcttgggtatcca

SEQ ID NO: 14564 - DNA, 21 bp, Artificial sequence
  SiRNA target sequence
ggcaagtgcttgggtatccat

SEQ ID NO: 14565 - DNA, 21 bp, Artificial sequence
  SiRNA target sequence
gcaagtgcttgggtatccatt

SEQ ID NO: 14566 - DNA, 21 bp, Artificial sequence
  SiRNA target sequence
caagtgcttgggtatccatta

SEQ ID NO: 14567 - DNA, 21 bp, Artificial sequence
  SiRNA target sequence
aagtgcttgggtatccattat

SEQ ID NO: 14568 - DNA, 21 bp, Artificial sequence
  SiRNA target sequence
agtgcttgggtatccattatt

SEQ ID NO: 14569 - DNA, 21 bp, Artificial sequence
  SiRNA target sequence
gtgcttgggtatccattattt

SEQ ID NO: 14570 - DNA, 21 bp, Artificial sequence
  SiRNA target sequence
tgcttgggtatccattattta

SEQ ID NO: 14571 - DNA, 21 bp, Artificial sequence
  SiRNA target sequence
gcttgggtatccattatttat

SEQ ID NO: 14572 - DNA, 21 bp, Artificial sequence
  SiRNA target sequence
cttgggtatccattatttata

SEQ ID NO: 14573 - DNA, 21 bp, Artificial sequence
  SiRNA target sequence
ttgggtatccattatttataa

SEQ ID NO: 14574 - DNA, 21 bp, Artificial sequence
  SiRNA target sequence
tgggtatccattatttataat

SEQ ID NO: 14575 - DNA, 21 bp, Artificial sequence
  SiRNA target sequence
gggtatccattatttataatg

SEQ ID NO: 14576 - DNA, 21 bp, Artificial sequence
  SiRNA target sequence
ggtatccattatttataatgg

SEQ ID NO: 14577 - DNA, 21 bp, Artificial sequence
  SiRNA target sequence
gtatccattatttataatggt

SEQ ID NO: 14578 - DNA, 21 bp, Artificial sequence
  SiRNA target sequence
tatccattatttataatggtg

SEQ ID NO: 14579 - DNA, 21 bp, Artificial sequence
  SiRNA target sequence
atccattatttataatggtgt

SEQ ID NO: 14580 - DNA, 21 bp, Artificial sequence
  SiRNA target sequence
tccattatttataatggtgtg

SEQ ID NO: 14581 - DNA, 21 bp, Artificial sequence
  SiRNA target sequence
ccattatttataatggtgtgt

SEQ ID NO: 14582 - DNA, 21 bp, Artificial sequence
  SiRNA target sequence
cattatttataatggtgtgtg

SEQ ID NO: 14583 - DNA, 21 bp, Artificial sequence
  SiRNA target sequence
attatttataatggtgtgtgt

SEQ ID NO: 14584 - DNA, 21 bp, Artificial sequence
  SiRNA target sequence
ttatttataatggtgtgtgta

SEQ ID NO: 14585 - DNA, 21 bp, Artificial sequence
  SiRNA target sequence
tatttataatggtgtgtgtaa

SEQ ID NO: 14586 - DNA, 21 bp, Artificial sequence
  SiRNA target sequence
atttataatggtgtgtgtaat

SEQ ID NO: 14587 - DNA, 21 bp, Artificial sequence
  SiRNA target sequence
tttataatggtgtgtgtaata

SEQ ID NO: 14588 - DNA, 21 bp, Artificial sequence
  SiRNA target sequence
ttataatggtgtgtgtaatat

SEQ ID NO: 14589 - DNA, 21 bp, Artificial sequence
  SiRNA target sequence
tataatggtgtgtgtaatatg

SEQ ID NO: 14590 - DNA, 21 bp, Artificial sequence
  SiRNA target sequence
ataatggtgtgtgtaatatgc

SEQ ID NO: 14591 - DNA, 21 bp, Artificial sequence
  SiRNA target sequence
taatggtgtgtgtaatatgct

SEQ ID NO: 14592 - DNA, 21 bp, Artificial sequence
  SiRNA target sequence
aatggtgtgtgtaatatgctt

SEQ ID NO: 14593 - DNA, 21 bp, Artificial sequence
  SiRNA target sequence
atggtgtgtgtaatatgctta

SEQ ID NO: 14594 - DNA, 21 bp, Artificial sequence
  SiRNA target sequence
tggtgtgtgtaatatgcttaa

SEQ ID NO: 14595 - DNA, 21 bp, Artificial sequence
  SiRNA target sequence
ggtgtgtgtaatatgcttaat

SEQ ID NO: 14596 - DNA, 21 bp, Artificial sequence
  SiRNA target sequence
gtgtgtgtaatatgcttaatg

SEQ ID NO: 14597 - DNA, 21 bp, Artificial sequence
  SiRNA target sequence
tgtgtgtaatatgcttaatgt

SEQ ID NO: 14598 - DNA, 21 bp, Artificial sequence
  SiRNA target sequence
  misc_feature (21)..(21): n is a, c, g, or t
gtgtgtaatatgcttaatgtn

SEQ ID NO: 14599 - DNA, 21 bp, Artificial sequence
  SiRNA target sequence
  misc_feature (20)..(20): n is a, c, g, or t
tgtgtaatatgcttaatgtng

SEQ ID NO: 14600 - DNA, 21 bp, Artificial sequence
  SiRNA target sequence
  misc_feature (19)..(19): n is a, c, g, or t
gtgtaatatgcttaatgtngc

SEQ ID NO: 14601 - DNA, 21 bp, Artificial sequence
  SiRNA target sequence
  misc_feature (18)..(18): n is a, c, g, or t
tgtaatatgcttaatgtngct

SEQ ID NO: 14602 - DNA, 21 bp, Artificial sequence
  SiRNA target sequence
  misc_feature (17)..(17): n is a, c, g, or t
gtaatatgcttaatgtngctg

SEQ ID NO: 14603 - DNA, 21 bp, Artificial sequence
  SiRNA target sequence
  misc_feature (16)..(16): n is a, c, g, or t
taatatgcttaatgtngctgc

SEQ ID NO: 14604 - DNA, 21 bp, Artificial sequence
  SiRNA target sequence
  misc_feature (15)..(15): n is a, c, g, or t
aatatgcttaatgtngctgct

SEQ ID NO: 14605 - DNA, 21 bp, Artificial sequence
  SiRNA target sequence
  misc_feature (14)..(14): n is a, c, g, or t
atatgcttaatgtngctgctc

SEQ ID NO: 14606 - DNA, 21 bp, Artificial sequence
  SiRNA target sequence
  misc_feature (13)..(13): n is a, c, g, or t
tatgcttaatgtngctgctca

SEQ ID NO: 14607 - DNA, 21 bp, Artificial sequence
  SiRNA target sequence
  misc_feature (12)..(12): n is a, c, g, or t
atgcttaatgtngctgctcaa

SEQ ID NO: 14608 - DNA, 21 bp, Artificial sequence
  SiRNA target sequence
  misc_feature (11)..(11): n is a, c, g, or t
tgcttaatgtngctgctcaaa

SEQ ID NO: 14609 - DNA, 21 bp, Artificial sequence
  SiRNA target sequence
  misc_feature (10)..(10): n is a, c, g, or t
gcttaatgtngctgctcaaaa

SEQ ID NO: 14610 - DNA, 21 bp, Artificial sequence
  SiRNA target sequence
  misc_feature (9)..(9): n is a, c, g, or t
cttaatgtngctgctcaaaaa

SEQ ID NO: 14611 - DNA, 21 bp, Artificial sequence
  SiRNA target sequence
  misc_feature (8)..(8): n is a, c, g, or t
ttaatgtngctgctcaaaaac

SEQ ID NO: 14612 - DNA, 21 bp, Artificial sequence
  SiRNA target sequence
  misc_feature (7)..(7): n is a, c, g, or t
taatgtngctgctcaaaaacc

SEQ ID NO: 14613 - DNA, 21 bp, Artificial sequence
  SiRNA target sequence
  misc_feature (6)..(6): n is a, c, g, or t
aatgtngctgctcaaaaaccg

SEQ ID NO: 14614 - DNA, 21 bp, Artificial sequence
  SiRNA target sequence
  misc_feature (5)..(5): n is a, c, g, or t
atgtngctgctcaaaaaccga

SEQ ID NO: 14615 - DNA, 21 bp, Artificial sequence
  SiRNA target sequence
  misc_feature (4)..(4): n is a, c, g, or t
tgtngctgctcaaaaaccgaa

SEQ ID NO: 14616 - DNA, 21 bp, Artificial sequence
  SiRNA target sequence
  misc_feature (3)..(3): n is a, c, g, or t
gtngctgctcaaaaaccgaaa

SEQ ID NO: 14617 - DNA, 21 bp, Artificial sequence
  SiRNA target sequence
  misc_feature (2)..(2): n is a, c, g, or t
tngctgctcaaaaaccgaaac

SEQ ID NO: 14618 - DNA, 21 bp, Artificial sequence
  SiRNA target sequence
  misc_feature (1)..(1): n is a, c, g, or t
ngctgctcaaaaaccgaaaca

SEQ ID NO: 14619 - DNA, 21 bp, Artificial sequence
  SiRNA target sequence
gctgctcaaaaaccgaaacaa

SEQ ID NO: 14620 - DNA, 21 bp, Artificial sequence
  SiRNA target sequence
ctgctcaaaaaccgaaacaat

SEQ ID NO: 14621 - DNA, 21 bp, Artificial sequence
  SiRNA target sequence
tgctcaaaaaccgaaacaatt

SEQ ID NO: 14622 - DNA, 21 bp, Artificial sequence
  SiRNA target sequence
gctcaaaaaccgaaacaattt

SEQ ID NO: 14623 - DNA, 21 bp, Artificial sequence
  SiRNA target sequence
ctcaaaaaccgaaacaattta

SEQ ID NO: 14624 - DNA, 21 bp, Artificial sequence
  SiRNA target sequence
tcaaaaaccgaaacaatttaa

SEQ ID NO: 14625 - DNA, 21 bp, Artificial sequence
  SiRNA target sequence
caaaaaccgaaacaatttaaa

SEQ ID NO: 14626 - DNA, 21 bp, Artificial sequence
  SiRNA target sequence
aaaaaccgaaacaatttaaag

SEQ ID NO: 14627 - DNA, 21 bp, Artificial sequence
  SiRNA target sequence
aaaaccgaaacaatttaaaga

SEQ ID NO: 14628 - DNA, 21 bp, Artificial sequence
  SiRNA target sequence
aaaccgaaacaatttaaagat

SEQ ID NO: 14629 - DNA, 21 bp, Artificial sequence
  SiRNA target sequence
aaccgaaacaatttaaagatt

SEQ ID NO: 14630 - DNA, 21 bp, Artificial sequence
  SiRNA target sequence
accgaaacaatttaaagattg

SEQ ID NO: 14631 - DNA, 21 bp, Artificial sequence
  SiRNA target sequence
ccgaaacaatttaaagattgg

SEQ ID NO: 14632 - DNA, 21 bp, Artificial sequence
  SiRNA target sequence
cgaaacaatttaaagattggg

SEQ ID NO: 14633 - DNA, 21 bp, Artificial sequence
  SiRNA target sequence
gaaacaatttaaagattgggt

SEQ ID NO: 14634 - DNA, 21 bp, Artificial sequence
  SiRNA target sequence
aaacaatttaaagattgggta

SEQ ID NO: 14635 - DNA, 21 bp, Artificial sequence
  SiRNA target sequence
aacaatttaaagattgggtaa

SEQ ID NO: 14636 - DNA, 21 bp, Artificial sequence
  SiRNA target sequence
acaatttaaagattgggtaaa

SEQ ID NO: 14637 - DNA, 21 bp, Artificial sequence
  SiRNA target sequence
caatttaaagattgggtaaaa

SEQ ID NO: 14638 - DNA, 21 bp, Artificial sequence
  SiRNA target sequence
aatttaaagattgggtaaaat

SEQ ID NO: 14639 - DNA, 21 bp, Artificial sequence
  SiRNA target sequence
atttaaagattgggtaaaatt

SEQ ID NO: 14640 - DNA, 21 bp, Artificial sequence
  SiRNA target sequence
tttaaagattgggtaaaatta

SEQ ID NO: 14641 - DNA, 21 bp, Artificial sequence
  SiRNA target sequence
ttaaagattgggtaaaattag

SEQ ID NO: 14642 - DNA, 21 bp, Artificial sequence
  SiRNA target sequence
taaagattgggtaaaattagc

SEQ ID NO: 14643 - DNA, 21 bp, Artificial sequence
  SiRNA target sequence
aaagattgggtaaaattagct

SEQ ID NO: 14644 - DNA, 21 bp, Artificial sequence
  SiRNA target sequence
aagattgggtaaaattagcta

SEQ ID NO: 14645 - DNA, 21 bp, Artificial sequence
  SiRNA target sequence
agattgggtaaaattagctac

SEQ ID NO: 14646 - DNA, 21 bp, Artificial sequence
  SiRNA target sequence
gattgggtaaaattagctact

SEQ ID NO: 14647 - DNA, 21 bp, Artificial sequence
  SiRNA target sequence
attgggtaaaattagctactg

SEQ ID NO: 14648 - DNA, 21 bp, Artificial sequence
  SiRNA target sequence
ttgggtaaaattagctactgt

SEQ ID NO: 14649 - DNA, 21 bp, Artificial sequence
  SiRNA target sequence
tgggtaaaattagctactgta

SEQ ID NO: 14650 - DNA, 21 bp, Artificial sequence
  SiRNA target sequence
gggtaaaattagctactgtag

SEQ ID NO: 14651 - DNA, 21 bp, Artificial sequence
  SiRNA target sequence
ggtaaaattagctactgtaga

SEQ ID NO: 14652 - DNA, 21 bp, Artificial sequence
  SiRNA target sequence
gtaaaattagctactgtagat

SEQ ID NO: 14653 - DNA, 21 bp, Artificial sequence
  SiRNA target sequence
taaaattagctactgtagatt

SEQ ID NO: 14654 - DNA, 21 bp, Artificial sequence
  SiRNA target sequence
aaaattagctactgtagattt

SEQ ID NO: 14655 - DNA, 21 bp, Artificial sequence
  SiRNA target sequence
aaattagctactgtagatttt

SEQ ID NO: 14656 - DNA, 21 bp, Artificial sequence
  SiRNA target sequence
aattagctactgtagatttta

SEQ ID NO: 14657 - DNA, 21 bp, Artificial sequence
  SiRNA target sequence
attagctactgtagattttag

SEQ ID NO: 14658 - DNA, 21 bp, Artificial sequence
  SiRNA target sequence
ttagctactgtagattttagt

SEQ ID NO: 14659 - DNA, 21 bp, Artificial sequence
  SiRNA target sequence
tagctactgtagattttagta

SEQ ID NO: 14660 - DNA, 21 bp, Artificial sequence
  SiRNA target sequence
agctactgtagattttagtaa

SEQ ID NO: 14661 - DNA, 21 bp, Artificial sequence
  SiRNA target sequence
gctactgtagattttagtaat

SEQ ID NO: 14662 - DNA, 21 bp, Artificial sequence
  SiRNA target sequence
ctactgtagattttagtaata

SEQ ID NO: 14663 - DNA, 21 bp, Artificial sequence
  SiRNA target sequence
tactgtagattttagtaataa

SEQ ID NO: 14664 - DNA, 21 bp, Artificial sequence
  SiRNA target sequence
actgtagattttagtaataat

SEQ ID NO: 14665 - DNA, 21 bp, Artificial sequence
  SiRNA target sequence
ctgtagattttagtaataatt

SEQ ID NO: 14666 - DNA, 21 bp, Artificial sequence
  SiRNA target sequence
tgtagattttagtaataattg

SEQ ID NO: 14667 - DNA, 21 bp, Artificial sequence
  SiRNA target sequence
gtagattttagtaataattgt

SEQ ID NO: 14668 - DNA, 21 bp, Artificial sequence
  SiRNA target sequence
tagattttagtaataattgta

SEQ ID NO: 14669 - DNA, 21 bp, Artificial sequence
  SiRNA target sequence
agattttagtaataattgtag

SEQ ID NO: 14670 - DNA, 21 bp, Artificial sequence
  SiRNA target sequence
gattttagtaataattgtaga

SEQ ID NO: 14671 - DNA, 21 bp, Artificial sequence
  SiRNA target sequence
attttagtaataattgtagag

SEQ ID NO: 14672 - DNA, 21 bp, Artificial sequence
  SiRNA target sequence
ttttagtaataattgtagagg

SEQ ID NO: 14673 - DNA, 21 bp, Artificial sequence
  SiRNA target sequence
tttagtaataattgtagaggt

SEQ ID NO: 14674 - DNA, 21 bp, Artificial sequence
  SiRNA target sequence
ttagtaataattgtagaggta

SEQ ID NO: 14675 - DNA, 21 bp, Artificial sequence
  SiRNA target sequence
tagtaataattgtagaggtag

SEQ ID NO: 14676 - DNA, 21 bp, Artificial sequence
  SiRNA target sequence
agtaataattgtagaggtagt

SEQ ID NO: 14677 - DNA, 21 bp, Artificial sequence
  SiRNA target sequence
gtaataattgtagaggtagta

SEQ ID NO: 14678 - DNA, 21 bp, Artificial sequence
  SiRNA target sequence
taataattgtagaggtagtaa

SEQ ID NO: 14679 - DNA, 21 bp, Artificial sequence
  SiRNA target sequence
aataattgtagaggtagtaac

SEQ ID NO: 14680 - DNA, 21 bp, Artificial sequence
  SiRNA target sequence
ataattgtagaggtagtaacc

SEQ ID NO: 14681 - DNA, 21 bp, Artificial sequence
  SiRNA target sequence
taattgtagaggtagtaacca

SEQ ID NO: 14682 - DNA, 21 bp, Artificial sequence
  SiRNA target sequence
aattgtagaggtagtaaccag

SEQ ID NO: 14683 - DNA, 21 bp, Artificial sequence
  SiRNA target sequence
attgtagaggtagtaaccagg

SEQ ID NO: 14684 - DNA, 21 bp, Artificial sequence
  SiRNA target sequence
ttgtagaggtagtaaccaggt

SEQ ID NO: 14685 - DNA, 21 bp, Artificial sequence
  SiRNA target sequence
tgtagaggtagtaaccaggta

SEQ ID NO: 14686 - DNA, 21 bp, Artificial sequence
  SiRNA target sequence
gtagaggtagtaaccaggtat

SEQ ID NO: 14687 - DNA, 21 bp, Artificial sequence
  SiRNA target sequence
tagaggtagtaaccaggtatt

SEQ ID NO: 14688 - DNA, 21 bp, Artificial sequence
  SiRNA target sequence
agaggtagtaaccaggtattt

SEQ ID NO: 14689 - DNA, 21 bp, Artificial sequence
  SiRNA target sequence
gaggtagtaaccaggtatttg

SEQ ID NO: 14690 - DNA, 21 bp, Artificial sequence
  SiRNA target sequence
aggtagtaaccaggtatttgt

SEQ ID NO: 14691 - DNA, 21 bp, Artificial sequence
  SiRNA target sequence
ggtagtaaccaggtatttgta

SEQ ID NO: 14692 - DNA, 21 bp, Artificial sequence
  SiRNA target sequence
gtagtaaccaggtatttgtat

SEQ ID NO: 14693 - DNA, 21 bp, Artificial sequence
  SiRNA target sequence
tagtaaccaggtatttgtatt

SEQ ID NO: 14694 - DNA, 21 bp, Artificial sequence
  SiRNA target sequence
agtaaccaggtatttgtattt

SEQ ID NO: 14695 - DNA, 21 bp, Artificial sequence
  SiRNA target sequence
gtaaccaggtatttgtatttt

SEQ ID NO: 14696 - DNA, 21 bp, Artificial sequence
  SiRNA target sequence
taaccaggtatttgtattttt

SEQ ID NO: 14697 - DNA, 21 bp, Artificial sequence
  SiRNA target sequence
aaccaggtatttgtatttttc

SEQ ID NO: 14698 - DNA, 21 bp, Artificial sequence
  SiRNA target sequence
accaggtatttgtatttttca

SEQ ID NO: 14699 - DNA, 21 bp, Artificial sequence
  SiRNA target sequence
ccaggtatttgtatttttcaa

SEQ ID NO: 14700 - DNA, 21 bp, Artificial sequence
  SiRNA target sequence
caggtatttgtatttttcaag

SEQ ID NO: 14701 - DNA, 21 bp, Artificial sequence
  SiRNA target sequence
aggtatttgtatttttcaaga

SEQ ID NO: 14702 - DNA, 21 bp, Artificial sequence
  SiRNA target sequence
ggtatttgtatttttcaagaa

SEQ ID NO: 14703 - DNA, 21 bp, Artificial sequence
  SiRNA target sequence
gtatttgtatttttcaagaat

SEQ ID NO: 14704 - DNA, 21 bp, Artificial sequence
  SiRNA target sequence
tatttgtatttttcaagaata

SEQ ID NO: 14705 - DNA, 21 bp, Artificial sequence
  SiRNA target sequence
atttgtatttttcaagaatac

SEQ ID NO: 14706 - DNA, 21 bp, Artificial sequence
  SiRNA target sequence
tttgtatttttcaagaataca

SEQ ID NO: 14707 - DNA, 21 bp, Artificial sequence
  SiRNA target sequence
ttgtatttttcaagaatacat

SEQ ID NO: 14708 - DNA, 21 bp, Artificial sequence
  SiRNA target sequence
tgtatttttcaagaatacatt

SEQ ID NO: 14709 - DNA, 21 bp, Artificial sequence
  SiRNA target sequence
gtatttttcaagaatacattt

SEQ ID NO: 14710 - DNA, 21 bp, Artificial sequence
  SiRNA target sequence
tatttttcaagaatacatttg

SEQ ID NO: 14711 - DNA, 21 bp, Artificial sequence
  SiRNA target sequence
atttttcaagaatacatttga

SEQ ID NO: 14712 - DNA, 21 bp, Artificial sequence
  SiRNA target sequence
tttttcaagaatacatttgaa

SEQ ID NO: 14713 - DNA, 21 bp, Artificial sequence
  SiRNA target sequence
ttttcaagaatacatttgaag

SEQ ID NO: 14714 - DNA, 21 bp, Artificial sequence
  SiRNA target sequence
tttcaagaatacatttgaagt

SEQ ID NO: 14715 - DNA, 21 bp, Artificial sequence
  SiRNA target sequence
ttcaagaatacatttgaagtg

SEQ ID NO: 14716 - DNA, 21 bp, Artificial sequence
  SiRNA target sequence
tcaagaatacatttgaagtgt

SEQ ID NO: 14717 - DNA, 21 bp, Artificial sequence
  SiRNA target sequence
caagaatacatttgaagtgtt

SEQ ID NO: 14718 - DNA, 21 bp, Artificial sequence
  SiRNA target sequence
aagaatacatttgaagtgttg

SEQ ID NO: 14719 - DNA, 21 bp, Artificial sequence
  SiRNA target sequence
agaatacatttgaagtgttga

SEQ ID NO: 14720 - DNA, 21 bp, Artificial sequence
  SiRNA target sequence
gaatacatttgaagtgttgaa

SEQ ID NO: 14721 - DNA, 21 bp, Artificial sequence
  SiRNA target sequence
aatacatttgaagtgttgaag

SEQ ID NO: 14722 - DNA, 21 bp, Artificial sequence
  SiRNA target sequence
atacatttgaagtgttgaaga

SEQ ID NO: 14723 - DNA, 21 bp, Artificial sequence
  SiRNA target sequence
tacatttgaagtgttgaagaa

SEQ ID NO: 14724 - DNA, 21 bp, Artificial sequence
  SiRNA target sequence
acatttgaagtgttgaagaaa

SEQ ID NO: 14725 - DNA, 21 bp, Artificial sequence
  SiRNA target sequence
catttgaagtgttgaagaaaa

SEQ ID NO: 14726 - DNA, 21 bp, Artificial sequence
  SiRNA target sequence
atttgaagtgttgaagaaaat

SEQ ID NO: 14727 - DNA, 21 bp, Artificial sequence
  SiRNA target sequence
tttgaagtgttgaagaaaatg

SEQ ID NO: 14728 - DNA, 21 bp, Artificial sequence
  SiRNA target sequence
ttgaagtgttgaagaaaatgt

SEQ ID NO: 14729 - DNA, 21 bp, Artificial sequence
  SiRNA target sequence
tgaagtgttgaagaaaatgtg

SEQ ID NO: 14730 - DNA, 21 bp, Artificial sequence
  SiRNA target sequence
gaagtgttgaagaaaatgtgg

SEQ ID NO: 14731 - DNA, 21 bp, Artificial sequence
  SiRNA target sequence
aagtgttgaagaaaatgtggg

SEQ ID NO: 14732 - DNA, 21 bp, Artificial sequence
  SiRNA target sequence
agtgttgaagaaaatgtgggg

SEQ ID NO: 14733 - DNA, 21 bp, Artificial sequence
  SiRNA target sequence
gtgttgaagaaaatgtggggt

SEQ ID NO: 14734 - DNA, 21 bp, Artificial sequence
  SiRNA target sequence
tgttgaagaaaatgtggggtt

SEQ ID NO: 14735 - DNA, 21 bp, Artificial sequence
  SiRNA target sequence
gttgaagaaaatgtggggtta

SEQ ID NO: 14736 - DNA, 21 bp, Artificial sequence
  SiRNA target sequence
ttgaagaaaatgtggggttat

SEQ ID NO: 14737 - DNA, 21 bp, Artificial sequence
  SiRNA target sequence
tgaagaaaatgtggggttatg

SEQ ID NO: 14738 - DNA, 21 bp, Artificial sequence
  SiRNA target sequence
gaagaaaatgtggggttatgt

SEQ ID NO: 14739 - DNA, 21 bp, Artificial sequence
  SiRNA target sequence
aagaaaatgtggggttatgta

SEQ ID NO: 14740 - DNA, 21 bp, Artificial sequence
  SiRNA target sequence
agaaaatgtggggttatgtat

SEQ ID NO: 14741 - DNA, 21 bp, Artificial sequence
  SiRNA target sequence
gaaaatgtggggttatgtatt

SEQ ID NO: 14742 - DNA, 21 bp, Artificial sequence
  SiRNA target sequence
aaaatgtggggttatgtattt

SEQ ID NO: 14743 - DNA, 21 bp, Artificial sequence
  SiRNA target sequence
aaatgtggggttatgtatttt

SEQ ID NO: 14744 - DNA, 21 bp, Artificial sequence
  SiRNA target sequence
aatgtggggttatgtattttg

SEQ ID NO: 14745 - DNA, 21 bp, Artificial sequence
  SiRNA target sequence
atgtggggttatgtattttgt

SEQ ID NO: 14746 - DNA, 21 bp, Artificial sequence
  SiRNA target sequence
tgtggggttatgtattttgtc

SEQ ID NO: 14747 - DNA, 21 bp, Artificial sequence
  SiRNA target sequence
gtggggttatgtattttgtca

SEQ ID NO: 14748 - DNA, 21 bp, Artificial sequence
  SiRNA target sequence
tggggttatgtattttgtcag

SEQ ID NO: 14749 - DNA, 21 bp, Artificial sequence
  SiRNA target sequence
ggggttatgtattttgtcaga

SEQ ID NO: 14750 - DNA, 21 bp, Artificial sequence
  SiRNA target sequence
gggttatgtattttgtcagag

SEQ ID NO: 14751 - DNA, 21 bp, Artificial sequence
  SiRNA target sequence
ggttatgtattttgtcagagt

SEQ ID NO: 14752 - DNA, 21 bp, Artificial sequence
  SiRNA target sequence
gttatgtattttgtcagagta

SEQ ID NO: 14753 - DNA, 21 bp, Artificial sequence
  SiRNA target sequence
ttatgtattttgtcagagtaa

SEQ ID NO: 14754 - DNA, 21 bp, Artificial sequence
  SiRNA target sequence
tatgtattttgtcagagtaat

SEQ ID NO: 14755 - DNA, 21 bp, Artificial sequence
  SiRNA target sequence
atgtattttgtcagagtaatc

SEQ ID NO: 14756 - DNA, 21 bp, Artificial sequence
  SiRNA target sequence
tgtattttgtcagagtaatcc

SEQ ID NO: 14757 - DNA, 21 bp, Artificial sequence
  SiRNA target sequence
gtattttgtcagagtaatcct

SEQ ID NO: 14758 - DNA, 21 bp, Artificial sequence
  SiRNA target sequence
tattttgtcagagtaatcctg

SEQ ID NO: 14759 - DNA, 21 bp, Artificial sequence
  SiRNA target sequence
attttgtcagagtaatcctgc

SEQ ID NO: 14760 - DNA, 21 bp, Artificial sequence
  SiRNA target sequence
ttttgtcagagtaatcctgca

SEQ ID NO: 14761 - DNA, 21 bp, Artificial sequence
  SiRNA target sequence
tttgtcagagtaatcctgcag

SEQ ID NO: 14762 - DNA, 21 bp, Artificial sequence
  SiRNA target sequence
ttgtcagagtaatcctgcagc

SEQ ID NO: 14763 - DNA, 21 bp, Artificial sequence
  SiRNA target sequence
tgtcagagtaatcctgcagcg

SEQ ID NO: 14764 - DNA, 21 bp, Artificial sequence
  SiRNA target sequence
gtcagagtaatcctgcagcgc

SEQ ID NO: 14765 - DNA, 21 bp, Artificial sequence
  SiRNA target sequence
tcagagtaatcctgcagcgcg

SEQ ID NO: 14766 - DNA, 21 bp, Artificial sequence
  SiRNA target sequence
cagagtaatcctgcagcgcgt

SEQ ID NO: 14767 - DNA, 21 bp, Artificial sequence
  SiRNA target sequence
agagtaatcctgcagcgcgtt

SEQ ID NO: 14768 - DNA, 21 bp, Artificial sequence
  SiRNA target sequence
gagtaatcctgcagcgcgttt

SEQ ID NO: 14769 - DNA, 21 bp, Artificial sequence
  SiRNA target sequence
agtaatcctgcagcgcgtttg

SEQ ID NO: 14770 - DNA, 21 bp, Artificial sequence
  SiRNA target sequence
gtaatcctgcagcgcgtttgt

SEQ ID NO: 14771 - DNA, 21 bp, Artificial sequence
  SiRNA target sequence
taatcctgcagcgcgtttgtt

SEQ ID NO: 14772 - DNA, 21 bp, Artificial sequence
  SiRNA target sequence
aatcctgcagcgcgtttgttg

SEQ ID NO: 14773 - DNA, 21 bp, Artificial sequence
  SiRNA target sequence
atcctgcagcgcgtttgttga

SEQ ID NO: 14774 - DNA, 21 bp, Artificial sequence
  SiRNA target sequence
tcctgcagcgcgtttgttgaa

SEQ ID NO: 14775 - DNA, 21 bp, Artificial sequence
  SiRNA target sequence
cctgcagcgcgtttgttgaaa

SEQ ID NO: 14776 - DNA, 21 bp, Artificial sequence
  SiRNA target sequence
ctgcagcgcgtttgttgaaag

SEQ ID NO: 14777 - DNA, 21 bp, Artificial sequence
  SiRNA target sequence
tgcagcgcgtttgttgaaagc

SEQ ID NO: 14778 - DNA, 21 bp, Artificial sequence
  SiRNA target sequence
gcagcgcgtttgttgaaagct

SEQ ID NO: 14779 - DNA, 21 bp, Artificial sequence
  SiRNA target sequence
cagcgcgtttgttgaaagctg

SEQ ID NO: 14780 - DNA, 21 bp, Artificial sequence
  SiRNA target sequence
agcgcgtttgttgaaagctgt

SEQ ID NO: 14781 - DNA, 21 bp, Artificial sequence
  SiRNA target sequence
gcgcgtttgttgaaagctgtg

SEQ ID NO: 14782 - DNA, 21 bp, Artificial sequence
  SiRNA target sequence
cgcgtttgttgaaagctgtga

SEQ ID NO: 14783 - DNA, 21 bp, Artificial sequence
  SiRNA target sequence
gcgtttgttgaaagctgtgaa

SEQ ID NO: 14784 - DNA, 21 bp, Artificial sequence
  SiRNA target sequence
cgtttgttgaaagctgtgaat

SEQ ID NO: 14785 - DNA, 21 bp, Artificial sequence
  SiRNA target sequence
gtttgttgaaagctgtgaatg

SEQ ID NO: 14786 - DNA, 21 bp, Artificial sequence
  SiRNA target sequence
tttgttgaaagctgtgaatga

SEQ ID NO: 14787 - DNA, 21 bp, Artificial sequence
  SiRNA target sequence
ttgttgaaagctgtgaatgac

SEQ ID NO: 14788 - DNA, 21 bp, Artificial sequence
  SiRNA target sequence
tgttgaaagctgtgaatgacg

SEQ ID NO: 14789 - DNA, 21 bp, Artificial sequence
  SiRNA target sequence
gttgaaagctgtgaatgacga

SEQ ID NO: 14790 - DNA, 21 bp, Artificial sequence
  SiRNA target sequence
ttgaaagctgtgaatgacgag

SEQ ID NO: 14791 - DNA, 21 bp, Artificial sequence
  SiRNA target sequence
tgaaagctgtgaatgacgagc

SEQ ID NO: 14792 - DNA, 21 bp, Artificial sequence
  SiRNA target sequence
gaaagctgtgaatgacgagcc

SEQ ID NO: 14793 - DNA, 21 bp, Artificial sequence
  SiRNA target sequence
aaagctgtgaatgacgagcct

SEQ ID NO: 14794 - DNA, 21 bp, Artificial sequence
  SiRNA target sequence
aagctgtgaatgacgagcctg

SEQ ID NO: 14795 - DNA, 21 bp, Artificial sequence
  SiRNA target sequence
agctgtgaatgacgagcctga

SEQ ID NO: 14796 - DNA, 21 bp, Artificial sequence
  SiRNA target sequence
gctgtgaatgacgagcctgag

SEQ ID NO: 14797 - DNA, 21 bp, Artificial sequence
  SiRNA target sequence
ctgtgaatgacgagcctgaga

SEQ ID NO: 14798 - DNA, 21 bp, Artificial sequence
  SiRNA target sequence
tgtgaatgacgagcctgagat

SEQ ID NO: 14799 - DNA, 21 bp, Artificial sequence
  SiRNA target sequence
gtgaatgacgagcctgagatt

SEQ ID NO: 14800 - DNA, 21 bp, Artificial sequence
  SiRNA target sequence
tgaatgacgagcctgagattt

SEQ ID NO: 14801 - DNA, 21 bp, Artificial sequence
  SiRNA target sequence
gaatgacgagcctgagatttt

SEQ ID NO: 14802 - DNA, 21 bp, Artificial sequence
  SiRNA target sequence
aatgacgagcctgagattttg

SEQ ID NO: 14803 - DNA, 21 bp, Artificial sequence
  SiRNA target sequence
atgacgagcctgagattttga

SEQ ID NO: 14804 - DNA, 21 bp, Artificial sequence
  SiRNA target sequence
tgacgagcctgagattttgaa

SEQ ID NO: 14805 - DNA, 21 bp, Artificial sequence
  SiRNA target sequence
gacgagcctgagattttgaaa

SEQ ID NO: 14806 - DNA, 21 bp, Artificial sequence
  SiRNA target sequence
acgagcctgagattttgaaag

SEQ ID NO: 14807 - DNA, 21 bp, Artificial sequence
  SiRNA target sequence
cgagcctgagattttgaaagc

SEQ ID NO: 14808 - DNA, 21 bp, Artificial sequence
  SiRNA target sequence
gagcctgagattttgaaagca

SEQ ID NO: 14809 - DNA, 21 bp, Artificial sequence
  SiRNA target sequence
agcctgagattttgaaagcat

SEQ ID NO: 14810 - DNA, 21 bp, Artificial sequence
  SiRNA target sequence
gcctgagattttgaaagcatg

SEQ ID NO: 14811 - DNA, 21 bp, Artificial sequence
  SiRNA target sequence
cctgagattttgaaagcatgg

SEQ ID NO: 14812 - DNA, 21 bp, Artificial sequence
  SiRNA target sequence
ctgagattttgaaagcatggg

SEQ ID NO: 14813 - DNA, 21 bp, Artificial sequence
  SiRNA target sequence
tgagattttgaaagcatgggt

SEQ ID NO: 14814 - DNA, 21 bp, Artificial sequence
  SiRNA target sequence
gagattttgaaagcatgggtg

SEQ ID NO: 14815 - DNA, 21 bp, Artificial sequence
  SiRNA target sequence
agattttgaaagcatgggtga

SEQ ID NO: 14816 - DNA, 21 bp, Artificial sequence
  SiRNA target sequence
gattttgaaagcatgggtgaa

SEQ ID NO: 14817 - DNA, 21 bp, Artificial sequence
  SiRNA target sequence
attttgaaagcatgggtgaag

SEQ ID NO: 14818 - DNA, 21 bp, Artificial sequence
  SiRNA target sequence
ttttgaaagcatgggtgaagg

SEQ ID NO: 14819 - DNA, 21 bp, Artificial sequence
  SiRNA target sequence
tttgaaagcatgggtgaagga

SEQ ID NO: 14820 - DNA, 21 bp, Artificial sequence
  SiRNA target sequence
ttgaaagcatgggtgaaggaa

SEQ ID NO: 14821 - DNA, 21 bp, Artificial sequence
  SiRNA target sequence
tgaaagcatgggtgaaggaat

SEQ ID NO: 14822 - DNA, 21 bp, Artificial sequence
  SiRNA target sequence
gaaagcatgggtgaaggaatg

SEQ ID NO: 14823 - DNA, 21 bp, Artificial sequence
  SiRNA target sequence
aaagcatgggtgaaggaatgt

SEQ ID NO: 14824 - DNA, 21 bp, Artificial sequence
  SiRNA target sequence
aagcatgggtgaaggaatgtc

SEQ ID NO: 14825 - DNA, 21 bp, Artificial sequence
  SiRNA target sequence
agcatgggtgaaggaatgtct

SEQ ID NO: 14826 - DNA, 21 bp, Artificial sequence
  SiRNA target sequence
gcatgggtgaaggaatgtctg

SEQ ID NO: 14827 - DNA, 21 bp, Artificial sequence
  SiRNA target sequence
catgggtgaaggaatgtctgt

SEQ ID NO: 14828 - DNA, 21 bp, Artificial sequence
  SiRNA target sequence
atgggtgaaggaatgtctgta

SEQ ID NO: 14829 - DNA, 21 bp, Artificial sequence
  SiRNA target sequence
tgggtgaaggaatgtctgtat

SEQ ID NO: 14830 - DNA, 21 bp, Artificial sequence
  SiRNA target sequence
gggtgaaggaatgtctgtatt

SEQ ID NO: 14831 - DNA, 21 bp, Artificial sequence
  SiRNA target sequence
ggtgaaggaatgtctgtattt

SEQ ID NO: 14832 - DNA, 21 bp, Artificial sequence
  SiRNA target sequence
gtgaaggaatgtctgtatttg

SEQ ID NO: 14833 - DNA, 21 bp, Artificial sequence
  SiRNA target sequence
tgaaggaatgtctgtatttgg

SEQ ID NO: 14834 - DNA, 21 bp, Artificial sequence
  SiRNA target sequence
gaaggaatgtctgtatttgga

SEQ ID NO: 14835 - DNA, 21 bp, Artificial sequence
  SiRNA target sequence
aaggaatgtctgtatttggat

SEQ ID NO: 14836 - DNA, 21 bp, Artificial sequence
  SiRNA target sequence
aggaatgtctgtatttggatg

SEQ ID NO: 14837 - DNA, 21 bp, Artificial sequence
  SiRNA target sequence
ggaatgtctgtatttggatga

SEQ ID NO: 14838 - DNA, 21 bp, Artificial sequence
  SiRNA target sequence
gaatgtctgtatttggatgat

SEQ ID NO: 14839 - DNA, 21 bp, Artificial sequence
  SiRNA target sequence
aatgtctgtatttggatgatc

SEQ ID NO: 14840 - DNA, 21 bp, Artificial sequence
  SiRNA target sequence
atgtctgtatttggatgatcc

SEQ ID NO: 14841 - DNA, 21 bp, Artificial sequence
  SiRNA target sequence
tgtctgtatttggatgatccc

SEQ ID NO: 14842 - DNA, 21 bp, Artificial sequence
  SiRNA target sequence
gtctgtatttggatgatccca

SEQ ID NO: 14843 - DNA, 21 bp, Artificial sequence
  SiRNA target sequence
tctgtatttggatgatcccaa

SEQ ID NO: 14844 - DNA, 21 bp, Artificial sequence
  SiRNA target sequence
ctgtatttggatgatcccaaa

SEQ ID NO: 14845 - DNA, 21 bp, Artificial sequence
  SiRNA target sequence
tgtatttggatgatcccaaat

SEQ ID NO: 14846 - DNA, 21 bp, Artificial sequence
  SiRNA target sequence
gtatttggatgatcccaaatt

SEQ ID NO: 14847 - DNA, 21 bp, Artificial sequence
  SiRNA target sequence
tatttggatgatcccaaattc

SEQ ID NO: 14848 - DNA, 21 bp, Artificial sequence
  SiRNA target sequence
atttggatgatcccaaattca

SEQ ID NO: 14849 - DNA, 21 bp, Artificial sequence
  SiRNA target sequence
tttggatgatcccaaattcag

SEQ ID NO: 14850 - DNA, 21 bp, Artificial sequence
  SiRNA target sequence
ttggatgatcccaaattcaga

SEQ ID NO: 14851 - DNA, 21 bp, Artificial sequence
  SiRNA target sequence
tggatgatcccaaattcagaa

SEQ ID NO: 14852 - DNA, 21 bp, Artificial sequence
  SiRNA target sequence
ggatgatcccaaattcagaat

SEQ ID NO: 14853 - DNA, 21 bp, Artificial sequence
  SiRNA target sequence
gatgatcccaaattcagaatg

SEQ ID NO: 14854 - DNA, 21 bp, Artificial sequence
  SiRNA target sequence
atgatcccaaattcagaatgc

SEQ ID NO: 14855 - DNA, 21 bp, Artificial sequence
  SiRNA target sequence
tgatcccaaattcagaatgcg

SEQ ID NO: 14856 - DNA, 21 bp, Artificial sequence
  SiRNA target sequence
gatcccaaattcagaatgcgt

SEQ ID NO: 14857 - DNA, 21 bp, Artificial sequence
  SiRNA target sequence
atcccaaattcagaatgcgtc

SEQ ID NO: 14858 - DNA, 21 bp, Artificial sequence
  SiRNA target sequence
tcccaaattcagaatgcgtcg

SEQ ID NO: 14859 - DNA, 21 bp, Artificial sequence
  SiRNA target sequence
cccaaattcagaatgcgtcga

SEQ ID NO: 14860 - DNA, 21 bp, Artificial sequence
  SiRNA target sequence
ccaaattcagaatgcgtcgag

SEQ ID NO: 14861 - DNA, 21 bp, Artificial sequence
  SiRNA target sequence
caaattcagaatgcgtcgagc

SEQ ID NO: 14862 - DNA, 21 bp, Artificial sequence
  SiRNA target sequence
aaattcagaatgcgtcgagcg

SEQ ID NO: 14863 - DNA, 21 bp, Artificial sequence
  SiRNA target sequence
aattcagaatgcgtcgagcgc

SEQ ID NO: 14864 - DNA, 21 bp, Artificial sequence
  SiRNA target sequence
attcagaatgcgtcgagcgca

SEQ ID NO: 14865 - DNA, 21 bp, Artificial sequence
  SiRNA target sequence
ttcagaatgcgtcgagcgcat

SEQ ID NO: 14866 - DNA, 21 bp, Artificial sequence
  SiRNA target sequence
tcagaatgcgtcgagcgcatg

SEQ ID NO: 14867 - DNA, 21 bp, Artificial sequence
  SiRNA target sequence
cagaatgcgtcgagcgcatga

SEQ ID NO: 14868 - DNA, 21 bp, Artificial sequence
  SiRNA target sequence
agaatgcgtcgagcgcatgat

SEQ ID NO: 14869 - DNA, 21 bp, Artificial sequence
  SiRNA target sequence
gaatgcgtcgagcgcatgatc

SEQ ID NO: 14870 - DNA, 21 bp, Artificial sequence
  SiRNA target sequence
aatgcgtcgagcgcatgatca

SEQ ID NO: 14871 - DNA, 21 bp, Artificial sequence
  SiRNA target sequence
atgcgtcgagcgcatgatcaa

SEQ ID NO: 14872 - DNA, 21 bp, Artificial sequence
  SiRNA target sequence
tgcgtcgagcgcatgatcaag

SEQ ID NO: 14873 - DNA, 21 bp, Artificial sequence
  SiRNA target sequence
gcgtcgagcgcatgatcaaga

SEQ ID NO: 14874 - DNA, 21 bp, Artificial sequence
  SiRNA target sequence
cgtcgagcgcatgatcaagag

SEQ ID NO: 14875 - DNA, 21 bp, Artificial sequence
  SiRNA target sequence
gtcgagcgcatgatcaagagt

SEQ ID NO: 14876 - DNA, 21 bp, Artificial sequence
  SiRNA target sequence
tcgagcgcatgatcaagagta

SEQ ID NO: 14877 - DNA, 21 bp, Artificial sequence
  SiRNA target sequence
cgagcgcatgatcaagagtat

SEQ ID NO: 14878 - DNA, 21 bp, Artificial sequence
  SiRNA target sequence
gagcgcatgatcaagagtata

SEQ ID NO: 14879 - DNA, 21 bp, Artificial sequence
  SiRNA target sequence
agcgcatgatcaagagtatat

SEQ ID NO: 14880 - DNA, 21 bp, Artificial sequence
  SiRNA target sequence
gcgcatgatcaagagtatatc

SEQ ID NO: 14881 - DNA, 21 bp, Artificial sequence
  SiRNA target sequence
cgcatgatcaagagtatatcg

SEQ ID NO: 14882 - DNA, 21 bp, Artificial sequence
  SiRNA target sequence
gcatgatcaagagtatatcga

SEQ ID NO: 14883 - DNA, 21 bp, Artificial sequence
  SiRNA target sequence
catgatcaagagtatatcgag

SEQ ID NO: 14884 - DNA, 21 bp, Artificial sequence
  SiRNA target sequence
atgatcaagagtatatcgaga

SEQ ID NO: 14885 - DNA, 21 bp, Artificial sequence
  SiRNA target sequence
tgatcaagagtatatcgagag

SEQ ID NO: 14886 - DNA, 21 bp, Artificial sequence
  SiRNA target sequence
gatcaagagtatatcgagaga

SEQ ID NO: 14887 - DNA, 21 bp, Artificial sequence
  SiRNA target sequence
atcaagagtatatcgagagag

SEQ ID NO: 14888 - DNA, 21 bp, Artificial sequence
  SiRNA target sequence
tcaagagtatatcgagagagt

SEQ ID NO: 14889 - DNA, 21 bp, Artificial sequence
  SiRNA target sequence
caagagtatatcgagagagtg

SEQ ID NO: 14890 - DNA, 21 bp, Artificial sequence
  SiRNA target sequence
aagagtatatcgagagagtgt

SEQ ID NO: 14891 - DNA, 21 bp, Artificial sequence
  SiRNA target sequence
agagtatatcgagagagtgtt

SEQ ID NO: 14892 - DNA, 21 bp, Artificial sequence
  SiRNA target sequence
gagtatatcgagagagtgttt

SEQ ID NO: 14893 - DNA, 21 bp, Artificial sequence
  SiRNA target sequence
agtatatcgagagagtgtttg

SEQ ID NO: 14894 - DNA, 21 bp, Artificial sequence
  SiRNA target sequence
gtatatcgagagagtgtttgc

SEQ ID NO: 14895 - DNA, 21 bp, Artificial sequence
  SiRNA target sequence
tatatcgagagagtgtttgcg

SEQ ID NO: 14896 - DNA, 21 bp, Artificial sequence
  SiRNA target sequence
atatcgagagagtgtttgcgg

SEQ ID NO: 14897 - DNA, 21 bp, Artificial sequence
  SiRNA target sequence
tatcgagagagtgtttgcggc

SEQ ID NO: 14898 - DNA, 21 bp, Artificial sequence
  SiRNA target sequence
atcgagagagtgtttgcggca

SEQ ID NO: 14899 - DNA, 21 bp, Artificial sequence
  SiRNA target sequence
tcgagagagtgtttgcggcac

SEQ ID NO: 14900 - DNA, 21 bp, Artificial sequence
  SiRNA target sequence
cgagagagtgtttgcggcaca

SEQ ID NO: 14901 - DNA, 21 bp, Artificial sequence
  SiRNA target sequence
gagagagtgtttgcggcacat

SEQ ID NO: 14902 - DNA, 21 bp, Artificial sequence
  SiRNA target sequence
agagagtgtttgcggcacatt

SEQ ID NO: 14903 - DNA, 21 bp, Artificial sequence
  SiRNA target sequence
gagagtgtttgcggcacattc

SEQ ID NO: 14904 - DNA, 21 bp, Artificial sequence
  SiRNA target sequence
agagtgtttgcggcacattca

SEQ ID NO: 14905 - DNA, 21 bp, Artificial sequence
  SiRNA target sequence
gagtgtttgcggcacattcat

SEQ ID NO: 14906 - DNA, 21 bp, Artificial sequence
  SiRNA target sequence
agtgtttgcggcacattcata

SEQ ID NO: 14907 - DNA, 21 bp, Artificial sequence
  SiRNA target sequence
gtgtttgcggcacattcatat

SEQ ID NO: 14908 - DNA, 21 bp, Artificial sequence
  SiRNA target sequence
tgtttgcggcacattcatatg

SEQ ID NO: 14909 - DNA, 21 bp, Artificial sequence
  SiRNA target sequence
gtttgcggcacattcatatgg

SEQ ID NO: 14910 - DNA, 21 bp, Artificial sequence
  SiRNA target sequence
tttgcggcacattcatatgga

SEQ ID NO: 14911 - DNA, 21 bp, Artificial sequence
  SiRNA target sequence
ttgcggcacattcatatggac

SEQ ID NO: 14912 - DNA, 21 bp, Artificial sequence
  SiRNA target sequence
tgcggcacattcatatggaca

SEQ ID NO: 14913 - DNA, 21 bp, Artificial sequence
  SiRNA target sequence
gcggcacattcatatggacaa

SEQ ID NO: 14914 - DNA, 21 bp, Artificial sequence
  SiRNA target sequence
cggcacattcatatggacaaa

SEQ ID NO: 14915 - DNA, 21 bp, Artificial sequence
  SiRNA target sequence
ggcacattcatatggacaaat

SEQ ID NO: 14916 - DNA, 21 bp, Artificial sequence
  SiRNA target sequence
gcacattcatatggacaaatt

SEQ ID NO: 14917 - DNA, 21 bp, Artificial sequence
  SiRNA target sequence
cacattcatatggacaaattt

SEQ ID NO: 14918 - DNA, 21 bp, Artificial sequence
  SiRNA target sequence
acattcatatggacaaatttt

SEQ ID NO: 14919 - DNA, 21 bp, Artificial sequence
  SiRNA target sequence
cattcatatggacaaattttg

SEQ ID NO: 14920 - DNA, 21 bp, Artificial sequence
  SiRNA target sequence
attcatatggacaaattttgc

SEQ ID NO: 14921 - DNA, 21 bp, Artificial sequence
  SiRNA target sequence
ttcatatggacaaattttgct

SEQ ID NO: 14922 - DNA, 21 bp, Artificial sequence
  SiRNA target sequence
tcatatggacaaattttgcta

SEQ ID NO: 14923 - DNA, 21 bp, Artificial sequence
  SiRNA target sequence
catatggacaaattttgctac

SEQ ID NO: 14924 - DNA, 21 bp, Artificial sequence
  SiRNA target sequence
atatggacaaattttgctaca

SEQ ID NO: 14925 - DNA, 21 bp, Artificial sequence
  SiRNA target sequence
tatggacaaattttgctacat

SEQ ID NO: 14926 - DNA, 21 bp, Artificial sequence
  SiRNA target sequence
atggacaaattttgctacatg

SEQ ID NO: 14927 - DNA, 21 bp, Artificial sequence
  SiRNA target sequence
tggacaaattttgctacatga

SEQ ID NO: 14928 - DNA, 21 bp, Artificial sequence
  SiRNA target sequence
ggacaaattttgctacatgat

SEQ ID NO: 14929 - DNA, 21 bp, Artificial sequence
  SiRNA target sequence
gacaaattttgctacatgatt

SEQ ID NO: 14930 - DNA, 21 bp, Artificial sequence
  SiRNA target sequence
acaaattttgctacatgattt

SEQ ID NO: 14931 - DNA, 21 bp, Artificial sequence
  SiRNA target sequence
caaattttgctacatgattta

SEQ ID NO: 14932 - DNA, 21 bp, Artificial sequence
  SiRNA target sequence
aaattttgctacatgatttaa

SEQ ID NO: 14933 - DNA, 21 bp, Artificial sequence
  SiRNA target sequence
aattttgctacatgatttaac

SEQ ID NO: 14934 - DNA, 21 bp, Artificial sequence
  SiRNA target sequence
attttgctacatgatttaact

SEQ ID NO: 14935 - DNA, 21 bp, Artificial sequence
  SiRNA target sequence
ttttgctacatgatttaactg

SEQ ID NO: 14936 - DNA, 21 bp, Artificial sequence
  SiRNA target sequence
tttgctacatgatttaactgc

SEQ ID NO: 14937 - DNA, 21 bp, Artificial sequence
  SiRNA target sequence
ttgctacatgatttaactgct

SEQ ID NO: 14938 - DNA, 21 bp, Artificial sequence
  SiRNA target sequence
tgctacatgatttaactgctg

SEQ ID NO: 14939 - DNA, 21 bp, Artificial sequence
  SiRNA target sequence
gctacatgatttaactgctga

SEQ ID NO: 14940 - DNA, 21 bp, Artificial sequence
  SiRNA target sequence
ctacatgatttaactgctgaa

SEQ ID NO: 14941 - DNA, 21 bp, Artificial sequence
  SiRNA target sequence
tacatgatttaactgctgaaa

SEQ ID NO: 14942 - DNA, 21 bp, Artificial sequence
  SiRNA target sequence
acatgatttaactgctgaaat

SEQ ID NO: 14943 - DNA, 21 bp, Artificial sequence
  SiRNA target sequence
catgatttaactgctgaaatg

SEQ ID NO: 14944 - DNA, 21 bp, Artificial sequence
  SiRNA target sequence
atgatttaactgctgaaatga

SEQ ID NO: 14945 - DNA, 21 bp, Artificial sequence
  SiRNA target sequence
tgatttaactgctgaaatgaa

SEQ ID NO: 14946 - DNA, 21 bp, Artificial sequence
  SiRNA target sequence
gatttaactgctgaaatgaat

SEQ ID NO: 14947 - DNA, 21 bp, Artificial sequence
  SiRNA target sequence
atttaactgctgaaatgaatc

SEQ ID NO: 14948 - DNA, 21 bp, Artificial sequence
  SiRNA target sequence
tttaactgctgaaatgaatca

SEQ ID NO: 14949 - DNA, 21 bp, Artificial sequence
  SiRNA target sequence
ttaactgctgaaatgaatcaa

SEQ ID NO: 14950 - DNA, 21 bp, Artificial sequence
  SiRNA target sequence
taactgctgaaatgaatcaat

SEQ ID NO: 14951 - DNA, 21 bp, Artificial sequence
  SiRNA target sequence
aactgctgaaatgaatcaatc

SEQ ID NO: 14952 - DNA, 21 bp, Artificial sequence
  SiRNA target sequence
actgctgaaatgaatcaatca

SEQ ID NO: 14953 - DNA, 21 bp, Artificial sequence
  SiRNA target sequence
ctgctgaaatgaatcaatcac

SEQ ID NO: 14954 - DNA, 21 bp, Artificial sequence
  SiRNA target sequence
tgctgaaatgaatcaatcacg

SEQ ID NO: 14955 - DNA, 21 bp, Artificial sequence
  SiRNA target sequence
gctgaaatgaatcaatcacga

SEQ ID NO: 14956 - DNA, 21 bp, Artificial sequence
  SiRNA target sequence
ctgaaatgaatcaatcacgaa

SEQ ID NO: 14957 - DNA, 21 bp, Artificial sequence
  SiRNA target sequence
tgaaatgaatcaatcacgaaa

SEQ ID NO: 14958 - DNA, 21 bp, Artificial sequence
  SiRNA target sequence
gaaatgaatcaatcacgaaat

SEQ ID NO: 14959 - DNA, 21 bp, Artificial sequence
  SiRNA target sequence
aaatgaatcaatcacgaaatt

SEQ ID NO: 14960 - DNA, 21 bp, Artificial sequence
  SiRNA target sequence
aatgaatcaatcacgaaattt

SEQ ID NO: 14961 - DNA, 21 bp, Artificial sequence
  SiRNA target sequence
atgaatcaatcacgaaatttg

SEQ ID NO: 14962 - DNA, 21 bp, Artificial sequence
  SiRNA target sequence
tgaatcaatcacgaaatttga

SEQ ID NO: 14963 - DNA, 21 bp, Artificial sequence
  SiRNA target sequence
gaatcaatcacgaaatttgag

SEQ ID NO: 14964 - DNA, 21 bp, Artificial sequence
  SiRNA target sequence
aatcaatcacgaaatttgagt

SEQ ID NO: 14965 - DNA, 21 bp, Artificial sequence
  SiRNA target sequence
atcaatcacgaaatttgagtg

SEQ ID NO: 14966 - DNA, 21 bp, Artificial sequence
  SiRNA target sequence
tcaatcacgaaatttgagtgt

SEQ ID NO: 14967 - DNA, 21 bp, Artificial sequence
  SiRNA target sequence
caatcacgaaatttgagtgtg

SEQ ID NO: 14968 - DNA, 21 bp, Artificial sequence
  SiRNA target sequence
aatcacgaaatttgagtgtgt

SEQ ID NO: 14969 - DNA, 21 bp, Artificial sequence
  SiRNA target sequence
atcacgaaatttgagtgtgtt

SEQ ID NO: 14970 - DNA, 21 bp, Artificial sequence
  SiRNA target sequence
tcacgaaatttgagtgtgttt

SEQ ID NO: 14971 - DNA, 21 bp, Artificial sequence
  SiRNA target sequence
cacgaaatttgagtgtgttta

SEQ ID NO: 14972 - DNA, 21 bp, Artificial sequence
  SiRNA target sequence
acgaaatttgagtgtgtttac

SEQ ID NO: 14973 - DNA, 21 bp, Artificial sequence
  SiRNA target sequence
cgaaatttgagtgtgtttaca

SEQ ID NO: 14974 - DNA, 21 bp, Artificial sequence
  SiRNA target sequence
gaaatttgagtgtgtttacac

SEQ ID NO: 14975 - DNA, 21 bp, Artificial sequence
  SiRNA target sequence
aaatttgagtgtgtttacacg

SEQ ID NO: 14976 - DNA, 21 bp, Artificial sequence
  SiRNA target sequence
aatttgagtgtgtttacacgt

SEQ ID NO: 14977 - DNA, 21 bp, Artificial sequence
  SiRNA target sequence
atttgagtgtgtttacacgtg

SEQ ID NO: 14978 - DNA, 21 bp, Artificial sequence
  SiRNA target sequence
tttgagtgtgtttacacgtgt

SEQ ID NO: 14979 - DNA, 21 bp, Artificial sequence
  SiRNA target sequence
ttgagtgtgtttacacgtgtg

SEQ ID NO: 14980 - DNA, 21 bp, Artificial sequence
  SiRNA target sequence
tgagtgtgtttacacgtgtgt

SEQ ID NO: 14981 - DNA, 21 bp, Artificial sequence
  SiRNA target sequence
gagtgtgtttacacgtgtgta

SEQ ID NO: 14982 - DNA, 21 bp, Artificial sequence
  SiRNA target sequence
agtgtgtttacacgtgtgtat

SEQ ID NO: 14983 - DNA, 21 bp, Artificial sequence
  SiRNA target sequence
gtgtgtttacacgtgtgtatg

SEQ ID NO: 14984 - DNA, 21 bp, Artificial sequence
  SiRNA target sequence
tgtgtttacacgtgtgtatga

SEQ ID NO: 14985 - DNA, 21 bp, Artificial sequence
  SiRNA target sequence
gtgtttacacgtgtgtatgat

SEQ ID NO: 14986 - DNA, 21 bp, Artificial sequence
  SiRNA target sequence
tgtttacacgtgtgtatgatc

SEQ ID NO: 14987 - DNA, 21 bp, Artificial sequence
  SiRNA target sequence
gtttacacgtgtgtatgatca

SEQ ID NO: 14988 - DNA, 21 bp, Artificial sequence
  SiRNA target sequence
tttacacgtgtgtatgatcaa

SEQ ID NO: 14989 - DNA, 21 bp, Artificial sequence
  SiRNA target sequence
ttacacgtgtgtatgatcaaa

SEQ ID NO: 14990 - DNA, 21 bp, Artificial sequence
  SiRNA target sequence
tacacgtgtgtatgatcaaat

SEQ ID NO: 14991 - DNA, 21 bp, Artificial sequence
  SiRNA target sequence
acacgtgtgtatgatcaaatt

SEQ ID NO: 14992 - DNA, 21 bp, Artificial sequence
  SiRNA target sequence
cacgtgtgtatgatcaaattt

SEQ ID NO: 14993 - DNA, 21 bp, Artificial sequence
  SiRNA target sequence
acgtgtgtatgatcaaatttc

SEQ ID NO: 14994 - DNA, 21 bp, Artificial sequence
  SiRNA target sequence
cgtgtgtatgatcaaatttca

SEQ ID NO: 14995 - DNA, 21 bp, Artificial sequence
  SiRNA target sequence
gtgtgtatgatcaaatttcaa

SEQ ID NO: 14996 - DNA, 21 bp, Artificial sequence
  SiRNA target sequence
tgtgtatgatcaaatttcaaa

SEQ ID NO: 14997 - DNA, 21 bp, Artificial sequence
  SiRNA target sequence
gtgtatgatcaaatttcaaaa

SEQ ID NO: 14998 - DNA, 21 bp, Artificial sequence
  SiRNA target sequence
tgtatgatcaaatttcaaaat

SEQ ID NO: 14999 - DNA, 21 bp, Artificial sequence
  SiRNA target sequence
gtatgatcaaatttcaaaatt

SEQ ID NO: 15000 - DNA, 21 bp, Artificial sequence
  SiRNA target sequence
tatgatcaaatttcaaaattg

SEQ ID NO: 15001 - DNA, 21 bp, Artificial sequence
  SiRNA target sequence
atgatcaaatttcaaaattga

SEQ ID NO: 15002 - DNA, 21 bp, Artificial sequence
  SiRNA target sequence
tgatcaaatttcaaaattgaa

SEQ ID NO: 15003 - DNA, 21 bp, Artificial sequence
  SiRNA target sequence
gatcaaatttcaaaattgaag

SEQ ID NO: 15004 - DNA, 21 bp, Artificial sequence
  SiRNA target sequence
atcaaatttcaaaattgaaga

SEQ ID NO: 15005 - DNA, 21 bp, Artificial sequence
  SiRNA target sequence
tcaaatttcaaaattgaagac

SEQ ID NO: 15006 - DNA, 21 bp, Artificial sequence
  SiRNA target sequence
caaatttcaaaattgaagacc

SEQ ID NO: 15007 - DNA, 21 bp, Artificial sequence
  SiRNA target sequence
aaatttcaaaattgaagaccg

SEQ ID NO: 15008 - DNA, 21 bp, Artificial sequence
  SiRNA target sequence
aatttcaaaattgaagaccga

SEQ ID NO: 15009 - DNA, 21 bp, Artificial sequence
  SiRNA target sequence
atttcaaaattgaagaccgat

SEQ ID NO: 15010 - DNA, 21 bp, Artificial sequence
  SiRNA target sequence
tttcaaaattgaagaccgatc

SEQ ID NO: 15011 - DNA, 21 bp, Artificial sequence
  SiRNA target sequence
ttcaaaattgaagaccgatct

SEQ ID NO: 15012 - DNA, 21 bp, Artificial sequence
  SiRNA target sequence
tcaaaattgaagaccgatctt

SEQ ID NO: 15013 - DNA, 21 bp, Artificial sequence
  SiRNA target sequence
caaaattgaagaccgatctta

SEQ ID NO: 15014 - DNA, 21 bp, Artificial sequence
  SiRNA target sequence
aaaattgaagaccgatcttat

SEQ ID NO: 15015 - DNA, 21 bp, Artificial sequence
  SiRNA target sequence
aaattgaagaccgatcttatg

SEQ ID NO: 15016 - DNA, 21 bp, Artificial sequence
  SiRNA target sequence
aattgaagaccgatcttatgg

SEQ ID NO: 15017 - DNA, 21 bp, Artificial sequence
  SiRNA target sequence
attgaagaccgatcttatgga

SEQ ID NO: 15018 - DNA, 21 bp, Artificial sequence
  SiRNA target sequence
ttgaagaccgatcttatggaa

SEQ ID NO: 15019 - DNA, 21 bp, Artificial sequence
  SiRNA target sequence
tgaagaccgatcttatggaaa

SEQ ID NO: 15020 - DNA, 21 bp, Artificial sequence
  SiRNA target sequence
gaagaccgatcttatggaaat

SEQ ID NO: 15021 - DNA, 21 bp, Artificial sequence
  SiRNA target sequence
aagaccgatcttatggaaatg

SEQ ID NO: 15022 - DNA, 21 bp, Artificial sequence
  SiRNA target sequence
agaccgatcttatggaaatgg

SEQ ID NO: 15023 - DNA, 21 bp, Artificial sequence
  SiRNA target sequence
gaccgatcttatggaaatggg

SEQ ID NO: 15024 - DNA, 21 bp, Artificial sequence
  SiRNA target sequence
accgatcttatggaaatggga

SEQ ID NO: 15025 - DNA, 21 bp, Artificial sequence
  SiRNA target sequence
ccgatcttatggaaatgggat

SEQ ID NO: 15026 - DNA, 21 bp, Artificial sequence
  SiRNA target sequence
cgatcttatggaaatgggatc

SEQ ID NO: 15027 - DNA, 21 bp, Artificial sequence
  SiRNA target sequence
gatcttatggaaatgggatcg

SEQ ID NO: 15028 - DNA, 21 bp, Artificial sequence
  SiRNA target sequence
atcttatggaaatgggatcga

SEQ ID NO: 15029 - DNA, 21 bp, Artificial sequence
  SiRNA target sequence
tcttatggaaatgggatcgaa

SEQ ID NO: 15030 - DNA, 21 bp, Artificial sequence
  SiRNA target sequence
cttatggaaatgggatcgaat

SEQ ID NO: 15031 - DNA, 21 bp, Artificial sequence
  SiRNA target sequence
ttatggaaatgggatcgaatc

SEQ ID NO: 15032 - DNA, 21 bp, Artificial sequence
  SiRNA target sequence
tatggaaatgggatcgaatcc

SEQ ID NO: 15033 - DNA, 21 bp, Artificial sequence
  SiRNA target sequence
atggaaatgggatcgaatcca

SEQ ID NO: 15034 - DNA, 21 bp, Artificial sequence
  SiRNA target sequence
tggaaatgggatcgaatccat

SEQ ID NO: 15035 - DNA, 21 bp, Artificial sequence
  SiRNA target sequence
ggaaatgggatcgaatccata

SEQ ID NO: 15036 - DNA, 21 bp, Artificial sequence
  SiRNA target sequence
gaaatgggatcgaatccatat

SEQ ID NO: 15037 - DNA, 21 bp, Artificial sequence
  SiRNA target sequence
aaatgggatcgaatccatata

SEQ ID NO: 15038 - DNA, 21 bp, Artificial sequence
  SiRNA target sequence
aatgggatcgaatccatatat

SEQ ID NO: 15039 - DNA, 21 bp, Artificial sequence
  SiRNA target sequence
atgggatcgaatccatatata

SEQ ID NO: 15040 - DNA, 21 bp, Artificial sequence
  SiRNA target sequence
tgggatcgaatccatatataa

SEQ ID NO: 15041 - DNA, 21 bp, Artificial sequence
  SiRNA target sequence
gggatcgaatccatatataag

SEQ ID NO: 15042 - DNA, 21 bp, Artificial sequence
  SiRNA target sequence
ggatcgaatccatatataagg

SEQ ID NO: 15043 - DNA, 21 bp, Artificial sequence
  SiRNA target sequence
gatcgaatccatatataaggc

SEQ ID NO: 15044 - DNA, 21 bp, Artificial sequence
  SiRNA target sequence
atcgaatccatatataaggcg

SEQ ID NO: 15045 - DNA, 21 bp, Artificial sequence
  SiRNA target sequence
tcgaatccatatataaggcgt

SEQ ID NO: 15046 - DNA, 21 bp, Artificial sequence
  SiRNA target sequence
cgaatccatatataaggcgtg

SEQ ID NO: 15047 - DNA, 21 bp, Artificial sequence
  SiRNA target sequence
gaatccatatataaggcgtga

SEQ ID NO: 15048 - DNA, 21 bp, Artificial sequence
  SiRNA target sequence
aatccatatataaggcgtgaa

SEQ ID NO: 15049 - DNA, 21 bp, Artificial sequence
  SiRNA target sequence
atccatatataaggcgtgaat

SEQ ID NO: 15050 - DNA, 21 bp, Artificial sequence
  SiRNA target sequence
tccatatataaggcgtgaatg

SEQ ID NO: 15051 - DNA, 21 bp, Artificial sequence
  SiRNA target sequence
ccatatataaggcgtgaatgt

SEQ ID NO: 15052 - DNA, 21 bp, Artificial sequence
  SiRNA target sequence
catatataaggcgtgaatgtt

SEQ ID NO: 15053 - DNA, 21 bp, Artificial sequence
  SiRNA target sequence
atatataaggcgtgaatgttt

SEQ ID NO: 15054 - DNA, 21 bp, Artificial sequence
  SiRNA target sequence
tatataaggcgtgaatgtttt

SEQ ID NO: 15055 - DNA, 21 bp, Artificial sequence
  SiRNA target sequence
atataaggcgtgaatgtttta

SEQ ID NO: 15056 - DNA, 21 bp, Artificial sequence
  SiRNA target sequence
tataaggcgtgaatgttttac

SEQ ID NO: 15057 - DNA, 21 bp, Artificial sequence
  SiRNA target sequence
ataaggcgtgaatgttttacg

SEQ ID NO: 15058 - DNA, 21 bp, Artificial sequence
  SiRNA target sequence
taaggcgtgaatgttttacga

SEQ ID NO: 15059 - DNA, 21 bp, Artificial sequence
  SiRNA target sequence
aaggcgtgaatgttttacgat

SEQ ID NO: 15060 - DNA, 21 bp, Artificial sequence
  SiRNA target sequence
aggcgtgaatgttttacgata

SEQ ID NO: 15061 - DNA, 21 bp, Artificial sequence
  SiRNA target sequence
ggcgtgaatgttttacgatat

SEQ ID NO: 15062 - DNA, 21 bp, Artificial sequence
  SiRNA target sequence
gcgtgaatgttttacgatatg

SEQ ID NO: 15063 - DNA, 21 bp, Artificial sequence
  SiRNA target sequence
cgtgaatgttttacgatatgc

SEQ ID NO: 15064 - DNA, 21 bp, Artificial sequence
  SiRNA target sequence
gtgaatgttttacgatatgca

SEQ ID NO: 15065 - DNA, 21 bp, Artificial sequence
  SiRNA target sequence
tgaatgttttacgatatgcat

SEQ ID NO: 15066 - DNA, 21 bp, Artificial sequence
  SiRNA target sequence
gaatgttttacgatatgcatg

SEQ ID NO: 15067 - DNA, 21 bp, Artificial sequence
  SiRNA target sequence
aatgttttacgatatgcatgt

SEQ ID NO: 15068 - DNA, 21 bp, Artificial sequence
  SiRNA target sequence
atgttttacgatatgcatgtg

SEQ ID NO: 15069 - DNA, 21 bp, Artificial sequence
  SiRNA target sequence
tgttttacgatatgcatgtgt

SEQ ID NO: 15070 - DNA, 21 bp, Artificial sequence
  SiRNA target sequence
gttttacgatatgcatgtgtg

SEQ ID NO: 15071 - DNA, 21 bp, Artificial sequence
  SiRNA target sequence
ttttacgatatgcatgtgtgg

SEQ ID NO: 15072 - DNA, 21 bp, Artificial sequence
  SiRNA target sequence
tttacgatatgcatgtgtggt

SEQ ID NO: 15073 - DNA, 21 bp, Artificial sequence
  SiRNA target sequence
ttacgatatgcatgtgtggtg

SEQ ID NO: 15074 - DNA, 21 bp, Artificial sequence
  SiRNA target sequence
tacgatatgcatgtgtggtgc

SEQ ID NO: 15075 - DNA, 21 bp, Artificial sequence
  SiRNA target sequence
acgatatgcatgtgtggtgca

SEQ ID NO: 15076 - DNA, 21 bp, Artificial sequence
  SiRNA target sequence
cgatatgcatgtgtggtgcat

SEQ ID NO: 15077 - DNA, 21 bp, Artificial sequence
  SiRNA target sequence
gatatgcatgtgtggtgcatc

SEQ ID NO: 15078 - DNA, 21 bp, Artificial sequence
  SiRNA target sequence
atatgcatgtgtggtgcatct

SEQ ID NO: 15079 - DNA, 21 bp, Artificial sequence
  SiRNA target sequence
tatgcatgtgtggtgcatctg

SEQ ID NO: 15080 - DNA, 21 bp, Artificial sequence
  SiRNA target sequence
atgcatgtgtggtgcatctgg

SEQ ID NO: 15081 - DNA, 21 bp, Artificial sequence
  SiRNA target sequence
tgcatgtgtggtgcatctgga

SEQ ID NO: 15082 - DNA, 21 bp, Artificial sequence
  SiRNA target sequence
gcatgtgtggtgcatctggaa

SEQ ID NO: 15083 - DNA, 21 bp, Artificial sequence
  SiRNA target sequence
catgtgtggtgcatctggaat

SEQ ID NO: 15084 - DNA, 21 bp, Artificial sequence
  SiRNA target sequence
atgtgtggtgcatctggaatt

SEQ ID NO: 15085 - DNA, 21 bp, Artificial sequence
  SiRNA target sequence
tgtgtggtgcatctggaattg

SEQ ID NO: 15086 - DNA, 21 bp, Artificial sequence
  SiRNA target sequence
gtgtggtgcatctggaattgg

SEQ ID NO: 15087 - DNA, 21 bp, Artificial sequence
  SiRNA target sequence
tgtggtgcatctggaattgga

SEQ ID NO: 15088 - DNA, 21 bp, Artificial sequence
  SiRNA target sequence
gtggtgcatctggaattggaa

SEQ ID NO: 15089 - DNA, 21 bp, Artificial sequence
  SiRNA target sequence
tggtgcatctggaattggaaa

SEQ ID NO: 15090 - DNA, 21 bp, Artificial sequence
  SiRNA target sequence
ggtgcatctggaattggaaaa

SEQ ID NO: 15091 - DNA, 21 bp, Artificial sequence
  SiRNA target sequence
gtgcatctggaattggaaaat

SEQ ID NO: 15092 - DNA, 21 bp, Artificial sequence
  SiRNA target sequence
tgcatctggaattggaaaatc

SEQ ID NO: 15093 - DNA, 21 bp, Artificial sequence
  SiRNA target sequence
gcatctggaattggaaaatca

SEQ ID NO: 15094 - DNA, 21 bp, Artificial sequence
  SiRNA target sequence
catctggaattggaaaatcat

SEQ ID NO: 15095 - DNA, 21 bp, Artificial sequence
  SiRNA target sequence
atctggaattggaaaatcata

SEQ ID NO: 15096 - DNA, 21 bp, Artificial sequence
  SiRNA target sequence
tctggaattggaaaatcatat

SEQ ID NO: 15097 - DNA, 21 bp, Artificial sequence
  SiRNA target sequence
ctggaattggaaaatcatatt

SEQ ID NO: 15098 - DNA, 21 bp, Artificial sequence
  SiRNA target sequence
tggaattggaaaatcatattt

SEQ ID NO: 15099 - DNA, 21 bp, Artificial sequence
  SiRNA target sequence
ggaattggaaaatcatatttg

SEQ ID NO: 15100 - DNA, 21 bp, Artificial sequence
  SiRNA target sequence
gaattggaaaatcatatttga

SEQ ID NO: 15101 - DNA, 21 bp, Artificial sequence
  SiRNA target sequence
aattggaaaatcatatttgac

SEQ ID NO: 15102 - DNA, 21 bp, Artificial sequence
  SiRNA target sequence
attggaaaatcatatttgacc

SEQ ID NO: 15103 - DNA, 21 bp, Artificial sequence
  SiRNA target sequence
ttggaaaatcatatttgaccg

SEQ ID NO: 15104 - DNA, 21 bp, Artificial sequence
  SiRNA target sequence
tggaaaatcatatttgaccga

SEQ ID NO: 15105 - DNA, 21 bp, Artificial sequence
  SiRNA target sequence
ggaaaatcatatttgaccgat

SEQ ID NO: 15106 - DNA, 21 bp, Artificial sequence
  SiRNA target sequence
gaaaatcatatttgaccgatt

SEQ ID NO: 15107 - DNA, 21 bp, Artificial sequence
  SiRNA target sequence
aaaatcatatttgaccgattc

SEQ ID NO: 15108 - DNA, 21 bp, Artificial sequence
  SiRNA target sequence
aaatcatatttgaccgattct

SEQ ID NO: 15109 - DNA, 21 bp, Artificial sequence
  SiRNA target sequence
aatcatatttgaccgattctt

SEQ ID NO: 15110 - DNA, 21 bp, Artificial sequence
  SiRNA target sequence
atcatatttgaccgattcttt

SEQ ID NO: 15111 - DNA, 21 bp, Artificial sequence
  SiRNA target sequence
tcatatttgaccgattcttta

SEQ ID NO: 15112 - DNA, 21 bp, Artificial sequence
  SiRNA target sequence
catatttgaccgattctttat

SEQ ID NO: 15113 - DNA, 21 bp, Artificial sequence
  SiRNA target sequence
atatttgaccgattctttatg

SEQ ID NO: 15114 - DNA, 21 bp, Artificial sequence
  SiRNA target sequence
tatttgaccgattctttatgc

SEQ ID NO: 15115 - DNA, 21 bp, Artificial sequence
  SiRNA target sequence
atttgaccgattctttatgca

SEQ ID NO: 15116 - DNA, 21 bp, Artificial sequence
  SiRNA target sequence
tttgaccgattctttatgcag

SEQ ID NO: 15117 - DNA, 21 bp, Artificial sequence
  SiRNA target sequence
ttgaccgattctttatgcagc

SEQ ID NO: 15118 - DNA, 21 bp, Artificial sequence
  SiRNA target sequence
tgaccgattctttatgcagcg

SEQ ID NO: 15119 - DNA, 21 bp, Artificial sequence
  SiRNA target sequence
gaccgattctttatgcagcga

SEQ ID NO: 15120 - DNA, 21 bp, Artificial sequence
  SiRNA target sequence
accgattctttatgcagcgag

SEQ ID NO: 15121 - DNA, 21 bp, Artificial sequence
  SiRNA target sequence
ccgattctttatgcagcgagc

SEQ ID NO: 15122 - DNA, 21 bp, Artificial sequence
  SiRNA target sequence
cgattctttatgcagcgagct

SEQ ID NO: 15123 - DNA, 21 bp, Artificial sequence
  SiRNA target sequence
gattctttatgcagcgagctc

SEQ ID NO: 15124 - DNA, 21 bp, Artificial sequence
  SiRNA target sequence
attctttatgcagcgagctct

SEQ ID NO: 15125 - DNA, 21 bp, Artificial sequence
  SiRNA target sequence
ttctttatgcagcgagctctt

SEQ ID NO: 15126 - DNA, 21 bp, Artificial sequence
  SiRNA target sequence
tctttatgcagcgagctctta

SEQ ID NO: 15127 - DNA, 21 bp, Artificial sequence
  SiRNA target sequence
ctttatgcagcgagctcttac

SEQ ID NO: 15128 - DNA, 21 bp, Artificial sequence
  SiRNA target sequence
tttatgcagcgagctcttacg

SEQ ID NO: 15129 - DNA, 21 bp, Artificial sequence
  SiRNA target sequence
ttatgcagcgagctcttacgt

SEQ ID NO: 15130 - DNA, 21 bp, Artificial sequence
  SiRNA target sequence
tatgcagcgagctcttacgtg

SEQ ID NO: 15131 - DNA, 21 bp, Artificial sequence
  SiRNA target sequence
atgcagcgagctcttacgtgc

SEQ ID NO: 15132 - DNA, 21 bp, Artificial sequence
  SiRNA target sequence
tgcagcgagctcttacgtgcg

SEQ ID NO: 15133 - DNA, 21 bp, Artificial sequence
  SiRNA target sequence
gcagcgagctcttacgtgcga

SEQ ID NO: 15134 - DNA, 21 bp, Artificial sequence
  SiRNA target sequence
cagcgagctcttacgtgcgag

SEQ ID NO: 15135 - DNA, 21 bp, Artificial sequence
  SiRNA target sequence
agcgagctcttacgtgcgagt

SEQ ID NO: 15136 - DNA, 21 bp, Artificial sequence
  SiRNA target sequence
gcgagctcttacgtgcgagtc

SEQ ID NO: 15137 - DNA, 21 bp, Artificial sequence
  SiRNA target sequence
cgagctcttacgtgcgagtcg

SEQ ID NO: 15138 - DNA, 21 bp, Artificial sequence
  SiRNA target sequence
gagctcttacgtgcgagtcgt

SEQ ID NO: 15139 - DNA, 21 bp, Artificial sequence
  SiRNA target sequence
agctcttacgtgcgagtcgta

SEQ ID NO: 15140 - DNA, 21 bp, Artificial sequence
  SiRNA target sequence
gctcttacgtgcgagtcgtac

SEQ ID NO: 15141 - DNA, 21 bp, Artificial sequence
  SiRNA target sequence
ctcttacgtgcgagtcgtact

SEQ ID NO: 15142 - DNA, 21 bp, Artificial sequence
  SiRNA target sequence
tcttacgtgcgagtcgtactc

SEQ ID NO: 15143 - DNA, 21 bp, Artificial sequence
  SiRNA target sequence
cttacgtgcgagtcgtactcc

SEQ ID NO: 15144 - DNA, 21 bp, Artificial sequence
  SiRNA target sequence
ttacgtgcgagtcgtactcct

SEQ ID NO: 15145 - DNA, 21 bp, Artificial sequence
  SiRNA target sequence
tacgtgcgagtcgtactcctg

SEQ ID NO: 15146 - DNA, 21 bp, Artificial sequence
  SiRNA target sequence
acgtgcgagtcgtactcctgt

SEQ ID NO: 15147 - DNA, 21 bp, Artificial sequence
  SiRNA target sequence
cgtgcgagtcgtactcctgtg

SEQ ID NO: 15148 - DNA, 21 bp, Artificial sequence
  SiRNA target sequence
gtgcgagtcgtactcctgtga

SEQ ID NO: 15149 - DNA, 21 bp, Artificial sequence
  SiRNA target sequence
tgcgagtcgtactcctgtgac

SEQ ID NO: 15150 - DNA, 21 bp, Artificial sequence
  SiRNA target sequence
gcgagtcgtactcctgtgaca

SEQ ID NO: 15151 - DNA, 21 bp, Artificial sequence
  SiRNA target sequence
cgagtcgtactcctgtgacaa

SEQ ID NO: 15152 - DNA, 21 bp, Artificial sequence
  SiRNA target sequence
gagtcgtactcctgtgacaac

SEQ ID NO: 15153 - DNA, 21 bp, Artificial sequence
  SiRNA target sequence
agtcgtactcctgtgacaaca

SEQ ID NO: 15154 - DNA, 21 bp, Artificial sequence
  SiRNA target sequence
gtcgtactcctgtgacaacag

SEQ ID NO: 15155 - DNA, 21 bp, Artificial sequence
  SiRNA target sequence
tcgtactcctgtgacaacagg

SEQ ID NO: 15156 - DNA, 21 bp, Artificial sequence
  SiRNA target sequence
cgtactcctgtgacaacaggc

SEQ ID NO: 15157 - DNA, 21 bp, Artificial sequence
  SiRNA target sequence
gtactcctgtgacaacaggca

SEQ ID NO: 15158 - DNA, 21 bp, Artificial sequence
  SiRNA target sequence
tactcctgtgacaacaggcat

SEQ ID NO: 15159 - DNA, 21 bp, Artificial sequence
  SiRNA target sequence
actcctgtgacaacaggcata

SEQ ID NO: 15160 - DNA, 21 bp, Artificial sequence
  SiRNA target sequence
ctcctgtgacaacaggcataa

SEQ ID NO: 15161 - DNA, 21 bp, Artificial sequence
  SiRNA target sequence
tcctgtgacaacaggcataaa

SEQ ID NO: 15162 - DNA, 21 bp, Artificial sequence
  SiRNA target sequence
cctgtgacaacaggcataaaa

SEQ ID NO: 15163 - DNA, 21 bp, Artificial sequence
  SiRNA target sequence
ctgtgacaacaggcataaaat

SEQ ID NO: 15164 - DNA, 21 bp, Artificial sequence
  SiRNA target sequence
tgtgacaacaggcataaaatg

SEQ ID NO: 15165 - DNA, 21 bp, Artificial sequence
  SiRNA target sequence
gtgacaacaggcataaaatgt

SEQ ID NO: 15166 - DNA, 21 bp, Artificial sequence
  SiRNA target sequence
tgacaacaggcataaaatgtg

SEQ ID NO: 15167 - DNA, 21 bp, Artificial sequence
  SiRNA target sequence
gacaacaggcataaaatgtgt

SEQ ID NO: 15168 - DNA, 21 bp, Artificial sequence
  SiRNA target sequence
acaacaggcataaaatgtgtt

SEQ ID NO: 15169 - DNA, 21 bp, Artificial sequence
  SiRNA target sequence
caacaggcataaaatgtgttg

SEQ ID NO: 15170 - DNA, 21 bp, Artificial sequence
  SiRNA target sequence
aacaggcataaaatgtgttgt

SEQ ID NO: 15171 - DNA, 21 bp, Artificial sequence
  SiRNA target sequence
acaggcataaaatgtgttgtt

SEQ ID NO: 15172 - DNA, 21 bp, Artificial sequence
  SiRNA target sequence
caggcataaaatgtgttgtta

SEQ ID NO: 15173 - DNA, 21 bp, Artificial sequence
  SiRNA target sequence
aggcataaaatgtgttgttaa

SEQ ID NO: 15174 - DNA, 21 bp, Artificial sequence
  SiRNA target sequence
ggcataaaatgtgttgttaat

SEQ ID NO: 15175 - DNA, 21 bp, Artificial sequence
  SiRNA target sequence
gcataaaatgtgttgttaatc

SEQ ID NO: 15176 - DNA, 21 bp, Artificial sequence
  SiRNA target sequence
cataaaatgtgttgttaatcc

SEQ ID NO: 15177 - DNA, 21 bp, Artificial sequence
  SiRNA target sequence
ataaaatgtgttgttaatcca

SEQ ID NO: 15178 - DNA, 21 bp, Artificial sequence
  SiRNA target sequence
taaaatgtgttgttaatccat

SEQ ID NO: 15179 - DNA, 21 bp, Artificial sequence
  SiRNA target sequence
aaaatgtgttgttaatccatt

SEQ ID NO: 15180 - DNA, 21 bp, Artificial sequence
  SiRNA target sequence
aaatgtgttgttaatccatta

SEQ ID NO: 15181 - DNA, 21 bp, Artificial sequence
  SiRNA target sequence
aatgtgttgttaatccattat

SEQ ID NO: 15182 - DNA, 21 bp, Artificial sequence
  SiRNA target sequence
atgtgttgttaatccattatc

SEQ ID NO: 15183 - DNA, 21 bp, Artificial sequence
  SiRNA target sequence
tgtgttgttaatccattatct

SEQ ID NO: 15184 - DNA, 21 bp, Artificial sequence
  SiRNA target sequence
gtgttgttaatccattatctg

SEQ ID NO: 15185 - DNA, 21 bp, Artificial sequence
  SiRNA target sequence
tgttgttaatccattatctga

SEQ ID NO: 15186 - DNA, 21 bp, Artificial sequence
  SiRNA target sequence
gttgttaatccattatctgat

SEQ ID NO: 15187 - DNA, 21 bp, Artificial sequence
  SiRNA target sequence
ttgttaatccattatctgatt

SEQ ID NO: 15188 - DNA, 21 bp, Artificial sequence
  SiRNA target sequence
tgttaatccattatctgatta

SEQ ID NO: 15189 - DNA, 21 bp, Artificial sequence
  SiRNA target sequence
gttaatccattatctgattat

SEQ ID NO: 15190 - DNA, 21 bp, Artificial sequence
  SiRNA target sequence
ttaatccattatctgattatt

SEQ ID NO: 15191 - DNA, 21 bp, Artificial sequence
  SiRNA target sequence
taatccattatctgattattg

SEQ ID NO: 15192 - DNA, 21 bp, Artificial sequence
  SiRNA target sequence
aatccattatctgattattgg

SEQ ID NO: 15193 - DNA, 21 bp, Artificial sequence
  SiRNA target sequence
atccattatctgattattggg

SEQ ID NO: 15194 - DNA, 21 bp, Artificial sequence
  SiRNA target sequence
tccattatctgattattggga

SEQ ID NO: 15195 - DNA, 21 bp, Artificial sequence
  SiRNA target sequence
ccattatctgattattgggat

SEQ ID NO: 15196 - DNA, 21 bp, Artificial sequence
  SiRNA target sequence
cattatctgattattgggatc

SEQ ID NO: 15197 - DNA, 21 bp, Artificial sequence
  SiRNA target sequence
attatctgattattgggatca

SEQ ID NO: 15198 - DNA, 21 bp, Artificial sequence
  SiRNA target sequence
ttatctgattattgggatcaa

SEQ ID NO: 15199 - DNA, 21 bp, Artificial sequence
  SiRNA target sequence
tatctgattattgggatcaat

SEQ ID NO: 15200 - DNA, 21 bp, Artificial sequence
  SiRNA target sequence
atctgattattgggatcaatg

SEQ ID NO: 15201 - DNA, 21 bp, Artificial sequence
  SiRNA target sequence
tctgattattgggatcaatgt

SEQ ID NO: 15202 - DNA, 21 bp, Artificial sequence
  SiRNA target sequence
ctgattattgggatcaatgtg

SEQ ID NO: 15203 - DNA, 21 bp, Artificial sequence
  SiRNA target sequence
tgattattgggatcaatgtga

SEQ ID NO: 15204 - DNA, 21 bp, Artificial sequence
  SiRNA target sequence
gattattgggatcaatgtgat

SEQ ID NO: 15205 - DNA, 21 bp, Artificial sequence
  SiRNA target sequence
attattgggatcaatgtgatt

SEQ ID NO: 15206 - DNA, 21 bp, Artificial sequence
  SiRNA target sequence
ttattgggatcaatgtgattt

SEQ ID NO: 15207 - DNA, 21 bp, Artificial sequence
  SiRNA target sequence
tattgggatcaatgtgatttt

SEQ ID NO: 15208 - DNA, 21 bp, Artificial sequence
  SiRNA target sequence
attgggatcaatgtgattttc

SEQ ID NO: 15209 - DNA, 21 bp, Artificial sequence
  SiRNA target sequence
ttgggatcaatgtgattttca

SEQ ID NO: 15210 - DNA, 21 bp, Artificial sequence
  SiRNA target sequence
tgggatcaatgtgattttcag

SEQ ID NO: 15211 - DNA, 21 bp, Artificial sequence
  SiRNA target sequence
gggatcaatgtgattttcagc

SEQ ID NO: 15212 - DNA, 21 bp, Artificial sequence
  SiRNA target sequence
ggatcaatgtgattttcagcc

SEQ ID NO: 15213 - DNA, 21 bp, Artificial sequence
  SiRNA target sequence
gatcaatgtgattttcagcct

SEQ ID NO: 15214 - DNA, 21 bp, Artificial sequence
  SiRNA target sequence
atcaatgtgattttcagcctg

SEQ ID NO: 15215 - DNA, 21 bp, Artificial sequence
  SiRNA target sequence
tcaatgtgattttcagcctgt

SEQ ID NO: 15216 - DNA, 21 bp, Artificial sequence
  SiRNA target sequence
caatgtgattttcagcctgtt

SEQ ID NO: 15217 - DNA, 21 bp, Artificial sequence
  SiRNA target sequence
aatgtgattttcagcctgttt

SEQ ID NO: 15218 - DNA, 21 bp, Artificial sequence
  SiRNA target sequence
atgtgattttcagcctgtttt

SEQ ID NO: 15219 - DNA, 21 bp, Artificial sequence
  SiRNA target sequence
tgtgattttcagcctgttttg

SEQ ID NO: 15220 - DNA, 21 bp, Artificial sequence
  SiRNA target sequence
gtgattttcagcctgttttgt

SEQ ID NO: 15221 - DNA, 21 bp, Artificial sequence
  SiRNA target sequence
tgattttcagcctgttttgtg

SEQ ID NO: 15222 - DNA, 21 bp, Artificial sequence
  SiRNA target sequence
gattttcagcctgttttgtgc

SEQ ID NO: 15223 - DNA, 21 bp, Artificial sequence
  SiRNA target sequence
attttcagcctgttttgtgcg

SEQ ID NO: 15224 - DNA, 21 bp, Artificial sequence
  SiRNA target sequence
ttttcagcctgttttgtgcgt

SEQ ID NO: 15225 - DNA, 21 bp, Artificial sequence
  SiRNA target sequence
tttcagcctgttttgtgcgtt

SEQ ID NO: 15226 - DNA, 21 bp, Artificial sequence
  SiRNA target sequence
ttcagcctgttttgtgcgttg

SEQ ID NO: 15227 - DNA, 21 bp, Artificial sequence
  SiRNA target sequence
tcagcctgttttgtgcgttga

SEQ ID NO: 15228 - DNA, 21 bp, Artificial sequence
  SiRNA target sequence
cagcctgttttgtgcgttgac

SEQ ID NO: 15229 - DNA, 21 bp, Artificial sequence
  SiRNA target sequence
agcctgttttgtgcgttgacg

SEQ ID NO: 15230 - DNA, 21 bp, Artificial sequence
  SiRNA target sequence
gcctgttttgtgcgttgacga

SEQ ID NO: 15231 - DNA, 21 bp, Artificial sequence
  SiRNA target sequence
cctgttttgtgcgttgacgat

SEQ ID NO: 15232 - DNA, 21 bp, Artificial sequence
  SiRNA target sequence
ctgttttgtgcgttgacgata

SEQ ID NO: 15233 - DNA, 21 bp, Artificial sequence
  SiRNA target sequence
tgttttgtgcgttgacgatat

SEQ ID NO: 15234 - DNA, 21 bp, Artificial sequence
  SiRNA target sequence
gttttgtgcgttgacgatatg

SEQ ID NO: 15235 - DNA, 21 bp, Artificial sequence
  SiRNA target sequence
ttttgtgcgttgacgatatgt

SEQ ID NO: 15236 - DNA, 21 bp, Artificial sequence
  SiRNA target sequence
tttgtgcgttgacgatatgtg

SEQ ID NO: 15237 - DNA, 21 bp, Artificial sequence
  SiRNA target sequence
ttgtgcgttgacgatatgtgg

SEQ ID NO: 15238 - DNA, 21 bp, Artificial sequence
  SiRNA target sequence
tgtgcgttgacgatatgtgga

SEQ ID NO: 15239 - DNA, 21 bp, Artificial sequence
  SiRNA target sequence
gtgcgttgacgatatgtggag

SEQ ID NO: 15240 - DNA, 21 bp, Artificial sequence
  SiRNA target sequence
tgcgttgacgatatgtggagt

SEQ ID NO: 15241 - DNA, 21 bp, Artificial sequence
  SiRNA target sequence
gcgttgacgatatgtggagtg

SEQ ID NO: 15242 - DNA, 21 bp, Artificial sequence
  SiRNA target sequence
cgttgacgatatgtggagtgt

SEQ ID NO: 15243 - DNA, 21 bp, Artificial sequence
  SiRNA target sequence
gttgacgatatgtggagtgtt

SEQ ID NO: 15244 - DNA, 21 bp, Artificial sequence
  SiRNA target sequence
ttgacgatatgtggagtgttg

SEQ ID NO: 15245 - DNA, 21 bp, Artificial sequence
  SiRNA target sequence
tgacgatatgtggagtgttga

SEQ ID NO: 15246 - DNA, 21 bp, Artificial sequence
  SiRNA target sequence
gacgatatgtggagtgttgaa

SEQ ID NO: 15247 - DNA, 21 bp, Artificial sequence
  SiRNA target sequence
acgatatgtggagtgttgaaa

SEQ ID NO: 15248 - DNA, 21 bp, Artificial sequence
  SiRNA target sequence
cgatatgtggagtgttgaaac

SEQ ID NO: 15249 - DNA, 21 bp, Artificial sequence
  SiRNA target sequence
gatatgtggagtgttgaaaca

SEQ ID NO: 15250 - DNA, 21 bp, Artificial sequence
  SiRNA target sequence
atatgtggagtgttgaaacat

SEQ ID NO: 15251 - DNA, 21 bp, Artificial sequence
  SiRNA target sequence
tatgtggagtgttgaaacatc

SEQ ID NO: 15252 - DNA, 21 bp, Artificial sequence
  SiRNA target sequence
atgtggagtgttgaaacatct

SEQ ID NO: 15253 - DNA, 21 bp, Artificial sequence
  SiRNA target sequence
tgtggagtgttgaaacatcta

SEQ ID NO: 15254 - DNA, 21 bp, Artificial sequence
  SiRNA target sequence
gtggagtgttgaaacatctac

SEQ ID NO: 15255 - DNA, 21 bp, Artificial sequence
  SiRNA target sequence
tggagtgttgaaacatctact

SEQ ID NO: 15256 - DNA, 21 bp, Artificial sequence
  SiRNA target sequence
ggagtgttgaaacatctacta

SEQ ID NO: 15257 - DNA, 21 bp, Artificial sequence
  SiRNA target sequence
gagtgttgaaacatctactac

SEQ ID NO: 15258 - DNA, 21 bp, Artificial sequence
  SiRNA target sequence
agtgttgaaacatctactacg

SEQ ID NO: 15259 - DNA, 21 bp, Artificial sequence
  SiRNA target sequence
gtgttgaaacatctactacgc

SEQ ID NO: 15260 - DNA, 21 bp, Artificial sequence
  SiRNA target sequence
tgttgaaacatctactacgct

SEQ ID NO: 15261 - DNA, 21 bp, Artificial sequence
  SiRNA target sequence
  misc_feature (21)..(21): n is a, c, g, or t
gttgaaacatctactacgctn

SEQ ID NO: 15262 - DNA, 21 bp, Artificial sequence
  SiRNA target sequence
  misc_feature (20)..(20): n is a, c, g, or t
ttgaaacatctactacgctng

SEQ ID NO: 15263 - DNA, 21 bp, Artificial sequence
  SiRNA target sequence
  misc_feature (19)..(19): n is a, c, g, or t
tgaaacatctactacgctnga

SEQ ID NO: 15264 - DNA, 21 bp, Artificial sequence
  SiRNA target sequence
  misc_feature (18)..(18): n is a, c, g, or t
gaaacatctactacgctngat

SEQ ID NO: 15265 - DNA, 21 bp, Artificial sequence
  SiRNA target sequence
  misc_feature (17)..(17): n is a, c, g, or t
aaacatctactacgctngata

SEQ ID NO: 15266 - DNA, 21 bp, Artificial sequence
  SiRNA target sequence
  misc_feature (16)..(16): n is a, c, g, or t
aacatctactacgctngataa

SEQ ID NO: 15267 - DNA, 21 bp, Artificial sequence
  SiRNA target sequence
  misc_feature (15)..(15): n is a, c, g, or t
acatctactacgctngataag

SEQ ID NO: 15268 - DNA, 21 bp, Artificial sequence
  SiRNA target sequence
  misc_feature (14)..(14): n is a, c, g, or t
catctactacgctngataagc

SEQ ID NO: 15269 - DNA, 21 bp, Artificial sequence
  SiRNA target sequence
  misc_feature (13)..(13): n is a, c, g, or t
atctactacgctngataagca

SEQ ID NO: 15270 - DNA, 21 bp, Artificial sequence
  SiRNA target sequence
  misc_feature (12)..(12): n is a, c, g, or t
tctactacgctngataagcag

SEQ ID NO: 15271 - DNA, 21 bp, Artificial sequence
  SiRNA target sequence
  misc_feature (11)..(11): n is a, c, g, or t
ctactacgctngataagcagt

SEQ ID NO: 15272 - DNA, 21 bp, Artificial sequence
  SiRNA target sequence
  misc_feature (10)..(10): n is a, c, g, or t
tactacgctngataagcagtt

SEQ ID NO: 15273 - DNA, 21 bp, Artificial sequence
  SiRNA target sequence
  misc_feature (9)..(9): n is a, c, g, or t
actacgctngataagcagttg

SEQ ID NO: 15274 - DNA, 21 bp, Artificial sequence
  SiRNA target sequence
  misc_feature (8)..(8): n is a, c, g, or t
ctacgctngataagcagttga

SEQ ID NO: 15275 - DNA, 21 bp, Artificial sequence
  SiRNA target sequence
  misc_feature (7)..(7): n is a, c, g, or t
tacgctngataagcagttgaa

SEQ ID NO: 15276 - DNA, 21 bp, Artificial sequence
  SiRNA target sequence
  misc_feature (6)..(6): n is a, c, g, or t
acgctngataagcagttgaat

SEQ ID NO: 15277 - DNA, 21 bp, Artificial sequence
  SiRNA target sequence
  misc_feature (5)..(5): n is a, c, g, or t
cgctngataagcagttgaata

SEQ ID NO: 15278 - DNA, 21 bp, Artificial sequence
  SiRNA target sequence
  misc_feature (4)..(4): n is a, c, g, or t
gctngataagcagttgaatat

SEQ ID NO: 15279 - DNA, 21 bp, Artificial sequence
  SiRNA target sequence
  misc_feature (3)..(3): n is a, c, g, or t
ctngataagcagttgaatatg

SEQ ID NO: 15280 - DNA, 21 bp, Artificial sequence
  SiRNA target sequence
  misc_feature (2)..(2): n is a, c, g, or t
tngataagcagttgaatatgc

SEQ ID NO: 15281 - DNA, 21 bp, Artificial sequence
  SiRNA target sequence
  misc_feature (1)..(1): n is a, c, g, or t
ngataagcagttgaatatgct

SEQ ID NO: 15282 - DNA, 21 bp, Artificial sequence
  SiRNA target sequence
gataagcagttgaatatgctt

SEQ ID NO: 15283 - DNA, 21 bp, Artificial sequence
  SiRNA target sequence
ataagcagttgaatatgcttt

SEQ ID NO: 15284 - DNA, 21 bp, Artificial sequence
  SiRNA target sequence
taagcagttgaatatgctttt

SEQ ID NO: 15285 - DNA, 21 bp, Artificial sequence
  SiRNA target sequence
aagcagttgaatatgcttttc

SEQ ID NO: 15286 - DNA, 21 bp, Artificial sequence
  SiRNA target sequence
agcagttgaatatgcttttcc

SEQ ID NO: 15287 - DNA, 21 bp, Artificial sequence
  SiRNA target sequence
gcagttgaatatgcttttcca

SEQ ID NO: 15288 - DNA, 21 bp, Artificial sequence
  SiRNA target sequence
cagttgaatatgcttttccag

SEQ ID NO: 15289 - DNA, 21 bp, Artificial sequence
  SiRNA target sequence
agttgaatatgcttttccagg

SEQ ID NO: 15290 - DNA, 21 bp, Artificial sequence
  SiRNA target sequence
gttgaatatgcttttccaggt

SEQ ID NO: 15291 - DNA, 21 bp, Artificial sequence
  SiRNA target sequence
ttgaatatgcttttccaggtc

SEQ ID NO: 15292 - DNA, 21 bp, Artificial sequence
  SiRNA target sequence
tgaatatgcttttccaggtcc

SEQ ID NO: 15293 - DNA, 21 bp, Artificial sequence
  SiRNA target sequence
gaatatgcttttccaggtcca

SEQ ID NO: 15294 - DNA, 21 bp, Artificial sequence
  SiRNA target sequence
aatatgcttttccaggtccat

SEQ ID NO: 15295 - DNA, 21 bp, Artificial sequence
  SiRNA target sequence
atatgcttttccaggtccatt

SEQ ID NO: 15296 - DNA, 21 bp, Artificial sequence
  SiRNA target sequence
tatgcttttccaggtccattc

SEQ ID NO: 15297 - DNA, 21 bp, Artificial sequence
  SiRNA target sequence
atgcttttccaggtccattcc

SEQ ID NO: 15298 - DNA, 21 bp, Artificial sequence
  SiRNA target sequence
tgcttttccaggtccattccc

SEQ ID NO: 15299 - DNA, 21 bp, Artificial sequence
  SiRNA target sequence
gcttttccaggtccattcccc

SEQ ID NO: 15300 - DNA, 21 bp, Artificial sequence
  SiRNA target sequence
cttttccaggtccattcccct

SEQ ID NO: 15301 - DNA, 21 bp, Artificial sequence
  SiRNA target sequence
ttttccaggtccattccccta

SEQ ID NO: 15302 - DNA, 21 bp, Artificial sequence
  SiRNA target sequence
tttccaggtccattcccctat

SEQ ID NO: 15303 - DNA, 21 bp, Artificial sequence
  SiRNA target sequence
ttccaggtccattcccctatc

SEQ ID NO: 15304 - DNA, 21 bp, Artificial sequence
  SiRNA target sequence
tccaggtccattcccctatcg

SEQ ID NO: 15305 - DNA, 21 bp, Artificial sequence
  SiRNA target sequence
ccaggtccattcccctatcgt

SEQ ID NO: 15306 - DNA, 21 bp, Artificial sequence
  SiRNA target sequence
caggtccattcccctatcgtg

SEQ ID NO: 15307 - DNA, 21 bp, Artificial sequence
  SiRNA target sequence
aggtccattcccctatcgtgc

SEQ ID NO: 15308 - DNA, 21 bp, Artificial sequence
  SiRNA target sequence
ggtccattcccctatcgtgct

SEQ ID NO: 15309 - DNA, 21 bp, Artificial sequence
  SiRNA target sequence
gtccattcccctatcgtgctt

SEQ ID NO: 15310 - DNA, 21 bp, Artificial sequence
  SiRNA target sequence
tccattcccctatcgtgcttt

SEQ ID NO: 15311 - DNA, 21 bp, Artificial sequence
  SiRNA target sequence
ccattcccctatcgtgctttc

SEQ ID NO: 15312 - DNA, 21 bp, Artificial sequence
  SiRNA target sequence
cattcccctatcgtgctttct

SEQ ID NO: 15313 - DNA, 21 bp, Artificial sequence
  SiRNA target sequence
attcccctatcgtgctttctc

SEQ ID NO: 15314 - DNA, 21 bp, Artificial sequence
  SiRNA target sequence
ttcccctatcgtgctttctcc

SEQ ID NO: 15315 - DNA, 21 bp, Artificial sequence
  SiRNA target sequence
tcccctatcgtgctttctcct

SEQ ID NO: 15316 - DNA, 21 bp, Artificial sequence
  SiRNA target sequence
cccctatcgtgctttctcctc

SEQ ID NO: 15317 - DNA, 21 bp, Artificial sequence
  SiRNA target sequence
ccctatcgtgctttctcctcc

SEQ ID NO: 15318 - DNA, 21 bp, Artificial sequence
  SiRNA target sequence
cctatcgtgctttctcctcct

SEQ ID NO: 15319 - DNA, 21 bp, Artificial sequence
  SiRNA target sequence
ctatcgtgctttctcctccta

SEQ ID NO: 15320 - DNA, 21 bp, Artificial sequence
  SiRNA target sequence
tatcgtgctttctcctcctaa

SEQ ID NO: 15321 - DNA, 21 bp, Artificial sequence
  SiRNA target sequence
atcgtgctttctcctcctaaa

SEQ ID NO: 15322 - DNA, 21 bp, Artificial sequence
  SiRNA target sequence
tcgtgctttctcctcctaaag

SEQ ID NO: 15323 - DNA, 21 bp, Artificial sequence
  SiRNA target sequence
cgtgctttctcctcctaaagc

SEQ ID NO: 15324 - DNA, 21 bp, Artificial sequence
  SiRNA target sequence
gtgctttctcctcctaaagct

SEQ ID NO: 15325 - DNA, 21 bp, Artificial sequence
  SiRNA target sequence
tgctttctcctcctaaagctg

SEQ ID NO: 15326 - DNA, 21 bp, Artificial sequence
  SiRNA target sequence
gctttctcctcctaaagctga

SEQ ID NO: 15327 - DNA, 21 bp, Artificial sequence
  SiRNA target sequence
ctttctcctcctaaagctgat

SEQ ID NO: 15328 - DNA, 21 bp, Artificial sequence
  SiRNA target sequence
tttctcctcctaaagctgatt

SEQ ID NO: 15329 - DNA, 21 bp, Artificial sequence
  SiRNA target sequence
ttctcctcctaaagctgattt

SEQ ID NO: 15330 - DNA, 21 bp, Artificial sequence
  SiRNA target sequence
tctcctcctaaagctgattta

SEQ ID NO: 15331 - DNA, 21 bp, Artificial sequence
  SiRNA target sequence
ctcctcctaaagctgatttag

SEQ ID NO: 15332 - DNA, 21 bp, Artificial sequence
  SiRNA target sequence
tcctcctaaagctgatttaga

SEQ ID NO: 15333 - DNA, 21 bp, Artificial sequence
  SiRNA target sequence
cctcctaaagctgatttagaa

SEQ ID NO: 15334 - DNA, 21 bp, Artificial sequence
  SiRNA target sequence
ctcctaaagctgatttagaag

SEQ ID NO: 15335 - DNA, 21 bp, Artificial sequence
  SiRNA target sequence
tcctaaagctgatttagaagg

SEQ ID NO: 15336 - DNA, 21 bp, Artificial sequence
  SiRNA target sequence
cctaaagctgatttagaaggt

SEQ ID NO: 15337 - DNA, 21 bp, Artificial sequence
  SiRNA target sequence
ctaaagctgatttagaaggta

SEQ ID NO: 15338 - DNA, 21 bp, Artificial sequence
  SiRNA target sequence
taaagctgatttagaaggtaa

SEQ ID NO: 15339 - DNA, 21 bp, Artificial sequence
  SiRNA target sequence
aaagctgatttagaaggtaag

SEQ ID NO: 15340 - DNA, 21 bp, Artificial sequence
  SiRNA target sequence
aagctgatttagaaggtaaga

SEQ ID NO: 15341 - DNA, 21 bp, Artificial sequence
  SiRNA target sequence
agctgatttagaaggtaagaa

SEQ ID NO: 15342 - DNA, 21 bp, Artificial sequence
  SiRNA target sequence
gctgatttagaaggtaagaaa

SEQ ID NO: 15343 - DNA, 21 bp, Artificial sequence
  SiRNA target sequence
ctgatttagaaggtaagaaaa

SEQ ID NO: 15344 - DNA, 21 bp, Artificial sequence
  SiRNA target sequence
tgatttagaaggtaagaaaat

SEQ ID NO: 15345 - DNA, 21 bp, Artificial sequence
  SiRNA target sequence
gatttagaaggtaagaaaatg

SEQ ID NO: 15346 - DNA, 21 bp, Artificial sequence
  SiRNA target sequence
atttagaaggtaagaaaatgc

SEQ ID NO: 15347 - DNA, 21 bp, Artificial sequence
  SiRNA target sequence
tttagaaggtaagaaaatgcg

SEQ ID NO: 15348 - DNA, 21 bp, Artificial sequence
  SiRNA target sequence
ttagaaggtaagaaaatgcga

SEQ ID NO: 15349 - DNA, 21 bp, Artificial sequence
  SiRNA target sequence
tagaaggtaagaaaatgcgat

SEQ ID NO: 15350 - DNA, 21 bp, Artificial sequence
  SiRNA target sequence
agaaggtaagaaaatgcgata

SEQ ID NO: 15351 - DNA, 21 bp, Artificial sequence
  SiRNA target sequence
gaaggtaagaaaatgcgatat

SEQ ID NO: 15352 - DNA, 21 bp, Artificial sequence
  SiRNA target sequence
aaggtaagaaaatgcgatata

SEQ ID NO: 15353 - DNA, 21 bp, Artificial sequence
  SiRNA target sequence
aggtaagaaaatgcgatataa

SEQ ID NO: 15354 - DNA, 21 bp, Artificial sequence
  SiRNA target sequence
ggtaagaaaatgcgatataac

SEQ ID NO: 15355 - DNA, 21 bp, Artificial sequence
  SiRNA target sequence
gtaagaaaatgcgatataacc

SEQ ID NO: 15356 - DNA, 21 bp, Artificial sequence
  SiRNA target sequence
taagaaaatgcgatataaccc

SEQ ID NO: 15357 - DNA, 21 bp, Artificial sequence
  SiRNA target sequence
aagaaaatgcgatataacccg

SEQ ID NO: 15358 - DNA, 21 bp, Artificial sequence
  SiRNA target sequence
agaaaatgcgatataacccgg

SEQ ID NO: 15359 - DNA, 21 bp, Artificial sequence
  SiRNA target sequence
gaaaatgcgatataacccgga

SEQ ID NO: 15360 - DNA, 21 bp, Artificial sequence
  SiRNA target sequence
aaaatgcgatataacccggaa

SEQ ID NO: 15361 - DNA, 21 bp, Artificial sequence
  SiRNA target sequence
aaatgcgatataacccggaaa

SEQ ID NO: 15362 - DNA, 21 bp, Artificial sequence
  SiRNA target sequence
aatgcgatataacccggaaat

SEQ ID NO: 15363 - DNA, 21 bp, Artificial sequence
  SiRNA target sequence
atgcgatataacccggaaata

SEQ ID NO: 15364 - DNA, 21 bp, Artificial sequence
  SiRNA target sequence
tgcgatataacccggaaatat

SEQ ID NO: 15365 - DNA, 21 bp, Artificial sequence
  SiRNA target sequence
gcgatataacccggaaatatt

SEQ ID NO: 15366 - DNA, 21 bp, Artificial sequence
  SiRNA target sequence
cgatataacccggaaatattc

SEQ ID NO: 15367 - DNA, 21 bp, Artificial sequence
  SiRNA target sequence
gatataacccggaaatattca

SEQ ID NO: 15368 - DNA, 21 bp, Artificial sequence
  SiRNA target sequence
atataacccggaaatattcat

SEQ ID NO: 15369 - DNA, 21 bp, Artificial sequence
  SiRNA target sequence
tataacccggaaatattcata

SEQ ID NO: 15370 - DNA, 21 bp, Artificial sequence
  SiRNA target sequence
ataacccggaaatattcatat

SEQ ID NO: 15371 - DNA, 21 bp, Artificial sequence
  SiRNA target sequence
taacccggaaatattcatata

SEQ ID NO: 15372 - DNA, 21 bp, Artificial sequence
  SiRNA target sequence
aacccggaaatattcatatac

SEQ ID NO: 15373 - DNA, 21 bp, Artificial sequence
  SiRNA target sequence
acccggaaatattcatataca

SEQ ID NO: 15374 - DNA, 21 bp, Artificial sequence
  SiRNA target sequence
cccggaaatattcatatacaa

SEQ ID NO: 15375 - DNA, 21 bp, Artificial sequence
  SiRNA target sequence
ccggaaatattcatatacaat

SEQ ID NO: 15376 - DNA, 21 bp, Artificial sequence
  SiRNA target sequence
cggaaatattcatatacaata

SEQ ID NO: 15377 - DNA, 21 bp, Artificial sequence
  SiRNA target sequence
ggaaatattcatatacaatac

SEQ ID NO: 15378 - DNA, 21 bp, Artificial sequence
  SiRNA target sequence
gaaatattcatatacaatacg

SEQ ID NO: 15379 - DNA, 21 bp, Artificial sequence
  SiRNA target sequence
aaatattcatatacaatacga

SEQ ID NO: 15380 - DNA, 21 bp, Artificial sequence
  SiRNA target sequence
aatattcatatacaatacgaa

SEQ ID NO: 15381 - DNA, 21 bp, Artificial sequence
  SiRNA target sequence
atattcatatacaatacgaat

SEQ ID NO: 15382 - DNA, 21 bp, Artificial sequence
  SiRNA target sequence
tattcatatacaatacgaata

SEQ ID NO: 15383 - DNA, 21 bp, Artificial sequence
  SiRNA target sequence
attcatatacaatacgaataa

SEQ ID NO: 15384 - DNA, 21 bp, Artificial sequence
  SiRNA target sequence
ttcatatacaatacgaataaa

SEQ ID NO: 15385 - DNA, 21 bp, Artificial sequence
  SiRNA target sequence
tcatatacaatacgaataaac

SEQ ID NO: 15386 - DNA, 21 bp, Artificial sequence
  SiRNA target sequence
catatacaatacgaataaacc

SEQ ID NO: 15387 - DNA, 21 bp, Artificial sequence
  SiRNA target sequence
atatacaatacgaataaacct

SEQ ID NO: 15388 - DNA, 21 bp, Artificial sequence
  SiRNA target sequence
tatacaatacgaataaacctt

SEQ ID NO: 15389 - DNA, 21 bp, Artificial sequence
  SiRNA target sequence
atacaatacgaataaaccttt

SEQ ID NO: 15390 - DNA, 21 bp, Artificial sequence
  SiRNA target sequence
tacaatacgaataaacctttc

SEQ ID NO: 15391 - DNA, 21 bp, Artificial sequence
  SiRNA target sequence
acaatacgaataaacctttcc

SEQ ID NO: 15392 - DNA, 21 bp, Artificial sequence
  SiRNA target sequence
caatacgaataaacctttccc

SEQ ID NO: 15393 - DNA, 21 bp, Artificial sequence
  SiRNA target sequence
aatacgaataaacctttcccg

SEQ ID NO: 15394 - DNA, 21 bp, Artificial sequence
  SiRNA target sequence
atacgaataaacctttcccga

SEQ ID NO: 15395 - DNA, 21 bp, Artificial sequence
  SiRNA target sequence
tacgaataaacctttcccgag

SEQ ID NO: 15396 - DNA, 21 bp, Artificial sequence
  SiRNA target sequence
acgaataaacctttcccgagg

SEQ ID NO: 15397 - DNA, 21 bp, Artificial sequence
  SiRNA target sequence
cgaataaacctttcccgaggt

SEQ ID NO: 15398 - DNA, 21 bp, Artificial sequence
  SiRNA target sequence
gaataaacctttcccgaggtt

SEQ ID NO: 15399 - DNA, 21 bp, Artificial sequence
  SiRNA target sequence
aataaacctttcccgaggttt

SEQ ID NO: 15400 - DNA, 21 bp, Artificial sequence
  SiRNA target sequence
ataaacctttcccgaggtttg

SEQ ID NO: 15401 - DNA, 21 bp, Artificial sequence
  SiRNA target sequence
taaacctttcccgaggtttga

SEQ ID NO: 15402 - DNA, 21 bp, Artificial sequence
  SiRNA target sequence
aaacctttcccgaggtttgat

SEQ ID NO: 15403 - DNA, 21 bp, Artificial sequence
  SiRNA target sequence
aacctttcccgaggtttgatc

SEQ ID NO: 15404 - DNA, 21 bp, Artificial sequence
  SiRNA target sequence
acctttcccgaggtttgatcg

SEQ ID NO: 15405 - DNA, 21 bp, Artificial sequence
  SiRNA target sequence
cctttcccgaggtttgatcgt

SEQ ID NO: 15406 - DNA, 21 bp, Artificial sequence
  SiRNA target sequence
ctttcccgaggtttgatcgta

SEQ ID NO: 15407 - DNA, 21 bp, Artificial sequence
  SiRNA target sequence
tttcccgaggtttgatcgtat

SEQ ID NO: 15408 - DNA, 21 bp, Artificial sequence
  SiRNA target sequence
ttcccgaggtttgatcgtatt

SEQ ID NO: 15409 - DNA, 21 bp, Artificial sequence
  SiRNA target sequence
tcccgaggtttgatcgtattg

SEQ ID NO: 15410 - DNA, 21 bp, Artificial sequence
  SiRNA target sequence
cccgaggtttgatcgtattgc

SEQ ID NO: 15411 - DNA, 21 bp, Artificial sequence
  SiRNA target sequence
ccgaggtttgatcgtattgct

SEQ ID NO: 15412 - DNA, 21 bp, Artificial sequence
  SiRNA target sequence
cgaggtttgatcgtattgcta

SEQ ID NO: 15413 - DNA, 21 bp, Artificial sequence
  SiRNA target sequence
gaggtttgatcgtattgctat

SEQ ID NO: 15414 - DNA, 21 bp, Artificial sequence
  SiRNA target sequence
aggtttgatcgtattgctatg

SEQ ID NO: 15415 - DNA, 21 bp, Artificial sequence
  SiRNA target sequence
ggtttgatcgtattgctatgg

SEQ ID NO: 15416 - DNA, 21 bp, Artificial sequence
  SiRNA target sequence
gtttgatcgtattgctatgga

SEQ ID NO: 15417 - DNA, 21 bp, Artificial sequence
  SiRNA target sequence
tttgatcgtattgctatggaa

SEQ ID NO: 15418 - DNA, 21 bp, Artificial sequence
  SiRNA target sequence
ttgatcgtattgctatggaag

SEQ ID NO: 15419 - DNA, 21 bp, Artificial sequence
  SiRNA target sequence
tgatcgtattgctatggaagc

SEQ ID NO: 15420 - DNA, 21 bp, Artificial sequence
  SiRNA target sequence
gatcgtattgctatggaagct

SEQ ID NO: 15421 - DNA, 21 bp, Artificial sequence
  SiRNA target sequence
atcgtattgctatggaagcta

SEQ ID NO: 15422 - DNA, 21 bp, Artificial sequence
  SiRNA target sequence
tcgtattgctatggaagctat

SEQ ID NO: 15423 - DNA, 21 bp, Artificial sequence
  SiRNA target sequence
cgtattgctatggaagctatt

SEQ ID NO: 15424 - DNA, 21 bp, Artificial sequence
  SiRNA target sequence
gtattgctatggaagctattt

SEQ ID NO: 15425 - DNA, 21 bp, Artificial sequence
  SiRNA target sequence
tattgctatggaagctattta

SEQ ID NO: 15426 - DNA, 21 bp, Artificial sequence
  SiRNA target sequence
attgctatggaagctatttat

SEQ ID NO: 15427 - DNA, 21 bp, Artificial sequence
  SiRNA target sequence
ttgctatggaagctatttatc

SEQ ID NO: 15428 - DNA, 21 bp, Artificial sequence
  SiRNA target sequence
tgctatggaagctatttatcg

SEQ ID NO: 15429 - DNA, 21 bp, Artificial sequence
  SiRNA target sequence
gctatggaagctatttatcgg

SEQ ID NO: 15430 - DNA, 21 bp, Artificial sequence
  SiRNA target sequence
ctatggaagctatttatcggc

SEQ ID NO: 15431 - DNA, 21 bp, Artificial sequence
  SiRNA target sequence
tatggaagctatttatcggcg

SEQ ID NO: 15432 - DNA, 21 bp, Artificial sequence
  SiRNA target sequence
atggaagctatttatcggcgt

SEQ ID NO: 15433 - DNA, 21 bp, Artificial sequence
  SiRNA target sequence
tggaagctatttatcggcgta

SEQ ID NO: 15434 - DNA, 21 bp, Artificial sequence
  SiRNA target sequence
ggaagctatttatcggcgtag

SEQ ID NO: 15435 - DNA, 21 bp, Artificial sequence
  SiRNA target sequence
gaagctatttatcggcgtaga

SEQ ID NO: 15436 - DNA, 21 bp, Artificial sequence
  SiRNA target sequence
aagctatttatcggcgtagaa

SEQ ID NO: 15437 - DNA, 21 bp, Artificial sequence
  SiRNA target sequence
agctatttatcggcgtagaaa

SEQ ID NO: 15438 - DNA, 21 bp, Artificial sequence
  SiRNA target sequence
gctatttatcggcgtagaaat

SEQ ID NO: 15439 - DNA, 21 bp, Artificial sequence
  SiRNA target sequence
ctatttatcggcgtagaaatg

SEQ ID NO: 15440 - DNA, 21 bp, Artificial sequence
  SiRNA target sequence
tatttatcggcgtagaaatgt

SEQ ID NO: 15441 - DNA, 21 bp, Artificial sequence
  SiRNA target sequence
atttatcggcgtagaaatgtt

SEQ ID NO: 15442 - DNA, 21 bp, Artificial sequence
  SiRNA target sequence
tttatcggcgtagaaatgttt

SEQ ID NO: 15443 - DNA, 21 bp, Artificial sequence
  SiRNA target sequence
ttatcggcgtagaaatgtttt

SEQ ID NO: 15444 - DNA, 21 bp, Artificial sequence
  SiRNA target sequence
tatcggcgtagaaatgttttg

SEQ ID NO: 15445 - DNA, 21 bp, Artificial sequence
  SiRNA target sequence
atcggcgtagaaatgttttga

SEQ ID NO: 15446 - DNA, 21 bp, Artificial sequence
  SiRNA target sequence
tcggcgtagaaatgttttgat

SEQ ID NO: 15447 - DNA, 21 bp, Artificial sequence
  SiRNA target sequence
cggcgtagaaatgttttgatt

SEQ ID NO: 15448 - DNA, 21 bp, Artificial sequence
  SiRNA target sequence
ggcgtagaaatgttttgattg

SEQ ID NO: 15449 - DNA, 21 bp, Artificial sequence
  SiRNA target sequence
gcgtagaaatgttttgattga

SEQ ID NO: 15450 - DNA, 21 bp, Artificial sequence
  SiRNA target sequence
cgtagaaatgttttgattgaa

SEQ ID NO: 15451 - DNA, 21 bp, Artificial sequence
  SiRNA target sequence
gtagaaatgttttgattgaat

SEQ ID NO: 15452 - DNA, 21 bp, Artificial sequence
  SiRNA target sequence
tagaaatgttttgattgaatg

SEQ ID NO: 15453 - DNA, 21 bp, Artificial sequence
  SiRNA target sequence
agaaatgttttgattgaatgt

SEQ ID NO: 15454 - DNA, 21 bp, Artificial sequence
  SiRNA target sequence
gaaatgttttgattgaatgta

SEQ ID NO: 15455 - DNA, 21 bp, Artificial sequence
  SiRNA target sequence
aaatgttttgattgaatgtaa

SEQ ID NO: 15456 - DNA, 21 bp, Artificial sequence
  SiRNA target sequence
aatgttttgattgaatgtaaa

SEQ ID NO: 15457 - DNA, 21 bp, Artificial sequence
  SiRNA target sequence
atgttttgattgaatgtaaag

SEQ ID NO: 15458 - DNA, 21 bp, Artificial sequence
  SiRNA target sequence
tgttttgattgaatgtaaagc

SEQ ID NO: 15459 - DNA, 21 bp, Artificial sequence
  SiRNA target sequence
gttttgattgaatgtaaagcg

SEQ ID NO: 15460 - DNA, 21 bp, Artificial sequence
  SiRNA target sequence
ttttgattgaatgtaaagcga

SEQ ID NO: 15461 - DNA, 21 bp, Artificial sequence
  SiRNA target sequence
tttgattgaatgtaaagcgag

SEQ ID NO: 15462 - DNA, 21 bp, Artificial sequence
  SiRNA target sequence
ttgattgaatgtaaagcgagt

SEQ ID NO: 15463 - DNA, 21 bp, Artificial sequence
  SiRNA target sequence
tgattgaatgtaaagcgagtg

SEQ ID NO: 15464 - DNA, 21 bp, Artificial sequence
  SiRNA target sequence
gattgaatgtaaagcgagtga

SEQ ID NO: 15465 - DNA, 21 bp, Artificial sequence
  SiRNA target sequence
attgaatgtaaagcgagtgaa

SEQ ID NO: 15466 - DNA, 21 bp, Artificial sequence
  SiRNA target sequence
ttgaatgtaaagcgagtgaag

SEQ ID NO: 15467 - DNA, 21 bp, Artificial sequence
  SiRNA target sequence
tgaatgtaaagcgagtgaaga

SEQ ID NO: 15468 - DNA, 21 bp, Artificial sequence
  SiRNA target sequence
gaatgtaaagcgagtgaagag

SEQ ID NO: 15469 - DNA, 21 bp, Artificial sequence
  SiRNA target sequence
aatgtaaagcgagtgaagaga

SEQ ID NO: 15470 - DNA, 21 bp, Artificial sequence
  SiRNA target sequence
atgtaaagcgagtgaagagaa

SEQ ID NO: 15471 - DNA, 21 bp, Artificial sequence
  SiRNA target sequence
tgtaaagcgagtgaagagaag

SEQ ID NO: 15472 - DNA, 21 bp, Artificial sequence
  SiRNA target sequence
gtaaagcgagtgaagagaaga

SEQ ID NO: 15473 - DNA, 21 bp, Artificial sequence
  SiRNA target sequence
taaagcgagtgaagagaagaa

SEQ ID NO: 15474 - DNA, 21 bp, Artificial sequence
  SiRNA target sequence
aaagcgagtgaagagaagaag

SEQ ID NO: 15475 - DNA, 21 bp, Artificial sequence
  SiRNA target sequence
aagcgagtgaagagaagaagc

SEQ ID NO: 15476 - DNA, 21 bp, Artificial sequence
  SiRNA target sequence
agcgagtgaagagaagaagcg

SEQ ID NO: 15477 - DNA, 21 bp, Artificial sequence
  SiRNA target sequence
gcgagtgaagagaagaagcga

SEQ ID NO: 15478 - DNA, 21 bp, Artificial sequence
  SiRNA target sequence
cgagtgaagagaagaagcgag

SEQ ID NO: 15479 - DNA, 21 bp, Artificial sequence
  SiRNA target sequence
gagtgaagagaagaagcgagg

SEQ ID NO: 15480 - DNA, 21 bp, Artificial sequence
  SiRNA target sequence
agtgaagagaagaagcgagga

SEQ ID NO: 15481 - DNA, 21 bp, Artificial sequence
  SiRNA target sequence
gtgaagagaagaagcgaggat

SEQ ID NO: 15482 - DNA, 21 bp, Artificial sequence
  SiRNA target sequence
tgaagagaagaagcgaggatg

SEQ ID NO: 15483 - DNA, 21 bp, Artificial sequence
  SiRNA target sequence
gaagagaagaagcgaggatgt

SEQ ID NO: 15484 - DNA, 21 bp, Artificial sequence
  SiRNA target sequence
aagagaagaagcgaggatgta

SEQ ID NO: 15485 - DNA, 21 bp, Artificial sequence
  SiRNA target sequence
agagaagaagcgaggatgtaa

SEQ ID NO: 15486 - DNA, 21 bp, Artificial sequence
  SiRNA target sequence
gagaagaagcgaggatgtaag

SEQ ID NO: 15487 - DNA, 21 bp, Artificial sequence
  SiRNA target sequence
agaagaagcgaggatgtaagc

SEQ ID NO: 15488 - DNA, 21 bp, Artificial sequence
  SiRNA target sequence
gaagaagcgaggatgtaagca

SEQ ID NO: 15489 - DNA, 21 bp, Artificial sequence
  SiRNA target sequence
aagaagcgaggatgtaagcat

SEQ ID NO: 15490 - DNA, 21 bp, Artificial sequence
  SiRNA target sequence
agaagcgaggatgtaagcatt

SEQ ID NO: 15491 - DNA, 21 bp, Artificial sequence
  SiRNA target sequence
gaagcgaggatgtaagcattg

SEQ ID NO: 15492 - DNA, 21 bp, Artificial sequence
  SiRNA target sequence
aagcgaggatgtaagcattgt

SEQ ID NO: 15493 - DNA, 21 bp, Artificial sequence
  SiRNA target sequence
agcgaggatgtaagcattgtg

SEQ ID NO: 15494 - DNA, 21 bp, Artificial sequence
  SiRNA target sequence
gcgaggatgtaagcattgtga

SEQ ID NO: 15495 - DNA, 21 bp, Artificial sequence
  SiRNA target sequence
cgaggatgtaagcattgtgag

SEQ ID NO: 15496 - DNA, 21 bp, Artificial sequence
  SiRNA target sequence
gaggatgtaagcattgtgaga

SEQ ID NO: 15497 - DNA, 21 bp, Artificial sequence
  SiRNA target sequence
aggatgtaagcattgtgagaa

SEQ ID NO: 15498 - DNA, 21 bp, Artificial sequence
  SiRNA target sequence
ggatgtaagcattgtgagaat

SEQ ID NO: 15499 - DNA, 21 bp, Artificial sequence
  SiRNA target sequence
gatgtaagcattgtgagaatg

SEQ ID NO: 15500 - DNA, 21 bp, Artificial sequence
  SiRNA target sequence
atgtaagcattgtgagaatga

SEQ ID NO: 15501 - DNA, 21 bp, Artificial sequence
  SiRNA target sequence
tgtaagcattgtgagaatgat

SEQ ID NO: 15502 - DNA, 21 bp, Artificial sequence
  SiRNA target sequence
gtaagcattgtgagaatgata

SEQ ID NO: 15503 - DNA, 21 bp, Artificial sequence
  SiRNA target sequence
taagcattgtgagaatgatat

SEQ ID NO: 15504 - DNA, 21 bp, Artificial sequence
  SiRNA target sequence
aagcattgtgagaatgatatt

SEQ ID NO: 15505 - DNA, 21 bp, Artificial sequence
  SiRNA target sequence
agcattgtgagaatgatattc

SEQ ID NO: 15506 - DNA, 21 bp, Artificial sequence
  SiRNA target sequence
gcattgtgagaatgatattcc

SEQ ID NO: 15507 - DNA, 21 bp, Artificial sequence
  SiRNA target sequence
cattgtgagaatgatattcct

SEQ ID NO: 15508 - DNA, 21 bp, Artificial sequence
  SiRNA target sequence
attgtgagaatgatattccta

SEQ ID NO: 15509 - DNA, 21 bp, Artificial sequence
  SiRNA target sequence
ttgtgagaatgatattcctat

SEQ ID NO: 15510 - DNA, 21 bp, Artificial sequence
  SiRNA target sequence
tgtgagaatgatattcctatt

SEQ ID NO: 15511 - DNA, 21 bp, Artificial sequence
  SiRNA target sequence
gtgagaatgatattcctattg

SEQ ID NO: 15512 - DNA, 21 bp, Artificial sequence
  SiRNA target sequence
tgagaatgatattcctattgc

SEQ ID NO: 15513 - DNA, 21 bp, Artificial sequence
  SiRNA target sequence
gagaatgatattcctattgct

SEQ ID NO: 15514 - DNA, 21 bp, Artificial sequence
  SiRNA target sequence
agaatgatattcctattgctg

SEQ ID NO: 15515 - DNA, 21 bp, Artificial sequence
  SiRNA target sequence
gaatgatattcctattgctga

SEQ ID NO: 15516 - DNA, 21 bp, Artificial sequence
  SiRNA target sequence
aatgatattcctattgctgaa

SEQ ID NO: 15517 - DNA, 21 bp, Artificial sequence
  SiRNA target sequence
atgatattcctattgctgaat

SEQ ID NO: 15518 - DNA, 21 bp, Artificial sequence
  SiRNA target sequence
tgatattcctattgctgaatg

SEQ ID NO: 15519 - DNA, 21 bp, Artificial sequence
  SiRNA target sequence
gatattcctattgctgaatgt

SEQ ID NO: 15520 - DNA, 21 bp, Artificial sequence
  SiRNA target sequence
atattcctattgctgaatgta

SEQ ID NO: 15521 - DNA, 21 bp, Artificial sequence
  SiRNA target sequence
tattcctattgctgaatgtag

SEQ ID NO: 15522 - DNA, 21 bp, Artificial sequence
  SiRNA target sequence
attcctattgctgaatgtagt

SEQ ID NO: 15523 - DNA, 21 bp, Artificial sequence
  SiRNA target sequence
ttcctattgctgaatgtagtc

SEQ ID NO: 15524 - DNA, 21 bp, Artificial sequence
  SiRNA target sequence
tcctattgctgaatgtagtcc

SEQ ID NO: 15525 - DNA, 21 bp, Artificial sequence
  SiRNA target sequence
cctattgctgaatgtagtcct

SEQ ID NO: 15526 - DNA, 21 bp, Artificial sequence
  SiRNA target sequence
ctattgctgaatgtagtccta

SEQ ID NO: 15527 - DNA, 21 bp, Artificial sequence
  SiRNA target sequence
tattgctgaatgtagtcctaa

SEQ ID NO: 15528 - DNA, 21 bp, Artificial sequence
  SiRNA target sequence
attgctgaatgtagtcctaag

SEQ ID NO: 15529 - DNA, 21 bp, Artificial sequence
  SiRNA target sequence
ttgctgaatgtagtcctaaga

SEQ ID NO: 15530 - DNA, 21 bp, Artificial sequence
  SiRNA target sequence
tgctgaatgtagtcctaagat

SEQ ID NO: 15531 - DNA, 21 bp, Artificial sequence
  SiRNA target sequence
gctgaatgtagtcctaagatg

SEQ ID NO: 15532 - DNA, 21 bp, Artificial sequence
  SiRNA target sequence
ctgaatgtagtcctaagatgt

SEQ ID NO: 15533 - DNA, 21 bp, Artificial sequence
  SiRNA target sequence
tgaatgtagtcctaagatgtt

SEQ ID NO: 15534 - DNA, 21 bp, Artificial sequence
  SiRNA target sequence
gaatgtagtcctaagatgttg

SEQ ID NO: 15535 - DNA, 21 bp, Artificial sequence
  SiRNA target sequence
aatgtagtcctaagatgttga

SEQ ID NO: 15536 - DNA, 21 bp, Artificial sequence
  SiRNA target sequence
atgtagtcctaagatgttgaa

SEQ ID NO: 15537 - DNA, 21 bp, Artificial sequence
  SiRNA target sequence
tgtagtcctaagatgttgaaa

SEQ ID NO: 15538 - DNA, 21 bp, Artificial sequence
  SiRNA target sequence
gtagtcctaagatgttgaaag

SEQ ID NO: 15539 - DNA, 21 bp, Artificial sequence
  SiRNA target sequence
tagtcctaagatgttgaaaga

SEQ ID NO: 15540 - DNA, 21 bp, Artificial sequence
  SiRNA target sequence
agtcctaagatgttgaaagat

SEQ ID NO: 15541 - DNA, 21 bp, Artificial sequence
  SiRNA target sequence
gtcctaagatgttgaaagatt

SEQ ID NO: 15542 - DNA, 21 bp, Artificial sequence
  SiRNA target sequence
tcctaagatgttgaaagattt

SEQ ID NO: 15543 - DNA, 21 bp, Artificial sequence
  SiRNA target sequence
cctaagatgttgaaagatttt

SEQ ID NO: 15544 - DNA, 21 bp, Artificial sequence
  SiRNA target sequence
ctaagatgttgaaagattttc

SEQ ID NO: 15545 - DNA, 21 bp, Artificial sequence
  SiRNA target sequence
taagatgttgaaagattttca

SEQ ID NO: 15546 - DNA, 21 bp, Artificial sequence
  SiRNA target sequence
aagatgttgaaagattttcat

SEQ ID NO: 15547 - DNA, 21 bp, Artificial sequence
  SiRNA target sequence
agatgttgaaagattttcatc

SEQ ID NO: 15548 - DNA, 21 bp, Artificial sequence
  SiRNA target sequence
gatgttgaaagattttcatca

SEQ ID NO: 15549 - DNA, 21 bp, Artificial sequence
  SiRNA target sequence
atgttgaaagattttcatcat

SEQ ID NO: 15550 - DNA, 21 bp, Artificial sequence
  SiRNA target sequence
tgttgaaagattttcatcata

SEQ ID NO: 15551 - DNA, 21 bp, Artificial sequence
  SiRNA target sequence
gttgaaagattttcatcatat

SEQ ID NO: 15552 - DNA, 21 bp, Artificial sequence
  SiRNA target sequence
ttgaaagattttcatcatatt

SEQ ID NO: 15553 - DNA, 21 bp, Artificial sequence
  SiRNA target sequence
tgaaagattttcatcatatta

SEQ ID NO: 15554 - DNA, 21 bp, Artificial sequence
  SiRNA target sequence
gaaagattttcatcatattaa

SEQ ID NO: 15555 - DNA, 21 bp, Artificial sequence
  SiRNA target sequence
aaagattttcatcatattaaa

SEQ ID NO: 15556 - DNA, 21 bp, Artificial sequence
  SiRNA target sequence
aagattttcatcatattaaat

SEQ ID NO: 15557 - DNA, 21 bp, Artificial sequence
  SiRNA target sequence
agattttcatcatattaaatt

SEQ ID NO: 15558 - DNA, 21 bp, Artificial sequence
  SiRNA target sequence
gattttcatcatattaaattt

SEQ ID NO: 15559 - DNA, 21 bp, Artificial sequence
  SiRNA target sequence
attttcatcatattaaattta

SEQ ID NO: 15560 - DNA, 21 bp, Artificial sequence
  SiRNA target sequence
ttttcatcatattaaatttag

SEQ ID NO: 15561 - DNA, 21 bp, Artificial sequence
  SiRNA target sequence
tttcatcatattaaatttagg

SEQ ID NO: 15562 - DNA, 21 bp, Artificial sequence
  SiRNA target sequence
ttcatcatattaaatttaggt

SEQ ID NO: 15563 - DNA, 21 bp, Artificial sequence
  SiRNA target sequence
tcatcatattaaatttaggta

SEQ ID NO: 15564 - DNA, 21 bp, Artificial sequence
  SiRNA target sequence
catcatattaaatttaggtat

SEQ ID NO: 15565 - DNA, 21 bp, Artificial sequence
  SiRNA target sequence
atcatattaaatttaggtatg

SEQ ID NO: 15566 - DNA, 21 bp, Artificial sequence
  SiRNA target sequence
tcatattaaatttaggtatgc

SEQ ID NO: 15567 - DNA, 21 bp, Artificial sequence
  SiRNA target sequence
catattaaatttaggtatgcg

SEQ ID NO: 15568 - DNA, 21 bp, Artificial sequence
  SiRNA target sequence
atattaaatttaggtatgcgc

SEQ ID NO: 15569 - DNA, 21 bp, Artificial sequence
  SiRNA target sequence
tattaaatttaggtatgcgca

SEQ ID NO: 15570 - DNA, 21 bp, Artificial sequence
  SiRNA target sequence
attaaatttaggtatgcgcat

SEQ ID NO: 15571 - DNA, 21 bp, Artificial sequence
  SiRNA target sequence
ttaaatttaggtatgcgcatg

SEQ ID NO: 15572 - DNA, 21 bp, Artificial sequence
  SiRNA target sequence
taaatttaggtatgcgcatga

SEQ ID NO: 15573 - DNA, 21 bp, Artificial sequence
  SiRNA target sequence
aaatttaggtatgcgcatgat

SEQ ID NO: 15574 - DNA, 21 bp, Artificial sequence
  SiRNA target sequence
aatttaggtatgcgcatgatg

SEQ ID NO: 15575 - DNA, 21 bp, Artificial sequence
  SiRNA target sequence
atttaggtatgcgcatgatgt

SEQ ID NO: 15576 - DNA, 21 bp, Artificial sequence
  SiRNA target sequence
tttaggtatgcgcatgatgta

SEQ ID NO: 15577 - DNA, 21 bp, Artificial sequence
  SiRNA target sequence
ttaggtatgcgcatgatgtat

SEQ ID NO: 15578 - DNA, 21 bp, Artificial sequence
  SiRNA target sequence
taggtatgcgcatgatgtatg

SEQ ID NO: 15579 - DNA, 21 bp, Artificial sequence
  SiRNA target sequence
aggtatgcgcatgatgtatgt

SEQ ID NO: 15580 - DNA, 21 bp, Artificial sequence
  SiRNA target sequence
ggtatgcgcatgatgtatgta

SEQ ID NO: 15581 - DNA, 21 bp, Artificial sequence
  SiRNA target sequence
gtatgcgcatgatgtatgtaa

SEQ ID NO: 15582 - DNA, 21 bp, Artificial sequence
  SiRNA target sequence
tatgcgcatgatgtatgtaat

SEQ ID NO: 15583 - DNA, 21 bp, Artificial sequence
  SiRNA target sequence
atgcgcatgatgtatgtaatt

SEQ ID NO: 15584 - DNA, 21 bp, Artificial sequence
  SiRNA target sequence
tgcgcatgatgtatgtaattc

SEQ ID NO: 15585 - DNA, 21 bp, Artificial sequence
  SiRNA target sequence
gcgcatgatgtatgtaattcc

SEQ ID NO: 15586 - DNA, 21 bp, Artificial sequence
  SiRNA target sequence
cgcatgatgtatgtaattccg

SEQ ID NO: 15587 - DNA, 21 bp, Artificial sequence
  SiRNA target sequence
gcatgatgtatgtaattccga

SEQ ID NO: 15588 - DNA, 21 bp, Artificial sequence
  SiRNA target sequence
catgatgtatgtaattccgag

SEQ ID NO: 15589 - DNA, 21 bp, Artificial sequence
  SiRNA target sequence
atgatgtatgtaattccgaga

SEQ ID NO: 15590 - DNA, 21 bp, Artificial sequence
  SiRNA target sequence
tgatgtatgtaattccgagac

SEQ ID NO: 15591 - DNA, 21 bp, Artificial sequence
  SiRNA target sequence
gatgtatgtaattccgagacc

SEQ ID NO: 15592 - DNA, 21 bp, Artificial sequence
  SiRNA target sequence
atgtatgtaattccgagacca

SEQ ID NO: 15593 - DNA, 21 bp, Artificial sequence
  SiRNA target sequence
tgtatgtaattccgagaccac

SEQ ID NO: 15594 - DNA, 21 bp, Artificial sequence
  SiRNA target sequence
gtatgtaattccgagaccaca

SEQ ID NO: 15595 - DNA, 21 bp, Artificial sequence
  SiRNA target sequence
tatgtaattccgagaccacat

SEQ ID NO: 15596 - DNA, 21 bp, Artificial sequence
  SiRNA target sequence
atgtaattccgagaccacatg

SEQ ID NO: 15597 - DNA, 21 bp, Artificial sequence
  SiRNA target sequence
tgtaattccgagaccacatgg

SEQ ID NO: 15598 - DNA, 21 bp, Artificial sequence
  SiRNA target sequence
gtaattccgagaccacatggt

SEQ ID NO: 15599 - DNA, 21 bp, Artificial sequence
  SiRNA target sequence
taattccgagaccacatggtc

SEQ ID NO: 15600 - DNA, 21 bp, Artificial sequence
  SiRNA target sequence
aattccgagaccacatggtct

SEQ ID NO: 15601 - DNA, 21 bp, Artificial sequence
  SiRNA target sequence
attccgagaccacatggtctg

SEQ ID NO: 15602 - DNA, 21 bp, Artificial sequence
  SiRNA target sequence
ttccgagaccacatggtctga

SEQ ID NO: 15603 - DNA, 21 bp, Artificial sequence
  SiRNA target sequence
tccgagaccacatggtctgaa

SEQ ID NO: 15604 - DNA, 21 bp, Artificial sequence
  SiRNA target sequence
ccgagaccacatggtctgaat

SEQ ID NO: 15605 - DNA, 21 bp, Artificial sequence
  SiRNA target sequence
cgagaccacatggtctgaatg

SEQ ID NO: 15606 - DNA, 21 bp, Artificial sequence
  SiRNA target sequence
gagaccacatggtctgaatgg

SEQ ID NO: 15607 - DNA, 21 bp, Artificial sequence
  SiRNA target sequence
agaccacatggtctgaatgga

SEQ ID NO: 15608 - DNA, 21 bp, Artificial sequence
  SiRNA target sequence
gaccacatggtctgaatggat

SEQ ID NO: 15609 - DNA, 21 bp, Artificial sequence
  SiRNA target sequence
accacatggtctgaatggatg

SEQ ID NO: 15610 - DNA, 21 bp, Artificial sequence
  SiRNA target sequence
ccacatggtctgaatggatga

SEQ ID NO: 15611 - DNA, 21 bp, Artificial sequence
  SiRNA target sequence
cacatggtctgaatggatgac

SEQ ID NO: 15612 - DNA, 21 bp, Artificial sequence
  SiRNA target sequence
acatggtctgaatggatgacg

SEQ ID NO: 15613 - DNA, 21 bp, Artificial sequence
  SiRNA target sequence
catggtctgaatggatgacgt

SEQ ID NO: 15614 - DNA, 21 bp, Artificial sequence
  SiRNA target sequence
atggtctgaatggatgacgta

SEQ ID NO: 15615 - DNA, 21 bp, Artificial sequence
  SiRNA target sequence
tggtctgaatggatgacgtat

SEQ ID NO: 15616 - DNA, 21 bp, Artificial sequence
  SiRNA target sequence
ggtctgaatggatgacgtata

SEQ ID NO: 15617 - DNA, 21 bp, Artificial sequence
  SiRNA target sequence
gtctgaatggatgacgtataa

SEQ ID NO: 15618 - DNA, 21 bp, Artificial sequence
  SiRNA target sequence
tctgaatggatgacgtataat

SEQ ID NO: 15619 - DNA, 21 bp, Artificial sequence
  SiRNA target sequence
ctgaatggatgacgtataatg

SEQ ID NO: 15620 - DNA, 21 bp, Artificial sequence
  SiRNA target sequence
tgaatggatgacgtataatga

SEQ ID NO: 15621 - DNA, 21 bp, Artificial sequence
  SiRNA target sequence
gaatggatgacgtataatgaa

SEQ ID NO: 15622 - DNA, 21 bp, Artificial sequence
  SiRNA target sequence
aatggatgacgtataatgaat

SEQ ID NO: 15623 - DNA, 21 bp, Artificial sequence
  SiRNA target sequence
atggatgacgtataatgaatt

SEQ ID NO: 15624 - DNA, 21 bp, Artificial sequence
  SiRNA target sequence
tggatgacgtataatgaattt

SEQ ID NO: 15625 - DNA, 21 bp, Artificial sequence
  SiRNA target sequence
ggatgacgtataatgaatttc

SEQ ID NO: 15626 - DNA, 21 bp, Artificial sequence
  SiRNA target sequence
gatgacgtataatgaatttct

SEQ ID NO: 15627 - DNA, 21 bp, Artificial sequence
  SiRNA target sequence
atgacgtataatgaatttctt

SEQ ID NO: 15628 - DNA, 21 bp, Artificial sequence
  SiRNA target sequence
tgacgtataatgaatttcttg

SEQ ID NO: 15629 - DNA, 21 bp, Artificial sequence
  SiRNA target sequence
gacgtataatgaatttcttga

SEQ ID NO: 15630 - DNA, 21 bp, Artificial sequence
  SiRNA target sequence
acgtataatgaatttcttgaa

SEQ ID NO: 15631 - DNA, 21 bp, Artificial sequence
  SiRNA target sequence
cgtataatgaatttcttgaat

SEQ ID NO: 15632 - DNA, 21 bp, Artificial sequence
  SiRNA target sequence
gtataatgaatttcttgaatg

SEQ ID NO: 15633 - DNA, 21 bp, Artificial sequence
  SiRNA target sequence
tataatgaatttcttgaatgg

SEQ ID NO: 15634 - DNA, 21 bp, Artificial sequence
  SiRNA target sequence
ataatgaatttcttgaatgga

SEQ ID NO: 15635 - DNA, 21 bp, Artificial sequence
  SiRNA target sequence
taatgaatttcttgaatggat

SEQ ID NO: 15636 - DNA, 21 bp, Artificial sequence
  SiRNA target sequence
aatgaatttcttgaatggata

SEQ ID NO: 15637 - DNA, 21 bp, Artificial sequence
  SiRNA target sequence
atgaatttcttgaatggataa

SEQ ID NO: 15638 - DNA, 21 bp, Artificial sequence
  SiRNA target sequence
tgaatttcttgaatggataac

SEQ ID NO: 15639 - DNA, 21 bp, Artificial sequence
  SiRNA target sequence
gaatttcttgaatggataact

SEQ ID NO: 15640 - DNA, 21 bp, Artificial sequence
  SiRNA target sequence
aatttcttgaatggataactc

SEQ ID NO: 15641 - DNA, 21 bp, Artificial sequence
  SiRNA target sequence
atttcttgaatggataactcc

SEQ ID NO: 15642 - DNA, 21 bp, Artificial sequence
  SiRNA target sequence
tttcttgaatggataactcct

SEQ ID NO: 15643 - DNA, 21 bp, Artificial sequence
  SiRNA target sequence
ttcttgaatggataactcctg

SEQ ID NO: 15644 - DNA, 21 bp, Artificial sequence
  SiRNA target sequence
tcttgaatggataactcctgt

SEQ ID NO: 15645 - DNA, 21 bp, Artificial sequence
  SiRNA target sequence
cttgaatggataactcctgtg

SEQ ID NO: 15646 - DNA, 21 bp, Artificial sequence
  SiRNA target sequence
ttgaatggataactcctgtgt

SEQ ID NO: 15647 - DNA, 21 bp, Artificial sequence
  SiRNA target sequence
tgaatggataactcctgtgta

SEQ ID NO: 15648 - DNA, 21 bp, Artificial sequence
  SiRNA target sequence
gaatggataactcctgtgtat

SEQ ID NO: 15649 - DNA, 21 bp, Artificial sequence
  SiRNA target sequence
aatggataactcctgtgtata

SEQ ID NO: 15650 - DNA, 21 bp, Artificial sequence
  SiRNA target sequence
atggataactcctgtgtatat

SEQ ID NO: 15651 - DNA, 21 bp, Artificial sequence
  SiRNA target sequence
tggataactcctgtgtatatg

SEQ ID NO: 15652 - DNA, 21 bp, Artificial sequence
  SiRNA target sequence
ggataactcctgtgtatatgg

SEQ ID NO: 15653 - DNA, 21 bp, Artificial sequence
  SiRNA target sequence
gataactcctgtgtatatggc

SEQ ID NO: 15654 - DNA, 21 bp, Artificial sequence
  SiRNA target sequence
ataactcctgtgtatatggct

SEQ ID NO: 15655 - DNA, 21 bp, Artificial sequence
  SiRNA target sequence
taactcctgtgtatatggcta

SEQ ID NO: 15656 - DNA, 21 bp, Artificial sequence
  SiRNA target sequence
aactcctgtgtatatggctaa

SEQ ID NO: 15657 - DNA, 21 bp, Artificial sequence
  SiRNA target sequence
actcctgtgtatatggctaac

SEQ ID NO: 15658 - DNA, 21 bp, Artificial sequence
  SiRNA target sequence
ctcctgtgtatatggctaacc

SEQ ID NO: 15659 - DNA, 21 bp, Artificial sequence
  SiRNA target sequence
tcctgtgtatatggctaaccg

SEQ ID NO: 15660 - DNA, 21 bp, Artificial sequence
  SiRNA target sequence
cctgtgtatatggctaaccgt

SEQ ID NO: 15661 - DNA, 21 bp, Artificial sequence
  SiRNA target sequence
ctgtgtatatggctaaccgtc

SEQ ID NO: 15662 - DNA, 21 bp, Artificial sequence
  SiRNA target sequence
tgtgtatatggctaaccgtcg

SEQ ID NO: 15663 - DNA, 21 bp, Artificial sequence
  SiRNA target sequence
gtgtatatggctaaccgtcgt

SEQ ID NO: 15664 - DNA, 21 bp, Artificial sequence
  SiRNA target sequence
tgtatatggctaaccgtcgta

SEQ ID NO: 15665 - DNA, 21 bp, Artificial sequence
  SiRNA target sequence
gtatatggctaaccgtcgtaa

SEQ ID NO: 15666 - DNA, 21 bp, Artificial sequence
  SiRNA target sequence
tatatggctaaccgtcgtaag

SEQ ID NO: 15667 - DNA, 21 bp, Artificial sequence
  SiRNA target sequence
atatggctaaccgtcgtaagg

SEQ ID NO: 15668 - DNA, 21 bp, Artificial sequence
  SiRNA target sequence
tatggctaaccgtcgtaaggc

SEQ ID NO: 15669 - DNA, 21 bp, Artificial sequence
  SiRNA target sequence
atggctaaccgtcgtaaggcg

SEQ ID NO: 15670 - DNA, 21 bp, Artificial sequence
  SiRNA target sequence
tggctaaccgtcgtaaggcga

SEQ ID NO: 15671 - DNA, 21 bp, Artificial sequence
  SiRNA target sequence
ggctaaccgtcgtaaggcgaa

SEQ ID NO: 15672 - DNA, 21 bp, Artificial sequence
  SiRNA target sequence
gctaaccgtcgtaaggcgaat

SEQ ID NO: 15673 - DNA, 21 bp, Artificial sequence
  SiRNA target sequence
ctaaccgtcgtaaggcgaatg

SEQ ID NO: 15674 - DNA, 21 bp, Artificial sequence
  SiRNA target sequence
taaccgtcgtaaggcgaatga

SEQ ID NO: 15675 - DNA, 21 bp, Artificial sequence
  SiRNA target sequence
aaccgtcgtaaggcgaatgaa

SEQ ID NO: 15676 - DNA, 21 bp, Artificial sequence
  SiRNA target sequence
accgtcgtaaggcgaatgaat

SEQ ID NO: 15677 - DNA, 21 bp, Artificial sequence
  SiRNA target sequence
ccgtcgtaaggcgaatgaatc

SEQ ID NO: 15678 - DNA, 21 bp, Artificial sequence
  SiRNA target sequence
cgtcgtaaggcgaatgaatcg

SEQ ID NO: 15679 - DNA, 21 bp, Artificial sequence
  SiRNA target sequence
gtcgtaaggcgaatgaatcgt

SEQ ID NO: 15680 - DNA, 21 bp, Artificial sequence
  SiRNA target sequence
tcgtaaggcgaatgaatcgtt

SEQ ID NO: 15681 - DNA, 21 bp, Artificial sequence
  SiRNA target sequence
cgtaaggcgaatgaatcgttt

SEQ ID NO: 15682 - DNA, 21 bp, Artificial sequence
  SiRNA target sequence
gtaaggcgaatgaatcgttta

SEQ ID NO: 15683 - DNA, 21 bp, Artificial sequence
  SiRNA target sequence
taaggcgaatgaatcgtttaa

SEQ ID NO: 15684 - DNA, 21 bp, Artificial sequence
  SiRNA target sequence
aaggcgaatgaatcgtttaag

SEQ ID NO: 15685 - DNA, 21 bp, Artificial sequence
  SiRNA target sequence
aggcgaatgaatcgtttaaga

SEQ ID NO: 15686 - DNA, 21 bp, Artificial sequence
  SiRNA target sequence
ggcgaatgaatcgtttaagat

SEQ ID NO: 15687 - DNA, 21 bp, Artificial sequence
  SiRNA target sequence
gcgaatgaatcgtttaagatg

SEQ ID NO: 15688 - DNA, 21 bp, Artificial sequence
  SiRNA target sequence
cgaatgaatcgtttaagatgc

SEQ ID NO: 15689 - DNA, 21 bp, Artificial sequence
  SiRNA target sequence
gaatgaatcgtttaagatgcg

SEQ ID NO: 15690 - DNA, 21 bp, Artificial sequence
  SiRNA target sequence
aatgaatcgtttaagatgcgt

SEQ ID NO: 15691 - DNA, 21 bp, Artificial sequence
  SiRNA target sequence
atgaatcgtttaagatgcgtg

SEQ ID NO: 15692 - DNA, 21 bp, Artificial sequence
  SiRNA target sequence
tgaatcgtttaagatgcgtgt

SEQ ID NO: 15693 - DNA, 21 bp, Artificial sequence
  SiRNA target sequence
gaatcgtttaagatgcgtgtg

SEQ ID NO: 15694 - DNA, 21 bp, Artificial sequence
  SiRNA target sequence
aatcgtttaagatgcgtgtgg

SEQ ID NO: 15695 - DNA, 21 bp, Artificial sequence
  SiRNA target sequence
atcgtttaagatgcgtgtgga

SEQ ID NO: 15696 - DNA, 21 bp, Artificial sequence
  SiRNA target sequence
tcgtttaagatgcgtgtggat

SEQ ID NO: 15697 - DNA, 21 bp, Artificial sequence
  SiRNA target sequence
cgtttaagatgcgtgtggatg

SEQ ID NO: 15698 - DNA, 21 bp, Artificial sequence
  SiRNA target sequence
gtttaagatgcgtgtggatga

SEQ ID NO: 15699 - DNA, 21 bp, Artificial sequence
  SiRNA target sequence
tttaagatgcgtgtggatgaa

SEQ ID NO: 15700 - DNA, 21 bp, Artificial sequence
  SiRNA target sequence
ttaagatgcgtgtggatgaaa

SEQ ID NO: 15701 - DNA, 21 bp, Artificial sequence
  SiRNA target sequence
taagatgcgtgtggatgaaat

SEQ ID NO: 15702 - DNA, 21 bp, Artificial sequence
  SiRNA target sequence
aagatgcgtgtggatgaaatg

SEQ ID NO: 15703 - DNA, 21 bp, Artificial sequence
  SiRNA target sequence
agatgcgtgtggatgaaatgc

SEQ ID NO: 15704 - DNA, 21 bp, Artificial sequence
  SiRNA target sequence
gatgcgtgtggatgaaatgca

SEQ ID NO: 15705 - DNA, 21 bp, Artificial sequence
  SiRNA target sequence
atgcgtgtggatgaaatgcaa

SEQ ID NO: 15706 - DNA, 21 bp, Artificial sequence
  SiRNA target sequence
tgcgtgtggatgaaatgcaaa

SEQ ID NO: 15707 - DNA, 21 bp, Artificial sequence
  SiRNA target sequence
gcgtgtggatgaaatgcaaat

SEQ ID NO: 15708 - DNA, 21 bp, Artificial sequence
  SiRNA target sequence
cgtgtggatgaaatgcaaatg

SEQ ID NO: 15709 - DNA, 21 bp, Artificial sequence
  SiRNA target sequence
gtgtggatgaaatgcaaatgt

SEQ ID NO: 15710 - DNA, 21 bp, Artificial sequence
  SiRNA target sequence
tgtggatgaaatgcaaatgtt

SEQ ID NO: 15711 - DNA, 21 bp, Artificial sequence
  SiRNA target sequence
gtggatgaaatgcaaatgtta

SEQ ID NO: 15712 - DNA, 21 bp, Artificial sequence
  SiRNA target sequence
tggatgaaatgcaaatgttac

SEQ ID NO: 15713 - DNA, 21 bp, Artificial sequence
  SiRNA target sequence
ggatgaaatgcaaatgttacg

SEQ ID NO: 15714 - DNA, 21 bp, Artificial sequence
  SiRNA target sequence
gatgaaatgcaaatgttacgt

SEQ ID NO: 15715 - DNA, 21 bp, Artificial sequence
  SiRNA target sequence
atgaaatgcaaatgttacgta

SEQ ID NO: 15716 - DNA, 21 bp, Artificial sequence
  SiRNA target sequence
tgaaatgcaaatgttacgtat

SEQ ID NO: 15717 - DNA, 21 bp, Artificial sequence
  SiRNA target sequence
gaaatgcaaatgttacgtatg

SEQ ID NO: 15718 - DNA, 21 bp, Artificial sequence
  SiRNA target sequence
aaatgcaaatgttacgtatgg

SEQ ID NO: 15719 - DNA, 21 bp, Artificial sequence
  SiRNA target sequence
aatgcaaatgttacgtatgga

SEQ ID NO: 15720 - DNA, 21 bp, Artificial sequence
  SiRNA target sequence
atgcaaatgttacgtatggat

SEQ ID NO: 15721 - DNA, 21 bp, Artificial sequence
  SiRNA target sequence
tgcaaatgttacgtatggatg

SEQ ID NO: 15722 - DNA, 21 bp, Artificial sequence
  SiRNA target sequence
gcaaatgttacgtatggatga

SEQ ID NO: 15723 - DNA, 21 bp, Artificial sequence
  SiRNA target sequence
caaatgttacgtatggatgaa

SEQ ID NO: 15724 - DNA, 21 bp, Artificial sequence
  SiRNA target sequence
aaatgttacgtatggatgaac

SEQ ID NO: 15725 - DNA, 21 bp, Artificial sequence
  SiRNA target sequence
aatgttacgtatggatgaacc

SEQ ID NO: 15726 - DNA, 21 bp, Artificial sequence
  SiRNA target sequence
atgttacgtatggatgaacca

SEQ ID NO: 15727 - DNA, 21 bp, Artificial sequence
  SiRNA target sequence
tgttacgtatggatgaaccat

SEQ ID NO: 15728 - DNA, 21 bp, Artificial sequence
  SiRNA target sequence
gttacgtatggatgaaccatt

SEQ ID NO: 15729 - DNA, 21 bp, Artificial sequence
  SiRNA target sequence
ttacgtatggatgaaccattg

SEQ ID NO: 15730 - DNA, 21 bp, Artificial sequence
  SiRNA target sequence
tacgtatggatgaaccattgg

SEQ ID NO: 15731 - DNA, 21 bp, Artificial sequence
  SiRNA target sequence
acgtatggatgaaccattgga

SEQ ID NO: 15732 - DNA, 21 bp, Artificial sequence
  SiRNA target sequence
cgtatggatgaaccattggaa

SEQ ID NO: 15733 - DNA, 21 bp, Artificial sequence
  SiRNA target sequence
gtatggatgaaccattggaag

SEQ ID NO: 15734 - DNA, 21 bp, Artificial sequence
  SiRNA target sequence
tatggatgaaccattggaagg

SEQ ID NO: 15735 - DNA, 21 bp, Artificial sequence
  SiRNA target sequence
atggatgaaccattggaaggt

SEQ ID NO: 15736 - DNA, 21 bp, Artificial sequence
  SiRNA target sequence
tggatgaaccattggaaggtg

SEQ ID NO: 15737 - DNA, 21 bp, Artificial sequence
  SiRNA target sequence
ggatgaaccattggaaggtga

SEQ ID NO: 15738 - DNA, 21 bp, Artificial sequence
  SiRNA target sequence
gatgaaccattggaaggtgat

SEQ ID NO: 15739 - DNA, 21 bp, Artificial sequence
  SiRNA target sequence
atgaaccattggaaggtgata

SEQ ID NO: 15740 - DNA, 21 bp, Artificial sequence
  SiRNA target sequence
tgaaccattggaaggtgataa

SEQ ID NO: 15741 - DNA, 21 bp, Artificial sequence
  SiRNA target sequence
gaaccattggaaggtgataat

SEQ ID NO: 15742 - DNA, 21 bp, Artificial sequence
  SiRNA target sequence
aaccattggaaggtgataata

SEQ ID NO: 15743 - DNA, 21 bp, Artificial sequence
  SiRNA target sequence
accattggaaggtgataatat

SEQ ID NO: 15744 - DNA, 21 bp, Artificial sequence
  SiRNA target sequence
ccattggaaggtgataatatt

SEQ ID NO: 15745 - DNA, 21 bp, Artificial sequence
  SiRNA target sequence
cattggaaggtgataatattc

SEQ ID NO: 15746 - DNA, 21 bp, Artificial sequence
  SiRNA target sequence
attggaaggtgataatattct

SEQ ID NO: 15747 - DNA, 21 bp, Artificial sequence
  SiRNA target sequence
ttggaaggtgataatattctc

SEQ ID NO: 15748 - DNA, 21 bp, Artificial sequence
  SiRNA target sequence
tggaaggtgataatattctca

SEQ ID NO: 15749 - DNA, 21 bp, Artificial sequence
  SiRNA target sequence
ggaaggtgataatattctcaa

SEQ ID NO: 15750 - DNA, 21 bp, Artificial sequence
  SiRNA target sequence
gaaggtgataatattctcaat

SEQ ID NO: 15751 - DNA, 21 bp, Artificial sequence
  SiRNA target sequence
aaggtgataatattctcaata

SEQ ID NO: 15752 - DNA, 21 bp, Artificial sequence
  SiRNA target sequence
aggtgataatattctcaataa

SEQ ID NO: 15753 - DNA, 21 bp, Artificial sequence
  SiRNA target sequence
ggtgataatattctcaataag

SEQ ID NO: 15754 - DNA, 21 bp, Artificial sequence
  SiRNA target sequence
gtgataatattctcaataagt

SEQ ID NO: 15755 - DNA, 21 bp, Artificial sequence
  SiRNA target sequence
tgataatattctcaataagta

SEQ ID NO: 15756 - DNA, 21 bp, Artificial sequence
  SiRNA target sequence
gataatattctcaataagtat

SEQ ID NO: 15757 - DNA, 21 bp, Artificial sequence
  SiRNA target sequence
ataatattctcaataagtatg

SEQ ID NO: 15758 - DNA, 21 bp, Artificial sequence
  SiRNA target sequence
taatattctcaataagtatgt

SEQ ID NO: 15759 - DNA, 21 bp, Artificial sequence
  SiRNA target sequence
aatattctcaataagtatgtt

SEQ ID NO: 15760 - DNA, 21 bp, Artificial sequence
  SiRNA target sequence
atattctcaataagtatgttg

SEQ ID NO: 15761 - DNA, 21 bp, Artificial sequence
  SiRNA target sequence
tattctcaataagtatgttga

SEQ ID NO: 15762 - DNA, 21 bp, Artificial sequence
  SiRNA target sequence
attctcaataagtatgttgaa

SEQ ID NO: 15763 - DNA, 21 bp, Artificial sequence
  SiRNA target sequence
ttctcaataagtatgttgaag

SEQ ID NO: 15764 - DNA, 21 bp, Artificial sequence
  SiRNA target sequence
tctcaataagtatgttgaagt

SEQ ID NO: 15765 - DNA, 21 bp, Artificial sequence
  SiRNA target sequence
ctcaataagtatgttgaagtt

SEQ ID NO: 15766 - DNA, 21 bp, Artificial sequence
  SiRNA target sequence
tcaataagtatgttgaagtta

SEQ ID NO: 15767 - DNA, 21 bp, Artificial sequence
  SiRNA target sequence
caataagtatgttgaagttaa

SEQ ID NO: 15768 - DNA, 21 bp, Artificial sequence
  SiRNA target sequence
aataagtatgttgaagttaat

SEQ ID NO: 15769 - DNA, 21 bp, Artificial sequence
  SiRNA target sequence
ataagtatgttgaagttaatc

SEQ ID NO: 15770 - DNA, 21 bp, Artificial sequence
  SiRNA target sequence
taagtatgttgaagttaatca

SEQ ID NO: 15771 - DNA, 21 bp, Artificial sequence
  SiRNA target sequence
aagtatgttgaagttaatcag

SEQ ID NO: 15772 - DNA, 21 bp, Artificial sequence
  SiRNA target sequence
agtatgttgaagttaatcagc

SEQ ID NO: 15773 - DNA, 21 bp, Artificial sequence
  SiRNA target sequence
gtatgttgaagttaatcagcg

SEQ ID NO: 15774 - DNA, 21 bp, Artificial sequence
  SiRNA target sequence
tatgttgaagttaatcagcgc

SEQ ID NO: 15775 - DNA, 21 bp, Artificial sequence
  SiRNA target sequence
atgttgaagttaatcagcgct

SEQ ID NO: 15776 - DNA, 21 bp, Artificial sequence
  SiRNA target sequence
tgttgaagttaatcagcgctt

SEQ ID NO: 15777 - DNA, 21 bp, Artificial sequence
  SiRNA target sequence
gttgaagttaatcagcgctta

SEQ ID NO: 15778 - DNA, 21 bp, Artificial sequence
  SiRNA target sequence
ttgaagttaatcagcgcttag

SEQ ID NO: 15779 - DNA, 21 bp, Artificial sequence
  SiRNA target sequence
tgaagttaatcagcgcttagt

SEQ ID NO: 15780 - DNA, 21 bp, Artificial sequence
  SiRNA target sequence
gaagttaatcagcgcttagtg

SEQ ID NO: 15781 - DNA, 21 bp, Artificial sequence
  SiRNA target sequence
aagttaatcagcgcttagtgg

SEQ ID NO: 15782 - DNA, 21 bp, Artificial sequence
  SiRNA target sequence
agttaatcagcgcttagtgga

SEQ ID NO: 15783 - DNA, 21 bp, Artificial sequence
  SiRNA target sequence
gttaatcagcgcttagtggag

SEQ ID NO: 15784 - DNA, 21 bp, Artificial sequence
  SiRNA target sequence
ttaatcagcgcttagtggagg

SEQ ID NO: 15785 - DNA, 21 bp, Artificial sequence
  SiRNA target sequence
taatcagcgcttagtggagga

SEQ ID NO: 15786 - DNA, 21 bp, Artificial sequence
  SiRNA target sequence
aatcagcgcttagtggaggaa

SEQ ID NO: 15787 - DNA, 21 bp, Artificial sequence
  SiRNA target sequence
atcagcgcttagtggaggaaa

SEQ ID NO: 15788 - DNA, 21 bp, Artificial sequence
  SiRNA target sequence
tcagcgcttagtggaggaaat

SEQ ID NO: 15789 - DNA, 21 bp, Artificial sequence
  SiRNA target sequence
cagcgcttagtggaggaaatg

SEQ ID NO: 15790 - DNA, 21 bp, Artificial sequence
  SiRNA target sequence
agcgcttagtggaggaaatga

SEQ ID NO: 15791 - DNA, 21 bp, Artificial sequence
  SiRNA target sequence
gcgcttagtggaggaaatgaa

SEQ ID NO: 15792 - DNA, 21 bp, Artificial sequence
  SiRNA target sequence
cgcttagtggaggaaatgaag

SEQ ID NO: 15793 - DNA, 21 bp, Artificial sequence
  SiRNA target sequence
gcttagtggaggaaatgaagg

SEQ ID NO: 15794 - DNA, 21 bp, Artificial sequence
  SiRNA target sequence
cttagtggaggaaatgaaggc

SEQ ID NO: 15795 - DNA, 21 bp, Artificial sequence
  SiRNA target sequence
ttagtggaggaaatgaaggca

SEQ ID NO: 15796 - DNA, 21 bp, Artificial sequence
  SiRNA target sequence
tagtggaggaaatgaaggcat

SEQ ID NO: 15797 - DNA, 21 bp, Artificial sequence
  SiRNA target sequence
agtggaggaaatgaaggcatt

SEQ ID NO: 15798 - DNA, 21 bp, Artificial sequence
  SiRNA target sequence
gtggaggaaatgaaggcattt

SEQ ID NO: 15799 - DNA, 21 bp, Artificial sequence
  SiRNA target sequence
tggaggaaatgaaggcattta

SEQ ID NO: 15800 - DNA, 21 bp, Artificial sequence
  SiRNA target sequence
ggaggaaatgaaggcatttaa

SEQ ID NO: 15801 - DNA, 21 bp, Artificial sequence
  SiRNA target sequence
gaggaaatgaaggcatttaag

SEQ ID NO: 15802 - DNA, 21 bp, Artificial sequence
  SiRNA target sequence
aggaaatgaaggcatttaagg

SEQ ID NO: 15803 - DNA, 21 bp, Artificial sequence
  SiRNA target sequence
ggaaatgaaggcatttaagga

SEQ ID NO: 15804 - DNA, 21 bp, Artificial sequence
  SiRNA target sequence
gaaatgaaggcatttaaggag

SEQ ID NO: 15805 - DNA, 21 bp, Artificial sequence
  SiRNA target sequence
aaatgaaggcatttaaggagc

SEQ ID NO: 15806 - DNA, 21 bp, Artificial sequence
  SiRNA target sequence
aatgaaggcatttaaggagcg

SEQ ID NO: 15807 - DNA, 21 bp, Artificial sequence
  SiRNA target sequence
atgaaggcatttaaggagcgt

SEQ ID NO: 15808 - DNA, 21 bp, Artificial sequence
  SiRNA target sequence
tgaaggcatttaaggagcgta

SEQ ID NO: 15809 - DNA, 21 bp, Artificial sequence
  SiRNA target sequence
gaaggcatttaaggagcgtac

SEQ ID NO: 15810 - DNA, 21 bp, Artificial sequence
  SiRNA target sequence
aaggcatttaaggagcgtaca

SEQ ID NO: 15811 - DNA, 21 bp, Artificial sequence
  SiRNA target sequence
aggcatttaaggagcgtacac

SEQ ID NO: 15812 - DNA, 21 bp, Artificial sequence
  SiRNA target sequence
ggcatttaaggagcgtacact

SEQ ID NO: 15813 - DNA, 21 bp, Artificial sequence
  SiRNA target sequence
gcatttaaggagcgtacacta

SEQ ID NO: 15814 - DNA, 21 bp, Artificial sequence
  SiRNA target sequence
catttaaggagcgtacactat

SEQ ID NO: 15815 - DNA, 21 bp, Artificial sequence
  SiRNA target sequence
atttaaggagcgtacactatg

SEQ ID NO: 15816 - DNA, 21 bp, Artificial sequence
  SiRNA target sequence
tttaaggagcgtacactatgg

SEQ ID NO: 15817 - DNA, 21 bp, Artificial sequence
  SiRNA target sequence
ttaaggagcgtacactatggt

SEQ ID NO: 15818 - DNA, 21 bp, Artificial sequence
  SiRNA target sequence
taaggagcgtacactatggtc

SEQ ID NO: 15819 - DNA, 21 bp, Artificial sequence
  SiRNA target sequence
aaggagcgtacactatggtca

SEQ ID NO: 15820 - DNA, 21 bp, Artificial sequence
  SiRNA target sequence
aggagcgtacactatggtcag

SEQ ID NO: 15821 - DNA, 21 bp, Artificial sequence
  SiRNA target sequence
ggagcgtacactatggtcaga

SEQ ID NO: 15822 - DNA, 21 bp, Artificial sequence
  SiRNA target sequence
gagcgtacactatggtcagat

SEQ ID NO: 15823 - DNA, 21 bp, Artificial sequence
  SiRNA target sequence
agcgtacactatggtcagatt

SEQ ID NO: 15824 - DNA, 21 bp, Artificial sequence
  SiRNA target sequence
gcgtacactatggtcagattt

SEQ ID NO: 15825 - DNA, 21 bp, Artificial sequence
  SiRNA target sequence
cgtacactatggtcagattta

SEQ ID NO: 15826 - DNA, 21 bp, Artificial sequence
  SiRNA target sequence
gtacactatggtcagatttac

SEQ ID NO: 15827 - DNA, 21 bp, Artificial sequence
  SiRNA target sequence
tacactatggtcagatttaca

SEQ ID NO: 15828 - DNA, 21 bp, Artificial sequence
  SiRNA target sequence
acactatggtcagatttacat

SEQ ID NO: 15829 - DNA, 21 bp, Artificial sequence
  SiRNA target sequence
cactatggtcagatttacatc

SEQ ID NO: 15830 - DNA, 21 bp, Artificial sequence
  SiRNA target sequence
actatggtcagatttacatcg

SEQ ID NO: 15831 - DNA, 21 bp, Artificial sequence
  SiRNA target sequence
ctatggtcagatttacatcgc

SEQ ID NO: 15832 - DNA, 21 bp, Artificial sequence
  SiRNA target sequence
tatggtcagatttacatcgcg

SEQ ID NO: 15833 - DNA, 21 bp, Artificial sequence
  SiRNA target sequence
atggtcagatttacatcgcgt

SEQ ID NO: 15834 - DNA, 21 bp, Artificial sequence
  SiRNA target sequence
tggtcagatttacatcgcgta

SEQ ID NO: 15835 - DNA, 21 bp, Artificial sequence
  SiRNA target sequence
ggtcagatttacatcgcgtag

SEQ ID NO: 15836 - DNA, 21 bp, Artificial sequence
  SiRNA target sequence
gtcagatttacatcgcgtagg

SEQ ID NO: 15837 - DNA, 21 bp, Artificial sequence
  SiRNA target sequence
tcagatttacatcgcgtaggt

SEQ ID NO: 15838 - DNA, 21 bp, Artificial sequence
  SiRNA target sequence
cagatttacatcgcgtaggtg

SEQ ID NO: 15839 - DNA, 21 bp, Artificial sequence
  SiRNA target sequence
agatttacatcgcgtaggtgc

SEQ ID NO: 15840 - DNA, 21 bp, Artificial sequence
  SiRNA target sequence
gatttacatcgcgtaggtgcg

SEQ ID NO: 15841 - DNA, 21 bp, Artificial sequence
  SiRNA target sequence
atttacatcgcgtaggtgcgg

SEQ ID NO: 15842 - DNA, 21 bp, Artificial sequence
  SiRNA target sequence
tttacatcgcgtaggtgcgga

SEQ ID NO: 15843 - DNA, 21 bp, Artificial sequence
  SiRNA target sequence
ttacatcgcgtaggtgcggaa

SEQ ID NO: 15844 - DNA, 21 bp, Artificial sequence
  SiRNA target sequence
tacatcgcgtaggtgcggaaa

SEQ ID NO: 15845 - DNA, 21 bp, Artificial sequence
  SiRNA target sequence
acatcgcgtaggtgcggaaat

SEQ ID NO: 15846 - DNA, 21 bp, Artificial sequence
  SiRNA target sequence
catcgcgtaggtgcggaaatt

SEQ ID NO: 15847 - DNA, 21 bp, Artificial sequence
  SiRNA target sequence
atcgcgtaggtgcggaaatta

SEQ ID NO: 15848 - DNA, 21 bp, Artificial sequence
  SiRNA target sequence
tcgcgtaggtgcggaaattag

SEQ ID NO: 15849 - DNA, 21 bp, Artificial sequence
  SiRNA target sequence
cgcgtaggtgcggaaattagt

SEQ ID NO: 15850 - DNA, 21 bp, Artificial sequence
  SiRNA target sequence
gcgtaggtgcggaaattagtg

SEQ ID NO: 15851 - DNA, 21 bp, Artificial sequence
  SiRNA target sequence
cgtaggtgcggaaattagtgc

SEQ ID NO: 15852 - DNA, 21 bp, Artificial sequence
  SiRNA target sequence
gtaggtgcggaaattagtgcg

SEQ ID NO: 15853 - DNA, 21 bp, Artificial sequence
  SiRNA target sequence
taggtgcggaaattagtgcgt

SEQ ID NO: 15854 - DNA, 21 bp, Artificial sequence
  SiRNA target sequence
aggtgcggaaattagtgcgtc

SEQ ID NO: 15855 - DNA, 21 bp, Artificial sequence
  SiRNA target sequence
ggtgcggaaattagtgcgtca

SEQ ID NO: 15856 - DNA, 21 bp, Artificial sequence
  SiRNA target sequence
gtgcggaaattagtgcgtcag

SEQ ID NO: 15857 - DNA, 21 bp, Artificial sequence
  SiRNA target sequence
tgcggaaattagtgcgtcagt

SEQ ID NO: 15858 - DNA, 21 bp, Artificial sequence
  SiRNA target sequence
gcggaaattagtgcgtcagtt

SEQ ID NO: 15859 - DNA, 21 bp, Artificial sequence
  SiRNA target sequence
cggaaattagtgcgtcagtta

SEQ ID NO: 15860 - DNA, 21 bp, Artificial sequence
  SiRNA target sequence
ggaaattagtgcgtcagttaa

SEQ ID NO: 15861 - DNA, 21 bp, Artificial sequence
  SiRNA target sequence
gaaattagtgcgtcagttaag

SEQ ID NO: 15862 - DNA, 21 bp, Artificial sequence
  SiRNA target sequence
aaattagtgcgtcagttaaga

SEQ ID NO: 15863 - DNA, 21 bp, Artificial sequence
  SiRNA target sequence
aattagtgcgtcagttaagaa

SEQ ID NO: 15864 - DNA, 21 bp, Artificial sequence
  SiRNA target sequence
attagtgcgtcagttaagaaa

SEQ ID NO: 15865 - DNA, 21 bp, Artificial sequence
  SiRNA target sequence
ttagtgcgtcagttaagaaag

SEQ ID NO: 15866 - DNA, 21 bp, Artificial sequence
  SiRNA target sequence
tagtgcgtcagttaagaaagc

SEQ ID NO: 15867 - DNA, 21 bp, Artificial sequence
  SiRNA target sequence
agtgcgtcagttaagaaagct

SEQ ID NO: 15868 - DNA, 21 bp, Artificial sequence
  SiRNA target sequence
gtgcgtcagttaagaaagctt

SEQ ID NO: 15869 - DNA, 21 bp, Artificial sequence
  SiRNA target sequence
tgcgtcagttaagaaagcttt

SEQ ID NO: 15870 - DNA, 21 bp, Artificial sequence
  SiRNA target sequence
gcgtcagttaagaaagcttta

SEQ ID NO: 15871 - DNA, 21 bp, Artificial sequence
  SiRNA target sequence
cgtcagttaagaaagctttac

SEQ ID NO: 15872 - DNA, 21 bp, Artificial sequence
  SiRNA target sequence
gtcagttaagaaagctttacc

SEQ ID NO: 15873 - DNA, 21 bp, Artificial sequence
  SiRNA target sequence
tcagttaagaaagctttacca

SEQ ID NO: 15874 - DNA, 21 bp, Artificial sequence
  SiRNA target sequence
cagttaagaaagctttaccaa

SEQ ID NO: 15875 - DNA, 21 bp, Artificial sequence
  SiRNA target sequence
agttaagaaagctttaccaac

SEQ ID NO: 15876 - DNA, 21 bp, Artificial sequence
  SiRNA target sequence
gttaagaaagctttaccaacc

SEQ ID NO: 15877 - DNA, 21 bp, Artificial sequence
  SiRNA target sequence
ttaagaaagctttaccaacca

SEQ ID NO: 15878 - DNA, 21 bp, Artificial sequence
  SiRNA target sequence
taagaaagctttaccaaccat

SEQ ID NO: 15879 - DNA, 21 bp, Artificial sequence
  SiRNA target sequence
aagaaagctttaccaaccatt

SEQ ID NO: 15880 - DNA, 21 bp, Artificial sequence
  SiRNA target sequence
agaaagctttaccaaccattt

SEQ ID NO: 15881 - DNA, 21 bp, Artificial sequence
  SiRNA target sequence
gaaagctttaccaaccatttc

SEQ ID NO: 15882 - DNA, 21 bp, Artificial sequence
  SiRNA target sequence
aaagctttaccaaccatttcc

SEQ ID NO: 15883 - DNA, 21 bp, Artificial sequence
  SiRNA target sequence
aagctttaccaaccatttcca

SEQ ID NO: 15884 - DNA, 21 bp, Artificial sequence
  SiRNA target sequence
agctttaccaaccatttccat

SEQ ID NO: 15885 - DNA, 21 bp, Artificial sequence
  SiRNA target sequence
gctttaccaaccatttccata

SEQ ID NO: 15886 - DNA, 21 bp, Artificial sequence
  SiRNA target sequence
ctttaccaaccatttccataa

SEQ ID NO: 15887 - DNA, 21 bp, Artificial sequence
  SiRNA target sequence
tttaccaaccatttccataac

SEQ ID NO: 15888 - DNA, 21 bp, Artificial sequence
  SiRNA target sequence
ttaccaaccatttccataacc

SEQ ID NO: 15889 - DNA, 21 bp, Artificial sequence
  SiRNA target sequence
taccaaccatttccataaccg

SEQ ID NO: 15890 - DNA, 21 bp, Artificial sequence
  SiRNA target sequence
accaaccatttccataaccga

SEQ ID NO: 15891 - DNA, 21 bp, Artificial sequence
  SiRNA target sequence
ccaaccatttccataaccgaa

SEQ ID NO: 15892 - DNA, 21 bp, Artificial sequence
  SiRNA target sequence
caaccatttccataaccgaaa

SEQ ID NO: 15893 - DNA, 21 bp, Artificial sequence
  SiRNA target sequence
aaccatttccataaccgaaaa

SEQ ID NO: 15894 - DNA, 21 bp, Artificial sequence
  SiRNA target sequence
accatttccataaccgaaaaa

SEQ ID NO: 15895 - DNA, 21 bp, Artificial sequence
  SiRNA target sequence
  misc_feature (21)..(21): n is a, c, g, or t
ccatttccataaccgaaaaan

SEQ ID NO: 15896 - DNA, 21 bp, Artificial sequence
  SiRNA target sequence
  misc_feature (20)..(20): n is a, c, g, or t
catttccataaccgaaaaant

SEQ ID NO: 15897 - DNA, 21 bp, Artificial sequence
  SiRNA target sequence
  misc_feature (19)..(19): n is a, c, g, or t
atttccataaccgaaaaanta

SEQ ID NO: 15898 - DNA, 21 bp, Artificial sequence
  SiRNA target sequence
  misc_feature (18)..(18): n is a, c, g, or t
tttccataaccgaaaaantac

SEQ ID NO: 15899 - DNA, 21 bp, Artificial sequence
  SiRNA target sequence
  misc_feature (17)..(17): n is a, c, g, or t
ttccataaccgaaaaantacc

SEQ ID NO: 15900 - DNA, 21 bp, Artificial sequence
  SiRNA target sequence
  misc_feature (16)..(16): n is a, c, g, or t
tccataaccgaaaaantacca

SEQ ID NO: 15901 - DNA, 21 bp, Artificial sequence
  SiRNA target sequence
  misc_feature (15)..(15): n is a, c, g, or t
ccataaccgaaaaantaccac

SEQ ID NO: 15902 - DNA, 21 bp, Artificial sequence
  SiRNA target sequence
  misc_feature (14)..(14): n is a, c, g, or t
cataaccgaaaaantaccaca

SEQ ID NO: 15903 - DNA, 21 bp, Artificial sequence
  SiRNA target sequence
  misc_feature (13)..(13): n is a, c, g, or t
ataaccgaaaaantaccacat

SEQ ID NO: 15904 - DNA, 21 bp, Artificial sequence
  SiRNA target sequence
  misc_feature (12)..(12): n is a, c, g, or t
taaccgaaaaantaccacatt

SEQ ID NO: 15905 - DNA, 21 bp, Artificial sequence
  SiRNA target sequence
  misc_feature (11)..(11): n is a, c, g, or t
aaccgaaaaantaccacattg

SEQ ID NO: 15906 - DNA, 21 bp, Artificial sequence
  SiRNA target sequence
  misc_feature (10)..(10): n is a, c, g, or t
accgaaaaantaccacattgg

SEQ ID NO: 15907 - DNA, 21 bp, Artificial sequence
  SiRNA target sequence
  misc_feature (9)..(9): n is a, c, g, or t
ccgaaaaantaccacattgga

SEQ ID NO: 15908 - DNA, 21 bp, Artificial sequence
  SiRNA target sequence
  misc_feature (8)..(8): n is a, c, g, or t
cgaaaaantaccacattggac

SEQ ID NO: 15909 - DNA, 21 bp, Artificial sequence
  SiRNA target sequence
  misc_feature (7)..(7): n is a, c, g, or t
gaaaaantaccacattggact

SEQ ID NO: 15910 - DNA, 21 bp, Artificial sequence
  SiRNA target sequence
  misc_feature (6)..(6): n is a, c, g, or t
aaaaantaccacattggactg

SEQ ID NO: 15911 - DNA, 21 bp, Artificial sequence
  SiRNA target sequence
  misc_feature (5)..(5): n is a, c, g, or t
aaaantaccacattggactgt

SEQ ID NO: 15912 - DNA, 21 bp, Artificial sequence
  SiRNA target sequence
  misc_feature (4)..(4): n is a, c, g, or t
aaantaccacattggactgtt

SEQ ID NO: 15913 - DNA, 21 bp, Artificial sequence
  SiRNA target sequence
  misc_feature (3)..(3): n is a, c, g, or t
aantaccacattggactgttc

SEQ ID NO: 15914 - DNA, 21 bp, Artificial sequence
  SiRNA target sequence
  misc_feature (2)..(2): n is a, c, g, or t
antaccacattggactgttca

SEQ ID NO: 15915 - DNA, 21 bp, Artificial sequence
  SiRNA target sequence
  misc_feature (1)..(1): n is a, c, g, or t
ntaccacattggactgttcaa

SEQ ID NO: 15916 - DNA, 21 bp, Artificial sequence
  SiRNA target sequence
taccacattggactgttcaat

SEQ ID NO: 15917 - DNA, 21 bp, Artificial sequence
  SiRNA target sequence
accacattggactgttcaatg

SEQ ID NO: 15918 - DNA, 21 bp, Artificial sequence
  SiRNA target sequence
ccacattggactgttcaatgt

SEQ ID NO: 15919 - DNA, 21 bp, Artificial sequence
  SiRNA target sequence
cacattggactgttcaatgtg

SEQ ID NO: 15920 - DNA, 21 bp, Artificial sequence
  SiRNA target sequence
acattggactgttcaatgtgg

SEQ ID NO: 15921 - DNA, 21 bp, Artificial sequence
  SiRNA target sequence
cattggactgttcaatgtggt

SEQ ID NO: 15922 - DNA, 21 bp, Artificial sequence
  SiRNA target sequence
attggactgttcaatgtggta

SEQ ID NO: 15923 - DNA, 21 bp, Artificial sequence
  SiRNA target sequence
ttggactgttcaatgtggtat

SEQ ID NO: 15924 - DNA, 21 bp, Artificial sequence
  SiRNA target sequence
tggactgttcaatgtggtatt

SEQ ID NO: 15925 - DNA, 21 bp, Artificial sequence
  SiRNA target sequence
ggactgttcaatgtggtattg

SEQ ID NO: 15926 - DNA, 21 bp, Artificial sequence
  SiRNA target sequence
gactgttcaatgtggtattgc

SEQ ID NO: 15927 - DNA, 21 bp, Artificial sequence
  SiRNA target sequence
actgttcaatgtggtattgct

SEQ ID NO: 15928 - DNA, 21 bp, Artificial sequence
  SiRNA target sequence
ctgttcaatgtggtattgcta

SEQ ID NO: 15929 - DNA, 21 bp, Artificial sequence
  SiRNA target sequence
tgttcaatgtggtattgctaa

SEQ ID NO: 15930 - DNA, 21 bp, Artificial sequence
  SiRNA target sequence
gttcaatgtggtattgctaaa

SEQ ID NO: 15931 - DNA, 21 bp, Artificial sequence
  SiRNA target sequence
ttcaatgtggtattgctaaac

SEQ ID NO: 15932 - DNA, 21 bp, Artificial sequence
  SiRNA target sequence
tcaatgtggtattgctaaacc

SEQ ID NO: 15933 - DNA, 21 bp, Artificial sequence
  SiRNA target sequence
caatgtggtattgctaaacct

SEQ ID NO: 15934 - DNA, 21 bp, Artificial sequence
  SiRNA target sequence
aatgtggtattgctaaacctg

SEQ ID NO: 15935 - DNA, 21 bp, Artificial sequence
  SiRNA target sequence
atgtggtattgctaaacctga

SEQ ID NO: 15936 - DNA, 21 bp, Artificial sequence
  SiRNA target sequence
  misc_feature (21)..(21): n is a, c, g, or t
tgtggtattgctaaacctgan

SEQ ID NO: 15937 - DNA, 21 bp, Artificial sequence
  SiRNA target sequence
  misc_feature (20)..(20): n is a, c, g, or t
gtggtattgctaaacctgana

SEQ ID NO: 15938 - DNA, 21 bp, Artificial sequence
  SiRNA target sequence
  misc_feature (19)..(19): n is a, c, g, or t
tggtattgctaaacctganat

SEQ ID NO: 15939 - DNA, 21 bp, Artificial sequence
  SiRNA target sequence
  misc_feature (18)..(18): n is a, c, g, or t
ggtattgctaaacctganatg

SEQ ID NO: 15940 - DNA, 21 bp, Artificial sequence
  SiRNA target sequence
  misc_feature (17)..(17): n is a, c, g, or t
gtattgctaaacctganatgg

SEQ ID NO: 15941 - DNA, 21 bp, Artificial sequence
  SiRNA target sequence
  misc_feature (16)..(16): n is a, c, g, or t
tattgctaaacctganatgga

SEQ ID NO: 15942 - DNA, 21 bp, Artificial sequence
  SiRNA target sequence
  misc_feature (15)..(15): n is a, c, g, or t
attgctaaacctganatggac

SEQ ID NO: 15943 - DNA, 21 bp, Artificial sequence
  SiRNA target sequence
  misc_feature (14)..(14): n is a, c, g, or t
ttgctaaacctganatggacc

SEQ ID NO: 15944 - DNA, 21 bp, Artificial sequence
  SiRNA target sequence
  misc_feature (13)..(13): n is a, c, g, or t
tgctaaacctganatggacca

SEQ ID NO: 15945 - DNA, 21 bp, Artificial sequence
  SiRNA target sequence
  misc_feature (12)..(12): n is a, c, g, or t
gctaaacctganatggaccat

SEQ ID NO: 15946 - DNA, 21 bp, Artificial sequence
  SiRNA target sequence
  misc_feature (11)..(11): n is a, c, g, or t
ctaaacctganatggaccatg

SEQ ID NO: 15947 - DNA, 21 bp, Artificial sequence
  SiRNA target sequence
  misc_feature (10)..(10): n is a, c, g, or t
taaacctganatggaccatgc

SEQ ID NO: 15948 - DNA, 21 bp, Artificial sequence
  SiRNA target sequence
  misc_feature (9)..(9): n is a, c, g, or t
aaacctganatggaccatgct

SEQ ID NO: 15949 - DNA, 21 bp, Artificial sequence
  SiRNA target sequence
  misc_feature (8)..(8): n is a, c, g, or t
aacctganatggaccatgctt

SEQ ID NO: 15950 - DNA, 21 bp, Artificial sequence
  SiRNA target sequence
  misc_feature (7)..(7): n is a, c, g, or t
acctganatggaccatgctta

SEQ ID NO: 15951 - DNA, 21 bp, Artificial sequence
  SiRNA target sequence
  misc_feature (6)..(6): n is a, c, g, or t
cctganatggaccatgcttat

SEQ ID NO: 15952 - DNA, 21 bp, Artificial sequence
  SiRNA target sequence
  misc_feature (5)..(5): n is a, c, g, or t
ctganatggaccatgcttatg

SEQ ID NO: 15953 - DNA, 21 bp, Artificial sequence
  SiRNA target sequence
  misc_feature (4)..(4): n is a, c, g, or t
tganatggaccatgcttatga

SEQ ID NO: 15954 - DNA, 21 bp, Artificial sequence
  SiRNA target sequence
  misc_feature (3)..(3): n is a, c, g, or t
ganatggaccatgcttatgag

SEQ ID NO: 15955 - DNA, 21 bp, Artificial sequence
  SiRNA target sequence
  misc_feature (2)..(2): n is a, c, g, or t
anatggaccatgcttatgagg

SEQ ID NO: 15956 - DNA, 21 bp, Artificial sequence
  SiRNA target sequence
  misc_feature (1)..(1): n is a, c, g, or t
natggaccatgcttatgaggt

SEQ ID NO: 15957 - DNA, 21 bp, Artificial sequence
  SiRNA target sequence
atggaccatgcttatgaggtt

SEQ ID NO: 15958 - DNA, 21 bp, Artificial sequence
  SiRNA target sequence
tggaccatgcttatgaggtta

SEQ ID NO: 15959 - DNA, 21 bp, Artificial sequence
  SiRNA target sequence
ggaccatgcttatgaggttat

SEQ ID NO: 15960 - DNA, 21 bp, Artificial sequence
  SiRNA target sequence
gaccatgcttatgaggttatg

SEQ ID NO: 15961 - DNA, 21 bp, Artificial sequence
  SiRNA target sequence
accatgcttatgaggttatga

SEQ ID NO: 15962 - DNA, 21 bp, Artificial sequence
  SiRNA target sequence
ccatgcttatgaggttatgag

SEQ ID NO: 15963 - DNA, 21 bp, Artificial sequence
  SiRNA target sequence
catgcttatgaggttatgagt

SEQ ID NO: 15964 - DNA, 21 bp, Artificial sequence
  SiRNA target sequence
atgcttatgaggttatgagtt

SEQ ID NO: 15965 - DNA, 21 bp, Artificial sequence
  SiRNA target sequence
tgcttatgaggttatgagttc

SEQ ID NO: 15966 - DNA, 21 bp, Artificial sequence
  SiRNA target sequence
gcttatgaggttatgagttcg

SEQ ID NO: 15967 - DNA, 21 bp, Artificial sequence
  SiRNA target sequence
cttatgaggttatgagttcgt

SEQ ID NO: 15968 - DNA, 21 bp, Artificial sequence
  SiRNA target sequence
ttatgaggttatgagttcgta

SEQ ID NO: 15969 - DNA, 21 bp, Artificial sequence
  SiRNA target sequence
tatgaggttatgagttcgtat

SEQ ID NO: 15970 - DNA, 21 bp, Artificial sequence
  SiRNA target sequence
atgaggttatgagttcgtatg

SEQ ID NO: 15971 - DNA, 21 bp, Artificial sequence
  SiRNA target sequence
tgaggttatgagttcgtatgc

SEQ ID NO: 15972 - DNA, 21 bp, Artificial sequence
  SiRNA target sequence
gaggttatgagttcgtatgca

SEQ ID NO: 15973 - DNA, 21 bp, Artificial sequence
  SiRNA target sequence
aggttatgagttcgtatgcag

SEQ ID NO: 15974 - DNA, 21 bp, Artificial sequence
  SiRNA target sequence
ggttatgagttcgtatgcagc

SEQ ID NO: 15975 - DNA, 21 bp, Artificial sequence
  SiRNA target sequence
gttatgagttcgtatgcagct

SEQ ID NO: 15976 - DNA, 21 bp, Artificial sequence
  SiRNA target sequence
ttatgagttcgtatgcagctg

SEQ ID NO: 15977 - DNA, 21 bp, Artificial sequence
  SiRNA target sequence
tatgagttcgtatgcagctgg

SEQ ID NO: 15978 - DNA, 21 bp, Artificial sequence
  SiRNA target sequence
atgagttcgtatgcagctgga

SEQ ID NO: 15979 - DNA, 21 bp, Artificial sequence
  SiRNA target sequence
tgagttcgtatgcagctggaa

SEQ ID NO: 15980 - DNA, 21 bp, Artificial sequence
  SiRNA target sequence
gagttcgtatgcagctggaat

SEQ ID NO: 15981 - DNA, 21 bp, Artificial sequence
  SiRNA target sequence
agttcgtatgcagctggaatg

SEQ ID NO: 15982 - DNA, 21 bp, Artificial sequence
  SiRNA target sequence
gttcgtatgcagctggaatga

SEQ ID NO: 15983 - DNA, 21 bp, Artificial sequence
  SiRNA target sequence
ttcgtatgcagctggaatgaa

SEQ ID NO: 15984 - DNA, 21 bp, Artificial sequence
  SiRNA target sequence
tcgtatgcagctggaatgaat

SEQ ID NO: 15985 - DNA, 21 bp, Artificial sequence
  SiRNA target sequence
cgtatgcagctggaatgaatg

SEQ ID NO: 15986 - DNA, 21 bp, Artificial sequence
  SiRNA target sequence
gtatgcagctggaatgaatgc

SEQ ID NO: 15987 - DNA, 21 bp, Artificial sequence
  SiRNA target sequence
tatgcagctggaatgaatgca

SEQ ID NO: 15988 - DNA, 21 bp, Artificial sequence
  SiRNA target sequence
atgcagctggaatgaatgcag

SEQ ID NO: 15989 - DNA, 21 bp, Artificial sequence
  SiRNA target sequence
tgcagctggaatgaatgcaga

SEQ ID NO: 15990 - DNA, 21 bp, Artificial sequence
  SiRNA target sequence
gcagctggaatgaatgcagag

SEQ ID NO: 15991 - DNA, 21 bp, Artificial sequence
  SiRNA target sequence
cagctggaatgaatgcagaga

SEQ ID NO: 15992 - DNA, 21 bp, Artificial sequence
  SiRNA target sequence
agctggaatgaatgcagagat

SEQ ID NO: 15993 - DNA, 21 bp, Artificial sequence
  SiRNA target sequence
gctggaatgaatgcagagatt

SEQ ID NO: 15994 - DNA, 21 bp, Artificial sequence
  SiRNA target sequence
ctggaatgaatgcagagattg

SEQ ID NO: 15995 - DNA, 21 bp, Artificial sequence
  SiRNA target sequence
tggaatgaatgcagagattga

SEQ ID NO: 15996 - DNA, 21 bp, Artificial sequence
  SiRNA target sequence
ggaatgaatgcagagattgaa

SEQ ID NO: 15997 - DNA, 21 bp, Artificial sequence
  SiRNA target sequence
gaatgaatgcagagattgaag

SEQ ID NO: 15998 - DNA, 21 bp, Artificial sequence
  SiRNA target sequence
aatgaatgcagagattgaagc

SEQ ID NO: 15999 - DNA, 21 bp, Artificial sequence
  SiRNA target sequence
atgaatgcagagattgaagcg

SEQ ID NO: 16000 - DNA, 21 bp, Artificial sequence
  SiRNA target sequence
tgaatgcagagattgaagcgc

SEQ ID NO: 16001 - DNA, 21 bp, Artificial sequence
  SiRNA target sequence
gaatgcagagattgaagcgca

SEQ ID NO: 16002 - DNA, 21 bp, Artificial sequence
  SiRNA target sequence
aatgcagagattgaagcgcat

SEQ ID NO: 16003 - DNA, 21 bp, Artificial sequence
  SiRNA target sequence
atgcagagattgaagcgcatg

SEQ ID NO: 16004 - DNA, 21 bp, Artificial sequence
  SiRNA target sequence
tgcagagattgaagcgcatga

SEQ ID NO: 16005 - DNA, 21 bp, Artificial sequence
  SiRNA target sequence
gcagagattgaagcgcatgaa

SEQ ID NO: 16006 - DNA, 21 bp, Artificial sequence
  SiRNA target sequence
cagagattgaagcgcatgaac

SEQ ID NO: 16007 - DNA, 21 bp, Artificial sequence
  SiRNA target sequence
agagattgaagcgcatgaaca

SEQ ID NO: 16008 - DNA, 21 bp, Artificial sequence
  SiRNA target sequence
gagattgaagcgcatgaacaa

SEQ ID NO: 16009 - DNA, 21 bp, Artificial sequence
  SiRNA target sequence
agattgaagcgcatgaacaag

SEQ ID NO: 16010 - DNA, 21 bp, Artificial sequence
  SiRNA target sequence
gattgaagcgcatgaacaagt

SEQ ID NO: 16011 - DNA, 21 bp, Artificial sequence
  SiRNA target sequence
attgaagcgcatgaacaagtt

SEQ ID NO: 16012 - DNA, 21 bp, Artificial sequence
  SiRNA target sequence
ttgaagcgcatgaacaagttc

SEQ ID NO: 16013 - DNA, 21 bp, Artificial sequence
  SiRNA target sequence
tgaagcgcatgaacaagttcg

SEQ ID NO: 16014 - DNA, 21 bp, Artificial sequence
  SiRNA target sequence
gaagcgcatgaacaagttcgg

SEQ ID NO: 16015 - DNA, 21 bp, Artificial sequence
  SiRNA target sequence
aagcgcatgaacaagttcggc

SEQ ID NO: 16016 - DNA, 21 bp, Artificial sequence
  SiRNA target sequence
agcgcatgaacaagttcggcg

SEQ ID NO: 16017 - DNA, 21 bp, Artificial sequence
  SiRNA target sequence
gcgcatgaacaagttcggcgt

SEQ ID NO: 16018 - DNA, 21 bp, Artificial sequence
  SiRNA target sequence
cgcatgaacaagttcggcgtt

SEQ ID NO: 16019 - DNA, 21 bp, Artificial sequence
  SiRNA target sequence
gcatgaacaagttcggcgttc

SEQ ID NO: 16020 - DNA, 21 bp, Artificial sequence
  SiRNA target sequence
  misc_feature (21)..(21): n is a, c, g, or t
catgaacaagttcggcgttcn

SEQ ID NO: 16021 - DNA, 21 bp, Artificial sequence
  SiRNA target sequence
  misc_feature (20)..(20): n is a, c, g, or t
atgaacaagttcggcgttcnt

SEQ ID NO: 16022 - DNA, 21 bp, Artificial sequence
  SiRNA target sequence
  misc_feature (19)..(19): n is a, c, g, or t
tgaacaagttcggcgttcntc

SEQ ID NO: 16023 - DNA, 21 bp, Artificial sequence
  SiRNA target sequence
  misc_feature (18)..(18): n is a, c, g, or t
gaacaagttcggcgttcntca

SEQ ID NO: 16024 - DNA, 21 bp, Artificial sequence
  SiRNA target sequence
  misc_feature (17)..(17): n is a, c, g, or t
aacaagttcggcgttcntcag

SEQ ID NO: 16025 - DNA, 21 bp, Artificial sequence
  SiRNA target sequence
  misc_feature (16)..(16): n is a, c, g, or t
acaagttcggcgttcntcagt

SEQ ID NO: 16026 - DNA, 21 bp, Artificial sequence
  SiRNA target sequence
  misc_feature (15)..(15): n is a, c, g, or t
caagttcggcgttcntcagtg

SEQ ID NO: 16027 - DNA, 21 bp, Artificial sequence
  SiRNA target sequence
  misc_feature (14)..(14): n is a, c, g, or t
aagttcggcgttcntcagtgg

SEQ ID NO: 16028 - DNA, 21 bp, Artificial sequence
  SiRNA target sequence
  misc_feature (13)..(13): n is a, c, g, or t
agttcggcgttcntcagtgga

SEQ ID NO: 16029 - DNA, 21 bp, Artificial sequence
  SiRNA target sequence
  misc_feature (12)..(12): n is a, c, g, or t
gttcggcgttcntcagtggaa

SEQ ID NO: 16030 - DNA, 21 bp, Artificial sequence
  SiRNA target sequence
  misc_feature (11)..(11): n is a, c, g, or t
ttcggcgttcntcagtggaat

SEQ ID NO: 16031 - DNA, 21 bp, Artificial sequence
  SiRNA target sequence
  misc_feature (10)..(10): n is a, c, g, or t
tcggcgttcntcagtggaatg

SEQ ID NO: 16032 - DNA, 21 bp, Artificial sequence
  SiRNA target sequence
  misc_feature (9)..(9): n is a, c, g, or t
cggcgttcntcagtggaatgt

SEQ ID NO: 16033 - DNA, 21 bp, Artificial sequence
  SiRNA target sequence
  misc_feature (8)..(8): n is a, c, g, or t
ggcgttcntcagtggaatgtc

SEQ ID NO: 16034 - DNA, 21 bp, Artificial sequence
  SiRNA target sequence
  misc_feature (7)..(7): n is a, c, g, or t
gcgttcntcagtggaatgtca

SEQ ID NO: 16035 - DNA, 21 bp, Artificial sequence
  SiRNA target sequence
  misc_feature (6)..(6): n is a, c, g, or t
cgttcntcagtggaatgtcaa

SEQ ID NO: 16036 - DNA, 21 bp, Artificial sequence
  SiRNA target sequence
  misc_feature (5)..(5): n is a, c, g, or t
gttcntcagtggaatgtcaat

SEQ ID NO: 16037 - DNA, 21 bp, Artificial sequence
  SiRNA target sequence
  misc_feature (4)..(4): n is a, c, g, or t
ttcntcagtggaatgtcaatt

SEQ ID NO: 16038 - DNA, 21 bp, Artificial sequence
  SiRNA target sequence
  misc_feature (3)..(3): n is a, c, g, or t
tcntcagtggaatgtcaattt

SEQ ID NO: 16039 - DNA, 21 bp, Artificial sequence
  SiRNA target sequence
  misc_feature (2)..(2): n is a, c, g, or t
cntcagtggaatgtcaatttg

SEQ ID NO: 16040 - DNA, 21 bp, Artificial sequence
  SiRNA target sequence
  misc_feature (1)..(1): n is a, c, g, or t
ntcagtggaatgtcaatttgc

SEQ ID NO: 16041 - DNA, 21 bp, Artificial sequence
  SiRNA target sequence
tcagtggaatgtcaatttgca

SEQ ID NO: 16042 - DNA, 21 bp, Artificial sequence
  SiRNA target sequence
cagtggaatgtcaatttgcag

SEQ ID NO: 16043 - DNA, 21 bp, Artificial sequence
  SiRNA target sequence
agtggaatgtcaatttgcaga

SEQ ID NO: 16044 - DNA, 21 bp, Artificial sequence
  SiRNA target sequence
gtggaatgtcaatttgcagag

SEQ ID NO: 16045 - DNA, 21 bp, Artificial sequence
  SiRNA target sequence
tggaatgtcaatttgcagagc

SEQ ID NO: 16046 - DNA, 21 bp, Artificial sequence
  SiRNA target sequence
ggaatgtcaatttgcagagcc

SEQ ID NO: 16047 - DNA, 21 bp, Artificial sequence
  SiRNA target sequence
gaatgtcaatttgcagagcct

SEQ ID NO: 16048 - DNA, 21 bp, Artificial sequence
  SiRNA target sequence
aatgtcaatttgcagagcctc

SEQ ID NO: 16049 - DNA, 21 bp, Artificial sequence
  SiRNA target sequence
atgtcaatttgcagagcctca

SEQ ID NO: 16050 - DNA, 21 bp, Artificial sequence
  SiRNA target sequence
tgtcaatttgcagagcctcaa

SEQ ID NO: 16051 - DNA, 21 bp, Artificial sequence
  SiRNA target sequence
gtcaatttgcagagcctcaag

SEQ ID NO: 16052 - DNA, 21 bp, Artificial sequence
  SiRNA target sequence
tcaatttgcagagcctcaagc

SEQ ID NO: 16053 - DNA, 21 bp, Artificial sequence
  SiRNA target sequence
caatttgcagagcctcaagct

SEQ ID NO: 16054 - DNA, 21 bp, Artificial sequence
  SiRNA target sequence
  misc_feature (21)..(21): n is a, c, g, or t
aatttgcagagcctcaagctn

SEQ ID NO: 16055 - DNA, 21 bp, Artificial sequence
  SiRNA target sequence
  misc_feature (20)..(20): n is a, c, g, or t
atttgcagagcctcaagctnc

SEQ ID NO: 16056 - DNA, 21 bp, Artificial sequence
  SiRNA target sequence
  misc_feature (19)..(19): n is a, c, g, or t
tttgcagagcctcaagctnca

SEQ ID NO: 16057 - DNA, 21 bp, Artificial sequence
  SiRNA target sequence
  misc_feature (18)..(18): n is a, c, g, or t
ttgcagagcctcaagctncaa

SEQ ID NO: 16058 - DNA, 21 bp, Artificial sequence
  SiRNA target sequence
  misc_feature (17)..(17): n is a, c, g, or t
tgcagagcctcaagctncaag

SEQ ID NO: 16059 - DNA, 21 bp, Artificial sequence
  SiRNA target sequence
  misc_feature (16)..(16): n is a, c, g, or t
gcagagcctcaagctncaaga

SEQ ID NO: 16060 - DNA, 21 bp, Artificial sequence
  SiRNA target sequence
  misc_feature (15)..(15): n is a, c, g, or t
cagagcctcaagctncaagaa

SEQ ID NO: 16061 - DNA, 21 bp, Artificial sequence
  SiRNA target sequence
  misc_feature (14)..(14): n is a, c, g, or t
agagcctcaagctncaagaaa

SEQ ID NO: 16062 - DNA, 21 bp, Artificial sequence
  SiRNA target sequence
  misc_feature (13)..(13): n is a, c, g, or t
  misc_feature (21)..(21): n is a, c, g, or t
gagcctcaagctncaagaaan

SEQ ID NO: 16063 - DNA, 21 bp, Artificial sequence
  SiRNA target sequence
  misc_feature (12)..(12): n is a, c, g, or t
  misc_feature (20)..(20): n is a, c, g, or t
agcctcaagctncaagaaanc

SEQ ID NO: 16064 - DNA, 21 bp, Artificial sequence
  SiRNA target sequence
  misc_feature (11)..(11): n is a, c, g, or t
  misc_feature (19)..(19): n is a, c, g, or t
gcctcaagctncaagaaancc

SEQ ID NO: 16065 - DNA, 21 bp, Artificial sequence
  SiRNA target sequence
  misc_feature (10)..(10): n is a, c, g, or t
  misc_feature (18)..(18): n is a, c, g, or t
cctcaagctncaagaaancct

SEQ ID NO: 16066 - DNA, 21 bp, Artificial sequence
  SiRNA target sequence
  misc_feature (9)..(9): n is a, c, g, or t
  misc_feature (17)..(17): n is a, c, g, or t
ctcaagctncaagaaancctg

SEQ ID NO: 16067 - DNA, 21 bp, Artificial sequence
  SiRNA target sequence
  misc_feature (8)..(8): n is a, c, g, or t
  misc_feature (16)..(16): n is a, c, g, or t
tcaagctncaagaaancctga

SEQ ID NO: 16068 - DNA, 21 bp, Artificial sequence
  SiRNA target sequence
  misc_feature (7)..(7): n is a, c, g, or t
  misc_feature (15)..(15): n is a, c, g, or t
caagctncaagaaancctgat

SEQ ID NO: 16069 - DNA, 21 bp, Artificial sequence
  SiRNA target sequence
  misc_feature (6)..(6): n is a, c, g, or t
  misc_feature (14)..(14): n is a, c, g, or t
aagctncaagaaancctgatg

SEQ ID NO: 16070 - DNA, 21 bp, Artificial sequence
  SiRNA target sequence
  misc_feature (5)..(5): n is a, c, g, or t
  misc_feature (13)..(13): n is a, c, g, or t
agctncaagaaancctgatga

SEQ ID NO: 16071 - DNA, 21 bp, Artificial sequence
  SiRNA target sequence
  misc_feature (4)..(4): n is a, c, g, or t
  misc_feature (12)..(12): n is a, c, g, or t
gctncaagaaancctgatgat

SEQ ID NO: 16072 - DNA, 21 bp, Artificial sequence
  SiRNA target sequence
  misc_feature (3)..(3): n is a, c, g, or t
  misc_feature (11)..(11): n is a, c, g, or t
ctncaagaaancctgatgatg

SEQ ID NO: 16073 - DNA, 21 bp, Artificial sequence
  SiRNA target sequence
  misc_feature (2)..(2): n is a, c, g, or t
  misc_feature (10)..(10): n is a, c, g, or t
tncaagaaancctgatgatga

SEQ ID NO: 16074 - DNA, 21 bp, Artificial sequence
  SiRNA target sequence
  misc_feature (1)..(1): n is a, c, g, or t
  misc_feature (9)..(9): n is a, c, g, or t
ncaagaaancctgatgatgaa

SEQ ID NO: 16075 - DNA, 21 bp, Artificial sequence
  SiRNA target sequence
  misc_feature (8)..(8): n is a, c, g, or t
caagaaancctgatgatgaag

SEQ ID NO: 16076 - DNA, 21 bp, Artificial sequence
  SiRNA target sequence
  misc_feature (7)..(7): n is a, c, g, or t
aagaaancctgatgatgaagg

SEQ ID NO: 16077 - DNA, 21 bp, Artificial sequence
  SiRNA target sequence
  misc_feature (6)..(6): n is a, c, g, or t
agaaancctgatgatgaagga

SEQ ID NO: 16078 - DNA, 21 bp, Artificial sequence
  SiRNA target sequence
  misc_feature (5)..(5): n is a, c, g, or t
gaaancctgatgatgaaggac

SEQ ID NO: 16079 - DNA, 21 bp, Artificial sequence
  SiRNA target sequence
  misc_feature (4)..(4): n is a, c, g, or t
aaancctgatgatgaaggacc

SEQ ID NO: 16080 - DNA, 21 bp, Artificial sequence
  SiRNA target sequence
  misc_feature (3)..(3): n is a, c, g, or t
aancctgatgatgaaggacca

SEQ ID NO: 16081 - DNA, 21 bp, Artificial sequence
  SiRNA target sequence
  misc_feature (2)..(2): n is a, c, g, or t
ancctgatgatgaaggaccaa

SEQ ID NO: 16082 - DNA, 21 bp, Artificial sequence
  SiRNA target sequence
  misc_feature (1)..(1): n is a, c, g, or t
ncctgatgatgaaggaccaac

SEQ ID NO: 16083 - DNA, 21 bp, Artificial sequence
  SiRNA target sequence
cctgatgatgaaggaccaacc

SEQ ID NO: 16084 - DNA, 21 bp, Artificial sequence
  SiRNA target sequence
ctgatgatgaaggaccaacca

SEQ ID NO: 16085 - DNA, 21 bp, Artificial sequence
  SiRNA target sequence
tgatgatgaaggaccaaccat

SEQ ID NO: 16086 - DNA, 21 bp, Artificial sequence
  SiRNA target sequence
gatgatgaaggaccaaccata

SEQ ID NO: 16087 - DNA, 21 bp, Artificial sequence
  SiRNA target sequence
atgatgaaggaccaaccatag

SEQ ID NO: 16088 - DNA, 21 bp, Artificial sequence
  SiRNA target sequence
tgatgaaggaccaaccataga

SEQ ID NO: 16089 - DNA, 21 bp, Artificial sequence
  SiRNA target sequence
gatgaaggaccaaccatagat

SEQ ID NO: 16090 - DNA, 21 bp, Artificial sequence
  SiRNA target sequence
atgaaggaccaaccatagatg

SEQ ID NO: 16091 - DNA, 21 bp, Artificial sequence
  SiRNA target sequence
tgaaggaccaaccatagatga

SEQ ID NO: 16092 - DNA, 21 bp, Artificial sequence
  SiRNA target sequence
gaaggaccaaccatagatgaa

SEQ ID NO: 16093 - DNA, 21 bp, Artificial sequence
  SiRNA target sequence
aaggaccaaccatagatgaag

SEQ ID NO: 16094 - DNA, 21 bp, Artificial sequence
  SiRNA target sequence
aggaccaaccatagatgaaga

SEQ ID NO: 16095 - DNA, 21 bp, Artificial sequence
  SiRNA target sequence
ggaccaaccatagatgaagaa

SEQ ID NO: 16096 - DNA, 21 bp, Artificial sequence
  SiRNA target sequence
gaccaaccatagatgaagaac

SEQ ID NO: 16097 - DNA, 21 bp, Artificial sequence
  SiRNA target sequence
accaaccatagatgaagaact

SEQ ID NO: 16098 - DNA, 21 bp, Artificial sequence
  SiRNA target sequence
ccaaccatagatgaagaactt

SEQ ID NO: 16099 - DNA, 21 bp, Artificial sequence
  SiRNA target sequence
caaccatagatgaagaactta

SEQ ID NO: 16100 - DNA, 21 bp, Artificial sequence
  SiRNA target sequence
aaccatagatgaagaacttat

SEQ ID NO: 16101 - DNA, 21 bp, Artificial sequence
  SiRNA target sequence
accatagatgaagaacttatg

SEQ ID NO: 16102 - DNA, 21 bp, Artificial sequence
  SiRNA target sequence
ccatagatgaagaacttatgg

SEQ ID NO: 16103 - DNA, 21 bp, Artificial sequence
  SiRNA target sequence
catagatgaagaacttatggg

SEQ ID NO: 16104 - DNA, 21 bp, Artificial sequence
  SiRNA target sequence
atagatgaagaacttatgggc

SEQ ID NO: 16105 - DNA, 21 bp, Artificial sequence
  SiRNA target sequence
tagatgaagaacttatgggcg

SEQ ID NO: 16106 - DNA, 21 bp, Artificial sequence
  SiRNA target sequence
agatgaagaacttatgggcga

SEQ ID NO: 16107 - DNA, 21 bp, Artificial sequence
  SiRNA target sequence
gatgaagaacttatgggcgac

SEQ ID NO: 16108 - DNA, 21 bp, Artificial sequence
  SiRNA target sequence
atgaagaacttatgggcgaca

SEQ ID NO: 16109 - DNA, 21 bp, Artificial sequence
  SiRNA target sequence
tgaagaacttatgggcgacac

SEQ ID NO: 16110 - DNA, 21 bp, Artificial sequence
  SiRNA target sequence
gaagaacttatgggcgacact

SEQ ID NO: 16111 - DNA, 21 bp, Artificial sequence
  SiRNA target sequence
aagaacttatgggcgacactg

SEQ ID NO: 16112 - DNA, 21 bp, Artificial sequence
  SiRNA target sequence
agaacttatgggcgacactga

SEQ ID NO: 16113 - DNA, 21 bp, Artificial sequence
  SiRNA target sequence
gaacttatgggcgacactgaa

SEQ ID NO: 16114 - DNA, 21 bp, Artificial sequence
  SiRNA target sequence
aacttatgggcgacactgaat

SEQ ID NO: 16115 - DNA, 21 bp, Artificial sequence
  SiRNA target sequence
acttatgggcgacactgaatt

SEQ ID NO: 16116 - DNA, 21 bp, Artificial sequence
  SiRNA target sequence
cttatgggcgacactgaattc

SEQ ID NO: 16117 - DNA, 21 bp, Artificial sequence
  SiRNA target sequence
ttatgggcgacactgaattca

SEQ ID NO: 16118 - DNA, 21 bp, Artificial sequence
  SiRNA target sequence
tatgggcgacactgaattcac

SEQ ID NO: 16119 - DNA, 21 bp, Artificial sequence
  SiRNA target sequence
atgggcgacactgaattcaca

SEQ ID NO: 16120 - DNA, 21 bp, Artificial sequence
  SiRNA target sequence
tgggcgacactgaattcacat

SEQ ID NO: 16121 - DNA, 21 bp, Artificial sequence
  SiRNA target sequence
gggcgacactgaattcacatc

SEQ ID NO: 16122 - DNA, 21 bp, Artificial sequence
  SiRNA target sequence
ggcgacactgaattcacatca

SEQ ID NO: 16123 - DNA, 21 bp, Artificial sequence
  SiRNA target sequence
gcgacactgaattcacatcac

SEQ ID NO: 16124 - DNA, 21 bp, Artificial sequence
  SiRNA target sequence
cgacactgaattcacatcaca

SEQ ID NO: 16125 - DNA, 21 bp, Artificial sequence
  SiRNA target sequence
gacactgaattcacatcacag

SEQ ID NO: 16126 - DNA, 21 bp, Artificial sequence
  SiRNA target sequence
acactgaattcacatcacagg

SEQ ID NO: 16127 - DNA, 21 bp, Artificial sequence
  SiRNA target sequence
cactgaattcacatcacaggc

SEQ ID NO: 16128 - DNA, 21 bp, Artificial sequence
  SiRNA target sequence
actgaattcacatcacaggct

SEQ ID NO: 16129 - DNA, 21 bp, Artificial sequence
  SiRNA target sequence
ctgaattcacatcacaggctc

SEQ ID NO: 16130 - DNA, 21 bp, Artificial sequence
  SiRNA target sequence
tgaattcacatcacaggctct

SEQ ID NO: 16131 - DNA, 21 bp, Artificial sequence
  SiRNA target sequence
gaattcacatcacaggctcta

SEQ ID NO: 16132 - DNA, 21 bp, Artificial sequence
  SiRNA target sequence
aattcacatcacaggctctag

SEQ ID NO: 16133 - DNA, 21 bp, Artificial sequence
  SiRNA target sequence
attcacatcacaggctctaga

SEQ ID NO: 16134 - DNA, 21 bp, Artificial sequence
  SiRNA target sequence
ttcacatcacaggctctagaa

SEQ ID NO: 16135 - DNA, 21 bp, Artificial sequence
  SiRNA target sequence
tcacatcacaggctctagaac

SEQ ID NO: 16136 - DNA, 21 bp, Artificial sequence
  SiRNA target sequence
cacatcacaggctctagaacg

SEQ ID NO: 16137 - DNA, 21 bp, Artificial sequence
  SiRNA target sequence
acatcacaggctctagaacgt

SEQ ID NO: 16138 - DNA, 21 bp, Artificial sequence
  SiRNA target sequence
catcacaggctctagaacgtc

SEQ ID NO: 16139 - DNA, 21 bp, Artificial sequence
  SiRNA target sequence
atcacaggctctagaacgtct

SEQ ID NO: 16140 - DNA, 21 bp, Artificial sequence
  SiRNA target sequence
tcacaggctctagaacgtctt

SEQ ID NO: 16141 - DNA, 21 bp, Artificial sequence
  SiRNA target sequence
cacaggctctagaacgtcttg

SEQ ID NO: 16142 - DNA, 21 bp, Artificial sequence
  SiRNA target sequence
acaggctctagaacgtcttgt

SEQ ID NO: 16143 - DNA, 21 bp, Artificial sequence
  SiRNA target sequence
caggctctagaacgtcttgtg

SEQ ID NO: 16144 - DNA, 21 bp, Artificial sequence
  SiRNA target sequence
aggctctagaacgtcttgtgg

SEQ ID NO: 16145 - DNA, 21 bp, Artificial sequence
  SiRNA target sequence
ggctctagaacgtcttgtgga

SEQ ID NO: 16146 - DNA, 21 bp, Artificial sequence
  SiRNA target sequence
gctctagaacgtcttgtggat

SEQ ID NO: 16147 - DNA, 21 bp, Artificial sequence
  SiRNA target sequence
ctctagaacgtcttgtggatg

SEQ ID NO: 16148 - DNA, 21 bp, Artificial sequence
  SiRNA target sequence
tctagaacgtcttgtggatga

SEQ ID NO: 16149 - DNA, 21 bp, Artificial sequence
  SiRNA target sequence
ctagaacgtcttgtggatgaa

SEQ ID NO: 16150 - DNA, 21 bp, Artificial sequence
  SiRNA target sequence
tagaacgtcttgtggatgaag

SEQ ID NO: 16151 - DNA, 21 bp, Artificial sequence
  SiRNA target sequence
agaacgtcttgtggatgaagg

SEQ ID NO: 16152 - DNA, 21 bp, Artificial sequence
  SiRNA target sequence
gaacgtcttgtggatgaaggt

SEQ ID NO: 16153 - DNA, 21 bp, Artificial sequence
  SiRNA target sequence
aacgtcttgtggatgaaggtt

SEQ ID NO: 16154 - DNA, 21 bp, Artificial sequence
  SiRNA target sequence
acgtcttgtggatgaaggtta

SEQ ID NO: 16155 - DNA, 21 bp, Artificial sequence
  SiRNA target sequence
cgtcttgtggatgaaggttat

SEQ ID NO: 16156 - DNA, 21 bp, Artificial sequence
  SiRNA target sequence
gtcttgtggatgaaggttata

SEQ ID NO: 16157 - DNA, 21 bp, Artificial sequence
  SiRNA target sequence
tcttgtggatgaaggttatat

SEQ ID NO: 16158 - DNA, 21 bp, Artificial sequence
  SiRNA target sequence
cttgtggatgaaggttatata

SEQ ID NO: 16159 - DNA, 21 bp, Artificial sequence
  SiRNA target sequence
ttgtggatgaaggttatataa

SEQ ID NO: 16160 - DNA, 21 bp, Artificial sequence
  SiRNA target sequence
tgtggatgaaggttatataac

SEQ ID NO: 16161 - DNA, 21 bp, Artificial sequence
  SiRNA target sequence
gtggatgaaggttatataact

SEQ ID NO: 16162 - DNA, 21 bp, Artificial sequence
  SiRNA target sequence
tggatgaaggttatataactg

SEQ ID NO: 16163 - DNA, 21 bp, Artificial sequence
  SiRNA target sequence
ggatgaaggttatataactgg

SEQ ID NO: 16164 - DNA, 21 bp, Artificial sequence
  SiRNA target sequence
gatgaaggttatataactgga

SEQ ID NO: 16165 - DNA, 21 bp, Artificial sequence
  SiRNA target sequence
atgaaggttatataactggaa

SEQ ID NO: 16166 - DNA, 21 bp, Artificial sequence
  SiRNA target sequence
tgaaggttatataactggaaa

SEQ ID NO: 16167 - DNA, 21 bp, Artificial sequence
  SiRNA target sequence
gaaggttatataactggaaaa

SEQ ID NO: 16168 - DNA, 21 bp, Artificial sequence
  SiRNA target sequence
aaggttatataactggaaaac

SEQ ID NO: 16169 - DNA, 21 bp, Artificial sequence
  SiRNA target sequence
aggttatataactggaaaaca

SEQ ID NO: 16170 - DNA, 21 bp, Artificial sequence
  SiRNA target sequence
ggttatataactggaaaacag

SEQ ID NO: 16171 - DNA, 21 bp, Artificial sequence
  SiRNA target sequence
gttatataactggaaaacaga

SEQ ID NO: 16172 - DNA, 21 bp, Artificial sequence
  SiRNA target sequence
ttatataactggaaaacagaa

SEQ ID NO: 16173 - DNA, 21 bp, Artificial sequence
  SiRNA target sequence
tatataactggaaaacagaag

SEQ ID NO: 16174 - DNA, 21 bp, Artificial sequence
  SiRNA target sequence
atataactggaaaacagaaga

SEQ ID NO: 16175 - DNA, 21 bp, Artificial sequence
  SiRNA target sequence
tataactggaaaacagaagaa

SEQ ID NO: 16176 - DNA, 21 bp, Artificial sequence
  SiRNA target sequence
ataactggaaaacagaagaaa

SEQ ID NO: 16177 - DNA, 21 bp, Artificial sequence
  SiRNA target sequence
taactggaaaacagaagaaat

SEQ ID NO: 16178 - DNA, 21 bp, Artificial sequence
  SiRNA target sequence
aactggaaaacagaagaaata

SEQ ID NO: 16179 - DNA, 21 bp, Artificial sequence
  SiRNA target sequence
actggaaaacagaagaaatat

SEQ ID NO: 16180 - DNA, 21 bp, Artificial sequence
  SiRNA target sequence
ctggaaaacagaagaaatata

SEQ ID NO: 16181 - DNA, 21 bp, Artificial sequence
  SiRNA target sequence
tggaaaacagaagaaatatat

SEQ ID NO: 16182 - DNA, 21 bp, Artificial sequence
  SiRNA target sequence
ggaaaacagaagaaatatata

SEQ ID NO: 16183 - DNA, 21 bp, Artificial sequence
  SiRNA target sequence
gaaaacagaagaaatatatag

SEQ ID NO: 16184 - DNA, 21 bp, Artificial sequence
  SiRNA target sequence
aaaacagaagaaatatatagc

SEQ ID NO: 16185 - DNA, 21 bp, Artificial sequence
  SiRNA target sequence
aaacagaagaaatatatagct

SEQ ID NO: 16186 - DNA, 21 bp, Artificial sequence
  SiRNA target sequence
aacagaagaaatatatagcta

SEQ ID NO: 16187 - DNA, 21 bp, Artificial sequence
  SiRNA target sequence
acagaagaaatatatagctat

SEQ ID NO: 16188 - DNA, 21 bp, Artificial sequence
  SiRNA target sequence
cagaagaaatatatagctatg

SEQ ID NO: 16189 - DNA, 21 bp, Artificial sequence
  SiRNA target sequence
agaagaaatatatagctatgt

SEQ ID NO: 16190 - DNA, 21 bp, Artificial sequence
  SiRNA target sequence
gaagaaatatatagctatgtg

SEQ ID NO: 16191 - DNA, 21 bp, Artificial sequence
  SiRNA target sequence
aagaaatatatagctatgtgg

SEQ ID NO: 16192 - DNA, 21 bp, Artificial sequence
  SiRNA target sequence
agaaatatatagctatgtggt

SEQ ID NO: 16193 - DNA, 21 bp, Artificial sequence
  SiRNA target sequence
gaaatatatagctatgtggtg

SEQ ID NO: 16194 - DNA, 21 bp, Artificial sequence
  SiRNA target sequence
aaatatatagctatgtggtgt

SEQ ID NO: 16195 - DNA, 21 bp, Artificial sequence
  SiRNA target sequence
aatatatagctatgtggtgta

SEQ ID NO: 16196 - DNA, 21 bp, Artificial sequence
  SiRNA target sequence
atatatagctatgtggtgtag

SEQ ID NO: 16197 - DNA, 21 bp, Artificial sequence
  SiRNA target sequence
tatatagctatgtggtgtagt

SEQ ID NO: 16198 - DNA, 21 bp, Artificial sequence
  SiRNA target sequence
atatagctatgtggtgtagta

SEQ ID NO: 16199 - DNA, 21 bp, Artificial sequence
  SiRNA target sequence
tatagctatgtggtgtagtaa

SEQ ID NO: 16200 - DNA, 21 bp, Artificial sequence
  SiRNA target sequence
atagctatgtggtgtagtaag

SEQ ID NO: 16201 - DNA, 21 bp, Artificial sequence
  SiRNA target sequence
tagctatgtggtgtagtaagc

SEQ ID NO: 16202 - DNA, 21 bp, Artificial sequence
  SiRNA target sequence
agctatgtggtgtagtaagcg

SEQ ID NO: 16203 - DNA, 21 bp, Artificial sequence
  SiRNA target sequence
gctatgtggtgtagtaagcgt

SEQ ID NO: 16204 - DNA, 21 bp, Artificial sequence
  SiRNA target sequence
ctatgtggtgtagtaagcgtc

SEQ ID NO: 16205 - DNA, 21 bp, Artificial sequence
  SiRNA target sequence
tatgtggtgtagtaagcgtcg

SEQ ID NO: 16206 - DNA, 21 bp, Artificial sequence
  SiRNA target sequence
atgtggtgtagtaagcgtcgt

SEQ ID NO: 16207 - DNA, 21 bp, Artificial sequence
  SiRNA target sequence
tgtggtgtagtaagcgtcgtg

SEQ ID NO: 16208 - DNA, 21 bp, Artificial sequence
  SiRNA target sequence
gtggtgtagtaagcgtcgtga

SEQ ID NO: 16209 - DNA, 21 bp, Artificial sequence
  SiRNA target sequence
tggtgtagtaagcgtcgtgaa

SEQ ID NO: 16210 - DNA, 21 bp, Artificial sequence
  SiRNA target sequence
ggtgtagtaagcgtcgtgaac

SEQ ID NO: 16211 - DNA, 21 bp, Artificial sequence
  SiRNA target sequence
gtgtagtaagcgtcgtgaaca

SEQ ID NO: 16212 - DNA, 21 bp, Artificial sequence
  SiRNA target sequence
tgtagtaagcgtcgtgaacat

SEQ ID NO: 16213 - DNA, 21 bp, Artificial sequence
  SiRNA target sequence
gtagtaagcgtcgtgaacata

SEQ ID NO: 16214 - DNA, 21 bp, Artificial sequence
  SiRNA target sequence
tagtaagcgtcgtgaacatac

SEQ ID NO: 16215 - DNA, 21 bp, Artificial sequence
  SiRNA target sequence
agtaagcgtcgtgaacatact

SEQ ID NO: 16216 - DNA, 21 bp, Artificial sequence
  SiRNA target sequence
gtaagcgtcgtgaacatactg

SEQ ID NO: 16217 - DNA, 21 bp, Artificial sequence
  SiRNA target sequence
taagcgtcgtgaacatactgc

SEQ ID NO: 16218 - DNA, 21 bp, Artificial sequence
  SiRNA target sequence
aagcgtcgtgaacatactgct

SEQ ID NO: 16219 - DNA, 21 bp, Artificial sequence
  SiRNA target sequence
agcgtcgtgaacatactgctg

SEQ ID NO: 16220 - DNA, 21 bp, Artificial sequence
  SiRNA target sequence
gcgtcgtgaacatactgctga

SEQ ID NO: 16221 - DNA, 21 bp, Artificial sequence
  SiRNA target sequence
cgtcgtgaacatactgctgac

SEQ ID NO: 16222 - DNA, 21 bp, Artificial sequence
  SiRNA target sequence
gtcgtgaacatactgctgact

SEQ ID NO: 16223 - DNA, 21 bp, Artificial sequence
  SiRNA target sequence
tcgtgaacatactgctgactt

SEQ ID NO: 16224 - DNA, 21 bp, Artificial sequence
  SiRNA target sequence
cgtgaacatactgctgacttt

SEQ ID NO: 16225 - DNA, 21 bp, Artificial sequence
  SiRNA target sequence
gtgaacatactgctgactttg

SEQ ID NO: 16226 - DNA, 21 bp, Artificial sequence
  SiRNA target sequence
tgaacatactgctgactttga

SEQ ID NO: 16227 - DNA, 21 bp, Artificial sequence
  SiRNA target sequence
gaacatactgctgactttgat

SEQ ID NO: 16228 - DNA, 21 bp, Artificial sequence
  SiRNA target sequence
aacatactgctgactttgatc

SEQ ID NO: 16229 - DNA, 21 bp, Artificial sequence
  SiRNA target sequence
acatactgctgactttgatct

SEQ ID NO: 16230 - DNA, 21 bp, Artificial sequence
  SiRNA target sequence
catactgctgactttgatctt

SEQ ID NO: 16231 - DNA, 21 bp, Artificial sequence
  SiRNA target sequence
atactgctgactttgatcttg

SEQ ID NO: 16232 - DNA, 21 bp, Artificial sequence
  SiRNA target sequence
tactgctgactttgatcttgt

SEQ ID NO: 16233 - DNA, 21 bp, Artificial sequence
  SiRNA target sequence
actgctgactttgatcttgtg

SEQ ID NO: 16234 - DNA, 21 bp, Artificial sequence
  SiRNA target sequence
ctgctgactttgatcttgtgt

SEQ ID NO: 16235 - DNA, 21 bp, Artificial sequence
  SiRNA target sequence
tgctgactttgatcttgtgtg

SEQ ID NO: 16236 - DNA, 21 bp, Artificial sequence
  SiRNA target sequence
gctgactttgatcttgtgtgg

SEQ ID NO: 16237 - DNA, 21 bp, Artificial sequence
  SiRNA target sequence
ctgactttgatcttgtgtgga

SEQ ID NO: 16238 - DNA, 21 bp, Artificial sequence
  SiRNA target sequence
tgactttgatcttgtgtggac

SEQ ID NO: 16239 - DNA, 21 bp, Artificial sequence
  SiRNA target sequence
gactttgatcttgtgtggact

SEQ ID NO: 16240 - DNA, 21 bp, Artificial sequence
  SiRNA target sequence
actttgatcttgtgtggactg

SEQ ID NO: 16241 - DNA, 21 bp, Artificial sequence
  SiRNA target sequence
ctttgatcttgtgtggactga

SEQ ID NO: 16242 - DNA, 21 bp, Artificial sequence
  SiRNA target sequence
tttgatcttgtgtggactgat

SEQ ID NO: 16243 - DNA, 21 bp, Artificial sequence
  SiRNA target sequence
ttgatcttgtgtggactgata

SEQ ID NO: 16244 - DNA, 21 bp, Artificial sequence
  SiRNA target sequence
tgatcttgtgtggactgataa

SEQ ID NO: 16245 - DNA, 21 bp, Artificial sequence
  SiRNA target sequence
gatcttgtgtggactgataat

SEQ ID NO: 16246 - DNA, 21 bp, Artificial sequence
  SiRNA target sequence
atcttgtgtggactgataatt

SEQ ID NO: 16247 - DNA, 21 bp, Artificial sequence
  SiRNA target sequence
tcttgtgtggactgataattt

SEQ ID NO: 16248 - DNA, 21 bp, Artificial sequence
  SiRNA target sequence
cttgtgtggactgataatttg

SEQ ID NO: 16249 - DNA, 21 bp, Artificial sequence
  SiRNA target sequence
ttgtgtggactgataatttgc

SEQ ID NO: 16250 - DNA, 21 bp, Artificial sequence
  SiRNA target sequence
tgtgtggactgataatttgcg

SEQ ID NO: 16251 - DNA, 21 bp, Artificial sequence
  SiRNA target sequence
gtgtggactgataatttgcgt

SEQ ID NO: 16252 - DNA, 21 bp, Artificial sequence
  SiRNA target sequence
tgtggactgataatttgcgtg

SEQ ID NO: 16253 - DNA, 21 bp, Artificial sequence
  SiRNA target sequence
gtggactgataatttgcgtgt

SEQ ID NO: 16254 - DNA, 21 bp, Artificial sequence
  SiRNA target sequence
tggactgataatttgcgtgtg

SEQ ID NO: 16255 - DNA, 21 bp, Artificial sequence
  SiRNA target sequence
ggactgataatttgcgtgtgt

SEQ ID NO: 16256 - DNA, 21 bp, Artificial sequence
  SiRNA target sequence
gactgataatttgcgtgtgtt

SEQ ID NO: 16257 - DNA, 21 bp, Artificial sequence
  SiRNA target sequence
actgataatttgcgtgtgtta

SEQ ID NO: 16258 - DNA, 21 bp, Artificial sequence
  SiRNA target sequence
ctgataatttgcgtgtgttaa

SEQ ID NO: 16259 - DNA, 21 bp, Artificial sequence
  SiRNA target sequence
tgataatttgcgtgtgttaag

SEQ ID NO: 16260 - DNA, 21 bp, Artificial sequence
  SiRNA target sequence
gataatttgcgtgtgttaagt

SEQ ID NO: 16261 - DNA, 21 bp, Artificial sequence
  SiRNA target sequence
ataatttgcgtgtgttaagtg

SEQ ID NO: 16262 - DNA, 21 bp, Artificial sequence
  SiRNA target sequence
taatttgcgtgtgttaagtgc

SEQ ID NO: 16263 - DNA, 21 bp, Artificial sequence
  SiRNA target sequence
aatttgcgtgtgttaagtgcg

SEQ ID NO: 16264 - DNA, 21 bp, Artificial sequence
  SiRNA target sequence
atttgcgtgtgttaagtgcgt

SEQ ID NO: 16265 - DNA, 21 bp, Artificial sequence
  SiRNA target sequence
tttgcgtgtgttaagtgcgta

SEQ ID NO: 16266 - DNA, 21 bp, Artificial sequence
  SiRNA target sequence
ttgcgtgtgttaagtgcgtat

SEQ ID NO: 16267 - DNA, 21 bp, Artificial sequence
  SiRNA target sequence
tgcgtgtgttaagtgcgtatg

SEQ ID NO: 16268 - DNA, 21 bp, Artificial sequence
  SiRNA target sequence
gcgtgtgttaagtgcgtatgt

SEQ ID NO: 16269 - DNA, 21 bp, Artificial sequence
  SiRNA target sequence
cgtgtgttaagtgcgtatgtg

SEQ ID NO: 16270 - DNA, 21 bp, Artificial sequence
  SiRNA target sequence
gtgtgttaagtgcgtatgtgc

SEQ ID NO: 16271 - DNA, 21 bp, Artificial sequence
  SiRNA target sequence
tgtgttaagtgcgtatgtgca

SEQ ID NO: 16272 - DNA, 21 bp, Artificial sequence
  SiRNA target sequence
gtgttaagtgcgtatgtgcat

SEQ ID NO: 16273 - DNA, 21 bp, Artificial sequence
  SiRNA target sequence
tgttaagtgcgtatgtgcatg

SEQ ID NO: 16274 - DNA, 21 bp, Artificial sequence
  SiRNA target sequence
gttaagtgcgtatgtgcatga

SEQ ID NO: 16275 - DNA, 21 bp, Artificial sequence
  SiRNA target sequence
ttaagtgcgtatgtgcatgaa

SEQ ID NO: 16276 - DNA, 21 bp, Artificial sequence
  SiRNA target sequence
taagtgcgtatgtgcatgaac

SEQ ID NO: 16277 - DNA, 21 bp, Artificial sequence
  SiRNA target sequence
aagtgcgtatgtgcatgaacg

SEQ ID NO: 16278 - DNA, 21 bp, Artificial sequence
  SiRNA target sequence
agtgcgtatgtgcatgaacgt

SEQ ID NO: 16279 - DNA, 21 bp, Artificial sequence
  SiRNA target sequence
gtgcgtatgtgcatgaacgtt

SEQ ID NO: 16280 - DNA, 21 bp, Artificial sequence
  SiRNA target sequence
tgcgtatgtgcatgaacgttc

SEQ ID NO: 16281 - DNA, 21 bp, Artificial sequence
  SiRNA target sequence
gcgtatgtgcatgaacgttca

SEQ ID NO: 16282 - DNA, 21 bp, Artificial sequence
  SiRNA target sequence
cgtatgtgcatgaacgttcat

SEQ ID NO: 16283 - DNA, 21 bp, Artificial sequence
  SiRNA target sequence
gtatgtgcatgaacgttcatc

SEQ ID NO: 16284 - DNA, 21 bp, Artificial sequence
  SiRNA target sequence
tatgtgcatgaacgttcatct

SEQ ID NO: 16285 - DNA, 21 bp, Artificial sequence
  SiRNA target sequence
atgtgcatgaacgttcatctt

SEQ ID NO: 16286 - DNA, 21 bp, Artificial sequence
  SiRNA target sequence
tgtgcatgaacgttcatcttc

SEQ ID NO: 16287 - DNA, 21 bp, Artificial sequence
  SiRNA target sequence
gtgcatgaacgttcatcttca

SEQ ID NO: 16288 - DNA, 21 bp, Artificial sequence
  SiRNA target sequence
tgcatgaacgttcatcttcaa

SEQ ID NO: 16289 - DNA, 21 bp, Artificial sequence
  SiRNA target sequence
gcatgaacgttcatcttcaac

SEQ ID NO: 16290 - DNA, 21 bp, Artificial sequence
  SiRNA target sequence
catgaacgttcatcttcaact

SEQ ID NO: 16291 - DNA, 21 bp, Artificial sequence
  SiRNA target sequence
atgaacgttcatcttcaactc

SEQ ID NO: 16292 - DNA, 21 bp, Artificial sequence
  SiRNA target sequence
tgaacgttcatcttcaactcg

SEQ ID NO: 16293 - DNA, 21 bp, Artificial sequence
  SiRNA target sequence
gaacgttcatcttcaactcgg

SEQ ID NO: 16294 - DNA, 21 bp, Artificial sequence
  SiRNA target sequence
aacgttcatcttcaactcggc

SEQ ID NO: 16295 - DNA, 21 bp, Artificial sequence
  SiRNA target sequence
acgttcatcttcaactcggct

SEQ ID NO: 16296 - DNA, 21 bp, Artificial sequence
  SiRNA target sequence
cgttcatcttcaactcggctt

SEQ ID NO: 16297 - DNA, 21 bp, Artificial sequence
  SiRNA target sequence
gttcatcttcaactcggcttt

SEQ ID NO: 16298 - DNA, 21 bp, Artificial sequence
  SiRNA target sequence
ttcatcttcaactcggctttc

SEQ ID NO: 16299 - DNA, 21 bp, Artificial sequence
  SiRNA target sequence
tcatcttcaactcggctttct

SEQ ID NO: 16300 - DNA, 21 bp, Artificial sequence
  SiRNA target sequence
catcttcaactcggctttcta

SEQ ID NO: 16301 - DNA, 21 bp, Artificial sequence
  SiRNA target sequence
atcttcaactcggctttctac

SEQ ID NO: 16302 - DNA, 21 bp, Artificial sequence
  SiRNA target sequence
tcttcaactcggctttctacg

SEQ ID NO: 16303 - DNA, 21 bp, Artificial sequence
  SiRNA target sequence
cttcaactcggctttctacgg

SEQ ID NO: 16304 - DNA, 21 bp, Artificial sequence
  SiRNA target sequence
ttcaactcggctttctacgga

SEQ ID NO: 16305 - DNA, 21 bp, Artificial sequence
  SiRNA target sequence
tcaactcggctttctacggat

SEQ ID NO: 16306 - DNA, 21 bp, Artificial sequence
  SiRNA target sequence
caactcggctttctacggatg

SEQ ID NO: 16307 - DNA, 21 bp, Artificial sequence
  SiRNA target sequence
aactcggctttctacggatga

SEQ ID NO: 16308 - DNA, 21 bp, Artificial sequence
  SiRNA target sequence
actcggctttctacggatgac

SEQ ID NO: 16309 - DNA, 21 bp, Artificial sequence
  SiRNA target sequence
ctcggctttctacggatgacg

SEQ ID NO: 16310 - DNA, 21 bp, Artificial sequence
  SiRNA target sequence
tcggctttctacggatgacgt

SEQ ID NO: 16311 - DNA, 21 bp, Artificial sequence
  SiRNA target sequence
cggctttctacggatgacgtc

SEQ ID NO: 16312 - DNA, 21 bp, Artificial sequence
  SiRNA target sequence
ggctttctacggatgacgtca

SEQ ID NO: 16313 - DNA, 21 bp, Artificial sequence
  SiRNA target sequence
gctttctacggatgacgtcaa

SEQ ID NO: 16314 - DNA, 21 bp, Artificial sequence
  SiRNA target sequence
ctttctacggatgacgtcaag

SEQ ID NO: 16315 - DNA, 21 bp, Artificial sequence
  SiRNA target sequence
tttctacggatgacgtcaagt

SEQ ID NO: 16316 - DNA, 21 bp, Artificial sequence
  SiRNA target sequence
ttctacggatgacgtcaagtt

SEQ ID NO: 16317 - DNA, 21 bp, Artificial sequence
  SiRNA target sequence
tctacggatgacgtcaagtta

SEQ ID NO: 16318 - DNA, 21 bp, Artificial sequence
  SiRNA target sequence
ctacggatgacgtcaagttat

SEQ ID NO: 16319 - DNA, 21 bp, Artificial sequence
  SiRNA target sequence
tacggatgacgtcaagttata

SEQ ID NO: 16320 - DNA, 21 bp, Artificial sequence
  SiRNA target sequence
acggatgacgtcaagttatat

SEQ ID NO: 16321 - DNA, 21 bp, Artificial sequence
  SiRNA target sequence
cggatgacgtcaagttatata

SEQ ID NO: 16322 - DNA, 21 bp, Artificial sequence
  SiRNA target sequence
ggatgacgtcaagttatataa

SEQ ID NO: 16323 - DNA, 21 bp, Artificial sequence
  SiRNA target sequence
gatgacgtcaagttatataaa

SEQ ID NO: 16324 - DNA, 21 bp, Artificial sequence
  SiRNA target sequence
atgacgtcaagttatataaaa

SEQ ID NO: 16325 - DNA, 21 bp, Artificial sequence
  SiRNA target sequence
tgacgtcaagttatataaaac

SEQ ID NO: 16326 - DNA, 21 bp, Artificial sequence
  SiRNA target sequence
gacgtcaagttatataaaacg

SEQ ID NO: 16327 - DNA, 21 bp, Artificial sequence
  SiRNA target sequence
acgtcaagttatataaaacga

SEQ ID NO: 16328 - DNA, 21 bp, Artificial sequence
  SiRNA target sequence
cgtcaagttatataaaacgat

SEQ ID NO: 16329 - DNA, 21 bp, Artificial sequence
  SiRNA target sequence
gtcaagttatataaaacgatt

SEQ ID NO: 16330 - DNA, 21 bp, Artificial sequence
  SiRNA target sequence
tcaagttatataaaacgatta

SEQ ID NO: 16331 - DNA, 21 bp, Artificial sequence
  SiRNA target sequence
caagttatataaaacgattag

SEQ ID NO: 16332 - DNA, 21 bp, Artificial sequence
  SiRNA target sequence
aagttatataaaacgattagc

SEQ ID NO: 16333 - DNA, 21 bp, Artificial sequence
  SiRNA target sequence
agttatataaaacgattagca

SEQ ID NO: 16334 - DNA, 21 bp, Artificial sequence
  SiRNA target sequence
gttatataaaacgattagcat

SEQ ID NO: 16335 - DNA, 21 bp, Artificial sequence
  SiRNA target sequence
ttatataaaacgattagcatg

SEQ ID NO: 16336 - DNA, 21 bp, Artificial sequence
  SiRNA target sequence
tatataaaacgattagcatgt

SEQ ID NO: 16337 - DNA, 21 bp, Artificial sequence
  SiRNA target sequence
atataaaacgattagcatgtt

SEQ ID NO: 16338 - DNA, 21 bp, Artificial sequence
  SiRNA target sequence
tataaaacgattagcatgtta

SEQ ID NO: 16339 - DNA, 21 bp, Artificial sequence
  SiRNA target sequence
ataaaacgattagcatgttac

SEQ ID NO: 16340 - DNA, 21 bp, Artificial sequence
  SiRNA target sequence
taaaacgattagcatgttaca

SEQ ID NO: 16341 - DNA, 21 bp, Artificial sequence
  SiRNA target sequence
aaaacgattagcatgttacat

SEQ ID NO: 16342 - DNA, 21 bp, Artificial sequence
  SiRNA target sequence
aaacgattagcatgttacatc

SEQ ID NO: 16343 - DNA, 21 bp, Artificial sequence
  SiRNA target sequence
aacgattagcatgttacatca

SEQ ID NO: 16344 - DNA, 21 bp, Artificial sequence
  SiRNA target sequence
acgattagcatgttacatcaa

SEQ ID NO: 16345 - DNA, 21 bp, Artificial sequence
  SiRNA target sequence
cgattagcatgttacatcaaa

SEQ ID NO: 16346 - DNA, 21 bp, Artificial sequence
  SiRNA target sequence
gattagcatgttacatcaaaa

SEQ ID NO: 16347 - DNA, 21 bp, Artificial sequence
  SiRNA target sequence
attagcatgttacatcaaaag

SEQ ID NO: 16348 - DNA, 21 bp, Artificial sequence
  SiRNA target sequence
ttagcatgttacatcaaaagt

SEQ ID NO: 16349 - DNA, 21 bp, Artificial sequence
  SiRNA target sequence
tagcatgttacatcaaaagta

SEQ ID NO: 16350 - DNA, 21 bp, Artificial sequence
  SiRNA target sequence
agcatgttacatcaaaagtat

SEQ ID NO: 16351 - DNA, 21 bp, Artificial sequence
  SiRNA target sequence
gcatgttacatcaaaagtatg

SEQ ID NO: 16352 - DNA, 21 bp, Artificial sequence
  SiRNA target sequence
catgttacatcaaaagtatga

SEQ ID NO: 16353 - DNA, 21 bp, Artificial sequence
  SiRNA target sequence
atgttacatcaaaagtatgat

SEQ ID NO: 16354 - DNA, 21 bp, Artificial sequence
  SiRNA target sequence
tgttacatcaaaagtatgata

SEQ ID NO: 16355 - DNA, 21 bp, Artificial sequence
  SiRNA target sequence
gttacatcaaaagtatgatac

SEQ ID NO: 16356 - DNA, 21 bp, Artificial sequence
  SiRNA target sequence
ttacatcaaaagtatgatacc

SEQ ID NO: 16357 - DNA, 21 bp, Artificial sequence
  SiRNA target sequence
tacatcaaaagtatgatacca

SEQ ID NO: 16358 - DNA, 21 bp, Artificial sequence
  SiRNA target sequence
acatcaaaagtatgataccac

SEQ ID NO: 16359 - DNA, 21 bp, Artificial sequence
  SiRNA target sequence
catcaaaagtatgataccaca

SEQ ID NO: 16360 - DNA, 21 bp, Artificial sequence
  SiRNA target sequence
atcaaaagtatgataccacag

SEQ ID NO: 16361 - DNA, 21 bp, Artificial sequence
  SiRNA target sequence
tcaaaagtatgataccacaga

SEQ ID NO: 16362 - DNA, 21 bp, Artificial sequence
  SiRNA target sequence
caaaagtatgataccacagag

SEQ ID NO: 16363 - DNA, 21 bp, Artificial sequence
  SiRNA target sequence
aaaagtatgataccacagagt

SEQ ID NO: 16364 - DNA, 21 bp, Artificial sequence
  SiRNA target sequence
aaagtatgataccacagagtg

SEQ ID NO: 16365 - DNA, 21 bp, Artificial sequence
  SiRNA target sequence
aagtatgataccacagagtgt

SEQ ID NO: 16366 - DNA, 21 bp, Artificial sequence
  SiRNA target sequence
agtatgataccacagagtgtg

SEQ ID NO: 16367 - DNA, 21 bp, Artificial sequence
  SiRNA target sequence
gtatgataccacagagtgtgc

SEQ ID NO: 16368 - DNA, 21 bp, Artificial sequence
  SiRNA target sequence
tatgataccacagagtgtgct

SEQ ID NO: 16369 - DNA, 21 bp, Artificial sequence
  SiRNA target sequence
atgataccacagagtgtgcta

SEQ ID NO: 16370 - DNA, 21 bp, Artificial sequence
  SiRNA target sequence
tgataccacagagtgtgctaa

SEQ ID NO: 16371 - DNA, 21 bp, Artificial sequence
  SiRNA target sequence
gataccacagagtgtgctaaa

SEQ ID NO: 16372 - DNA, 21 bp, Artificial sequence
  SiRNA target sequence
ataccacagagtgtgctaaat

SEQ ID NO: 16373 - DNA, 21 bp, Artificial sequence
  SiRNA target sequence
taccacagagtgtgctaaatg

SEQ ID NO: 16374 - DNA, 21 bp, Artificial sequence
  SiRNA target sequence
accacagagtgtgctaaatgt

SEQ ID NO: 16375 - DNA, 21 bp, Artificial sequence
  SiRNA target sequence
ccacagagtgtgctaaatgtc

SEQ ID NO: 16376 - DNA, 21 bp, Artificial sequence
  SiRNA target sequence
cacagagtgtgctaaatgtca

SEQ ID NO: 16377 - DNA, 21 bp, Artificial sequence
  SiRNA target sequence
acagagtgtgctaaatgtcaa

SEQ ID NO: 16378 - DNA, 21 bp, Artificial sequence
  SiRNA target sequence
cagagtgtgctaaatgtcaac

SEQ ID NO: 16379 - DNA, 21 bp, Artificial sequence
  SiRNA target sequence
agagtgtgctaaatgtcaaca

SEQ ID NO: 16380 - DNA, 21 bp, Artificial sequence
  SiRNA target sequence
gagtgtgctaaatgtcaacat

SEQ ID NO: 16381 - DNA, 21 bp, Artificial sequence
  SiRNA target sequence
agtgtgctaaatgtcaacatt

SEQ ID NO: 16382 - DNA, 21 bp, Artificial sequence
  SiRNA target sequence
gtgtgctaaatgtcaacattg

SEQ ID NO: 16383 - DNA, 21 bp, Artificial sequence
  SiRNA target sequence
tgtgctaaatgtcaacattgg

SEQ ID NO: 16384 - DNA, 21 bp, Artificial sequence
  SiRNA target sequence
gtgctaaatgtcaacattggt

SEQ ID NO: 16385 - DNA, 21 bp, Artificial sequence
  SiRNA target sequence
tgctaaatgtcaacattggta

SEQ ID NO: 16386 - DNA, 21 bp, Artificial sequence
  SiRNA target sequence
gctaaatgtcaacattggtat

SEQ ID NO: 16387 - DNA, 21 bp, Artificial sequence
  SiRNA target sequence
ctaaatgtcaacattggtatg

SEQ ID NO: 16388 - DNA, 21 bp, Artificial sequence
  SiRNA target sequence
taaatgtcaacattggtatgc

SEQ ID NO: 16389 - DNA, 21 bp, Artificial sequence
  SiRNA target sequence
aaatgtcaacattggtatgct

SEQ ID NO: 16390 - DNA, 21 bp, Artificial sequence
  SiRNA target sequence
aatgtcaacattggtatgctc

SEQ ID NO: 16391 - DNA, 21 bp, Artificial sequence
  SiRNA target sequence
atgtcaacattggtatgctcc

SEQ ID NO: 16392 - DNA, 21 bp, Artificial sequence
  SiRNA target sequence
tgtcaacattggtatgctccg

SEQ ID NO: 16393 - DNA, 21 bp, Artificial sequence
  SiRNA target sequence
gtcaacattggtatgctccgt

SEQ ID NO: 16394 - DNA, 21 bp, Artificial sequence
  SiRNA target sequence
tcaacattggtatgctccgtt

SEQ ID NO: 16395 - DNA, 21 bp, Artificial sequence
  SiRNA target sequence
caacattggtatgctccgttg

SEQ ID NO: 16396 - DNA, 21 bp, Artificial sequence
  SiRNA target sequence
aacattggtatgctccgttga

SEQ ID NO: 16397 - DNA, 21 bp, Artificial sequence
  SiRNA target sequence
acattggtatgctccgttgac

SEQ ID NO: 16398 - DNA, 21 bp, Artificial sequence
  SiRNA target sequence
cattggtatgctccgttgact

SEQ ID NO: 16399 - DNA, 21 bp, Artificial sequence
  SiRNA target sequence
attggtatgctccgttgactg

SEQ ID NO: 16400 - DNA, 21 bp, Artificial sequence
  SiRNA target sequence
ttggtatgctccgttgactga

SEQ ID NO: 16401 - DNA, 21 bp, Artificial sequence
  SiRNA target sequence
tggtatgctccgttgactgat

SEQ ID NO: 16402 - DNA, 21 bp, Artificial sequence
  SiRNA target sequence
ggtatgctccgttgactgata

SEQ ID NO: 16403 - DNA, 21 bp, Artificial sequence
  SiRNA target sequence
gtatgctccgttgactgatat

SEQ ID NO: 16404 - DNA, 21 bp, Artificial sequence
  SiRNA target sequence
tatgctccgttgactgatatc

SEQ ID NO: 16405 - DNA, 21 bp, Artificial sequence
  SiRNA target sequence
atgctccgttgactgatatct

SEQ ID NO: 16406 - DNA, 21 bp, Artificial sequence
  SiRNA target sequence
tgctccgttgactgatatcta

SEQ ID NO: 16407 - DNA, 21 bp, Artificial sequence
  SiRNA target sequence
gctccgttgactgatatctat

SEQ ID NO: 16408 - DNA, 21 bp, Artificial sequence
  SiRNA target sequence
ctccgttgactgatatctatg

SEQ ID NO: 16409 - DNA, 21 bp, Artificial sequence
  SiRNA target sequence
tccgttgactgatatctatgt

SEQ ID NO: 16410 - DNA, 21 bp, Artificial sequence
  SiRNA target sequence
ccgttgactgatatctatgtt

SEQ ID NO: 16411 - DNA, 21 bp, Artificial sequence
  SiRNA target sequence
cgttgactgatatctatgttg

SEQ ID NO: 16412 - DNA, 21 bp, Artificial sequence
  SiRNA target sequence
gttgactgatatctatgttga

SEQ ID NO: 16413 - DNA, 21 bp, Artificial sequence
  SiRNA target sequence
ttgactgatatctatgttgat

SEQ ID NO: 16414 - DNA, 21 bp, Artificial sequence
  SiRNA target sequence
tgactgatatctatgttgatg

SEQ ID NO: 16415 - DNA, 21 bp, Artificial sequence
  SiRNA target sequence
gactgatatctatgttgatga

SEQ ID NO: 16416 - DNA, 21 bp, Artificial sequence
  SiRNA target sequence
actgatatctatgttgatgac

SEQ ID NO: 16417 - DNA, 21 bp, Artificial sequence
  SiRNA target sequence
ctgatatctatgttgatgaca

SEQ ID NO: 16418 - DNA, 21 bp, Artificial sequence
  SiRNA target sequence
tgatatctatgttgatgacaa

SEQ ID NO: 16419 - DNA, 21 bp, Artificial sequence
  SiRNA target sequence
gatatctatgttgatgacaag

SEQ ID NO: 16420 - DNA, 21 bp, Artificial sequence
  SiRNA target sequence
atatctatgttgatgacaaga

SEQ ID NO: 16421 - DNA, 21 bp, Artificial sequence
  SiRNA target sequence
tatctatgttgatgacaagaa

SEQ ID NO: 16422 - DNA, 21 bp, Artificial sequence
  SiRNA target sequence
atctatgttgatgacaagaaa

SEQ ID NO: 16423 - DNA, 21 bp, Artificial sequence
  SiRNA target sequence
tctatgttgatgacaagaaat

SEQ ID NO: 16424 - DNA, 21 bp, Artificial sequence
  SiRNA target sequence
ctatgttgatgacaagaaatt

SEQ ID NO: 16425 - DNA, 21 bp, Artificial sequence
  SiRNA target sequence
tatgttgatgacaagaaattg

SEQ ID NO: 16426 - DNA, 21 bp, Artificial sequence
  SiRNA target sequence
atgttgatgacaagaaattgt

SEQ ID NO: 16427 - DNA, 21 bp, Artificial sequence
  SiRNA target sequence
tgttgatgacaagaaattgtt

SEQ ID NO: 16428 - DNA, 21 bp, Artificial sequence
  SiRNA target sequence
  misc_feature (21)..(21): n is a, c, g, or t
gttgatgacaagaaattgttn

SEQ ID NO: 16429 - DNA, 21 bp, Artificial sequence
  SiRNA target sequence
  misc_feature (20)..(20): n is a, c, g, or t
ttgatgacaagaaattgttnt

SEQ ID NO: 16430 - DNA, 21 bp, Artificial sequence
  SiRNA target sequence
  misc_feature (19)..(19): n is a, c, g, or t
tgatgacaagaaattgttntg

SEQ ID NO: 16431 - DNA, 21 bp, Artificial sequence
  SiRNA target sequence
  misc_feature (18)..(18): n is a, c, g, or t
gatgacaagaaattgttntgg

SEQ ID NO: 16432 - DNA, 21 bp, Artificial sequence
  SiRNA target sequence
  misc_feature (17)..(17): n is a, c, g, or t
atgacaagaaattgttntggt

SEQ ID NO: 16433 - DNA, 21 bp, Artificial sequence
  SiRNA target sequence
  misc_feature (16)..(16): n is a, c, g, or t
tgacaagaaattgttntggtg

SEQ ID NO: 16434 - DNA, 21 bp, Artificial sequence
  SiRNA target sequence
  misc_feature (15)..(15): n is a, c, g, or t
gacaagaaattgttntggtgt

SEQ ID NO: 16435 - DNA, 21 bp, Artificial sequence
  SiRNA target sequence
  misc_feature (14)..(14): n is a, c, g, or t
acaagaaattgttntggtgtc

SEQ ID NO: 16436 - DNA, 21 bp, Artificial sequence
  SiRNA target sequence
  misc_feature (13)..(13): n is a, c, g, or t
caagaaattgttntggtgtca

SEQ ID NO: 16437 - DNA, 21 bp, Artificial sequence
  SiRNA target sequence
  misc_feature (12)..(12): n is a, c, g, or t
aagaaattgttntggtgtcag

SEQ ID NO: 16438 - DNA, 21 bp, Artificial sequence
  SiRNA target sequence
  misc_feature (11)..(11): n is a, c, g, or t
agaaattgttntggtgtcaga

SEQ ID NO: 16439 - DNA, 21 bp, Artificial sequence
  SiRNA target sequence
  misc_feature (10)..(10): n is a, c, g, or t
gaaattgttntggtgtcagaa

SEQ ID NO: 16440 - DNA, 21 bp, Artificial sequence
  SiRNA target sequence
  misc_feature (9)..(9): n is a, c, g, or t
aaattgttntggtgtcagaaa

SEQ ID NO: 16441 - DNA, 21 bp, Artificial sequence
  SiRNA target sequence
  misc_feature (8)..(8): n is a, c, g, or t
aattgttntggtgtcagaaag

SEQ ID NO: 16442 - DNA, 21 bp, Artificial sequence
  SiRNA target sequence
  misc_feature (7)..(7): n is a, c, g, or t
attgttntggtgtcagaaaga

SEQ ID NO: 16443 - DNA, 21 bp, Artificial sequence
  SiRNA target sequence
  misc_feature (6)..(6): n is a, c, g, or t
ttgttntggtgtcagaaagag

SEQ ID NO: 16444 - DNA, 21 bp, Artificial sequence
  SiRNA target sequence
  misc_feature (5)..(5): n is a, c, g, or t
tgttntggtgtcagaaagaga

SEQ ID NO: 16445 - DNA, 21 bp, Artificial sequence
  SiRNA target sequence
  misc_feature (4)..(4): n is a, c, g, or t
gttntggtgtcagaaagagaa

SEQ ID NO: 16446 - DNA, 21 bp, Artificial sequence
  SiRNA target sequence
  misc_feature (3)..(3): n is a, c, g, or t
ttntggtgtcagaaagagaaa

SEQ ID NO: 16447 - DNA, 21 bp, Artificial sequence
  SiRNA target sequence
  misc_feature (2)..(2): n is a, c, g, or t
tntggtgtcagaaagagaaaa

SEQ ID NO: 16448 - DNA, 21 bp, Artificial sequence
  SiRNA target sequence
  misc_feature (1)..(1): n is a, c, g, or t
ntggtgtcagaaagagaaaaa

SEQ ID NO: 16449 - DNA, 21 bp, Artificial sequence
  SiRNA target sequence
tggtgtcagaaagagaaaaag

SEQ ID NO: 16450 - DNA, 21 bp, Artificial sequence
  SiRNA target sequence
ggtgtcagaaagagaaaaaga

SEQ ID NO: 16451 - DNA, 21 bp, Artificial sequence
  SiRNA target sequence
gtgtcagaaagagaaaaagac

SEQ ID NO: 16452 - DNA, 21 bp, Artificial sequence
  SiRNA target sequence
tgtcagaaagagaaaaagaca

SEQ ID NO: 16453 - DNA, 21 bp, Artificial sequence
  SiRNA target sequence
gtcagaaagagaaaaagacac

SEQ ID NO: 16454 - DNA, 21 bp, Artificial sequence
  SiRNA target sequence
tcagaaagagaaaaagacact

SEQ ID NO: 16455 - DNA, 21 bp, Artificial sequence
  SiRNA target sequence
cagaaagagaaaaagacactt

SEQ ID NO: 16456 - DNA, 21 bp, Artificial sequence
  SiRNA target sequence
agaaagagaaaaagacactta

SEQ ID NO: 16457 - DNA, 21 bp, Artificial sequence
  SiRNA target sequence
gaaagagaaaaagacacttat

SEQ ID NO: 16458 - DNA, 21 bp, Artificial sequence
  SiRNA target sequence
aaagagaaaaagacacttatt

SEQ ID NO: 16459 - DNA, 21 bp, Artificial sequence
  SiRNA target sequence
aagagaaaaagacacttattg

SEQ ID NO: 16460 - DNA, 21 bp, Artificial sequence
  SiRNA target sequence
agagaaaaagacacttattga

SEQ ID NO: 16461 - DNA, 21 bp, Artificial sequence
  SiRNA target sequence
gagaaaaagacacttattgat

SEQ ID NO: 16462 - DNA, 21 bp, Artificial sequence
  SiRNA target sequence
agaaaaagacacttattgatg

SEQ ID NO: 16463 - DNA, 21 bp, Artificial sequence
  SiRNA target sequence
gaaaaagacacttattgatgt

SEQ ID NO: 16464 - DNA, 21 bp, Artificial sequence
  SiRNA target sequence
aaaaagacacttattgatgtc

SEQ ID NO: 16465 - DNA, 21 bp, Artificial sequence
  SiRNA target sequence
aaaagacacttattgatgtcc

SEQ ID NO: 16466 - DNA, 21 bp, Artificial sequence
  SiRNA target sequence
aaagacacttattgatgtccg

SEQ ID NO: 16467 - DNA, 21 bp, Artificial sequence
  SiRNA target sequence
aagacacttattgatgtccga

SEQ ID NO: 16468 - DNA, 21 bp, Artificial sequence
  SiRNA target sequence
agacacttattgatgtccgaa

SEQ ID NO: 16469 - DNA, 21 bp, Artificial sequence
  SiRNA target sequence
gacacttattgatgtccgaaa

SEQ ID NO: 16470 - DNA, 21 bp, Artificial sequence
  SiRNA target sequence
acacttattgatgtccgaaaa

SEQ ID NO: 16471 - DNA, 21 bp, Artificial sequence
  SiRNA target sequence
cacttattgatgtccgaaaat

SEQ ID NO: 16472 - DNA, 21 bp, Artificial sequence
  SiRNA target sequence
acttattgatgtccgaaaatt

SEQ ID NO: 16473 - DNA, 21 bp, Artificial sequence
  SiRNA target sequence
cttattgatgtccgaaaattg

SEQ ID NO: 16474 - DNA, 21 bp, Artificial sequence
  SiRNA target sequence
ttattgatgtccgaaaattgt

SEQ ID NO: 16475 - DNA, 21 bp, Artificial sequence
  SiRNA target sequence
tattgatgtccgaaaattgtc

SEQ ID NO: 16476 - DNA, 21 bp, Artificial sequence
  SiRNA target sequence
attgatgtccgaaaattgtcg

SEQ ID NO: 16477 - DNA, 21 bp, Artificial sequence
  SiRNA target sequence
ttgatgtccgaaaattgtcga

SEQ ID NO: 16478 - DNA, 21 bp, Artificial sequence
  SiRNA target sequence
tgatgtccgaaaattgtcgaa

SEQ ID NO: 16479 - DNA, 21 bp, Artificial sequence
  SiRNA target sequence
gatgtccgaaaattgtcgaaa

SEQ ID NO: 16480 - DNA, 21 bp, Artificial sequence
  SiRNA target sequence
atgtccgaaaattgtcgaaag

SEQ ID NO: 16481 - DNA, 21 bp, Artificial sequence
  SiRNA target sequence
tgtccgaaaattgtcgaaaga

SEQ ID NO: 16482 - DNA, 21 bp, Artificial sequence
  SiRNA target sequence
gtccgaaaattgtcgaaagaa

SEQ ID NO: 16483 - DNA, 21 bp, Artificial sequence
  SiRNA target sequence
tccgaaaattgtcgaaagaag

SEQ ID NO: 16484 - DNA, 21 bp, Artificial sequence
  SiRNA target sequence
ccgaaaattgtcgaaagaaga

SEQ ID NO: 16485 - DNA, 21 bp, Artificial sequence
  SiRNA target sequence
cgaaaattgtcgaaagaagat

SEQ ID NO: 16486 - DNA, 21 bp, Artificial sequence
  SiRNA target sequence
gaaaattgtcgaaagaagatg

SEQ ID NO: 16487 - DNA, 21 bp, Artificial sequence
  SiRNA target sequence
aaaattgtcgaaagaagatgt

SEQ ID NO: 16488 - DNA, 21 bp, Artificial sequence
  SiRNA target sequence
aaattgtcgaaagaagatgtg

SEQ ID NO: 16489 - DNA, 21 bp, Artificial sequence
  SiRNA target sequence
aattgtcgaaagaagatgtga

SEQ ID NO: 16490 - DNA, 21 bp, Artificial sequence
  SiRNA target sequence
attgtcgaaagaagatgtgac

SEQ ID NO: 16491 - DNA, 21 bp, Artificial sequence
  SiRNA target sequence
ttgtcgaaagaagatgtgact

SEQ ID NO: 16492 - DNA, 21 bp, Artificial sequence
  SiRNA target sequence
tgtcgaaagaagatgtgactg

SEQ ID NO: 16493 - DNA, 21 bp, Artificial sequence
  SiRNA target sequence
gtcgaaagaagatgtgactgt

SEQ ID NO: 16494 - DNA, 21 bp, Artificial sequence
  SiRNA target sequence
tcgaaagaagatgtgactgtt

SEQ ID NO: 16495 - DNA, 21 bp, Artificial sequence
  SiRNA target sequence
cgaaagaagatgtgactgttc

SEQ ID NO: 16496 - DNA, 21 bp, Artificial sequence
  SiRNA target sequence
gaaagaagatgtgactgttca

SEQ ID NO: 16497 - DNA, 21 bp, Artificial sequence
  SiRNA target sequence
aaagaagatgtgactgttcaa

SEQ ID NO: 16498 - DNA, 21 bp, Artificial sequence
  SiRNA target sequence
aagaagatgtgactgttcaat

SEQ ID NO: 16499 - DNA, 21 bp, Artificial sequence
  SiRNA target sequence
agaagatgtgactgttcaatc

SEQ ID NO: 16500 - DNA, 21 bp, Artificial sequence
  SiRNA target sequence
  misc_feature (21)..(21): n is a, c, g, or t
gaagatgtgactgttcaatcn

SEQ ID NO: 16501 - DNA, 21 bp, Artificial sequence
  SiRNA target sequence
  misc_feature (20)..(20): n is a, c, g, or t
aagatgtgactgttcaatcna

SEQ ID NO: 16502 - DNA, 21 bp, Artificial sequence
  SiRNA target sequence
  misc_feature (19)..(19): n is a, c, g, or t
agatgtgactgttcaatcnaa

SEQ ID NO: 16503 - DNA, 21 bp, Artificial sequence
  SiRNA target sequence
  misc_feature (18)..(18): n is a, c, g, or t
gatgtgactgttcaatcnaaa

SEQ ID NO: 16504 - DNA, 21 bp, Artificial sequence
  SiRNA target sequence
  misc_feature (17)..(17): n is a, c, g, or t
atgtgactgttcaatcnaaat

SEQ ID NO: 16505 - DNA, 21 bp, Artificial sequence
  SiRNA target sequence
  misc_feature (16)..(16): n is a, c, g, or t
tgtgactgttcaatcnaaatt

SEQ ID NO: 16506 - DNA, 21 bp, Artificial sequence
  SiRNA target sequence
  misc_feature (15)..(15): n is a, c, g, or t
gtgactgttcaatcnaaattg

SEQ ID NO: 16507 - DNA, 21 bp, Artificial sequence
  SiRNA target sequence
  misc_feature (14)..(14): n is a, c, g, or t
  misc_feature (21)..(21): n is a, c, g, or t
tgactgttcaatcnaaattgn

SEQ ID NO: 16508 - DNA, 21 bp, Artificial sequence
  SiRNA target sequence
  misc_feature (13)..(13): n is a, c, g, or t
  misc_feature (20)..(20): n is a, c, g, or t
gactgttcaatcnaaattgnt

SEQ ID NO: 16509 - DNA, 21 bp, Artificial sequence
  SiRNA target sequence
  misc_feature (12)..(12): n is a, c, g, or t
  misc_feature (19)..(19): n is a, c, g, or t
actgttcaatcnaaattgntt

SEQ ID NO: 16510 - DNA, 21 bp, Artificial sequence
  SiRNA target sequence
  misc_feature (11)..(11): n is a, c, g, or t
  misc_feature (18)..(18): n is a, c, g, or t
ctgttcaatcnaaattgntta

SEQ ID NO: 16511 - DNA, 21 bp, Artificial sequence
  SiRNA target sequence
  misc_feature (10)..(10): n is a, c, g, or t
  misc_feature (17)..(17): n is a, c, g, or t
tgttcaatcnaaattgnttaa

SEQ ID NO: 16512 - DNA, 21 bp, Artificial sequence
  SiRNA target sequence
  misc_feature (9)..(9): n is a, c, g, or t
  misc_feature (16)..(16): n is a, c, g, or t
gttcaatcnaaattgnttaat

SEQ ID NO: 16513 - DNA, 21 bp, Artificial sequence
  SiRNA target sequence
  misc_feature (8)..(8): n is a, c, g, or t
  misc_feature (15)..(15): n is a, c, g, or t
ttcaatcnaaattgnttaatt

SEQ ID NO: 16514 - DNA, 21 bp, Artificial sequence
  SiRNA target sequence
  misc_feature (7)..(7): n is a, c, g, or t
  misc_feature (14)..(14): n is a, c, g, or t
tcaatcnaaattgnttaattt

SEQ ID NO: 16515 - DNA, 21 bp, Artificial sequence
  SiRNA target sequence
  misc_feature (6)..(6): n is a, c, g, or t
  misc_feature (13)..(13): n is a, c, g, or t
caatcnaaattgnttaattta

SEQ ID NO: 16516 - DNA, 21 bp, Artificial sequence
  SiRNA target sequence
  misc_feature (5)..(5): n is a, c, g, or t
  misc_feature (12)..(12): n is a, c, g, or t
aatcnaaattgnttaatttat

SEQ ID NO: 16517 - DNA, 21 bp, Artificial sequence
  SiRNA target sequence
  misc_feature (4)..(4): n is a, c, g, or t
  misc_feature (11)..(11): n is a, c, g, or t
atcnaaattgnttaatttatc

SEQ ID NO: 16518 - DNA, 21 bp, Artificial sequence
  SiRNA target sequence
  misc_feature (3)..(3): n is a, c, g, or t
  misc_feature (10)..(10): n is a, c, g, or t
tcnaaattgnttaatttatct

SEQ ID NO: 16519 - DNA, 21 bp, Artificial sequence
  SiRNA target sequence
  misc_feature (2)..(2): n is a, c, g, or t
  misc_feature (9)..(9): n is a, c, g, or t
cnaaattgnttaatttatctg

SEQ ID NO: 16520 - DNA, 21 bp, Artificial sequence
  SiRNA target sequence
  misc_feature (1)..(1): n is a, c, g, or t
  misc_feature (8)..(8): n is a, c, g, or t
naaattgnttaatttatctgt

SEQ ID NO: 16521 - DNA, 21 bp, Artificial sequence
  SiRNA target sequence
  misc_feature (7)..(7): n is a, c, g, or t
aaattgnttaatttatctgtt

SEQ ID NO: 16522 - DNA, 21 bp, Artificial sequence
  SiRNA target sequence
  misc_feature (6)..(6): n is a, c, g, or t
aattgnttaatttatctgttc

SEQ ID NO: 16523 - DNA, 21 bp, Artificial sequence
  SiRNA target sequence
  misc_feature (5)..(5): n is a, c, g, or t
attgnttaatttatctgttcc

SEQ ID NO: 16524 - DNA, 21 bp, Artificial sequence
  SiRNA target sequence
  misc_feature (4)..(4): n is a, c, g, or t
ttgnttaatttatctgttcct

SEQ ID NO: 16525 - DNA, 21 bp, Artificial sequence
  SiRNA target sequence
  misc_feature (3)..(3): n is a, c, g, or t
tgnttaatttatctgttcctt

SEQ ID NO: 16526 - DNA, 21 bp, Artificial sequence
  SiRNA target sequence
  misc_feature (2)..(2): n is a, c, g, or t
gnttaatttatctgttccttg

SEQ ID NO: 16527 - DNA, 21 bp, Artificial sequence
  SiRNA target sequence
  misc_feature (1)..(1): n is a, c, g, or t
nttaatttatctgttccttgt

SEQ ID NO: 16528 - DNA, 21 bp, Artificial sequence
  SiRNA target sequence
ttaatttatctgttccttgtg

SEQ ID NO: 16529 - DNA, 21 bp, Artificial sequence
  SiRNA target sequence
taatttatctgttccttgtgg

SEQ ID NO: 16530 - DNA, 21 bp, Artificial sequence
  SiRNA target sequence
aatttatctgttccttgtggt

SEQ ID NO: 16531 - DNA, 21 bp, Artificial sequence
  SiRNA target sequence
atttatctgttccttgtggtg

SEQ ID NO: 16532 - DNA, 21 bp, Artificial sequence
  SiRNA target sequence
tttatctgttccttgtggtga

SEQ ID NO: 16533 - DNA, 21 bp, Artificial sequence
  SiRNA target sequence
ttatctgttccttgtggtgaa

SEQ ID NO: 16534 - DNA, 21 bp, Artificial sequence
  SiRNA target sequence
tatctgttccttgtggtgaag

SEQ ID NO: 16535 - DNA, 21 bp, Artificial sequence
  SiRNA target sequence
atctgttccttgtggtgaagt

SEQ ID NO: 16536 - DNA, 21 bp, Artificial sequence
  SiRNA target sequence
  misc_feature (21)..(21): n is a, c, g, or t
tctgttccttgtggtgaagtn

SEQ ID NO: 16537 - DNA, 21 bp, Artificial sequence
  SiRNA target sequence
  misc_feature (20)..(20): n is a, c, g, or t
ctgttccttgtggtgaagtnt

SEQ ID NO: 16538 - DNA, 21 bp, Artificial sequence
  SiRNA target sequence
  misc_feature (19)..(19): n is a, c, g, or t
tgttccttgtggtgaagtntg

SEQ ID NO: 16539 - DNA, 21 bp, Artificial sequence
  SiRNA target sequence
  misc_feature (18)..(18): n is a, c, g, or t
gttccttgtggtgaagtntgt

SEQ ID NO: 16540 - DNA, 21 bp, Artificial sequence
  SiRNA target sequence
  misc_feature (17)..(17): n is a, c, g, or t
ttccttgtggtgaagtntgta

SEQ ID NO: 16541 - DNA, 21 bp, Artificial sequence
  SiRNA target sequence
  misc_feature (16)..(16): n is a, c, g, or t
tccttgtggtgaagtntgtat

SEQ ID NO: 16542 - DNA, 21 bp, Artificial sequence
  SiRNA target sequence
  misc_feature (15)..(15): n is a, c, g, or t
ccttgtggtgaagtntgtatg

SEQ ID NO: 16543 - DNA, 21 bp, Artificial sequence
  SiRNA target sequence
  misc_feature (14)..(14): n is a, c, g, or t
cttgtggtgaagtntgtatgt

SEQ ID NO: 16544 - DNA, 21 bp, Artificial sequence
  SiRNA target sequence
  misc_feature (13)..(13): n is a, c, g, or t
ttgtggtgaagtntgtatgtt

SEQ ID NO: 16545 - DNA, 21 bp, Artificial sequence
  SiRNA target sequence
  misc_feature (12)..(12): n is a, c, g, or t
tgtggtgaagtntgtatgtta

SEQ ID NO: 16546 - DNA, 21 bp, Artificial sequence
  SiRNA target sequence
  misc_feature (11)..(11): n is a, c, g, or t
gtggtgaagtntgtatgttac

SEQ ID NO: 16547 - DNA, 21 bp, Artificial sequence
  SiRNA target sequence
  misc_feature (10)..(10): n is a, c, g, or t
tggtgaagtntgtatgttaca

SEQ ID NO: 16548 - DNA, 21 bp, Artificial sequence
  SiRNA target sequence
  misc_feature (9)..(9): n is a, c, g, or t
ggtgaagtntgtatgttacat

SEQ ID NO: 16549 - DNA, 21 bp, Artificial sequence
  SiRNA target sequence
  misc_feature (8)..(8): n is a, c, g, or t
gtgaagtntgtatgttacatt

SEQ ID NO: 16550 - DNA, 21 bp, Artificial sequence
  SiRNA target sequence
  misc_feature (7)..(7): n is a, c, g, or t
tgaagtntgtatgttacattc

SEQ ID NO: 16551 - DNA, 21 bp, Artificial sequence
  SiRNA target sequence
  misc_feature (6)..(6): n is a, c, g, or t
gaagtntgtatgttacattca

SEQ ID NO: 16552 - DNA, 21 bp, Artificial sequence
  SiRNA target sequence
  misc_feature (5)..(5): n is a, c, g, or t
aagtntgtatgttacattcaa

SEQ ID NO: 16553 - DNA, 21 bp, Artificial sequence
  SiRNA target sequence
  misc_feature (4)..(4): n is a, c, g, or t
agtntgtatgttacattcaaa

SEQ ID NO: 16554 - DNA, 21 bp, Artificial sequence
  SiRNA target sequence
  misc_feature (3)..(3): n is a, c, g, or t
gtntgtatgttacattcaaaa

SEQ ID NO: 16555 - DNA, 21 bp, Artificial sequence
  SiRNA target sequence
  misc_feature (2)..(2): n is a, c, g, or t
tntgtatgttacattcaaaat

SEQ ID NO: 16556 - DNA, 21 bp, Artificial sequence
  SiRNA target sequence
  misc_feature (1)..(1): n is a, c, g, or t
ntgtatgttacattcaaaata

SEQ ID NO: 16557 - DNA, 21 bp, Artificial sequence
  SiRNA target sequence
tgtatgttacattcaaaatat

SEQ ID NO: 16558 - DNA, 21 bp, Artificial sequence
  SiRNA target sequence
gtatgttacattcaaaatatt

SEQ ID NO: 16559 - DNA, 21 bp, Artificial sequence
  SiRNA target sequence
tatgttacattcaaaatattt

SEQ ID NO: 16560 - DNA, 21 bp, Artificial sequence
  SiRNA target sequence
  misc_feature (21)..(21): n is a, c, g, or t
atgttacattcaaaatatttn

SEQ ID NO: 16561 - DNA, 21 bp, Artificial sequence
  SiRNA target sequence
  misc_feature (20)..(20): n is a, c, g, or t
tgttacattcaaaatatttna

SEQ ID NO: 16562 - DNA, 21 bp, Artificial sequence
  SiRNA target sequence
  misc_feature (19)..(19): n is a, c, g, or t
gttacattcaaaatatttnaa

SEQ ID NO: 16563 - DNA, 21 bp, Artificial sequence
  SiRNA target sequence
  misc_feature (18)..(18): n is a, c, g, or t
ttacattcaaaatatttnaat

SEQ ID NO: 16564 - DNA, 21 bp, Artificial sequence
  SiRNA target sequence
  misc_feature (17)..(17): n is a, c, g, or t
tacattcaaaatatttnaatt

SEQ ID NO: 16565 - DNA, 21 bp, Artificial sequence
  SiRNA target sequence
  misc_feature (16)..(16): n is a, c, g, or t
acattcaaaatatttnaatta

SEQ ID NO: 16566 - DNA, 21 bp, Artificial sequence
  SiRNA target sequence
  misc_feature (15)..(15): n is a, c, g, or t
cattcaaaatatttnaattat

SEQ ID NO: 16567 - DNA, 21 bp, Artificial sequence
  SiRNA target sequence
  misc_feature (14)..(14): n is a, c, g, or t
attcaaaatatttnaattatc

SEQ ID NO: 16568 - DNA, 21 bp, Artificial sequence
  SiRNA target sequence
  misc_feature (13)..(13): n is a, c, g, or t
ttcaaaatatttnaattatct

SEQ ID NO: 16569 - DNA, 21 bp, Artificial sequence
  SiRNA target sequence
  misc_feature (12)..(12): n is a, c, g, or t
tcaaaatatttnaattatctt

SEQ ID NO: 16570 - DNA, 21 bp, Artificial sequence
  SiRNA target sequence
  misc_feature (11)..(11): n is a, c, g, or t
caaaatatttnaattatcttt

SEQ ID NO: 16571 - DNA, 21 bp, Artificial sequence
  SiRNA target sequence
  misc_feature (10)..(10): n is a, c, g, or t
aaaatatttnaattatctttt

SEQ ID NO: 16572 - DNA, 21 bp, Artificial sequence
  SiRNA target sequence
  misc_feature (9)..(9): n is a, c, g, or t
aaatatttnaattatcttttc

SEQ ID NO: 16573 - DNA, 21 bp, Artificial sequence
  SiRNA target sequence
  misc_feature (8)..(8): n is a, c, g, or t
aatatttnaattatcttttcc

SEQ ID NO: 16574 - DNA, 21 bp, Artificial sequence
  SiRNA target sequence
  misc_feature (7)..(7): n is a, c, g, or t
atatttnaattatcttttcca

SEQ ID NO: 16575 - DNA, 21 bp, Artificial sequence
  SiRNA target sequence
  misc_feature (6)..(6): n is a, c, g, or t
tatttnaattatcttttccat

SEQ ID NO: 16576 - DNA, 21 bp, Artificial sequence
  SiRNA target sequence
  misc_feature (5)..(5): n is a, c, g, or t
atttnaattatcttttccata

SEQ ID NO: 16577 - DNA, 21 bp, Artificial sequence
  SiRNA target sequence
  misc_feature (4)..(4): n is a, c, g, or t
tttnaattatcttttccataa

SEQ ID NO: 16578 - DNA, 21 bp, Artificial sequence
  SiRNA target sequence
  misc_feature (3)..(3): n is a, c, g, or t
ttnaattatcttttccataaa

SEQ ID NO: 16579 - DNA, 21 bp, Artificial sequence
  SiRNA target sequence
  misc_feature (2)..(2): n is a, c, g, or t
tnaattatcttttccataaag

SEQ ID NO: 16580 - DNA, 21 bp, Artificial sequence
  SiRNA target sequence
  misc_feature (1)..(1): n is a, c, g, or t
naattatcttttccataaagc

SEQ ID NO: 16581 - DNA, 21 bp, Artificial sequence
  SiRNA target sequence
aattatcttttccataaagca

SEQ ID NO: 16582 - DNA, 21 bp, Artificial sequence
  SiRNA target sequence
attatcttttccataaagcat

SEQ ID NO: 16583 - DNA, 21 bp, Artificial sequence
  SiRNA target sequence
ttatcttttccataaagcatg

SEQ ID NO: 16584 - DNA, 21 bp, Artificial sequence
  SiRNA target sequence
tatcttttccataaagcatgg

SEQ ID NO: 16585 - DNA, 21 bp, Artificial sequence
  SiRNA target sequence
atcttttccataaagcatggt

SEQ ID NO: 16586 - DNA, 21 bp, Artificial sequence
  SiRNA target sequence
tcttttccataaagcatggtt

SEQ ID NO: 16587 - DNA, 21 bp, Artificial sequence
  SiRNA target sequence
cttttccataaagcatggttg

SEQ ID NO: 16588 - DNA, 21 bp, Artificial sequence
  SiRNA target sequence
ttttccataaagcatggttgt

SEQ ID NO: 16589 - DNA, 21 bp, Artificial sequence
  SiRNA target sequence
tttccataaagcatggttgtt

SEQ ID NO: 16590 - DNA, 21 bp, Artificial sequence
  SiRNA target sequence
ttccataaagcatggttgttt

SEQ ID NO: 16591 - DNA, 21 bp, Artificial sequence
  SiRNA target sequence
tccataaagcatggttgtttg

SEQ ID NO: 16592 - DNA, 21 bp, Artificial sequence
  SiRNA target sequence
ccataaagcatggttgtttga

SEQ ID NO: 16593 - DNA, 21 bp, Artificial sequence
  SiRNA target sequence
cataaagcatggttgtttgag

SEQ ID NO: 16594 - DNA, 21 bp, Artificial sequence
  SiRNA target sequence
ataaagcatggttgtttgaga

SEQ ID NO: 16595 - DNA, 21 bp, Artificial sequence
  SiRNA target sequence
taaagcatggttgtttgagaa

SEQ ID NO: 16596 - DNA, 21 bp, Artificial sequence
  SiRNA target sequence
aaagcatggttgtttgagaac

SEQ ID NO: 16597 - DNA, 21 bp, Artificial sequence
  SiRNA target sequence
aagcatggttgtttgagaacc

SEQ ID NO: 16598 - DNA, 21 bp, Artificial sequence
  SiRNA target sequence
agcatggttgtttgagaaccc

SEQ ID NO: 16599 - DNA, 21 bp, Artificial sequence
  SiRNA target sequence
gcatggttgtttgagaaccca

SEQ ID NO: 16600 - DNA, 21 bp, Artificial sequence
  SiRNA target sequence
catggttgtttgagaacccaa

SEQ ID NO: 16601 - DNA, 21 bp, Artificial sequence
  SiRNA target sequence
atggttgtttgagaacccaac

SEQ ID NO: 16602 - DNA, 21 bp, Artificial sequence
  SiRNA target sequence
tggttgtttgagaacccaact

SEQ ID NO: 16603 - DNA, 21 bp, Artificial sequence
  SiRNA target sequence
ggttgtttgagaacccaactt

SEQ ID NO: 16604 - DNA, 21 bp, Artificial sequence
  SiRNA target sequence
gttgtttgagaacccaacttg

SEQ ID NO: 16605 - DNA, 21 bp, Artificial sequence
  SiRNA target sequence
ttgtttgagaacccaacttgg

SEQ ID NO: 16606 - DNA, 21 bp, Artificial sequence
  SiRNA target sequence
tgtttgagaacccaacttggc

SEQ ID NO: 16607 - DNA, 21 bp, Artificial sequence
  SiRNA target sequence
gtttgagaacccaacttggcg

SEQ ID NO: 16608 - DNA, 21 bp, Artificial sequence
  SiRNA target sequence
tttgagaacccaacttggcgc

SEQ ID NO: 16609 - DNA, 21 bp, Artificial sequence
  SiRNA target sequence
ttgagaacccaacttggcgcc

SEQ ID NO: 16610 - DNA, 21 bp, Artificial sequence
  SiRNA target sequence
tgagaacccaacttggcgcct

SEQ ID NO: 16611 - DNA, 21 bp, Artificial sequence
  SiRNA target sequence
gagaacccaacttggcgccta

SEQ ID NO: 16612 - DNA, 21 bp, Artificial sequence
  SiRNA target sequence
agaacccaacttggcgcctaa

SEQ ID NO: 16613 - DNA, 21 bp, Artificial sequence
  SiRNA target sequence
gaacccaacttggcgcctaat

SEQ ID NO: 16614 - DNA, 21 bp, Artificial sequence
  SiRNA target sequence
aacccaacttggcgcctaata

SEQ ID NO: 16615 - DNA, 21 bp, Artificial sequence
  SiRNA target sequence
acccaacttggcgcctaatat

SEQ ID NO: 16616 - DNA, 21 bp, Artificial sequence
  SiRNA target sequence
cccaacttggcgcctaatata

SEQ ID NO: 16617 - DNA, 21 bp, Artificial sequence
  SiRNA target sequence
ccaacttggcgcctaatatat

SEQ ID NO: 16618 - DNA, 21 bp, Artificial sequence
  SiRNA target sequence
caacttggcgcctaatatata

SEQ ID NO: 16619 - DNA, 21 bp, Artificial sequence
  SiRNA target sequence
aacttggcgcctaatatataa

SEQ ID NO: 16620 - DNA, 21 bp, Artificial sequence
  SiRNA target sequence
acttggcgcctaatatataat

SEQ ID NO: 16621 - DNA, 21 bp, Artificial sequence
  SiRNA target sequence
cttggcgcctaatatataatg

SEQ ID NO: 16622 - DNA, 21 bp, Artificial sequence
  SiRNA target sequence
ttggcgcctaatatataatgg

SEQ ID NO: 16623 - DNA, 21 bp, Artificial sequence
  SiRNA target sequence
tggcgcctaatatataatggt

SEQ ID NO: 16624 - DNA, 21 bp, Artificial sequence
  SiRNA target sequence
ggcgcctaatatataatggta

SEQ ID NO: 16625 - DNA, 21 bp, Artificial sequence
  SiRNA target sequence
gcgcctaatatataatggtac

SEQ ID NO: 16626 - DNA, 21 bp, Artificial sequence
  SiRNA target sequence
cgcctaatatataatggtacc

SEQ ID NO: 16627 - DNA, 21 bp, Artificial sequence
  SiRNA target sequence
gcctaatatataatggtacca

SEQ ID NO: 16628 - DNA, 21 bp, Artificial sequence
  SiRNA target sequence
cctaatatataatggtaccaa

SEQ ID NO: 16629 - DNA, 21 bp, Artificial sequence
  SiRNA target sequence
ctaatatataatggtaccaag

SEQ ID NO: 16630 - DNA, 21 bp, Artificial sequence
  SiRNA target sequence
taatatataatggtaccaaga

SEQ ID NO: 16631 - DNA, 21 bp, Artificial sequence
  SiRNA target sequence
aatatataatggtaccaagaa

SEQ ID NO: 16632 - DNA, 21 bp, Artificial sequence
  SiRNA target sequence
atatataatggtaccaagaag

SEQ ID NO: 16633 - DNA, 21 bp, Artificial sequence
  SiRNA target sequence
tatataatggtaccaagaagg

SEQ ID NO: 16634 - DNA, 21 bp, Artificial sequence
  SiRNA target sequence
atataatggtaccaagaaggg

SEQ ID NO: 16635 - DNA, 21 bp, Artificial sequence
  SiRNA target sequence
tataatggtaccaagaagggt

SEQ ID NO: 16636 - DNA, 21 bp, Artificial sequence
  SiRNA target sequence
ataatggtaccaagaagggta

SEQ ID NO: 16637 - DNA, 21 bp, Artificial sequence
  SiRNA target sequence
taatggtaccaagaagggtat

SEQ ID NO: 16638 - DNA, 21 bp, Artificial sequence
  SiRNA target sequence
aatggtaccaagaagggtatg

SEQ ID NO: 16639 - DNA, 21 bp, Artificial sequence
  SiRNA target sequence
atggtaccaagaagggtatgc

SEQ ID NO: 16640 - DNA, 21 bp, Artificial sequence
  SiRNA target sequence
tggtaccaagaagggtatgcc

SEQ ID NO: 16641 - DNA, 21 bp, Artificial sequence
  SiRNA target sequence
ggtaccaagaagggtatgccc

SEQ ID NO: 16642 - DNA, 21 bp, Artificial sequence
  SiRNA target sequence
gtaccaagaagggtatgcccg

SEQ ID NO: 16643 - DNA, 21 bp, Artificial sequence
  SiRNA target sequence
taccaagaagggtatgcccga

SEQ ID NO: 16644 - DNA, 21 bp, Artificial sequence
  SiRNA target sequence
accaagaagggtatgcccgag

SEQ ID NO: 16645 - DNA, 21 bp, Artificial sequence
  SiRNA target sequence
ccaagaagggtatgcccgagt

SEQ ID NO: 16646 - DNA, 21 bp, Artificial sequence
  SiRNA target sequence
caagaagggtatgcccgagta

SEQ ID NO: 16647 - DNA, 21 bp, Artificial sequence
  SiRNA target sequence
aagaagggtatgcccgagtac

SEQ ID NO: 16648 - DNA, 21 bp, Artificial sequence
  SiRNA target sequence
agaagggtatgcccgagtact

SEQ ID NO: 16649 - DNA, 21 bp, Artificial sequence
  SiRNA target sequence
gaagggtatgcccgagtactt

SEQ ID NO: 16650 - DNA, 21 bp, Artificial sequence
  SiRNA target sequence
aagggtatgcccgagtacttt

SEQ ID NO: 16651 - DNA, 21 bp, Artificial sequence
  SiRNA target sequence
agggtatgcccgagtacttta

SEQ ID NO: 16652 - DNA, 21 bp, Artificial sequence
  SiRNA target sequence
gggtatgcccgagtactttat

SEQ ID NO: 16653 - DNA, 21 bp, Artificial sequence
  SiRNA target sequence
ggtatgcccgagtactttatg

SEQ ID NO: 16654 - DNA, 21 bp, Artificial sequence
  SiRNA target sequence
gtatgcccgagtactttatga

SEQ ID NO: 16655 - DNA, 21 bp, Artificial sequence
  SiRNA target sequence
tatgcccgagtactttatgaa

SEQ ID NO: 16656 - DNA, 21 bp, Artificial sequence
  SiRNA target sequence
atgcccgagtactttatgaat

SEQ ID NO: 16657 - DNA, 21 bp, Artificial sequence
  SiRNA target sequence
tgcccgagtactttatgaatt

SEQ ID NO: 16658 - DNA, 21 bp, Artificial sequence
  SiRNA target sequence
gcccgagtactttatgaattg

SEQ ID NO: 16659 - DNA, 21 bp, Artificial sequence
  SiRNA target sequence
cccgagtactttatgaattgt

SEQ ID NO: 16660 - DNA, 21 bp, Artificial sequence
  SiRNA target sequence
ccgagtactttatgaattgtg

SEQ ID NO: 16661 - DNA, 21 bp, Artificial sequence
  SiRNA target sequence
cgagtactttatgaattgtgt

SEQ ID NO: 16662 - DNA, 21 bp, Artificial sequence
  SiRNA target sequence
gagtactttatgaattgtgtg

SEQ ID NO: 16663 - DNA, 21 bp, Artificial sequence
  SiRNA target sequence
agtactttatgaattgtgtgg

SEQ ID NO: 16664 - DNA, 21 bp, Artificial sequence
  SiRNA target sequence
gtactttatgaattgtgtgga

SEQ ID NO: 16665 - DNA, 21 bp, Artificial sequence
  SiRNA target sequence
tactttatgaattgtgtggat

SEQ ID NO: 16666 - DNA, 21 bp, Artificial sequence
  SiRNA target sequence
actttatgaattgtgtggatg

SEQ ID NO: 16667 - DNA, 21 bp, Artificial sequence
  SiRNA target sequence
ctttatgaattgtgtggatga

SEQ ID NO: 16668 - DNA, 21 bp, Artificial sequence
  SiRNA target sequence
tttatgaattgtgtggatgaa

SEQ ID NO: 16669 - DNA, 21 bp, Artificial sequence
  SiRNA target sequence
ttatgaattgtgtggatgaaa

SEQ ID NO: 16670 - DNA, 21 bp, Artificial sequence
  SiRNA target sequence
tatgaattgtgtggatgaaat

SEQ ID NO: 16671 - DNA, 21 bp, Artificial sequence
  SiRNA target sequence
atgaattgtgtggatgaaatt

SEQ ID NO: 16672 - DNA, 21 bp, Artificial sequence
  SiRNA target sequence
tgaattgtgtggatgaaattt

SEQ ID NO: 16673 - DNA, 21 bp, Artificial sequence
  SiRNA target sequence
gaattgtgtggatgaaatttc

SEQ ID NO: 16674 - DNA, 21 bp, Artificial sequence
  SiRNA target sequence
aattgtgtggatgaaatttca

SEQ ID NO: 16675 - DNA, 21 bp, Artificial sequence
  SiRNA target sequence
attgtgtggatgaaatttcat

SEQ ID NO: 16676 - DNA, 21 bp, Artificial sequence
  SiRNA target sequence
ttgtgtggatgaaatttcatt

SEQ ID NO: 16677 - DNA, 21 bp, Artificial sequence
  SiRNA target sequence
tgtgtggatgaaatttcatta

SEQ ID NO: 16678 - DNA, 21 bp, Artificial sequence
  SiRNA target sequence
gtgtggatgaaatttcattag

SEQ ID NO: 16679 - DNA, 21 bp, Artificial sequence
  SiRNA target sequence
tgtggatgaaatttcattaga

SEQ ID NO: 16680 - DNA, 21 bp, Artificial sequence
  SiRNA target sequence
gtggatgaaatttcattagat

SEQ ID NO: 16681 - DNA, 21 bp, Artificial sequence
  SiRNA target sequence
tggatgaaatttcattagatt

SEQ ID NO: 16682 - DNA, 21 bp, Artificial sequence
  SiRNA target sequence
ggatgaaatttcattagattc

SEQ ID NO: 16683 - DNA, 21 bp, Artificial sequence
  SiRNA target sequence
gatgaaatttcattagattcc

SEQ ID NO: 16684 - DNA, 21 bp, Artificial sequence
  SiRNA target sequence
atgaaatttcattagattcca

SEQ ID NO: 16685 - DNA, 21 bp, Artificial sequence
  SiRNA target sequence
tgaaatttcattagattccaa

SEQ ID NO: 16686 - DNA, 21 bp, Artificial sequence
  SiRNA target sequence
gaaatttcattagattccaaa

SEQ ID NO: 16687 - DNA, 21 bp, Artificial sequence
  SiRNA target sequence
aaatttcattagattccaaat

SEQ ID NO: 16688 - DNA, 21 bp, Artificial sequence
  SiRNA target sequence
aatttcattagattccaaatt

SEQ ID NO: 16689 - DNA, 21 bp, Artificial sequence
  SiRNA target sequence
atttcattagattccaaattt

SEQ ID NO: 16690 - DNA, 21 bp, Artificial sequence
  SiRNA target sequence
tttcattagattccaaatttg

SEQ ID NO: 16691 - DNA, 21 bp, Artificial sequence
  SiRNA target sequence
ttcattagattccaaatttgg

SEQ ID NO: 16692 - DNA, 21 bp, Artificial sequence
  SiRNA target sequence
tcattagattccaaatttggt

SEQ ID NO: 16693 - DNA, 21 bp, Artificial sequence
  SiRNA target sequence
cattagattccaaatttggta

SEQ ID NO: 16694 - DNA, 21 bp, Artificial sequence
  SiRNA target sequence
attagattccaaatttggtaa

SEQ ID NO: 16695 - DNA, 21 bp, Artificial sequence
  SiRNA target sequence
ttagattccaaatttggtaaa

SEQ ID NO: 16696 - DNA, 21 bp, Artificial sequence
  SiRNA target sequence
tagattccaaatttggtaaag

SEQ ID NO: 16697 - DNA, 21 bp, Artificial sequence
  SiRNA target sequence
agattccaaatttggtaaagt

SEQ ID NO: 16698 - DNA, 21 bp, Artificial sequence
  SiRNA target sequence
gattccaaatttggtaaagtg

SEQ ID NO: 16699 - DNA, 21 bp, Artificial sequence
  SiRNA target sequence
attccaaatttggtaaagtga

SEQ ID NO: 16700 - DNA, 21 bp, Artificial sequence
  SiRNA target sequence
ttccaaatttggtaaagtgaa

SEQ ID NO: 16701 - DNA, 21 bp, Artificial sequence
  SiRNA target sequence
tccaaatttggtaaagtgaaa

SEQ ID NO: 16702 - DNA, 21 bp, Artificial sequence
  SiRNA target sequence
ccaaatttggtaaagtgaaag

SEQ ID NO: 16703 - DNA, 21 bp, Artificial sequence
  SiRNA target sequence
caaatttggtaaagtgaaagt

SEQ ID NO: 16704 - DNA, 21 bp, Artificial sequence
  SiRNA target sequence
aaatttggtaaagtgaaagtg

SEQ ID NO: 16705 - DNA, 21 bp, Artificial sequence
  SiRNA target sequence
aatttggtaaagtgaaagtgt

SEQ ID NO: 16706 - DNA, 21 bp, Artificial sequence
  SiRNA target sequence
atttggtaaagtgaaagtgtg

SEQ ID NO: 16707 - DNA, 21 bp, Artificial sequence
  SiRNA target sequence
tttggtaaagtgaaagtgtgg

SEQ ID NO: 16708 - DNA, 21 bp, Artificial sequence
  SiRNA target sequence
ttggtaaagtgaaagtgtggt

SEQ ID NO: 16709 - DNA, 21 bp, Artificial sequence
  SiRNA target sequence
tggtaaagtgaaagtgtggtt

SEQ ID NO: 16710 - DNA, 21 bp, Artificial sequence
  SiRNA target sequence
ggtaaagtgaaagtgtggttg

SEQ ID NO: 16711 - DNA, 21 bp, Artificial sequence
  SiRNA target sequence
gtaaagtgaaagtgtggttgc

SEQ ID NO: 16712 - DNA, 21 bp, Artificial sequence
  SiRNA target sequence
taaagtgaaagtgtggttgca

SEQ ID NO: 16713 - DNA, 21 bp, Artificial sequence
  SiRNA target sequence
aaagtgaaagtgtggttgcaa

SEQ ID NO: 16714 - DNA, 21 bp, Artificial sequence
  SiRNA target sequence
aagtgaaagtgtggttgcaag

SEQ ID NO: 16715 - DNA, 21 bp, Artificial sequence
  SiRNA target sequence
agtgaaagtgtggttgcaagc

SEQ ID NO: 16716 - DNA, 21 bp, Artificial sequence
  SiRNA target sequence
gtgaaagtgtggttgcaagcg

SEQ ID NO: 16717 - DNA, 21 bp, Artificial sequence
  SiRNA target sequence
tgaaagtgtggttgcaagcga

SEQ ID NO: 16718 - DNA, 21 bp, Artificial sequence
  SiRNA target sequence
gaaagtgtggttgcaagcgat

SEQ ID NO: 16719 - DNA, 21 bp, Artificial sequence
  SiRNA target sequence
aaagtgtggttgcaagcgatc

SEQ ID NO: 16720 - DNA, 21 bp, Artificial sequence
  SiRNA target sequence
aagtgtggttgcaagcgatca

SEQ ID NO: 16721 - DNA, 21 bp, Artificial sequence
  SiRNA target sequence
agtgtggttgcaagcgatcat

SEQ ID NO: 16722 - DNA, 21 bp, Artificial sequence
  SiRNA target sequence
gtgtggttgcaagcgatcatt

SEQ ID NO: 16723 - DNA, 21 bp, Artificial sequence
  SiRNA target sequence
tgtggttgcaagcgatcattg

SEQ ID NO: 16724 - DNA, 21 bp, Artificial sequence
  SiRNA target sequence
gtggttgcaagcgatcattga

SEQ ID NO: 16725 - DNA, 21 bp, Artificial sequence
  SiRNA target sequence
tggttgcaagcgatcattgat

SEQ ID NO: 16726 - DNA, 21 bp, Artificial sequence
  SiRNA target sequence
ggttgcaagcgatcattgata

SEQ ID NO: 16727 - DNA, 21 bp, Artificial sequence
  SiRNA target sequence
gttgcaagcgatcattgataa

SEQ ID NO: 16728 - DNA, 21 bp, Artificial sequence
  SiRNA target sequence
ttgcaagcgatcattgataag

SEQ ID NO: 16729 - DNA, 21 bp, Artificial sequence
  SiRNA target sequence
tgcaagcgatcattgataagt

SEQ ID NO: 16730 - DNA, 21 bp, Artificial sequence
  SiRNA target sequence
gcaagcgatcattgataagta

SEQ ID NO: 16731 - DNA, 21 bp, Artificial sequence
  SiRNA target sequence
caagcgatcattgataagtat

SEQ ID NO: 16732 - DNA, 21 bp, Artificial sequence
  SiRNA target sequence
aagcgatcattgataagtatt

SEQ ID NO: 16733 - DNA, 21 bp, Artificial sequence
  SiRNA target sequence
agcgatcattgataagtattt

SEQ ID NO: 16734 - DNA, 21 bp, Artificial sequence
  SiRNA target sequence
gcgatcattgataagtattta

SEQ ID NO: 16735 - DNA, 21 bp, Artificial sequence
  SiRNA target sequence
cgatcattgataagtatttaa

SEQ ID NO: 16736 - DNA, 21 bp, Artificial sequence
  SiRNA target sequence
gatcattgataagtatttaac

SEQ ID NO: 16737 - DNA, 21 bp, Artificial sequence
  SiRNA target sequence
atcattgataagtatttaact

SEQ ID NO: 16738 - DNA, 21 bp, Artificial sequence
  SiRNA target sequence
tcattgataagtatttaactc

SEQ ID NO: 16739 - DNA, 21 bp, Artificial sequence
  SiRNA target sequence
cattgataagtatttaactcg

SEQ ID NO: 16740 - DNA, 21 bp, Artificial sequence
  SiRNA target sequence
attgataagtatttaactcgt

SEQ ID NO: 16741 - DNA, 21 bp, Artificial sequence
  SiRNA target sequence
ttgataagtatttaactcgtc

SEQ ID NO: 16742 - DNA, 21 bp, Artificial sequence
  SiRNA target sequence
tgataagtatttaactcgtcc

SEQ ID NO: 16743 - DNA, 21 bp, Artificial sequence
  SiRNA target sequence
gataagtatttaactcgtccc

SEQ ID NO: 16744 - DNA, 21 bp, Artificial sequence
  SiRNA target sequence
ataagtatttaactcgtcccg

SEQ ID NO: 16745 - DNA, 21 bp, Artificial sequence
  SiRNA target sequence
taagtatttaactcgtcccgt

SEQ ID NO: 16746 - DNA, 21 bp, Artificial sequence
  SiRNA target sequence
aagtatttaactcgtcccgtg

SEQ ID NO: 16747 - DNA, 21 bp, Artificial sequence
  SiRNA target sequence
agtatttaactcgtcccgtga

SEQ ID NO: 16748 - DNA, 21 bp, Artificial sequence
  SiRNA target sequence
gtatttaactcgtcccgtgaa

SEQ ID NO: 16749 - DNA, 21 bp, Artificial sequence
  SiRNA target sequence
tatttaactcgtcccgtgaaa

SEQ ID NO: 16750 - DNA, 21 bp, Artificial sequence
  SiRNA target sequence
atttaactcgtcccgtgaaaa

SEQ ID NO: 16751 - DNA, 21 bp, Artificial sequence
  SiRNA target sequence
tttaactcgtcccgtgaaaat

SEQ ID NO: 16752 - DNA, 21 bp, Artificial sequence
  SiRNA target sequence
ttaactcgtcccgtgaaaatg

SEQ ID NO: 16753 - DNA, 21 bp, Artificial sequence
  SiRNA target sequence
taactcgtcccgtgaaaatga

SEQ ID NO: 16754 - DNA, 21 bp, Artificial sequence
  SiRNA target sequence
aactcgtcccgtgaaaatgat

SEQ ID NO: 16755 - DNA, 21 bp, Artificial sequence
  SiRNA target sequence
actcgtcccgtgaaaatgatt

SEQ ID NO: 16756 - DNA, 21 bp, Artificial sequence
  SiRNA target sequence
ctcgtcccgtgaaaatgattc

SEQ ID NO: 16757 - DNA, 21 bp, Artificial sequence
  SiRNA target sequence
tcgtcccgtgaaaatgattcg

SEQ ID NO: 16758 - DNA, 21 bp, Artificial sequence
  SiRNA target sequence
cgtcccgtgaaaatgattcgt

SEQ ID NO: 16759 - DNA, 21 bp, Artificial sequence
  SiRNA target sequence
gtcccgtgaaaatgattcgtg

SEQ ID NO: 16760 - DNA, 21 bp, Artificial sequence
  SiRNA target sequence
tcccgtgaaaatgattcgtga

SEQ ID NO: 16761 - DNA, 21 bp, Artificial sequence
  SiRNA target sequence
cccgtgaaaatgattcgtgat

SEQ ID NO: 16762 - DNA, 21 bp, Artificial sequence
  SiRNA target sequence
ccgtgaaaatgattcgtgatt

SEQ ID NO: 16763 - DNA, 21 bp, Artificial sequence
  SiRNA target sequence
cgtgaaaatgattcgtgattt

SEQ ID NO: 16764 - DNA, 21 bp, Artificial sequence
  SiRNA target sequence
gtgaaaatgattcgtgatttt

SEQ ID NO: 16765 - DNA, 21 bp, Artificial sequence
  SiRNA target sequence
tgaaaatgattcgtgattttc

SEQ ID NO: 16766 - DNA, 21 bp, Artificial sequence
  SiRNA target sequence
gaaaatgattcgtgattttct

SEQ ID NO: 16767 - DNA, 21 bp, Artificial sequence
  SiRNA target sequence
aaaatgattcgtgattttctt

SEQ ID NO: 16768 - DNA, 21 bp, Artificial sequence
  SiRNA target sequence
aaatgattcgtgattttcttt

SEQ ID NO: 16769 - DNA, 21 bp, Artificial sequence
  SiRNA target sequence
aatgattcgtgattttctttt

SEQ ID NO: 16770 - DNA, 21 bp, Artificial sequence
  SiRNA target sequence
atgattcgtgattttcttttc

SEQ ID NO: 16771 - DNA, 21 bp, Artificial sequence
  SiRNA target sequence
tgattcgtgattttcttttca

SEQ ID NO: 16772 - DNA, 21 bp, Artificial sequence
  SiRNA target sequence
gattcgtgattttcttttcaa

SEQ ID NO: 16773 - DNA, 21 bp, Artificial sequence
  SiRNA target sequence
attcgtgattttcttttcaag

SEQ ID NO: 16774 - DNA, 21 bp, Artificial sequence
  SiRNA target sequence
ttcgtgattttcttttcaagt

SEQ ID NO: 16775 - DNA, 21 bp, Artificial sequence
  SiRNA target sequence
tcgtgattttcttttcaagtg

SEQ ID NO: 16776 - DNA, 21 bp, Artificial sequence
  SiRNA target sequence
cgtgattttcttttcaagtgg

SEQ ID NO: 16777 - DNA, 21 bp, Artificial sequence
  SiRNA target sequence
gtgattttcttttcaagtggt

SEQ ID NO: 16778 - DNA, 21 bp, Artificial sequence
  SiRNA target sequence
tgattttcttttcaagtggtg

SEQ ID NO: 16779 - DNA, 21 bp, Artificial sequence
  SiRNA target sequence
gattttcttttcaagtggtgg

SEQ ID NO: 16780 - DNA, 21 bp, Artificial sequence
  SiRNA target sequence
attttcttttcaagtggtggc

SEQ ID NO: 16781 - DNA, 21 bp, Artificial sequence
  SiRNA target sequence
ttttcttttcaagtggtggcc

SEQ ID NO: 16782 - DNA, 21 bp, Artificial sequence
  SiRNA target sequence
tttcttttcaagtggtggccg

SEQ ID NO: 16783 - DNA, 21 bp, Artificial sequence
  SiRNA target sequence
ttcttttcaagtggtggccgc

SEQ ID NO: 16784 - DNA, 21 bp, Artificial sequence
  SiRNA target sequence
tcttttcaagtggtggccgca

SEQ ID NO: 16785 - DNA, 21 bp, Artificial sequence
  SiRNA target sequence
cttttcaagtggtggccgcaa

SEQ ID NO: 16786 - DNA, 21 bp, Artificial sequence
  SiRNA target sequence
ttttcaagtggtggccgcaag

SEQ ID NO: 16787 - DNA, 21 bp, Artificial sequence
  SiRNA target sequence
tttcaagtggtggccgcaagt

SEQ ID NO: 16788 - DNA, 21 bp, Artificial sequence
  SiRNA target sequence
ttcaagtggtggccgcaagtt

SEQ ID NO: 16789 - DNA, 21 bp, Artificial sequence
  SiRNA target sequence
tcaagtggtggccgcaagttg

SEQ ID NO: 16790 - DNA, 21 bp, Artificial sequence
  SiRNA target sequence
caagtggtggccgcaagttgc

SEQ ID NO: 16791 - DNA, 21 bp, Artificial sequence
  SiRNA target sequence
aagtggtggccgcaagttgcg

SEQ ID NO: 16792 - DNA, 21 bp, Artificial sequence
  SiRNA target sequence
agtggtggccgcaagttgcgt

SEQ ID NO: 16793 - DNA, 21 bp, Artificial sequence
  SiRNA target sequence
gtggtggccgcaagttgcgta

SEQ ID NO: 16794 - DNA, 21 bp, Artificial sequence
  SiRNA target sequence
tggtggccgcaagttgcgtat

SEQ ID NO: 16795 - DNA, 21 bp, Artificial sequence
  SiRNA target sequence
ggtggccgcaagttgcgtatg

SEQ ID NO: 16796 - DNA, 21 bp, Artificial sequence
  SiRNA target sequence
gtggccgcaagttgcgtatgt

SEQ ID NO: 16797 - DNA, 21 bp, Artificial sequence
  SiRNA target sequence
tggccgcaagttgcgtatgtg

SEQ ID NO: 16798 - DNA, 21 bp, Artificial sequence
  SiRNA target sequence
ggccgcaagttgcgtatgtgt

SEQ ID NO: 16799 - DNA, 21 bp, Artificial sequence
  SiRNA target sequence
gccgcaagttgcgtatgtgtt

SEQ ID NO: 16800 - DNA, 21 bp, Artificial sequence
  SiRNA target sequence
ccgcaagttgcgtatgtgttg

SEQ ID NO: 16801 - DNA, 21 bp, Artificial sequence
  SiRNA target sequence
cgcaagttgcgtatgtgttga

SEQ ID NO: 16802 - DNA, 21 bp, Artificial sequence
  SiRNA target sequence
gcaagttgcgtatgtgttgag

SEQ ID NO: 16803 - DNA, 21 bp, Artificial sequence
  SiRNA target sequence
caagttgcgtatgtgttgagc

SEQ ID NO: 16804 - DNA, 21 bp, Artificial sequence
  SiRNA target sequence
aagttgcgtatgtgttgagct

SEQ ID NO: 16805 - DNA, 21 bp, Artificial sequence
  SiRNA target sequence
agttgcgtatgtgttgagctt

SEQ ID NO: 16806 - DNA, 21 bp, Artificial sequence
  SiRNA target sequence
gttgcgtatgtgttgagcttg

SEQ ID NO: 16807 - DNA, 21 bp, Artificial sequence
  SiRNA target sequence
ttgcgtatgtgttgagcttgc

SEQ ID NO: 16808 - DNA, 21 bp, Artificial sequence
  SiRNA target sequence
tgcgtatgtgttgagcttgct

SEQ ID NO: 16809 - DNA, 21 bp, Artificial sequence
  SiRNA target sequence
gcgtatgtgttgagcttgcta

SEQ ID NO: 16810 - DNA, 21 bp, Artificial sequence
  SiRNA target sequence
cgtatgtgttgagcttgctag

SEQ ID NO: 16811 - DNA, 21 bp, Artificial sequence
  SiRNA target sequence
gtatgtgttgagcttgctagg

SEQ ID NO: 16812 - DNA, 21 bp, Artificial sequence
  SiRNA target sequence
tatgtgttgagcttgctaggt

SEQ ID NO: 16813 - DNA, 21 bp, Artificial sequence
  SiRNA target sequence
atgtgttgagcttgctaggta

SEQ ID NO: 16814 - DNA, 21 bp, Artificial sequence
  SiRNA target sequence
tgtgttgagcttgctaggtat

SEQ ID NO: 16815 - DNA, 21 bp, Artificial sequence
  SiRNA target sequence
gtgttgagcttgctaggtata

SEQ ID NO: 16816 - DNA, 21 bp, Artificial sequence
  SiRNA target sequence
tgttgagcttgctaggtataa

SEQ ID NO: 16817 - DNA, 21 bp, Artificial sequence
  SiRNA target sequence
gttgagcttgctaggtataat

SEQ ID NO: 16818 - DNA, 21 bp, Artificial sequence
  SiRNA target sequence
  misc_feature (21)..(21): n is a, c, g, or t
ttgagcttgctaggtataatn

SEQ ID NO: 16819 - DNA, 21 bp, Artificial sequence
  SiRNA target sequence
  misc_feature (20)..(20): n is a, c, g, or t
tgagcttgctaggtataatng

SEQ ID NO: 16820 - DNA, 21 bp, Artificial sequence
  SiRNA target sequence
  misc_feature (19)..(19): n is a, c, g, or t
gagcttgctaggtataatngg

SEQ ID NO: 16821 - DNA, 21 bp, Artificial sequence
  SiRNA target sequence
  misc_feature (18)..(18): n is a, c, g, or t
agcttgctaggtataatnggt

SEQ ID NO: 16822 - DNA, 21 bp, Artificial sequence
  SiRNA target sequence
  misc_feature (17)..(17): n is a, c, g, or t
gcttgctaggtataatnggta

SEQ ID NO: 16823 - DNA, 21 bp, Artificial sequence
  SiRNA target sequence
  misc_feature (16)..(16): n is a, c, g, or t
cttgctaggtataatnggtat

SEQ ID NO: 16824 - DNA, 21 bp, Artificial sequence
  SiRNA target sequence
  misc_feature (15)..(15): n is a, c, g, or t
ttgctaggtataatnggtata

SEQ ID NO: 16825 - DNA, 21 bp, Artificial sequence
  SiRNA target sequence
  misc_feature (14)..(14): n is a, c, g, or t
tgctaggtataatnggtataa

SEQ ID NO: 16826 - DNA, 21 bp, Artificial sequence
  SiRNA target sequence
  misc_feature (13)..(13): n is a, c, g, or t
gctaggtataatnggtataac

SEQ ID NO: 16827 - DNA, 21 bp, Artificial sequence
  SiRNA target sequence
  misc_feature (12)..(12): n is a, c, g, or t
ctaggtataatnggtataact

SEQ ID NO: 16828 - DNA, 21 bp, Artificial sequence
  SiRNA target sequence
  misc_feature (11)..(11): n is a, c, g, or t
taggtataatnggtataactg

SEQ ID NO: 16829 - DNA, 21 bp, Artificial sequence
  SiRNA target sequence
  misc_feature (10)..(10): n is a, c, g, or t
aggtataatnggtataactgc

SEQ ID NO: 16830 - DNA, 21 bp, Artificial sequence
  SiRNA target sequence
  misc_feature (9)..(9): n is a, c, g, or t
ggtataatnggtataactgcg

SEQ ID NO: 16831 - DNA, 21 bp, Artificial sequence
  SiRNA target sequence
  misc_feature (8)..(8): n is a, c, g, or t
gtataatnggtataactgcgt

SEQ ID NO: 16832 - DNA, 21 bp, Artificial sequence
  SiRNA target sequence
  misc_feature (7)..(7): n is a, c, g, or t
tataatnggtataactgcgta

SEQ ID NO: 16833 - DNA, 21 bp, Artificial sequence
  SiRNA target sequence
  misc_feature (6)..(6): n is a, c, g, or t
ataatnggtataactgcgtat

SEQ ID NO: 16834 - DNA, 21 bp, Artificial sequence
  SiRNA target sequence
  misc_feature (5)..(5): n is a, c, g, or t
taatnggtataactgcgtatg

SEQ ID NO: 16835 - DNA, 21 bp, Artificial sequence
  SiRNA target sequence
  misc_feature (4)..(4): n is a, c, g, or t
aatnggtataactgcgtatga

SEQ ID NO: 16836 - DNA, 21 bp, Artificial sequence
  SiRNA target sequence
  misc_feature (3)..(3): n is a, c, g, or t
atnggtataactgcgtatgaa

SEQ ID NO: 16837 - DNA, 21 bp, Artificial sequence
  SiRNA target sequence
  misc_feature (2)..(2): n is a, c, g, or t
tnggtataactgcgtatgaaa

SEQ ID NO: 16838 - DNA, 21 bp, Artificial sequence
  SiRNA target sequence
  misc_feature (1)..(1): n is a, c, g, or t
nggtataactgcgtatgaaat

SEQ ID NO: 16839 - DNA, 21 bp, Artificial sequence
  SiRNA target sequence
ggtataactgcgtatgaaatg

SEQ ID NO: 16840 - DNA, 21 bp, Artificial sequence
  SiRNA target sequence
gtataactgcgtatgaaatga

SEQ ID NO: 16841 - DNA, 21 bp, Artificial sequence
  SiRNA target sequence
tataactgcgtatgaaatgag

SEQ ID NO: 16842 - DNA, 21 bp, Artificial sequence
  SiRNA target sequence
ataactgcgtatgaaatgaga

SEQ ID NO: 16843 - DNA, 21 bp, Artificial sequence
  SiRNA target sequence
taactgcgtatgaaatgagaa

SEQ ID NO: 16844 - DNA, 21 bp, Artificial sequence
  SiRNA target sequence
aactgcgtatgaaatgagaaa

SEQ ID NO: 16845 - DNA, 21 bp, Artificial sequence
  SiRNA target sequence
actgcgtatgaaatgagaaat

SEQ ID NO: 16846 - DNA, 21 bp, Artificial sequence
  SiRNA target sequence
ctgcgtatgaaatgagaaatc

SEQ ID NO: 16847 - DNA, 21 bp, Artificial sequence
  SiRNA target sequence
tgcgtatgaaatgagaaatcc

SEQ ID NO: 16848 - DNA, 21 bp, Artificial sequence
  SiRNA target sequence
gcgtatgaaatgagaaatccg

SEQ ID NO: 16849 - DNA, 21 bp, Artificial sequence
  SiRNA target sequence
cgtatgaaatgagaaatccga

SEQ ID NO: 16850 - DNA, 21 bp, Artificial sequence
  SiRNA target sequence
gtatgaaatgagaaatccgaa

SEQ ID NO: 16851 - DNA, 21 bp, Artificial sequence
  SiRNA target sequence
tatgaaatgagaaatccgaaa

SEQ ID NO: 16852 - DNA, 21 bp, Artificial sequence
  SiRNA target sequence
atgaaatgagaaatccgaaac

SEQ ID NO: 16853 - DNA, 21 bp, Artificial sequence
  SiRNA target sequence
tgaaatgagaaatccgaaacc

SEQ ID NO: 16854 - DNA, 21 bp, Artificial sequence
  SiRNA target sequence
gaaatgagaaatccgaaacca

SEQ ID NO: 16855 - DNA, 21 bp, Artificial sequence
  SiRNA target sequence
aaatgagaaatccgaaaccaa

SEQ ID NO: 16856 - DNA, 21 bp, Artificial sequence
  SiRNA target sequence
aatgagaaatccgaaaccaac

SEQ ID NO: 16857 - DNA, 21 bp, Artificial sequence
  SiRNA target sequence
atgagaaatccgaaaccaact

SEQ ID NO: 16858 - DNA, 21 bp, Artificial sequence
  SiRNA target sequence
tgagaaatccgaaaccaactt

SEQ ID NO: 16859 - DNA, 21 bp, Artificial sequence
  SiRNA target sequence
gagaaatccgaaaccaacttc

SEQ ID NO: 16860 - DNA, 21 bp, Artificial sequence
  SiRNA target sequence
agaaatccgaaaccaacttct

SEQ ID NO: 16861 - DNA, 21 bp, Artificial sequence
  SiRNA target sequence
gaaatccgaaaccaacttctg

SEQ ID NO: 16862 - DNA, 21 bp, Artificial sequence
  SiRNA target sequence
aaatccgaaaccaacttctga

SEQ ID NO: 16863 - DNA, 21 bp, Artificial sequence
  SiRNA target sequence
aatccgaaaccaacttctgag

SEQ ID NO: 16864 - DNA, 21 bp, Artificial sequence
  SiRNA target sequence
atccgaaaccaacttctgagg

SEQ ID NO: 16865 - DNA, 21 bp, Artificial sequence
  SiRNA target sequence
tccgaaaccaacttctgagga

SEQ ID NO: 16866 - DNA, 21 bp, Artificial sequence
  SiRNA target sequence
ccgaaaccaacttctgaggaa

SEQ ID NO: 16867 - DNA, 21 bp, Artificial sequence
  SiRNA target sequence
cgaaaccaacttctgaggaat

SEQ ID NO: 16868 - DNA, 21 bp, Artificial sequence
  SiRNA target sequence
gaaaccaacttctgaggaatt

SEQ ID NO: 16869 - DNA, 21 bp, Artificial sequence
  SiRNA target sequence
aaaccaacttctgaggaatta

SEQ ID NO: 16870 - DNA, 21 bp, Artificial sequence
  SiRNA target sequence
aaccaacttctgaggaattag

SEQ ID NO: 16871 - DNA, 21 bp, Artificial sequence
  SiRNA target sequence
accaacttctgaggaattagc

SEQ ID NO: 16872 - DNA, 21 bp, Artificial sequence
  SiRNA target sequence
ccaacttctgaggaattagct

SEQ ID NO: 16873 - DNA, 21 bp, Artificial sequence
  SiRNA target sequence
caacttctgaggaattagctg

SEQ ID NO: 16874 - DNA, 21 bp, Artificial sequence
  SiRNA target sequence
aacttctgaggaattagctga

SEQ ID NO: 16875 - DNA, 21 bp, Artificial sequence
  SiRNA target sequence
acttctgaggaattagctgat

SEQ ID NO: 16876 - DNA, 21 bp, Artificial sequence
  SiRNA target sequence
cttctgaggaattagctgatc

SEQ ID NO: 16877 - DNA, 21 bp, Artificial sequence
  SiRNA target sequence
ttctgaggaattagctgatca

SEQ ID NO: 16878 - DNA, 21 bp, Artificial sequence
  SiRNA target sequence
tctgaggaattagctgatcat

SEQ ID NO: 16879 - DNA, 21 bp, Artificial sequence
  SiRNA target sequence
ctgaggaattagctgatcatt

SEQ ID NO: 16880 - DNA, 21 bp, Artificial sequence
  SiRNA target sequence
tgaggaattagctgatcatta

SEQ ID NO: 16881 - DNA, 21 bp, Artificial sequence
  SiRNA target sequence
gaggaattagctgatcattat

SEQ ID NO: 16882 - DNA, 21 bp, Artificial sequence
  SiRNA target sequence
aggaattagctgatcattatg

SEQ ID NO: 16883 - DNA, 21 bp, Artificial sequence
  SiRNA target sequence
ggaattagctgatcattatgt

SEQ ID NO: 16884 - DNA, 21 bp, Artificial sequence
  SiRNA target sequence
gaattagctgatcattatgtg

SEQ ID NO: 16885 - DNA, 21 bp, Artificial sequence
  SiRNA target sequence
aattagctgatcattatgtga

SEQ ID NO: 16886 - DNA, 21 bp, Artificial sequence
  SiRNA target sequence
attagctgatcattatgtgaa

SEQ ID NO: 16887 - DNA, 21 bp, Artificial sequence
  SiRNA target sequence
ttagctgatcattatgtgaat

SEQ ID NO: 16888 - DNA, 21 bp, Artificial sequence
  SiRNA target sequence
tagctgatcattatgtgaata

SEQ ID NO: 16889 - DNA, 21 bp, Artificial sequence
  SiRNA target sequence
agctgatcattatgtgaatag

SEQ ID NO: 16890 - DNA, 21 bp, Artificial sequence
  SiRNA target sequence
gctgatcattatgtgaatagg

SEQ ID NO: 16891 - DNA, 21 bp, Artificial sequence
  SiRNA target sequence
ctgatcattatgtgaataggc

SEQ ID NO: 16892 - DNA, 21 bp, Artificial sequence
  SiRNA target sequence
tgatcattatgtgaataggca

SEQ ID NO: 16893 - DNA, 21 bp, Artificial sequence
  SiRNA target sequence
gatcattatgtgaataggcat

SEQ ID NO: 16894 - DNA, 21 bp, Artificial sequence
  SiRNA target sequence
atcattatgtgaataggcatt

SEQ ID NO: 16895 - DNA, 21 bp, Artificial sequence
  SiRNA target sequence
tcattatgtgaataggcattg

SEQ ID NO: 16896 - DNA, 21 bp, Artificial sequence
  SiRNA target sequence
cattatgtgaataggcattgt

SEQ ID NO: 16897 - DNA, 21 bp, Artificial sequence
  SiRNA target sequence
attatgtgaataggcattgta

SEQ ID NO: 16898 - DNA, 21 bp, Artificial sequence
  SiRNA target sequence
ttatgtgaataggcattgtag

SEQ ID NO: 16899 - DNA, 21 bp, Artificial sequence
  SiRNA target sequence
tatgtgaataggcattgtagc

SEQ ID NO: 16900 - DNA, 21 bp, Artificial sequence
  SiRNA target sequence
atgtgaataggcattgtagct

SEQ ID NO: 16901 - DNA, 21 bp, Artificial sequence
  SiRNA target sequence
tgtgaataggcattgtagctc

SEQ ID NO: 16902 - DNA, 21 bp, Artificial sequence
  SiRNA target sequence
gtgaataggcattgtagctct

SEQ ID NO: 16903 - DNA, 21 bp, Artificial sequence
  SiRNA target sequence
tgaataggcattgtagctctg

SEQ ID NO: 16904 - DNA, 21 bp, Artificial sequence
  SiRNA target sequence
gaataggcattgtagctctga

SEQ ID NO: 16905 - DNA, 21 bp, Artificial sequence
  SiRNA target sequence
aataggcattgtagctctgat

SEQ ID NO: 16906 - DNA, 21 bp, Artificial sequence
  SiRNA target sequence
ataggcattgtagctctgatt

SEQ ID NO: 16907 - DNA, 21 bp, Artificial sequence
  SiRNA target sequence
taggcattgtagctctgattt

SEQ ID NO: 16908 - DNA, 21 bp, Artificial sequence
  SiRNA target sequence
aggcattgtagctctgatttt

SEQ ID NO: 16909 - DNA, 21 bp, Artificial sequence
  SiRNA target sequence
ggcattgtagctctgattttt

SEQ ID NO: 16910 - DNA, 21 bp, Artificial sequence
  SiRNA target sequence
gcattgtagctctgatttttg

SEQ ID NO: 16911 - DNA, 21 bp, Artificial sequence
  SiRNA target sequence
cattgtagctctgatttttgg

SEQ ID NO: 16912 - DNA, 21 bp, Artificial sequence
  SiRNA target sequence
attgtagctctgatttttggt

SEQ ID NO: 16913 - DNA, 21 bp, Artificial sequence
  SiRNA target sequence
ttgtagctctgatttttggtc

SEQ ID NO: 16914 - DNA, 21 bp, Artificial sequence
  SiRNA target sequence
tgtagctctgatttttggtca

SEQ ID NO: 16915 - DNA, 21 bp, Artificial sequence
  SiRNA target sequence
gtagctctgatttttggtcac

SEQ ID NO: 16916 - DNA, 21 bp, Artificial sequence
  SiRNA target sequence
tagctctgatttttggtcacc

SEQ ID NO: 16917 - DNA, 21 bp, Artificial sequence
  SiRNA target sequence
agctctgatttttggtcacca

SEQ ID NO: 16918 - DNA, 21 bp, Artificial sequence
  SiRNA target sequence
gctctgatttttggtcaccag

SEQ ID NO: 16919 - DNA, 21 bp, Artificial sequence
  SiRNA target sequence
ctctgatttttggtcaccagg

SEQ ID NO: 16920 - DNA, 21 bp, Artificial sequence
  SiRNA target sequence
tctgatttttggtcaccagga

SEQ ID NO: 16921 - DNA, 21 bp, Artificial sequence
  SiRNA target sequence
ctgatttttggtcaccaggac

SEQ ID NO: 16922 - DNA, 21 bp, Artificial sequence
  SiRNA target sequence
tgatttttggtcaccaggact

SEQ ID NO: 16923 - DNA, 21 bp, Artificial sequence
  SiRNA target sequence
gatttttggtcaccaggactg

SEQ ID NO: 16924 - DNA, 21 bp, Artificial sequence
  SiRNA target sequence
atttttggtcaccaggactgg

SEQ ID NO: 16925 - DNA, 21 bp, Artificial sequence
  SiRNA target sequence
tttttggtcaccaggactggc

SEQ ID NO: 16926 - DNA, 21 bp, Artificial sequence
  SiRNA target sequence
ttttggtcaccaggactggca

SEQ ID NO: 16927 - DNA, 21 bp, Artificial sequence
  SiRNA target sequence
tttggtcaccaggactggcat

SEQ ID NO: 16928 - DNA, 21 bp, Artificial sequence
  SiRNA target sequence
ttggtcaccaggactggcatc

SEQ ID NO: 16929 - DNA, 21 bp, Artificial sequence
  SiRNA target sequence
tggtcaccaggactggcatca

SEQ ID NO: 16930 - DNA, 21 bp, Artificial sequence
  SiRNA target sequence
ggtcaccaggactggcatcac

SEQ ID NO: 16931 - DNA, 21 bp, Artificial sequence
  SiRNA target sequence
gtcaccaggactggcatcacc

SEQ ID NO: 16932 - DNA, 21 bp, Artificial sequence
  SiRNA target sequence
tcaccaggactggcatcacct

SEQ ID NO: 16933 - DNA, 21 bp, Artificial sequence
  SiRNA target sequence
caccaggactggcatcacctc

SEQ ID NO: 16934 - DNA, 21 bp, Artificial sequence
  SiRNA target sequence
accaggactggcatcacctca

SEQ ID NO: 16935 - DNA, 21 bp, Artificial sequence
  SiRNA target sequence
ccaggactggcatcacctcaa

SEQ ID NO: 16936 - DNA, 21 bp, Artificial sequence
  SiRNA target sequence
caggactggcatcacctcaag

SEQ ID NO: 16937 - DNA, 21 bp, Artificial sequence
  SiRNA target sequence
aggactggcatcacctcaagg

SEQ ID NO: 16938 - DNA, 21 bp, Artificial sequence
  SiRNA target sequence
ggactggcatcacctcaagga

SEQ ID NO: 16939 - DNA, 21 bp, Artificial sequence
  SiRNA target sequence
gactggcatcacctcaaggat

SEQ ID NO: 16940 - DNA, 21 bp, Artificial sequence
  SiRNA target sequence
actggcatcacctcaaggatt

SEQ ID NO: 16941 - DNA, 21 bp, Artificial sequence
  SiRNA target sequence
ctggcatcacctcaaggattg

SEQ ID NO: 16942 - DNA, 21 bp, Artificial sequence
  SiRNA target sequence
tggcatcacctcaaggattga

SEQ ID NO: 16943 - DNA, 21 bp, Artificial sequence
  SiRNA target sequence
ggcatcacctcaaggattgaa

SEQ ID NO: 16944 - DNA, 21 bp, Artificial sequence
  SiRNA target sequence
gcatcacctcaaggattgaaa

SEQ ID NO: 16945 - DNA, 21 bp, Artificial sequence
  SiRNA target sequence
catcacctcaaggattgaaat

SEQ ID NO: 16946 - DNA, 21 bp, Artificial sequence
  SiRNA target sequence
atcacctcaaggattgaaata

SEQ ID NO: 16947 - DNA, 21 bp, Artificial sequence
  SiRNA target sequence
tcacctcaaggattgaaatat

SEQ ID NO: 16948 - DNA, 21 bp, Artificial sequence
  SiRNA target sequence
cacctcaaggattgaaatata

SEQ ID NO: 16949 - DNA, 21 bp, Artificial sequence
  SiRNA target sequence
acctcaaggattgaaatatag

SEQ ID NO: 16950 - DNA, 21 bp, Artificial sequence
  SiRNA target sequence
cctcaaggattgaaatatagt

SEQ ID NO: 16951 - DNA, 21 bp, Artificial sequence
  SiRNA target sequence
ctcaaggattgaaatatagtg

SEQ ID NO: 16952 - DNA, 21 bp, Artificial sequence
  SiRNA target sequence
tcaaggattgaaatatagtga

SEQ ID NO: 16953 - DNA, 21 bp, Artificial sequence
  SiRNA target sequence
caaggattgaaatatagtgaa

SEQ ID NO: 16954 - DNA, 21 bp, Artificial sequence
  SiRNA target sequence
aaggattgaaatatagtgaag

SEQ ID NO: 16955 - DNA, 21 bp, Artificial sequence
  SiRNA target sequence
aggattgaaatatagtgaagc

SEQ ID NO: 16956 - DNA, 21 bp, Artificial sequence
  SiRNA target sequence
ggattgaaatatagtgaagca

SEQ ID NO: 16957 - DNA, 21 bp, Artificial sequence
  SiRNA target sequence
gattgaaatatagtgaagcag

SEQ ID NO: 16958 - DNA, 21 bp, Artificial sequence
  SiRNA target sequence
attgaaatatagtgaagcagt

SEQ ID NO: 16959 - DNA, 21 bp, Artificial sequence
  SiRNA target sequence
ttgaaatatagtgaagcagta

SEQ ID NO: 16960 - DNA, 21 bp, Artificial sequence
  SiRNA target sequence
tgaaatatagtgaagcagtaa

SEQ ID NO: 16961 - DNA, 21 bp, Artificial sequence
  SiRNA target sequence
gaaatatagtgaagcagtaac

SEQ ID NO: 16962 - DNA, 21 bp, Artificial sequence
  SiRNA target sequence
aaatatagtgaagcagtaaca

SEQ ID NO: 16963 - DNA, 21 bp, Artificial sequence
  SiRNA target sequence
aatatagtgaagcagtaacag

SEQ ID NO: 16964 - DNA, 21 bp, Artificial sequence
  SiRNA target sequence
atatagtgaagcagtaacagt

SEQ ID NO: 16965 - DNA, 21 bp, Artificial sequence
  SiRNA target sequence
tatagtgaagcagtaacagta

SEQ ID NO: 16966 - DNA, 21 bp, Artificial sequence
  SiRNA target sequence
atagtgaagcagtaacagtaa

SEQ ID NO: 16967 - DNA, 21 bp, Artificial sequence
  SiRNA target sequence
tagtgaagcagtaacagtaaa

SEQ ID NO: 16968 - DNA, 21 bp, Artificial sequence
  SiRNA target sequence
agtgaagcagtaacagtaaag

SEQ ID NO: 16969 - DNA, 21 bp, Artificial sequence
  SiRNA target sequence
gtgaagcagtaacagtaaagg

SEQ ID NO: 16970 - DNA, 21 bp, Artificial sequence
  SiRNA target sequence
tgaagcagtaacagtaaaggc

SEQ ID NO: 16971 - DNA, 21 bp, Artificial sequence
  SiRNA target sequence
gaagcagtaacagtaaaggca

SEQ ID NO: 16972 - DNA, 21 bp, Artificial sequence
  SiRNA target sequence
aagcagtaacagtaaaggcac

SEQ ID NO: 16973 - DNA, 21 bp, Artificial sequence
  SiRNA target sequence
agcagtaacagtaaaggcacc

SEQ ID NO: 16974 - DNA, 21 bp, Artificial sequence
  SiRNA target sequence
gcagtaacagtaaaggcacct

SEQ ID NO: 16975 - DNA, 21 bp, Artificial sequence
  SiRNA target sequence
cagtaacagtaaaggcaccta

SEQ ID NO: 16976 - DNA, 21 bp, Artificial sequence
  SiRNA target sequence
agtaacagtaaaggcacctag

SEQ ID NO: 16977 - DNA, 21 bp, Artificial sequence
  SiRNA target sequence
gtaacagtaaaggcacctaga

SEQ ID NO: 16978 - DNA, 21 bp, Artificial sequence
  SiRNA target sequence
taacagtaaaggcacctagaa

SEQ ID NO: 16979 - DNA, 21 bp, Artificial sequence
  SiRNA target sequence
aacagtaaaggcacctagaat

SEQ ID NO: 16980 - DNA, 21 bp, Artificial sequence
  SiRNA target sequence
acagtaaaggcacctagaatc

SEQ ID NO: 16981 - DNA, 21 bp, Artificial sequence
  SiRNA target sequence
cagtaaaggcacctagaatcc

SEQ ID NO: 16982 - DNA, 21 bp, Artificial sequence
  SiRNA target sequence
agtaaaggcacctagaatcca

SEQ ID NO: 16983 - DNA, 21 bp, Artificial sequence
  SiRNA target sequence
gtaaaggcacctagaatccat

SEQ ID NO: 16984 - DNA, 21 bp, Artificial sequence
  SiRNA target sequence
taaaggcacctagaatccata

SEQ ID NO: 16985 - DNA, 21 bp, Artificial sequence
  SiRNA target sequence
aaaggcacctagaatccatag

SEQ ID NO: 16986 - DNA, 21 bp, Artificial sequence
  SiRNA target sequence
aaggcacctagaatccataga

SEQ ID NO: 16987 - DNA, 21 bp, Artificial sequence
  SiRNA target sequence
aggcacctagaatccatagat

SEQ ID NO: 16988 - DNA, 21 bp, Artificial sequence
  SiRNA target sequence
ggcacctagaatccatagatt

SEQ ID NO: 16989 - DNA, 21 bp, Artificial sequence
  SiRNA target sequence
gcacctagaatccatagattg

SEQ ID NO: 16990 - DNA, 21 bp, Artificial sequence
  SiRNA target sequence
cacctagaatccatagattgc

SEQ ID NO: 16991 - DNA, 21 bp, Artificial sequence
  SiRNA target sequence
acctagaatccatagattgcc

SEQ ID NO: 16992 - DNA, 21 bp, Artificial sequence
  SiRNA target sequence
cctagaatccatagattgcca

SEQ ID NO: 16993 - DNA, 21 bp, Artificial sequence
  SiRNA target sequence
ctagaatccatagattgccag

SEQ ID NO: 16994 - DNA, 21 bp, Artificial sequence
  SiRNA target sequence
tagaatccatagattgccagt

SEQ ID NO: 16995 - DNA, 21 bp, Artificial sequence
  SiRNA target sequence
agaatccatagattgccagtt

SEQ ID NO: 16996 - DNA, 21 bp, Artificial sequence
  SiRNA target sequence
gaatccatagattgccagtta

SEQ ID NO: 16997 - DNA, 21 bp, Artificial sequence
  SiRNA target sequence
aatccatagattgccagttac

SEQ ID NO: 16998 - DNA, 21 bp, Artificial sequence
  SiRNA target sequence
atccatagattgccagttact

SEQ ID NO: 16999 - DNA, 21 bp, Artificial sequence
  SiRNA target sequence
tccatagattgccagttacta

SEQ ID NO: 17000 - DNA, 21 bp, Artificial sequence
  SiRNA target sequence
ccatagattgccagttactac

SEQ ID NO: 17001 - DNA, 21 bp, Artificial sequence
  SiRNA target sequence
catagattgccagttactact

SEQ ID NO: 17002 - DNA, 21 bp, Artificial sequence
  SiRNA target sequence
atagattgccagttactacta

SEQ ID NO: 17003 - DNA, 21 bp, Artificial sequence
  SiRNA target sequence
tagattgccagttactactaa

SEQ ID NO: 17004 - DNA, 21 bp, Artificial sequence
  SiRNA target sequence
agattgccagttactactaag

SEQ ID NO: 17005 - DNA, 21 bp, Artificial sequence
  SiRNA target sequence
gattgccagttactactaagc

SEQ ID NO: 17006 - DNA, 21 bp, Artificial sequence
  SiRNA target sequence
attgccagttactactaagcc

SEQ ID NO: 17007 - DNA, 21 bp, Artificial sequence
  SiRNA target sequence
ttgccagttactactaagcct

SEQ ID NO: 17008 - DNA, 21 bp, Artificial sequence
  SiRNA target sequence
tgccagttactactaagcctc

SEQ ID NO: 17009 - DNA, 21 bp, Artificial sequence
  SiRNA target sequence
gccagttactactaagcctca

SEQ ID NO: 17010 - DNA, 21 bp, Artificial sequence
  SiRNA target sequence
ccagttactactaagcctcag

SEQ ID NO: 17011 - DNA, 21 bp, Artificial sequence
  SiRNA target sequence
cagttactactaagcctcagg

SEQ ID NO: 17012 - DNA, 21 bp, Artificial sequence
  SiRNA target sequence
agttactactaagcctcaggg

SEQ ID NO: 17013 - DNA, 21 bp, Artificial sequence
  SiRNA target sequence
gttactactaagcctcaggga

SEQ ID NO: 17014 - DNA, 21 bp, Artificial sequence
  SiRNA target sequence
ttactactaagcctcagggat

SEQ ID NO: 17015 - DNA, 21 bp, Artificial sequence
  SiRNA target sequence
tactactaagcctcagggatc

SEQ ID NO: 17016 - DNA, 21 bp, Artificial sequence
  SiRNA target sequence
actactaagcctcagggatca

SEQ ID NO: 17017 - DNA, 21 bp, Artificial sequence
  SiRNA target sequence
ctactaagcctcagggatcaa

SEQ ID NO: 17018 - DNA, 21 bp, Artificial sequence
  SiRNA target sequence
tactaagcctcagggatcaac

SEQ ID NO: 17019 - DNA, 21 bp, Artificial sequence
  SiRNA target sequence
actaagcctcagggatcaaca

SEQ ID NO: 17020 - DNA, 21 bp, Artificial sequence
  SiRNA target sequence
ctaagcctcagggatcaacac

SEQ ID NO: 17021 - DNA, 21 bp, Artificial sequence
  SiRNA target sequence
taagcctcagggatcaacaca

SEQ ID NO: 17022 - DNA, 21 bp, Artificial sequence
  SiRNA target sequence
aagcctcagggatcaacacaa

SEQ ID NO: 17023 - DNA, 21 bp, Artificial sequence
  SiRNA target sequence
agcctcagggatcaacacaac

SEQ ID NO: 17024 - DNA, 21 bp, Artificial sequence
  SiRNA target sequence
gcctcagggatcaacacaaca

SEQ ID NO: 17025 - DNA, 21 bp, Artificial sequence
  SiRNA target sequence
cctcagggatcaacacaacaa

SEQ ID NO: 17026 - DNA, 21 bp, Artificial sequence
  SiRNA target sequence
ctcagggatcaacacaacaag

SEQ ID NO: 17027 - DNA, 21 bp, Artificial sequence
  SiRNA target sequence
tcagggatcaacacaacaagt

SEQ ID NO: 17028 - DNA, 21 bp, Artificial sequence
  SiRNA target sequence
cagggatcaacacaacaagta

SEQ ID NO: 17029 - DNA, 21 bp, Artificial sequence
  SiRNA target sequence
agggatcaacacaacaagtag

SEQ ID NO: 17030 - DNA, 21 bp, Artificial sequence
  SiRNA target sequence
gggatcaacacaacaagtaga

SEQ ID NO: 17031 - DNA, 21 bp, Artificial sequence
  SiRNA target sequence
ggatcaacacaacaagtagac

SEQ ID NO: 17032 - DNA, 21 bp, Artificial sequence
  SiRNA target sequence
gatcaacacaacaagtagacg

SEQ ID NO: 17033 - DNA, 21 bp, Artificial sequence
  SiRNA target sequence
atcaacacaacaagtagacgc

SEQ ID NO: 17034 - DNA, 21 bp, Artificial sequence
  SiRNA target sequence
tcaacacaacaagtagacgct

SEQ ID NO: 17035 - DNA, 21 bp, Artificial sequence
  SiRNA target sequence
caacacaacaagtagacgctg

SEQ ID NO: 17036 - DNA, 21 bp, Artificial sequence
  SiRNA target sequence
aacacaacaagtagacgctgc

SEQ ID NO: 17037 - DNA, 21 bp, Artificial sequence
  SiRNA target sequence
acacaacaagtagacgctgct

SEQ ID NO: 17038 - DNA, 21 bp, Artificial sequence
  SiRNA target sequence
cacaacaagtagacgctgctg

SEQ ID NO: 17039 - DNA, 21 bp, Artificial sequence
  SiRNA target sequence
acaacaagtagacgctgctgt

SEQ ID NO: 17040 - DNA, 21 bp, Artificial sequence
  SiRNA target sequence
caacaagtagacgctgctgtg

SEQ ID NO: 17041 - DNA, 21 bp, Artificial sequence
  SiRNA target sequence
aacaagtagacgctgctgtga

SEQ ID NO: 17042 - DNA, 21 bp, Artificial sequence
  SiRNA target sequence
acaagtagacgctgctgtgaa

SEQ ID NO: 17043 - DNA, 21 bp, Artificial sequence
  SiRNA target sequence
caagtagacgctgctgtgaat

SEQ ID NO: 17044 - DNA, 21 bp, Artificial sequence
  SiRNA target sequence
aagtagacgctgctgtgaata

SEQ ID NO: 17045 - DNA, 21 bp, Artificial sequence
  SiRNA target sequence
agtagacgctgctgtgaataa

SEQ ID NO: 17046 - DNA, 21 bp, Artificial sequence
  SiRNA target sequence
gtagacgctgctgtgaataaa

SEQ ID NO: 17047 - DNA, 21 bp, Artificial sequence
  SiRNA target sequence
tagacgctgctgtgaataaaa

SEQ ID NO: 17048 - DNA, 21 bp, Artificial sequence
  SiRNA target sequence
agacgctgctgtgaataaaat

SEQ ID NO: 17049 - DNA, 21 bp, Artificial sequence
  SiRNA target sequence
gacgctgctgtgaataaaatt

SEQ ID NO: 17050 - DNA, 21 bp, Artificial sequence
  SiRNA target sequence
acgctgctgtgaataaaattt

SEQ ID NO: 17051 - DNA, 21 bp, Artificial sequence
  SiRNA target sequence
cgctgctgtgaataaaatttt

SEQ ID NO: 17052 - DNA, 21 bp, Artificial sequence
  SiRNA target sequence
gctgctgtgaataaaatttta

SEQ ID NO: 17053 - DNA, 21 bp, Artificial sequence
  SiRNA target sequence
ctgctgtgaataaaattttac

SEQ ID NO: 17054 - DNA, 21 bp, Artificial sequence
  SiRNA target sequence
tgctgtgaataaaattttaca

SEQ ID NO: 17055 - DNA, 21 bp, Artificial sequence
  SiRNA target sequence
gctgtgaataaaattttacag

SEQ ID NO: 17056 - DNA, 21 bp, Artificial sequence
  SiRNA target sequence
ctgtgaataaaattttacaga

SEQ ID NO: 17057 - DNA, 21 bp, Artificial sequence
  SiRNA target sequence
tgtgaataaaattttacagaa

SEQ ID NO: 17058 - DNA, 21 bp, Artificial sequence
  SiRNA target sequence
  misc_feature (21)..(21): n is a, c, g, or t
gtgaataaaattttacagaan

SEQ ID NO: 17059 - DNA, 21 bp, Artificial sequence
  SiRNA target sequence
  misc_feature (20)..(20): n is a, c, g, or t
tgaataaaattttacagaana

SEQ ID NO: 17060 - DNA, 21 bp, Artificial sequence
  SiRNA target sequence
  misc_feature (19)..(19): n is a, c, g, or t
gaataaaattttacagaanat

SEQ ID NO: 17061 - DNA, 21 bp, Artificial sequence
  SiRNA target sequence
  misc_feature (18)..(18): n is a, c, g, or t
aataaaattttacagaanatg

SEQ ID NO: 17062 - DNA, 21 bp, Artificial sequence
  SiRNA target sequence
  misc_feature (17)..(17): n is a, c, g, or t
ataaaattttacagaanatgg

SEQ ID NO: 17063 - DNA, 21 bp, Artificial sequence
  SiRNA target sequence
  misc_feature (16)..(16): n is a, c, g, or t
taaaattttacagaanatggt

SEQ ID NO: 17064 - DNA, 21 bp, Artificial sequence
  SiRNA target sequence
  misc_feature (15)..(15): n is a, c, g, or t
aaaattttacagaanatggtt

SEQ ID NO: 17065 - DNA, 21 bp, Artificial sequence
  SiRNA target sequence
  misc_feature (14)..(14): n is a, c, g, or t
aaattttacagaanatggttt

SEQ ID NO: 17066 - DNA, 21 bp, Artificial sequence
  SiRNA target sequence
  misc_feature (13)..(13): n is a, c, g, or t
aattttacagaanatggttta

SEQ ID NO: 17067 - DNA, 21 bp, Artificial sequence
  SiRNA target sequence
  misc_feature (12)..(12): n is a, c, g, or t
attttacagaanatggtttac

SEQ ID NO: 17068 - DNA, 21 bp, Artificial sequence
  SiRNA target sequence
  misc_feature (11)..(11): n is a, c, g, or t
ttttacagaanatggtttaca

SEQ ID NO: 17069 - DNA, 21 bp, Artificial sequence
  SiRNA target sequence
  misc_feature (10)..(10): n is a, c, g, or t
tttacagaanatggtttacat

SEQ ID NO: 17070 - DNA, 21 bp, Artificial sequence
  SiRNA target sequence
  misc_feature (9)..(9): n is a, c, g, or t
ttacagaanatggtttacatt

SEQ ID NO: 17071 - DNA, 21 bp, Artificial sequence
  SiRNA target sequence
  misc_feature (8)..(8): n is a, c, g, or t
tacagaanatggtttacattg

SEQ ID NO: 17072 - DNA, 21 bp, Artificial sequence
  SiRNA target sequence
  misc_feature (7)..(7): n is a, c, g, or t
acagaanatggtttacattgg

SEQ ID NO: 17073 - DNA, 21 bp, Artificial sequence
  SiRNA target sequence
  misc_feature (6)..(6): n is a, c, g, or t
cagaanatggtttacattggt

SEQ ID NO: 17074 - DNA, 21 bp, Artificial sequence
  SiRNA target sequence
  misc_feature (5)..(5): n is a, c, g, or t
agaanatggtttacattggtg

SEQ ID NO: 17075 - DNA, 21 bp, Artificial sequence
  SiRNA target sequence
  misc_feature (4)..(4): n is a, c, g, or t
gaanatggtttacattggtgt

SEQ ID NO: 17076 - DNA, 21 bp, Artificial sequence
  SiRNA target sequence
  misc_feature (3)..(3): n is a, c, g, or t
aanatggtttacattggtgtt

SEQ ID NO: 17077 - DNA, 21 bp, Artificial sequence
  SiRNA target sequence
  misc_feature (2)..(2): n is a, c, g, or t
anatggtttacattggtgttg

SEQ ID NO: 17078 - DNA, 21 bp, Artificial sequence
  SiRNA target sequence
  misc_feature (1)..(1): n is a, c, g, or t
natggtttacattggtgttgt

SEQ ID NO: 17079 - DNA, 21 bp, Artificial sequence
  SiRNA target sequence
atggtttacattggtgttgtt

SEQ ID NO: 17080 - DNA, 21 bp, Artificial sequence
  SiRNA target sequence
tggtttacattggtgttgttt

SEQ ID NO: 17081 - DNA, 21 bp, Artificial sequence
  SiRNA target sequence
ggtttacattggtgttgtttt

SEQ ID NO: 17082 - DNA, 21 bp, Artificial sequence
  SiRNA target sequence
gtttacattggtgttgttttc

SEQ ID NO: 17083 - DNA, 21 bp, Artificial sequence
  SiRNA target sequence
tttacattggtgttgttttcc

SEQ ID NO: 17084 - DNA, 21 bp, Artificial sequence
  SiRNA target sequence
ttacattggtgttgttttccc

SEQ ID NO: 17085 - DNA, 21 bp, Artificial sequence
  SiRNA target sequence
tacattggtgttgttttccca

SEQ ID NO: 17086 - DNA, 21 bp, Artificial sequence
  SiRNA target sequence
acattggtgttgttttcccaa

SEQ ID NO: 17087 - DNA, 21 bp, Artificial sequence
  SiRNA target sequence
cattggtgttgttttcccaaa

SEQ ID NO: 17088 - DNA, 21 bp, Artificial sequence
  SiRNA target sequence
attggtgttgttttcccaaaa

SEQ ID NO: 17089 - DNA, 21 bp, Artificial sequence
  SiRNA target sequence
ttggtgttgttttcccaaaag

SEQ ID NO: 17090 - DNA, 21 bp, Artificial sequence
  SiRNA target sequence
tggtgttgttttcccaaaagt

SEQ ID NO: 17091 - DNA, 21 bp, Artificial sequence
  SiRNA target sequence
ggtgttgttttcccaaaagtg

SEQ ID NO: 17092 - DNA, 21 bp, Artificial sequence
  SiRNA target sequence
gtgttgttttcccaaaagtgc

SEQ ID NO: 17093 - DNA, 21 bp, Artificial sequence
  SiRNA target sequence
tgttgttttcccaaaagtgcc

SEQ ID NO: 17094 - DNA, 21 bp, Artificial sequence
  SiRNA target sequence
gttgttttcccaaaagtgcct

SEQ ID NO: 17095 - DNA, 21 bp, Artificial sequence
  SiRNA target sequence
ttgttttcccaaaagtgcctg

SEQ ID NO: 17096 - DNA, 21 bp, Artificial sequence
  SiRNA target sequence
tgttttcccaaaagtgcctgg

SEQ ID NO: 17097 - DNA, 21 bp, Artificial sequence
  SiRNA target sequence
gttttcccaaaagtgcctggt

SEQ ID NO: 17098 - DNA, 21 bp, Artificial sequence
  SiRNA target sequence
ttttcccaaaagtgcctggta

SEQ ID NO: 17099 - DNA, 21 bp, Artificial sequence
  SiRNA target sequence
tttcccaaaagtgcctggtag

SEQ ID NO: 17100 - DNA, 21 bp, Artificial sequence
  SiRNA target sequence
ttcccaaaagtgcctggtagt

SEQ ID NO: 17101 - DNA, 21 bp, Artificial sequence
  SiRNA target sequence
tcccaaaagtgcctggtagta

SEQ ID NO: 17102 - DNA, 21 bp, Artificial sequence
  SiRNA target sequence
cccaaaagtgcctggtagtaa

SEQ ID NO: 17103 - DNA, 21 bp, Artificial sequence
  SiRNA target sequence
ccaaaagtgcctggtagtaag

SEQ ID NO: 17104 - DNA, 21 bp, Artificial sequence
  SiRNA target sequence
caaaagtgcctggtagtaagt

SEQ ID NO: 17105 - DNA, 21 bp, Artificial sequence
  SiRNA target sequence
aaaagtgcctggtagtaagtg

SEQ ID NO: 17106 - DNA, 21 bp, Artificial sequence
  SiRNA target sequence
aaagtgcctggtagtaagtgg

SEQ ID NO: 17107 - DNA, 21 bp, Artificial sequence
  SiRNA target sequence
aagtgcctggtagtaagtggc

SEQ ID NO: 17108 - DNA, 21 bp, Artificial sequence
  SiRNA target sequence
agtgcctggtagtaagtggcg

SEQ ID NO: 17109 - DNA, 21 bp, Artificial sequence
  SiRNA target sequence
gtgcctggtagtaagtggcga

SEQ ID NO: 17110 - DNA, 21 bp, Artificial sequence
  SiRNA target sequence
tgcctggtagtaagtggcgag

SEQ ID NO: 17111 - DNA, 21 bp, Artificial sequence
  SiRNA target sequence
gcctggtagtaagtggcgaga

SEQ ID NO: 17112 - DNA, 21 bp, Artificial sequence
  SiRNA target sequence
cctggtagtaagtggcgagat

SEQ ID NO: 17113 - DNA, 21 bp, Artificial sequence
  SiRNA target sequence
ctggtagtaagtggcgagata

SEQ ID NO: 17114 - DNA, 21 bp, Artificial sequence
  SiRNA target sequence
tggtagtaagtggcgagatat

SEQ ID NO: 17115 - DNA, 21 bp, Artificial sequence
  SiRNA target sequence
ggtagtaagtggcgagatatt

SEQ ID NO: 17116 - DNA, 21 bp, Artificial sequence
  SiRNA target sequence
gtagtaagtggcgagatatta

SEQ ID NO: 17117 - DNA, 21 bp, Artificial sequence
  SiRNA target sequence
tagtaagtggcgagatattaa

SEQ ID NO: 17118 - DNA, 21 bp, Artificial sequence
  SiRNA target sequence
agtaagtggcgagatattaat

SEQ ID NO: 17119 - DNA, 21 bp, Artificial sequence
  SiRNA target sequence
gtaagtggcgagatattaatt

SEQ ID NO: 17120 - DNA, 21 bp, Artificial sequence
  SiRNA target sequence
taagtggcgagatattaattt

SEQ ID NO: 17121 - DNA, 21 bp, Artificial sequence
  SiRNA target sequence
aagtggcgagatattaatttt

SEQ ID NO: 17122 - DNA, 21 bp, Artificial sequence
  SiRNA target sequence
agtggcgagatattaatttta

SEQ ID NO: 17123 - DNA, 21 bp, Artificial sequence
  SiRNA target sequence
gtggcgagatattaattttag

SEQ ID NO: 17124 - DNA, 21 bp, Artificial sequence
  SiRNA target sequence
tggcgagatattaattttagg

SEQ ID NO: 17125 - DNA, 21 bp, Artificial sequence
  SiRNA target sequence
ggcgagatattaattttaggt

SEQ ID NO: 17126 - DNA, 21 bp, Artificial sequence
  SiRNA target sequence
gcgagatattaattttaggtg

SEQ ID NO: 17127 - DNA, 21 bp, Artificial sequence
  SiRNA target sequence
cgagatattaattttaggtgt

SEQ ID NO: 17128 - DNA, 21 bp, Artificial sequence
  SiRNA target sequence
gagatattaattttaggtgtc

SEQ ID NO: 17129 - DNA, 21 bp, Artificial sequence
  SiRNA target sequence
agatattaattttaggtgtct

SEQ ID NO: 17130 - DNA, 21 bp, Artificial sequence
  SiRNA target sequence
gatattaattttaggtgtctt

SEQ ID NO: 17131 - DNA, 21 bp, Artificial sequence
  SiRNA target sequence
atattaattttaggtgtctta

SEQ ID NO: 17132 - DNA, 21 bp, Artificial sequence
  SiRNA target sequence
tattaattttaggtgtcttat

SEQ ID NO: 17133 - DNA, 21 bp, Artificial sequence
  SiRNA target sequence
attaattttaggtgtcttatg

SEQ ID NO: 17134 - DNA, 21 bp, Artificial sequence
  SiRNA target sequence
ttaattttaggtgtcttatgc

SEQ ID NO: 17135 - DNA, 21 bp, Artificial sequence
  SiRNA target sequence
taattttaggtgtcttatgct

SEQ ID NO: 17136 - DNA, 21 bp, Artificial sequence
  SiRNA target sequence
aattttaggtgtcttatgctt

SEQ ID NO: 17137 - DNA, 21 bp, Artificial sequence
  SiRNA target sequence
attttaggtgtcttatgcttc

SEQ ID NO: 17138 - DNA, 21 bp, Artificial sequence
  SiRNA target sequence
ttttaggtgtcttatgcttca

SEQ ID NO: 17139 - DNA, 21 bp, Artificial sequence
  SiRNA target sequence
tttaggtgtcttatgcttcat

SEQ ID NO: 17140 - DNA, 21 bp, Artificial sequence
  SiRNA target sequence
ttaggtgtcttatgcttcata

SEQ ID NO: 17141 - DNA, 21 bp, Artificial sequence
  SiRNA target sequence
taggtgtcttatgcttcataa

SEQ ID NO: 17142 - DNA, 21 bp, Artificial sequence
  SiRNA target sequence
aggtgtcttatgcttcataat

SEQ ID NO: 17143 - DNA, 21 bp, Artificial sequence
  SiRNA target sequence
ggtgtcttatgcttcataata

SEQ ID NO: 17144 - DNA, 21 bp, Artificial sequence
  SiRNA target sequence
gtgtcttatgcttcataatag

SEQ ID NO: 17145 - DNA, 21 bp, Artificial sequence
  SiRNA target sequence
tgtcttatgcttcataatagg

SEQ ID NO: 17146 - DNA, 21 bp, Artificial sequence
  SiRNA target sequence
gtcttatgcttcataataggc

SEQ ID NO: 17147 - DNA, 21 bp, Artificial sequence
  SiRNA target sequence
tcttatgcttcataataggca

SEQ ID NO: 17148 - DNA, 21 bp, Artificial sequence
  SiRNA target sequence
cttatgcttcataataggcaa

SEQ ID NO: 17149 - DNA, 21 bp, Artificial sequence
  SiRNA target sequence
ttatgcttcataataggcaat

SEQ ID NO: 17150 - DNA, 21 bp, Artificial sequence
  SiRNA target sequence
tatgcttcataataggcaatg

SEQ ID NO: 17151 - DNA, 21 bp, Artificial sequence
  SiRNA target sequence
atgcttcataataggcaatgt

SEQ ID NO: 17152 - DNA, 21 bp, Artificial sequence
  SiRNA target sequence
tgcttcataataggcaatgtt

SEQ ID NO: 17153 - DNA, 21 bp, Artificial sequence
  SiRNA target sequence
gcttcataataggcaatgttt

SEQ ID NO: 17154 - DNA, 21 bp, Artificial sequence
  SiRNA target sequence
cttcataataggcaatgttta

SEQ ID NO: 17155 - DNA, 21 bp, Artificial sequence
  SiRNA target sequence
ttcataataggcaatgtttaa

SEQ ID NO: 17156 - DNA, 21 bp, Artificial sequence
  SiRNA target sequence
tcataataggcaatgtttaat

SEQ ID NO: 17157 - DNA, 21 bp, Artificial sequence
  SiRNA target sequence
cataataggcaatgtttaatg

SEQ ID NO: 17158 - DNA, 21 bp, Artificial sequence
  SiRNA target sequence
ataataggcaatgtttaatgt

SEQ ID NO: 17159 - DNA, 21 bp, Artificial sequence
  SiRNA target sequence
taataggcaatgtttaatgtt

SEQ ID NO: 17160 - DNA, 21 bp, Artificial sequence
  SiRNA target sequence
aataggcaatgtttaatgttg

SEQ ID NO: 17161 - DNA, 21 bp, Artificial sequence
  SiRNA target sequence
ataggcaatgtttaatgttga

SEQ ID NO: 17162 - DNA, 21 bp, Artificial sequence
  SiRNA target sequence
taggcaatgtttaatgttgag

SEQ ID NO: 17163 - DNA, 21 bp, Artificial sequence
  SiRNA target sequence
aggcaatgtttaatgttgagg

SEQ ID NO: 17164 - DNA, 21 bp, Artificial sequence
  SiRNA target sequence
ggcaatgtttaatgttgaggc

SEQ ID NO: 17165 - DNA, 21 bp, Artificial sequence
  SiRNA target sequence
gcaatgtttaatgttgaggca

SEQ ID NO: 17166 - DNA, 21 bp, Artificial sequence
  SiRNA target sequence
caatgtttaatgttgaggcat

SEQ ID NO: 17167 - DNA, 21 bp, Artificial sequence
  SiRNA target sequence
aatgtttaatgttgaggcatt

SEQ ID NO: 17168 - DNA, 21 bp, Artificial sequence
  SiRNA target sequence
atgtttaatgttgaggcatta

SEQ ID NO: 17169 - DNA, 21 bp, Artificial sequence
  SiRNA target sequence
tgtttaatgttgaggcattat

SEQ ID NO: 17170 - DNA, 21 bp, Artificial sequence
  SiRNA target sequence
gtttaatgttgaggcattata

SEQ ID NO: 17171 - DNA, 21 bp, Artificial sequence
  SiRNA target sequence
tttaatgttgaggcattatat

SEQ ID NO: 17172 - DNA, 21 bp, Artificial sequence
  SiRNA target sequence
ttaatgttgaggcattatatt

SEQ ID NO: 17173 - DNA, 21 bp, Artificial sequence
  SiRNA target sequence
taatgttgaggcattatattg

SEQ ID NO: 17174 - DNA, 21 bp, Artificial sequence
  SiRNA target sequence
aatgttgaggcattatattga

SEQ ID NO: 17175 - DNA, 21 bp, Artificial sequence
  SiRNA target sequence
atgttgaggcattatattgag

SEQ ID NO: 17176 - DNA, 21 bp, Artificial sequence
  SiRNA target sequence
tgttgaggcattatattgagt

SEQ ID NO: 17177 - DNA, 21 bp, Artificial sequence
  SiRNA target sequence
gttgaggcattatattgagtc

SEQ ID NO: 17178 - DNA, 21 bp, Artificial sequence
  SiRNA target sequence
  misc_feature (21)..(21): n is a, c, g, or t
ttgaggcattatattgagtcn

SEQ ID NO: 17179 - DNA, 21 bp, Artificial sequence
  SiRNA target sequence
  misc_feature (20)..(20): n is a, c, g, or t
tgaggcattatattgagtcna

SEQ ID NO: 17180 - DNA, 21 bp, Artificial sequence
  SiRNA target sequence
  misc_feature (19)..(19): n is a, c, g, or t
gaggcattatattgagtcnac

SEQ ID NO: 17181 - DNA, 21 bp, Artificial sequence
  SiRNA target sequence
  misc_feature (18)..(18): n is a, c, g, or t
aggcattatattgagtcnact

SEQ ID NO: 17182 - DNA, 21 bp, Artificial sequence
  SiRNA target sequence
  misc_feature (17)..(17): n is a, c, g, or t
ggcattatattgagtcnactg

SEQ ID NO: 17183 - DNA, 21 bp, Artificial sequence
  SiRNA target sequence
  misc_feature (16)..(16): n is a, c, g, or t
gcattatattgagtcnactgc

SEQ ID NO: 17184 - DNA, 21 bp, Artificial sequence
  SiRNA target sequence
  misc_feature (15)..(15): n is a, c, g, or t
cattatattgagtcnactgct

SEQ ID NO: 17185 - DNA, 21 bp, Artificial sequence
  SiRNA target sequence
  misc_feature (14)..(14): n is a, c, g, or t
attatattgagtcnactgctg

SEQ ID NO: 17186 - DNA, 21 bp, Artificial sequence
  SiRNA target sequence
  misc_feature (13)..(13): n is a, c, g, or t
ttatattgagtcnactgctgc

SEQ ID NO: 17187 - DNA, 21 bp, Artificial sequence
  SiRNA target sequence
  misc_feature (12)..(12): n is a, c, g, or t
tatattgagtcnactgctgcc

SEQ ID NO: 17188 - DNA, 21 bp, Artificial sequence
  SiRNA target sequence
  misc_feature (11)..(11): n is a, c, g, or t
atattgagtcnactgctgcct

SEQ ID NO: 17189 - DNA, 21 bp, Artificial sequence
  SiRNA target sequence
  misc_feature (10)..(10): n is a, c, g, or t
tattgagtcnactgctgcctt

SEQ ID NO: 17190 - DNA, 21 bp, Artificial sequence
  SiRNA target sequence
  misc_feature (9)..(9): n is a, c, g, or t
attgagtcnactgctgccttt

SEQ ID NO: 17191 - DNA, 21 bp, Artificial sequence
  SiRNA target sequence
  misc_feature (8)..(8): n is a, c, g, or t
ttgagtcnactgctgcctttc

SEQ ID NO: 17192 - DNA, 21 bp, Artificial sequence
  SiRNA target sequence
  misc_feature (7)..(7): n is a, c, g, or t
tgagtcnactgctgcctttcc

SEQ ID NO: 17193 - DNA, 21 bp, Artificial sequence
  SiRNA target sequence
  misc_feature (6)..(6): n is a, c, g, or t
gagtcnactgctgcctttcct

SEQ ID NO: 17194 - DNA, 21 bp, Artificial sequence
  SiRNA target sequence
  misc_feature (5)..(5): n is a, c, g, or t
agtcnactgctgcctttcctg

SEQ ID NO: 17195 - DNA, 21 bp, Artificial sequence
  SiRNA target sequence
  misc_feature (4)..(4): n is a, c, g, or t
gtcnactgctgcctttcctga

SEQ ID NO: 17196 - DNA, 21 bp, Artificial sequence
  SiRNA target sequence
  misc_feature (3)..(3): n is a, c, g, or t
tcnactgctgcctttcctgag

SEQ ID NO: 17197 - DNA, 21 bp, Artificial sequence
  SiRNA target sequence
  misc_feature (2)..(2): n is a, c, g, or t
cnactgctgcctttcctgagg

SEQ ID NO: 17198 - DNA, 21 bp, Artificial sequence
  SiRNA target sequence
  misc_feature (1)..(1): n is a, c, g, or t
nactgctgcctttcctgaggg

SEQ ID NO: 17199 - DNA, 21 bp, Artificial sequence
  SiRNA target sequence
actgctgcctttcctgaggga

SEQ ID NO: 17200 - DNA, 21 bp, Artificial sequence
  SiRNA target sequence
ctgctgcctttcctgagggaa

SEQ ID NO: 17201 - DNA, 21 bp, Artificial sequence
  SiRNA target sequence
tgctgcctttcctgagggaac

SEQ ID NO: 17202 - DNA, 21 bp, Artificial sequence
  SiRNA target sequence
gctgcctttcctgagggaacc

SEQ ID NO: 17203 - DNA, 21 bp, Artificial sequence
  SiRNA target sequence
ctgcctttcctgagggaacca

SEQ ID NO: 17204 - DNA, 21 bp, Artificial sequence
  SiRNA target sequence
tgcctttcctgagggaaccaa

SEQ ID NO: 17205 - DNA, 21 bp, Artificial sequence
  SiRNA target sequence
gcctttcctgagggaaccaag

SEQ ID NO: 17206 - DNA, 21 bp, Artificial sequence
  SiRNA target sequence
cctttcctgagggaaccaagt

SEQ ID NO: 17207 - DNA, 21 bp, Artificial sequence
  SiRNA target sequence
ctttcctgagggaaccaagta

SEQ ID NO: 17208 - DNA, 21 bp, Artificial sequence
  SiRNA target sequence
tttcctgagggaaccaagtac

SEQ ID NO: 17209 - DNA, 21 bp, Artificial sequence
  SiRNA target sequence
ttcctgagggaaccaagtact

SEQ ID NO: 17210 - DNA, 21 bp, Artificial sequence
  SiRNA target sequence
tcctgagggaaccaagtacta

SEQ ID NO: 17211 - DNA, 21 bp, Artificial sequence
  SiRNA target sequence
cctgagggaaccaagtactat

SEQ ID NO: 17212 - DNA, 21 bp, Artificial sequence
  SiRNA target sequence
ctgagggaaccaagtactatt

SEQ ID NO: 17213 - DNA, 21 bp, Artificial sequence
  SiRNA target sequence
tgagggaaccaagtactattt

SEQ ID NO: 17214 - DNA, 21 bp, Artificial sequence
  SiRNA target sequence
  misc_feature (21)..(21): n is a, c, g, or t
gagggaaccaagtactatttn

SEQ ID NO: 17215 - DNA, 21 bp, Artificial sequence
  SiRNA target sequence
  misc_feature (20)..(20): n is a, c, g, or t
agggaaccaagtactatttna

SEQ ID NO: 17216 - DNA, 21 bp, Artificial sequence
  SiRNA target sequence
  misc_feature (19)..(19): n is a, c, g, or t
gggaaccaagtactatttnaa

SEQ ID NO: 17217 - DNA, 21 bp, Artificial sequence
  SiRNA target sequence
  misc_feature (18)..(18): n is a, c, g, or t
ggaaccaagtactatttnaag

SEQ ID NO: 17218 - DNA, 21 bp, Artificial sequence
  SiRNA target sequence
  misc_feature (17)..(17): n is a, c, g, or t
gaaccaagtactatttnaagt

SEQ ID NO: 17219 - DNA, 21 bp, Artificial sequence
  SiRNA target sequence
  misc_feature (16)..(16): n is a, c, g, or t
aaccaagtactatttnaagta

SEQ ID NO: 17220 - DNA, 21 bp, Artificial sequence
  SiRNA target sequence
  misc_feature (15)..(15): n is a, c, g, or t
accaagtactatttnaagtat

SEQ ID NO: 17221 - DNA, 21 bp, Artificial sequence
  SiRNA target sequence
  misc_feature (14)..(14): n is a, c, g, or t
ccaagtactatttnaagtata

SEQ ID NO: 17222 - DNA, 21 bp, Artificial sequence
  SiRNA target sequence
  misc_feature (13)..(13): n is a, c, g, or t
caagtactatttnaagtatat

SEQ ID NO: 17223 - DNA, 21 bp, Artificial sequence
  SiRNA target sequence
  misc_feature (12)..(12): n is a, c, g, or t
aagtactatttnaagtatatt

SEQ ID NO: 17224 - DNA, 21 bp, Artificial sequence
  SiRNA target sequence
  misc_feature (11)..(11): n is a, c, g, or t
agtactatttnaagtatattc

SEQ ID NO: 17225 - DNA, 21 bp, Artificial sequence
  SiRNA target sequence
  misc_feature (10)..(10): n is a, c, g, or t
gtactatttnaagtatattca

SEQ ID NO: 17226 - DNA, 21 bp, Artificial sequence
  SiRNA target sequence
  misc_feature (9)..(9): n is a, c, g, or t
tactatttnaagtatattcat

SEQ ID NO: 17227 - DNA, 21 bp, Artificial sequence
  SiRNA target sequence
  misc_feature (8)..(8): n is a, c, g, or t
actatttnaagtatattcata

SEQ ID NO: 17228 - DNA, 21 bp, Artificial sequence
  SiRNA target sequence
  misc_feature (7)..(7): n is a, c, g, or t
ctatttnaagtatattcataa

SEQ ID NO: 17229 - DNA, 21 bp, Artificial sequence
  SiRNA target sequence
  misc_feature (6)..(6): n is a, c, g, or t
tatttnaagtatattcataat

SEQ ID NO: 17230 - DNA, 21 bp, Artificial sequence
  SiRNA target sequence
  misc_feature (5)..(5): n is a, c, g, or t
atttnaagtatattcataatc

SEQ ID NO: 17231 - DNA, 21 bp, Artificial sequence
  SiRNA target sequence
  misc_feature (4)..(4): n is a, c, g, or t
tttnaagtatattcataatca

SEQ ID NO: 17232 - DNA, 21 bp, Artificial sequence
  SiRNA target sequence
  misc_feature (3)..(3): n is a, c, g, or t
ttnaagtatattcataatcaa

SEQ ID NO: 17233 - DNA, 21 bp, Artificial sequence
  SiRNA target sequence
  misc_feature (2)..(2): n is a, c, g, or t
tnaagtatattcataatcaag

SEQ ID NO: 17234 - DNA, 21 bp, Artificial sequence
  SiRNA target sequence
  misc_feature (1)..(1): n is a, c, g, or t
naagtatattcataatcaaga

SEQ ID NO: 17235 - DNA, 21 bp, Artificial sequence
  SiRNA target sequence
aagtatattcataatcaagag

SEQ ID NO: 17236 - DNA, 21 bp, Artificial sequence
  SiRNA target sequence
agtatattcataatcaagaga

SEQ ID NO: 17237 - DNA, 21 bp, Artificial sequence
  SiRNA target sequence
gtatattcataatcaagagac

SEQ ID NO: 17238 - DNA, 21 bp, Artificial sequence
  SiRNA target sequence
tatattcataatcaagagact

SEQ ID NO: 17239 - DNA, 21 bp, Artificial sequence
  SiRNA target sequence
atattcataatcaagagacta

SEQ ID NO: 17240 - DNA, 21 bp, Artificial sequence
  SiRNA target sequence
tattcataatcaagagactag

SEQ ID NO: 17241 - DNA, 21 bp, Artificial sequence
  SiRNA target sequence
attcataatcaagagactaga

SEQ ID NO: 17242 - DNA, 21 bp, Artificial sequence
  SiRNA target sequence
ttcataatcaagagactagaa

SEQ ID NO: 17243 - DNA, 21 bp, Artificial sequence
  SiRNA target sequence
tcataatcaagagactagaat

SEQ ID NO: 17244 - DNA, 21 bp, Artificial sequence
  SiRNA target sequence
cataatcaagagactagaatg

SEQ ID NO: 17245 - DNA, 21 bp, Artificial sequence
  SiRNA target sequence
ataatcaagagactagaatgt

SEQ ID NO: 17246 - DNA, 21 bp, Artificial sequence
  SiRNA target sequence
taatcaagagactagaatgtc

SEQ ID NO: 17247 - DNA, 21 bp, Artificial sequence
  SiRNA target sequence
aatcaagagactagaatgtct

SEQ ID NO: 17248 - DNA, 21 bp, Artificial sequence
  SiRNA target sequence
atcaagagactagaatgtctg

SEQ ID NO: 17249 - DNA, 21 bp, Artificial sequence
  SiRNA target sequence
tcaagagactagaatgtctgg

SEQ ID NO: 17250 - DNA, 21 bp, Artificial sequence
  SiRNA target sequence
caagagactagaatgtctggt

SEQ ID NO: 17251 - DNA, 21 bp, Artificial sequence
  SiRNA target sequence
aagagactagaatgtctggtg

SEQ ID NO: 17252 - DNA, 21 bp, Artificial sequence
  SiRNA target sequence
agagactagaatgtctggtga

SEQ ID NO: 17253 - DNA, 21 bp, Artificial sequence
  SiRNA target sequence
gagactagaatgtctggtgat

SEQ ID NO: 17254 - DNA, 21 bp, Artificial sequence
  SiRNA target sequence
agactagaatgtctggtgata

SEQ ID NO: 17255 - DNA, 21 bp, Artificial sequence
  SiRNA target sequence
gactagaatgtctggtgatat

SEQ ID NO: 17256 - DNA, 21 bp, Artificial sequence
  SiRNA target sequence
actagaatgtctggtgatatt

SEQ ID NO: 17257 - DNA, 21 bp, Artificial sequence
  SiRNA target sequence
ctagaatgtctggtgatattt

SEQ ID NO: 17258 - DNA, 21 bp, Artificial sequence
  SiRNA target sequence
tagaatgtctggtgatatttc

SEQ ID NO: 17259 - DNA, 21 bp, Artificial sequence
  SiRNA target sequence
agaatgtctggtgatatttct

SEQ ID NO: 17260 - DNA, 21 bp, Artificial sequence
  SiRNA target sequence
gaatgtctggtgatatttctg

SEQ ID NO: 17261 - DNA, 21 bp, Artificial sequence
  SiRNA target sequence
aatgtctggtgatatttctgg

SEQ ID NO: 17262 - DNA, 21 bp, Artificial sequence
  SiRNA target sequence
atgtctggtgatatttctggt

SEQ ID NO: 17263 - DNA, 21 bp, Artificial sequence
  SiRNA target sequence
tgtctggtgatatttctggta

SEQ ID NO: 17264 - DNA, 21 bp, Artificial sequence
  SiRNA target sequence
gtctggtgatatttctggtat

SEQ ID NO: 17265 - DNA, 21 bp, Artificial sequence
  SiRNA target sequence
tctggtgatatttctggtatt

SEQ ID NO: 17266 - DNA, 21 bp, Artificial sequence
  SiRNA target sequence
ctggtgatatttctggtattg

SEQ ID NO: 17267 - DNA, 21 bp, Artificial sequence
  SiRNA target sequence
tggtgatatttctggtattga

SEQ ID NO: 17268 - DNA, 21 bp, Artificial sequence
  SiRNA target sequence
ggtgatatttctggtattgaa

SEQ ID NO: 17269 - DNA, 21 bp, Artificial sequence
  SiRNA target sequence
gtgatatttctggtattgaaa

SEQ ID NO: 17270 - DNA, 21 bp, Artificial sequence
  SiRNA target sequence
tgatatttctggtattgaaat

SEQ ID NO: 17271 - DNA, 21 bp, Artificial sequence
  SiRNA target sequence
gatatttctggtattgaaatt

SEQ ID NO: 17272 - DNA, 21 bp, Artificial sequence
  SiRNA target sequence
atatttctggtattgaaattg

SEQ ID NO: 17273 - DNA, 21 bp, Artificial sequence
  SiRNA target sequence
tatttctggtattgaaattga

SEQ ID NO: 17274 - DNA, 21 bp, Artificial sequence
  SiRNA target sequence
atttctggtattgaaattgat

SEQ ID NO: 17275 - DNA, 21 bp, Artificial sequence
  SiRNA target sequence
tttctggtattgaaattgatt

SEQ ID NO: 17276 - DNA, 21 bp, Artificial sequence
  SiRNA target sequence
ttctggtattgaaattgattt

SEQ ID NO: 17277 - DNA, 21 bp, Artificial sequence
  SiRNA target sequence
tctggtattgaaattgatttg

SEQ ID NO: 17278 - DNA, 21 bp, Artificial sequence
  SiRNA target sequence
ctggtattgaaattgatttgt

SEQ ID NO: 17279 - DNA, 21 bp, Artificial sequence
  SiRNA target sequence
tggtattgaaattgatttgtt

SEQ ID NO: 17280 - DNA, 21 bp, Artificial sequence
  SiRNA target sequence
ggtattgaaattgatttgttg

SEQ ID NO: 17281 - DNA, 21 bp, Artificial sequence
  SiRNA target sequence
gtattgaaattgatttgttga

SEQ ID NO: 17282 - DNA, 21 bp, Artificial sequence
  SiRNA target sequence
tattgaaattgatttgttgaa

SEQ ID NO: 17283 - DNA, 21 bp, Artificial sequence
  SiRNA target sequence
attgaaattgatttgttgaat

SEQ ID NO: 17284 - DNA, 21 bp, Artificial sequence
  SiRNA target sequence
ttgaaattgatttgttgaatt

SEQ ID NO: 17285 - DNA, 21 bp, Artificial sequence
  SiRNA target sequence
tgaaattgatttgttgaattt

SEQ ID NO: 17286 - DNA, 21 bp, Artificial sequence
  SiRNA target sequence
gaaattgatttgttgaattta

SEQ ID NO: 17287 - DNA, 21 bp, Artificial sequence
  SiRNA target sequence
aaattgatttgttgaatttac

SEQ ID NO: 17288 - DNA, 21 bp, Artificial sequence
  SiRNA target sequence
aattgatttgttgaatttacc

SEQ ID NO: 17289 - DNA, 21 bp, Artificial sequence
  SiRNA target sequence
attgatttgttgaatttacct

SEQ ID NO: 17290 - DNA, 21 bp, Artificial sequence
  SiRNA target sequence
ttgatttgttgaatttaccta

SEQ ID NO: 17291 - DNA, 21 bp, Artificial sequence
  SiRNA target sequence
tgatttgttgaatttacctag

SEQ ID NO: 17292 - DNA, 21 bp, Artificial sequence
  SiRNA target sequence
gatttgttgaatttacctaga

SEQ ID NO: 17293 - DNA, 21 bp, Artificial sequence
  SiRNA target sequence
atttgttgaatttacctagat

SEQ ID NO: 17294 - DNA, 21 bp, Artificial sequence
  SiRNA target sequence
tttgttgaatttacctagatt

SEQ ID NO: 17295 - DNA, 21 bp, Artificial sequence
  SiRNA target sequence
ttgttgaatttacctagattg

SEQ ID NO: 17296 - DNA, 21 bp, Artificial sequence
  SiRNA target sequence
tgttgaatttacctagattgt

SEQ ID NO: 17297 - DNA, 21 bp, Artificial sequence
  SiRNA target sequence
gttgaatttacctagattgta

SEQ ID NO: 17298 - DNA, 21 bp, Artificial sequence
  SiRNA target sequence
ttgaatttacctagattgtat

SEQ ID NO: 17299 - DNA, 21 bp, Artificial sequence
  SiRNA target sequence
tgaatttacctagattgtatt

SEQ ID NO: 17300 - DNA, 21 bp, Artificial sequence
  SiRNA target sequence
gaatttacctagattgtatta

SEQ ID NO: 17301 - DNA, 21 bp, Artificial sequence
  SiRNA target sequence
aatttacctagattgtattat

SEQ ID NO: 17302 - DNA, 21 bp, Artificial sequence
  SiRNA target sequence
atttacctagattgtattatg

SEQ ID NO: 17303 - DNA, 21 bp, Artificial sequence
  SiRNA target sequence
tttacctagattgtattatgg

SEQ ID NO: 17304 - DNA, 21 bp, Artificial sequence
  SiRNA target sequence
ttacctagattgtattatggt

SEQ ID NO: 17305 - DNA, 21 bp, Artificial sequence
  SiRNA target sequence
tacctagattgtattatggtg

SEQ ID NO: 17306 - DNA, 21 bp, Artificial sequence
  SiRNA target sequence
acctagattgtattatggtgg

SEQ ID NO: 17307 - DNA, 21 bp, Artificial sequence
  SiRNA target sequence
cctagattgtattatggtggt

SEQ ID NO: 17308 - DNA, 21 bp, Artificial sequence
  SiRNA target sequence
ctagattgtattatggtggtc

SEQ ID NO: 17309 - DNA, 21 bp, Artificial sequence
  SiRNA target sequence
tagattgtattatggtggtct

SEQ ID NO: 17310 - DNA, 21 bp, Artificial sequence
  SiRNA target sequence
agattgtattatggtggtctc

SEQ ID NO: 17311 - DNA, 21 bp, Artificial sequence
  SiRNA target sequence
gattgtattatggtggtctcg

SEQ ID NO: 17312 - DNA, 21 bp, Artificial sequence
  SiRNA target sequence
attgtattatggtggtctcgc

SEQ ID NO: 17313 - DNA, 21 bp, Artificial sequence
  SiRNA target sequence
ttgtattatggtggtctcgcg

SEQ ID NO: 17314 - DNA, 21 bp, Artificial sequence
  SiRNA target sequence
tgtattatggtggtctcgcgg

SEQ ID NO: 17315 - DNA, 21 bp, Artificial sequence
  SiRNA target sequence
gtattatggtggtctcgcggg

SEQ ID NO: 17316 - DNA, 21 bp, Artificial sequence
  SiRNA target sequence
tattatggtggtctcgcggga

SEQ ID NO: 17317 - DNA, 21 bp, Artificial sequence
  SiRNA target sequence
attatggtggtctcgcgggag

SEQ ID NO: 17318 - DNA, 21 bp, Artificial sequence
  SiRNA target sequence
ttatggtggtctcgcgggaga

SEQ ID NO: 17319 - DNA, 21 bp, Artificial sequence
  SiRNA target sequence
tatggtggtctcgcgggagag

SEQ ID NO: 17320 - DNA, 21 bp, Artificial sequence
  SiRNA target sequence
atggtggtctcgcgggagagg

SEQ ID NO: 17321 - DNA, 21 bp, Artificial sequence
  SiRNA target sequence
tggtggtctcgcgggagagga

SEQ ID NO: 17322 - DNA, 21 bp, Artificial sequence
  SiRNA target sequence
ggtggtctcgcgggagaggag

SEQ ID NO: 17323 - DNA, 21 bp, Artificial sequence
  SiRNA target sequence
gtggtctcgcgggagaggagt

SEQ ID NO: 17324 - DNA, 21 bp, Artificial sequence
  SiRNA target sequence
tggtctcgcgggagaggagtc

SEQ ID NO: 17325 - DNA, 21 bp, Artificial sequence
  SiRNA target sequence
ggtctcgcgggagaggagtca

SEQ ID NO: 17326 - DNA, 21 bp, Artificial sequence
  SiRNA target sequence
gtctcgcgggagaggagtcat

SEQ ID NO: 17327 - DNA, 21 bp, Artificial sequence
  SiRNA target sequence
tctcgcgggagaggagtcatt

SEQ ID NO: 17328 - DNA, 21 bp, Artificial sequence
  SiRNA target sequence
ctcgcgggagaggagtcattt

SEQ ID NO: 17329 - DNA, 21 bp, Artificial sequence
  SiRNA target sequence
tcgcgggagaggagtcatttg

SEQ ID NO: 17330 - DNA, 21 bp, Artificial sequence
  SiRNA target sequence
cgcgggagaggagtcatttga

SEQ ID NO: 17331 - DNA, 21 bp, Artificial sequence
  SiRNA target sequence
gcgggagaggagtcatttgat

SEQ ID NO: 17332 - DNA, 21 bp, Artificial sequence
  SiRNA target sequence
cgggagaggagtcatttgata

SEQ ID NO: 17333 - DNA, 21 bp, Artificial sequence
  SiRNA target sequence
gggagaggagtcatttgatag

SEQ ID NO: 17334 - DNA, 21 bp, Artificial sequence
  SiRNA target sequence
ggagaggagtcatttgatagc

SEQ ID NO: 17335 - DNA, 21 bp, Artificial sequence
  SiRNA target sequence
gagaggagtcatttgatagca

SEQ ID NO: 17336 - DNA, 21 bp, Artificial sequence
  SiRNA target sequence
agaggagtcatttgatagcaa

SEQ ID NO: 17337 - DNA, 21 bp, Artificial sequence
  SiRNA target sequence
gaggagtcatttgatagcaat

SEQ ID NO: 17338 - DNA, 21 bp, Artificial sequence
  SiRNA target sequence
aggagtcatttgatagcaata

SEQ ID NO: 17339 - DNA, 21 bp, Artificial sequence
  SiRNA target sequence
ggagtcatttgatagcaatat

SEQ ID NO: 17340 - DNA, 21 bp, Artificial sequence
  SiRNA target sequence
gagtcatttgatagcaatatc

SEQ ID NO: 17341 - DNA, 21 bp, Artificial sequence
  SiRNA target sequence
agtcatttgatagcaatatcg

SEQ ID NO: 17342 - DNA, 21 bp, Artificial sequence
  SiRNA target sequence
gtcatttgatagcaatatcgt

SEQ ID NO: 17343 - DNA, 21 bp, Artificial sequence
  SiRNA target sequence
tcatttgatagcaatatcgtg

SEQ ID NO: 17344 - DNA, 21 bp, Artificial sequence
  SiRNA target sequence
catttgatagcaatatcgtgc

SEQ ID NO: 17345 - DNA, 21 bp, Artificial sequence
  SiRNA target sequence
atttgatagcaatatcgtgct

SEQ ID NO: 17346 - DNA, 21 bp, Artificial sequence
  SiRNA target sequence
tttgatagcaatatcgtgctt

SEQ ID NO: 17347 - DNA, 21 bp, Artificial sequence
  SiRNA target sequence
ttgatagcaatatcgtgcttg

SEQ ID NO: 17348 - DNA, 21 bp, Artificial sequence
  SiRNA target sequence
tgatagcaatatcgtgcttgt

SEQ ID NO: 17349 - DNA, 21 bp, Artificial sequence
  SiRNA target sequence
gatagcaatatcgtgcttgtg

SEQ ID NO: 17350 - DNA, 21 bp, Artificial sequence
  SiRNA target sequence
atagcaatatcgtgcttgtga

SEQ ID NO: 17351 - DNA, 21 bp, Artificial sequence
  SiRNA target sequence
tagcaatatcgtgcttgtgac

SEQ ID NO: 17352 - DNA, 21 bp, Artificial sequence
  SiRNA target sequence
agcaatatcgtgcttgtgact

SEQ ID NO: 17353 - DNA, 21 bp, Artificial sequence
  SiRNA target sequence
gcaatatcgtgcttgtgacta

SEQ ID NO: 17354 - DNA, 21 bp, Artificial sequence
  SiRNA target sequence
caatatcgtgcttgtgactat

SEQ ID NO: 17355 - DNA, 21 bp, Artificial sequence
  SiRNA target sequence
aatatcgtgcttgtgactatg

SEQ ID NO: 17356 - DNA, 21 bp, Artificial sequence
  SiRNA target sequence
atatcgtgcttgtgactatgc

SEQ ID NO: 17357 - DNA, 21 bp, Artificial sequence
  SiRNA target sequence
tatcgtgcttgtgactatgcc

SEQ ID NO: 17358 - DNA, 21 bp, Artificial sequence
  SiRNA target sequence
atcgtgcttgtgactatgcct

SEQ ID NO: 17359 - DNA, 21 bp, Artificial sequence
  SiRNA target sequence
tcgtgcttgtgactatgccta

SEQ ID NO: 17360 - DNA, 21 bp, Artificial sequence
  SiRNA target sequence
cgtgcttgtgactatgcctaa

SEQ ID NO: 17361 - DNA, 21 bp, Artificial sequence
  SiRNA target sequence
gtgcttgtgactatgcctaat

SEQ ID NO: 17362 - DNA, 21 bp, Artificial sequence
  SiRNA target sequence
tgcttgtgactatgcctaatc

SEQ ID NO: 17363 - DNA, 21 bp, Artificial sequence
  SiRNA target sequence
gcttgtgactatgcctaatcg

SEQ ID NO: 17364 - DNA, 21 bp, Artificial sequence
  SiRNA target sequence
cttgtgactatgcctaatcgt

SEQ ID NO: 17365 - DNA, 21 bp, Artificial sequence
  SiRNA target sequence
ttgtgactatgcctaatcgta

SEQ ID NO: 17366 - DNA, 21 bp, Artificial sequence
  SiRNA target sequence
tgtgactatgcctaatcgtat

SEQ ID NO: 17367 - DNA, 21 bp, Artificial sequence
  SiRNA target sequence
gtgactatgcctaatcgtatt

SEQ ID NO: 17368 - DNA, 21 bp, Artificial sequence
  SiRNA target sequence
tgactatgcctaatcgtattc

SEQ ID NO: 17369 - DNA, 21 bp, Artificial sequence
  SiRNA target sequence
gactatgcctaatcgtattcc

SEQ ID NO: 17370 - DNA, 21 bp, Artificial sequence
  SiRNA target sequence
actatgcctaatcgtattcct

SEQ ID NO: 17371 - DNA, 21 bp, Artificial sequence
  SiRNA target sequence
ctatgcctaatcgtattcctg

SEQ ID NO: 17372 - DNA, 21 bp, Artificial sequence
  SiRNA target sequence
tatgcctaatcgtattcctga

SEQ ID NO: 17373 - DNA, 21 bp, Artificial sequence
  SiRNA target sequence
atgcctaatcgtattcctgag

SEQ ID NO: 17374 - DNA, 21 bp, Artificial sequence
  SiRNA target sequence
tgcctaatcgtattcctgagt

SEQ ID NO: 17375 - DNA, 21 bp, Artificial sequence
  SiRNA target sequence
gcctaatcgtattcctgagtg

SEQ ID NO: 17376 - DNA, 21 bp, Artificial sequence
  SiRNA target sequence
cctaatcgtattcctgagtgt

SEQ ID NO: 17377 - DNA, 21 bp, Artificial sequence
  SiRNA target sequence
ctaatcgtattcctgagtgta

SEQ ID NO: 17378 - DNA, 21 bp, Artificial sequence
  SiRNA target sequence
taatcgtattcctgagtgtaa

SEQ ID NO: 17379 - DNA, 21 bp, Artificial sequence
  SiRNA target sequence
aatcgtattcctgagtgtaag

SEQ ID NO: 17380 - DNA, 21 bp, Artificial sequence
  SiRNA target sequence
atcgtattcctgagtgtaaga

SEQ ID NO: 17381 - DNA, 21 bp, Artificial sequence
  SiRNA target sequence
tcgtattcctgagtgtaagag

SEQ ID NO: 17382 - DNA, 21 bp, Artificial sequence
  SiRNA target sequence
cgtattcctgagtgtaagagc

SEQ ID NO: 17383 - DNA, 21 bp, Artificial sequence
  SiRNA target sequence
gtattcctgagtgtaagagca

SEQ ID NO: 17384 - DNA, 21 bp, Artificial sequence
  SiRNA target sequence
tattcctgagtgtaagagcat

SEQ ID NO: 17385 - DNA, 21 bp, Artificial sequence
  SiRNA target sequence
attcctgagtgtaagagcatt

SEQ ID NO: 17386 - DNA, 21 bp, Artificial sequence
  SiRNA target sequence
ttcctgagtgtaagagcatta

SEQ ID NO: 17387 - DNA, 21 bp, Artificial sequence
  SiRNA target sequence
tcctgagtgtaagagcattat

SEQ ID NO: 17388 - DNA, 21 bp, Artificial sequence
  SiRNA target sequence
cctgagtgtaagagcattatt

SEQ ID NO: 17389 - DNA, 21 bp, Artificial sequence
  SiRNA target sequence
ctgagtgtaagagcattatta

SEQ ID NO: 17390 - DNA, 21 bp, Artificial sequence
  SiRNA target sequence
tgagtgtaagagcattattaa

SEQ ID NO: 17391 - DNA, 21 bp, Artificial sequence
  SiRNA target sequence
gagtgtaagagcattattaaa

SEQ ID NO: 17392 - DNA, 21 bp, Artificial sequence
  SiRNA target sequence
agtgtaagagcattattaaat

SEQ ID NO: 17393 - DNA, 21 bp, Artificial sequence
  SiRNA target sequence
gtgtaagagcattattaaatt

SEQ ID NO: 17394 - DNA, 21 bp, Artificial sequence
  SiRNA target sequence
tgtaagagcattattaaattt

SEQ ID NO: 17395 - DNA, 21 bp, Artificial sequence
  SiRNA target sequence
gtaagagcattattaaattta

SEQ ID NO: 17396 - DNA, 21 bp, Artificial sequence
  SiRNA target sequence
taagagcattattaaatttat

SEQ ID NO: 17397 - DNA, 21 bp, Artificial sequence
  SiRNA target sequence
aagagcattattaaatttata

SEQ ID NO: 17398 - DNA, 21 bp, Artificial sequence
  SiRNA target sequence
agagcattattaaatttatag

SEQ ID NO: 17399 - DNA, 21 bp, Artificial sequence
  SiRNA target sequence
gagcattattaaatttatagc

SEQ ID NO: 17400 - DNA, 21 bp, Artificial sequence
  SiRNA target sequence
agcattattaaatttatagcg

SEQ ID NO: 17401 - DNA, 21 bp, Artificial sequence
  SiRNA target sequence
gcattattaaatttatagcgt

SEQ ID NO: 17402 - DNA, 21 bp, Artificial sequence
  SiRNA target sequence
cattattaaatttatagcgtc

SEQ ID NO: 17403 - DNA, 21 bp, Artificial sequence
  SiRNA target sequence
attattaaatttatagcgtca

SEQ ID NO: 17404 - DNA, 21 bp, Artificial sequence
  SiRNA target sequence
ttattaaatttatagcgtcac

SEQ ID NO: 17405 - DNA, 21 bp, Artificial sequence
  SiRNA target sequence
tattaaatttatagcgtcaca

SEQ ID NO: 17406 - DNA, 21 bp, Artificial sequence
  SiRNA target sequence
attaaatttatagcgtcacat

SEQ ID NO: 17407 - DNA, 21 bp, Artificial sequence
  SiRNA target sequence
ttaaatttatagcgtcacata

SEQ ID NO: 17408 - DNA, 21 bp, Artificial sequence
  SiRNA target sequence
taaatttatagcgtcacataa

SEQ ID NO: 17409 - DNA, 21 bp, Artificial sequence
  SiRNA target sequence
aaatttatagcgtcacataat

SEQ ID NO: 17410 - DNA, 21 bp, Artificial sequence
  SiRNA target sequence
aatttatagcgtcacataatg

SEQ ID NO: 17411 - DNA, 21 bp, Artificial sequence
  SiRNA target sequence
atttatagcgtcacataatga

SEQ ID NO: 17412 - DNA, 21 bp, Artificial sequence
  SiRNA target sequence
tttatagcgtcacataatgaa

SEQ ID NO: 17413 - DNA, 21 bp, Artificial sequence
  SiRNA target sequence
ttatagcgtcacataatgaac

SEQ ID NO: 17414 - DNA, 21 bp, Artificial sequence
  SiRNA target sequence
tatagcgtcacataatgaaca

SEQ ID NO: 17415 - DNA, 21 bp, Artificial sequence
  SiRNA target sequence
atagcgtcacataatgaacat

SEQ ID NO: 17416 - DNA, 21 bp, Artificial sequence
  SiRNA target sequence
tagcgtcacataatgaacata

SEQ ID NO: 17417 - DNA, 21 bp, Artificial sequence
  SiRNA target sequence
agcgtcacataatgaacatat

SEQ ID NO: 17418 - DNA, 21 bp, Artificial sequence
  SiRNA target sequence
gcgtcacataatgaacatata

SEQ ID NO: 17419 - DNA, 21 bp, Artificial sequence
  SiRNA target sequence
cgtcacataatgaacatatac

SEQ ID NO: 17420 - DNA, 21 bp, Artificial sequence
  SiRNA target sequence
gtcacataatgaacatatacg

SEQ ID NO: 17421 - DNA, 21 bp, Artificial sequence
  SiRNA target sequence
tcacataatgaacatatacgt

SEQ ID NO: 17422 - DNA, 21 bp, Artificial sequence
  SiRNA target sequence
cacataatgaacatatacgtg

SEQ ID NO: 17423 - DNA, 21 bp, Artificial sequence
  SiRNA target sequence
acataatgaacatatacgtgc

SEQ ID NO: 17424 - DNA, 21 bp, Artificial sequence
  SiRNA target sequence
cataatgaacatatacgtgct

SEQ ID NO: 17425 - DNA, 21 bp, Artificial sequence
  SiRNA target sequence
ataatgaacatatacgtgctc

SEQ ID NO: 17426 - DNA, 21 bp, Artificial sequence
  SiRNA target sequence
taatgaacatatacgtgctca

SEQ ID NO: 17427 - DNA, 21 bp, Artificial sequence
  SiRNA target sequence
aatgaacatatacgtgctcag

SEQ ID NO: 17428 - DNA, 21 bp, Artificial sequence
  SiRNA target sequence
atgaacatatacgtgctcaga

SEQ ID NO: 17429 - DNA, 21 bp, Artificial sequence
  SiRNA target sequence
tgaacatatacgtgctcagaa

SEQ ID NO: 17430 - DNA, 21 bp, Artificial sequence
  SiRNA target sequence
gaacatatacgtgctcagaat

SEQ ID NO: 17431 - DNA, 21 bp, Artificial sequence
  SiRNA target sequence
aacatatacgtgctcagaatg

SEQ ID NO: 17432 - DNA, 21 bp, Artificial sequence
  SiRNA target sequence
acatatacgtgctcagaatga

SEQ ID NO: 17433 - DNA, 21 bp, Artificial sequence
  SiRNA target sequence
catatacgtgctcagaatgat

SEQ ID NO: 17434 - DNA, 21 bp, Artificial sequence
  SiRNA target sequence
atatacgtgctcagaatgatg

SEQ ID NO: 17435 - DNA, 21 bp, Artificial sequence
  SiRNA target sequence
tatacgtgctcagaatgatgg

SEQ ID NO: 17436 - DNA, 21 bp, Artificial sequence
  SiRNA target sequence
atacgtgctcagaatgatgga

SEQ ID NO: 17437 - DNA, 21 bp, Artificial sequence
  SiRNA target sequence
tacgtgctcagaatgatggag

SEQ ID NO: 17438 - DNA, 21 bp, Artificial sequence
  SiRNA target sequence
acgtgctcagaatgatggagt

SEQ ID NO: 17439 - DNA, 21 bp, Artificial sequence
  SiRNA target sequence
cgtgctcagaatgatggagtg

SEQ ID NO: 17440 - DNA, 21 bp, Artificial sequence
  SiRNA target sequence
gtgctcagaatgatggagtgt

SEQ ID NO: 17441 - DNA, 21 bp, Artificial sequence
  SiRNA target sequence
tgctcagaatgatggagtgtt

SEQ ID NO: 17442 - DNA, 21 bp, Artificial sequence
  SiRNA target sequence
gctcagaatgatggagtgtta

SEQ ID NO: 17443 - DNA, 21 bp, Artificial sequence
  SiRNA target sequence
ctcagaatgatggagtgttag

SEQ ID NO: 17444 - DNA, 21 bp, Artificial sequence
  SiRNA target sequence
tcagaatgatggagtgttagt

SEQ ID NO: 17445 - DNA, 21 bp, Artificial sequence
  SiRNA target sequence
cagaatgatggagtgttagta

SEQ ID NO: 17446 - DNA, 21 bp, Artificial sequence
  SiRNA target sequence
agaatgatggagtgttagtaa

SEQ ID NO: 17447 - DNA, 21 bp, Artificial sequence
  SiRNA target sequence
gaatgatggagtgttagtaac

SEQ ID NO: 17448 - DNA, 21 bp, Artificial sequence
  SiRNA target sequence
aatgatggagtgttagtaact

SEQ ID NO: 17449 - DNA, 21 bp, Artificial sequence
  SiRNA target sequence
atgatggagtgttagtaactg

SEQ ID NO: 17450 - DNA, 21 bp, Artificial sequence
  SiRNA target sequence
tgatggagtgttagtaactgg

SEQ ID NO: 17451 - DNA, 21 bp, Artificial sequence
  SiRNA target sequence
gatggagtgttagtaactggc

SEQ ID NO: 17452 - DNA, 21 bp, Artificial sequence
  SiRNA target sequence
atggagtgttagtaactggcg

SEQ ID NO: 17453 - DNA, 21 bp, Artificial sequence
  SiRNA target sequence
tggagtgttagtaactggcga

SEQ ID NO: 17454 - DNA, 21 bp, Artificial sequence
  SiRNA target sequence
ggagtgttagtaactggcgac

SEQ ID NO: 17455 - DNA, 21 bp, Artificial sequence
  SiRNA target sequence
gagtgttagtaactggcgacc

SEQ ID NO: 17456 - DNA, 21 bp, Artificial sequence
  SiRNA target sequence
agtgttagtaactggcgacca

SEQ ID NO: 17457 - DNA, 21 bp, Artificial sequence
  SiRNA target sequence
gtgttagtaactggcgaccat

SEQ ID NO: 17458 - DNA, 21 bp, Artificial sequence
  SiRNA target sequence
tgttagtaactggcgaccata

SEQ ID NO: 17459 - DNA, 21 bp, Artificial sequence
  SiRNA target sequence
gttagtaactggcgaccatac

SEQ ID NO: 17460 - DNA, 21 bp, Artificial sequence
  SiRNA target sequence
ttagtaactggcgaccatact

SEQ ID NO: 17461 - DNA, 21 bp, Artificial sequence
  SiRNA target sequence
tagtaactggcgaccatactc

SEQ ID NO: 17462 - DNA, 21 bp, Artificial sequence
  SiRNA target sequence
agtaactggcgaccatactca

SEQ ID NO: 17463 - DNA, 21 bp, Artificial sequence
  SiRNA target sequence
gtaactggcgaccatactcag

SEQ ID NO: 17464 - DNA, 21 bp, Artificial sequence
  SiRNA target sequence
taactggcgaccatactcagt

SEQ ID NO: 17465 - DNA, 21 bp, Artificial sequence
  SiRNA target sequence
aactggcgaccatactcagtt

SEQ ID NO: 17466 - DNA, 21 bp, Artificial sequence
  SiRNA target sequence
actggcgaccatactcagtta

SEQ ID NO: 17467 - DNA, 21 bp, Artificial sequence
  SiRNA target sequence
ctggcgaccatactcagttat

SEQ ID NO: 17468 - DNA, 21 bp, Artificial sequence
  SiRNA target sequence
tggcgaccatactcagttatt

SEQ ID NO: 17469 - DNA, 21 bp, Artificial sequence
  SiRNA target sequence
ggcgaccatactcagttattg

SEQ ID NO: 17470 - DNA, 21 bp, Artificial sequence
  SiRNA target sequence
gcgaccatactcagttattgg

SEQ ID NO: 17471 - DNA, 21 bp, Artificial sequence
  SiRNA target sequence
cgaccatactcagttattggc

SEQ ID NO: 17472 - DNA, 21 bp, Artificial sequence
  SiRNA target sequence
gaccatactcagttattggct

SEQ ID NO: 17473 - DNA, 21 bp, Artificial sequence
  SiRNA target sequence
accatactcagttattggctt

SEQ ID NO: 17474 - DNA, 21 bp, Artificial sequence
  SiRNA target sequence
ccatactcagttattggcttt

SEQ ID NO: 17475 - DNA, 21 bp, Artificial sequence
  SiRNA target sequence
catactcagttattggctttc

SEQ ID NO: 17476 - DNA, 21 bp, Artificial sequence
  SiRNA target sequence
atactcagttattggctttcg

SEQ ID NO: 17477 - DNA, 21 bp, Artificial sequence
  SiRNA target sequence
tactcagttattggctttcga

SEQ ID NO: 17478 - DNA, 21 bp, Artificial sequence
  SiRNA target sequence
actcagttattggctttcgag

SEQ ID NO: 17479 - DNA, 21 bp, Artificial sequence
  SiRNA target sequence
ctcagttattggctttcgaga

SEQ ID NO: 17480 - DNA, 21 bp, Artificial sequence
  SiRNA target sequence
tcagttattggctttcgagaa

SEQ ID NO: 17481 - DNA, 21 bp, Artificial sequence
  SiRNA target sequence
cagttattggctttcgagaat

SEQ ID NO: 17482 - DNA, 21 bp, Artificial sequence
  SiRNA target sequence
agttattggctttcgagaata

SEQ ID NO: 17483 - DNA, 21 bp, Artificial sequence
  SiRNA target sequence
gttattggctttcgagaataa

SEQ ID NO: 17484 - DNA, 21 bp, Artificial sequence
  SiRNA target sequence
ttattggctttcgagaataat

SEQ ID NO: 17485 - DNA, 21 bp, Artificial sequence
  SiRNA target sequence
tattggctttcgagaataata

SEQ ID NO: 17486 - DNA, 21 bp, Artificial sequence
  SiRNA target sequence
attggctttcgagaataataa

SEQ ID NO: 17487 - DNA, 21 bp, Artificial sequence
  SiRNA target sequence
ttggctttcgagaataataat

SEQ ID NO: 17488 - DNA, 21 bp, Artificial sequence
  SiRNA target sequence
tggctttcgagaataataata

SEQ ID NO: 17489 - DNA, 21 bp, Artificial sequence
  SiRNA target sequence
ggctttcgagaataataataa

SEQ ID NO: 17490 - DNA, 21 bp, Artificial sequence
  SiRNA target sequence
gctttcgagaataataataag

SEQ ID NO: 17491 - DNA, 21 bp, Artificial sequence
  SiRNA target sequence
ctttcgagaataataataaga

SEQ ID NO: 17492 - DNA, 21 bp, Artificial sequence
  SiRNA target sequence
tttcgagaataataataagac

SEQ ID NO: 17493 - DNA, 21 bp, Artificial sequence
  SiRNA target sequence
ttcgagaataataataagacc

SEQ ID NO: 17494 - DNA, 21 bp, Artificial sequence
  SiRNA target sequence
tcgagaataataataagaccc

SEQ ID NO: 17495 - DNA, 21 bp, Artificial sequence
  SiRNA target sequence
cgagaataataataagacccc

SEQ ID NO: 17496 - DNA, 21 bp, Artificial sequence
  SiRNA target sequence
gagaataataataagacccca

SEQ ID NO: 17497 - DNA, 21 bp, Artificial sequence
  SiRNA target sequence
agaataataataagaccccaa

SEQ ID NO: 17498 - DNA, 21 bp, Artificial sequence
  SiRNA target sequence
gaataataataagaccccaat

SEQ ID NO: 17499 - DNA, 21 bp, Artificial sequence
  SiRNA target sequence
aataataataagaccccaata

SEQ ID NO: 17500 - DNA, 21 bp, Artificial sequence
  SiRNA target sequence
ataataataagaccccaataa

SEQ ID NO: 17501 - DNA, 21 bp, Artificial sequence
  SiRNA target sequence
taataataagaccccaataag

SEQ ID NO: 17502 - DNA, 21 bp, Artificial sequence
  SiRNA target sequence
aataataagaccccaataagt

SEQ ID NO: 17503 - DNA, 21 bp, Artificial sequence
  SiRNA target sequence
ataataagaccccaataagta

SEQ ID NO: 17504 - DNA, 21 bp, Artificial sequence
  SiRNA target sequence
taataagaccccaataagtat

SEQ ID NO: 17505 - DNA, 21 bp, Artificial sequence
  SiRNA target sequence
aataagaccccaataagtatc

SEQ ID NO: 17506 - DNA, 21 bp, Artificial sequence
  SiRNA target sequence
ataagaccccaataagtatca

SEQ ID NO: 17507 - DNA, 21 bp, Artificial sequence
  SiRNA target sequence
taagaccccaataagtatcaa

SEQ ID NO: 17508 - DNA, 21 bp, Artificial sequence
  SiRNA target sequence
aagaccccaataagtatcaac

SEQ ID NO: 17509 - DNA, 21 bp, Artificial sequence
  SiRNA target sequence
agaccccaataagtatcaacg

SEQ ID NO: 17510 - DNA, 21 bp, Artificial sequence
  SiRNA target sequence
gaccccaataagtatcaacgc

SEQ ID NO: 17511 - DNA, 21 bp, Artificial sequence
  SiRNA target sequence
accccaataagtatcaacgct

SEQ ID NO: 17512 - DNA, 21 bp, Artificial sequence
  SiRNA target sequence
ccccaataagtatcaacgctg

SEQ ID NO: 17513 - DNA, 21 bp, Artificial sequence
  SiRNA target sequence
cccaataagtatcaacgctga

SEQ ID NO: 17514 - DNA, 21 bp, Artificial sequence
  SiRNA target sequence
ccaataagtatcaacgctgat

SEQ ID NO: 17515 - DNA, 21 bp, Artificial sequence
  SiRNA target sequence
caataagtatcaacgctgatg

SEQ ID NO: 17516 - DNA, 21 bp, Artificial sequence
  SiRNA target sequence
aataagtatcaacgctgatgg

SEQ ID NO: 17517 - DNA, 21 bp, Artificial sequence
  SiRNA target sequence
ataagtatcaacgctgatggt

SEQ ID NO: 17518 - DNA, 21 bp, Artificial sequence
  SiRNA target sequence
taagtatcaacgctgatggtt

SEQ ID NO: 17519 - DNA, 21 bp, Artificial sequence
  SiRNA target sequence
aagtatcaacgctgatggttt

SEQ ID NO: 17520 - DNA, 21 bp, Artificial sequence
  SiRNA target sequence
agtatcaacgctgatggtttg

SEQ ID NO: 17521 - DNA, 21 bp, Artificial sequence
  SiRNA target sequence
gtatcaacgctgatggtttgt

SEQ ID NO: 17522 - DNA, 21 bp, Artificial sequence
  SiRNA target sequence
tatcaacgctgatggtttgta

SEQ ID NO: 17523 - DNA, 21 bp, Artificial sequence
  SiRNA target sequence
atcaacgctgatggtttgtat

SEQ ID NO: 17524 - DNA, 21 bp, Artificial sequence
  SiRNA target sequence
tcaacgctgatggtttgtatg

SEQ ID NO: 17525 - DNA, 21 bp, Artificial sequence
  SiRNA target sequence
caacgctgatggtttgtatga

SEQ ID NO: 17526 - DNA, 21 bp, Artificial sequence
  SiRNA target sequence
aacgctgatggtttgtatgag

SEQ ID NO: 17527 - DNA, 21 bp, Artificial sequence
  SiRNA target sequence
acgctgatggtttgtatgagg

SEQ ID NO: 17528 - DNA, 21 bp, Artificial sequence
  SiRNA target sequence
cgctgatggtttgtatgaggt

SEQ ID NO: 17529 - DNA, 21 bp, Artificial sequence
  SiRNA target sequence
gctgatggtttgtatgaggtt

SEQ ID NO: 17530 - DNA, 21 bp, Artificial sequence
  SiRNA target sequence
ctgatggtttgtatgaggtta

SEQ ID NO: 17531 - DNA, 21 bp, Artificial sequence
  SiRNA target sequence
tgatggtttgtatgaggttat

SEQ ID NO: 17532 - DNA, 21 bp, Artificial sequence
  SiRNA target sequence
gatggtttgtatgaggttata

SEQ ID NO: 17533 - DNA, 21 bp, Artificial sequence
  SiRNA target sequence
atggtttgtatgaggttatac

SEQ ID NO: 17534 - DNA, 21 bp, Artificial sequence
  SiRNA target sequence
tggtttgtatgaggttatact

SEQ ID NO: 17535 - DNA, 21 bp, Artificial sequence
  SiRNA target sequence
ggtttgtatgaggttatactt

SEQ ID NO: 17536 - DNA, 21 bp, Artificial sequence
  SiRNA target sequence
gtttgtatgaggttatacttc

SEQ ID NO: 17537 - DNA, 21 bp, Artificial sequence
  SiRNA target sequence
tttgtatgaggttatacttca

SEQ ID NO: 17538 - DNA, 21 bp, Artificial sequence
  SiRNA target sequence
ttgtatgaggttatacttcaa

SEQ ID NO: 17539 - DNA, 21 bp, Artificial sequence
  SiRNA target sequence
tgtatgaggttatacttcaag

SEQ ID NO: 17540 - DNA, 21 bp, Artificial sequence
  SiRNA target sequence
gtatgaggttatacttcaagg

SEQ ID NO: 17541 - DNA, 21 bp, Artificial sequence
  SiRNA target sequence
tatgaggttatacttcaagga

SEQ ID NO: 17542 - DNA, 21 bp, Artificial sequence
  SiRNA target sequence
atgaggttatacttcaaggag

SEQ ID NO: 17543 - DNA, 21 bp, Artificial sequence
  SiRNA target sequence
tgaggttatacttcaaggagt

SEQ ID NO: 17544 - DNA, 21 bp, Artificial sequence
  SiRNA target sequence
gaggttatacttcaaggagta

SEQ ID NO: 17545 - DNA, 21 bp, Artificial sequence
  SiRNA target sequence
aggttatacttcaaggagtat

SEQ ID NO: 17546 - DNA, 21 bp, Artificial sequence
  SiRNA target sequence
ggttatacttcaaggagtata

SEQ ID NO: 17547 - DNA, 21 bp, Artificial sequence
  SiRNA target sequence
gttatacttcaaggagtatat

SEQ ID NO: 17548 - DNA, 21 bp, Artificial sequence
  SiRNA target sequence
ttatacttcaaggagtatata

SEQ ID NO: 17549 - DNA, 21 bp, Artificial sequence
  SiRNA target sequence
tatacttcaaggagtatatac

SEQ ID NO: 17550 - DNA, 21 bp, Artificial sequence
  SiRNA target sequence
atacttcaaggagtatatact

SEQ ID NO: 17551 - DNA, 21 bp, Artificial sequence
  SiRNA target sequence
tacttcaaggagtatatactt

SEQ ID NO: 17552 - DNA, 21 bp, Artificial sequence
  SiRNA target sequence
acttcaaggagtatatactta

SEQ ID NO: 17553 - DNA, 21 bp, Artificial sequence
  SiRNA target sequence
cttcaaggagtatatacttat

SEQ ID NO: 17554 - DNA, 21 bp, Artificial sequence
  SiRNA target sequence
ttcaaggagtatatacttatc

SEQ ID NO: 17555 - DNA, 21 bp, Artificial sequence
  SiRNA target sequence
tcaaggagtatatacttatcc

SEQ ID NO: 17556 - DNA, 21 bp, Artificial sequence
  SiRNA target sequence
caaggagtatatacttatcca

SEQ ID NO: 17557 - DNA, 21 bp, Artificial sequence
  SiRNA target sequence
aaggagtatatacttatccat

SEQ ID NO: 17558 - DNA, 21 bp, Artificial sequence
  SiRNA target sequence
aggagtatatacttatccata

SEQ ID NO: 17559 - DNA, 21 bp, Artificial sequence
  SiRNA target sequence
ggagtatatacttatccatac

SEQ ID NO: 17560 - DNA, 21 bp, Artificial sequence
  SiRNA target sequence
gagtatatacttatccatacc

SEQ ID NO: 17561 - DNA, 21 bp, Artificial sequence
  SiRNA target sequence
agtatatacttatccatacca

SEQ ID NO: 17562 - DNA, 21 bp, Artificial sequence
  SiRNA target sequence
gtatatacttatccataccat

SEQ ID NO: 17563 - DNA, 21 bp, Artificial sequence
  SiRNA target sequence
tatatacttatccataccatg

SEQ ID NO: 17564 - DNA, 21 bp, Artificial sequence
  SiRNA target sequence
atatacttatccataccatgg

SEQ ID NO: 17565 - DNA, 21 bp, Artificial sequence
  SiRNA target sequence
tatacttatccataccatggc

SEQ ID NO: 17566 - DNA, 21 bp, Artificial sequence
  SiRNA target sequence
atacttatccataccatggcg

SEQ ID NO: 17567 - DNA, 21 bp, Artificial sequence
  SiRNA target sequence
tacttatccataccatggcga

SEQ ID NO: 17568 - DNA, 21 bp, Artificial sequence
  SiRNA target sequence
acttatccataccatggcgat

SEQ ID NO: 17569 - DNA, 21 bp, Artificial sequence
  SiRNA target sequence
cttatccataccatggcgatg

SEQ ID NO: 17570 - DNA, 21 bp, Artificial sequence
  SiRNA target sequence
ttatccataccatggcgatgg

SEQ ID NO: 17571 - DNA, 21 bp, Artificial sequence
  SiRNA target sequence
tatccataccatggcgatggt

SEQ ID NO: 17572 - DNA, 21 bp, Artificial sequence
  SiRNA target sequence
atccataccatggcgatggtg

SEQ ID NO: 17573 - DNA, 21 bp, Artificial sequence
  SiRNA target sequence
tccataccatggcgatggtgt

SEQ ID NO: 17574 - DNA, 21 bp, Artificial sequence
  SiRNA target sequence
ccataccatggcgatggtgtt

SEQ ID NO: 17575 - DNA, 21 bp, Artificial sequence
  SiRNA target sequence
cataccatggcgatggtgttt

SEQ ID NO: 17576 - DNA, 21 bp, Artificial sequence
  SiRNA target sequence
ataccatggcgatggtgtttg

SEQ ID NO: 17577 - DNA, 21 bp, Artificial sequence
  SiRNA target sequence
taccatggcgatggtgtttgt

SEQ ID NO: 17578 - DNA, 21 bp, Artificial sequence
  SiRNA target sequence
accatggcgatggtgtttgtg

SEQ ID NO: 17579 - DNA, 21 bp, Artificial sequence
  SiRNA target sequence
ccatggcgatggtgtttgtgg

SEQ ID NO: 17580 - DNA, 21 bp, Artificial sequence
  SiRNA target sequence
catggcgatggtgtttgtggt

SEQ ID NO: 17581 - DNA, 21 bp, Artificial sequence
  SiRNA target sequence
atggcgatggtgtttgtggtt

SEQ ID NO: 17582 - DNA, 21 bp, Artificial sequence
  SiRNA target sequence
tggcgatggtgtttgtggttc

SEQ ID NO: 17583 - DNA, 21 bp, Artificial sequence
  SiRNA target sequence
ggcgatggtgtttgtggttcg

SEQ ID NO: 17584 - DNA, 21 bp, Artificial sequence
  SiRNA target sequence
gcgatggtgtttgtggttcga

SEQ ID NO: 17585 - DNA, 21 bp, Artificial sequence
  SiRNA target sequence
cgatggtgtttgtggttcgat

SEQ ID NO: 17586 - DNA, 21 bp, Artificial sequence
  SiRNA target sequence
gatggtgtttgtggttcgata

SEQ ID NO: 17587 - DNA, 21 bp, Artificial sequence
  SiRNA target sequence
atggtgtttgtggttcgatat

SEQ ID NO: 17588 - DNA, 21 bp, Artificial sequence
  SiRNA target sequence
tggtgtttgtggttcgatatt

SEQ ID NO: 17589 - DNA, 21 bp, Artificial sequence
  SiRNA target sequence
ggtgtttgtggttcgatattg

SEQ ID NO: 17590 - DNA, 21 bp, Artificial sequence
  SiRNA target sequence
gtgtttgtggttcgatattgc

SEQ ID NO: 17591 - DNA, 21 bp, Artificial sequence
  SiRNA target sequence
tgtttgtggttcgatattgct

SEQ ID NO: 17592 - DNA, 21 bp, Artificial sequence
  SiRNA target sequence
gtttgtggttcgatattgctg

SEQ ID NO: 17593 - DNA, 21 bp, Artificial sequence
  SiRNA target sequence
tttgtggttcgatattgctgt

SEQ ID NO: 17594 - DNA, 21 bp, Artificial sequence
  SiRNA target sequence
ttgtggttcgatattgctgtc

SEQ ID NO: 17595 - DNA, 21 bp, Artificial sequence
  SiRNA target sequence
tgtggttcgatattgctgtct

SEQ ID NO: 17596 - DNA, 21 bp, Artificial sequence
  SiRNA target sequence
gtggttcgatattgctgtctc

SEQ ID NO: 17597 - DNA, 21 bp, Artificial sequence
  SiRNA target sequence
tggttcgatattgctgtctcg

SEQ ID NO: 17598 - DNA, 21 bp, Artificial sequence
  SiRNA target sequence
ggttcgatattgctgtctcgg

SEQ ID NO: 17599 - DNA, 21 bp, Artificial sequence
  SiRNA target sequence
gttcgatattgctgtctcgga

SEQ ID NO: 17600 - DNA, 21 bp, Artificial sequence
  SiRNA target sequence
ttcgatattgctgtctcggaa

SEQ ID NO: 17601 - DNA, 21 bp, Artificial sequence
  SiRNA target sequence
tcgatattgctgtctcggaat

SEQ ID NO: 17602 - DNA, 21 bp, Artificial sequence
  SiRNA target sequence
cgatattgctgtctcggaatt

SEQ ID NO: 17603 - DNA, 21 bp, Artificial sequence
  SiRNA target sequence
gatattgctgtctcggaattt

SEQ ID NO: 17604 - DNA, 21 bp, Artificial sequence
  SiRNA target sequence
atattgctgtctcggaattta

SEQ ID NO: 17605 - DNA, 21 bp, Artificial sequence
  SiRNA target sequence
tattgctgtctcggaatttac

SEQ ID NO: 17606 - DNA, 21 bp, Artificial sequence
  SiRNA target sequence
attgctgtctcggaatttaca

SEQ ID NO: 17607 - DNA, 21 bp, Artificial sequence
  SiRNA target sequence
ttgctgtctcggaatttacaa

SEQ ID NO: 17608 - DNA, 21 bp, Artificial sequence
  SiRNA target sequence
tgctgtctcggaatttacaac

SEQ ID NO: 17609 - DNA, 21 bp, Artificial sequence
  SiRNA target sequence
gctgtctcggaatttacaacg

SEQ ID NO: 17610 - DNA, 21 bp, Artificial sequence
  SiRNA target sequence
ctgtctcggaatttacaacgg

SEQ ID NO: 17611 - DNA, 21 bp, Artificial sequence
  SiRNA target sequence
tgtctcggaatttacaacggc

SEQ ID NO: 17612 - DNA, 21 bp, Artificial sequence
  SiRNA target sequence
gtctcggaatttacaacggcc

SEQ ID NO: 17613 - DNA, 21 bp, Artificial sequence
  SiRNA target sequence
tctcggaatttacaacggcca

SEQ ID NO: 17614 - DNA, 21 bp, Artificial sequence
  SiRNA target sequence
ctcggaatttacaacggccaa

SEQ ID NO: 17615 - DNA, 21 bp, Artificial sequence
  SiRNA target sequence
tcggaatttacaacggccaat

SEQ ID NO: 17616 - DNA, 21 bp, Artificial sequence
  SiRNA target sequence
cggaatttacaacggccaatt

SEQ ID NO: 17617 - DNA, 21 bp, Artificial sequence
  SiRNA target sequence
ggaatttacaacggccaatta

SEQ ID NO: 17618 - DNA, 21 bp, Artificial sequence
  SiRNA target sequence
gaatttacaacggccaattat

SEQ ID NO: 17619 - DNA, 21 bp, Artificial sequence
  SiRNA target sequence
aatttacaacggccaattata

SEQ ID NO: 17620 - DNA, 21 bp, Artificial sequence
  SiRNA target sequence
atttacaacggccaattatag

SEQ ID NO: 17621 - DNA, 21 bp, Artificial sequence
  SiRNA target sequence
tttacaacggccaattatagg

SEQ ID NO: 17622 - DNA, 21 bp, Artificial sequence
  SiRNA target sequence
ttacaacggccaattataggt

SEQ ID NO: 17623 - DNA, 21 bp, Artificial sequence
  SiRNA target sequence
tacaacggccaattataggta

SEQ ID NO: 17624 - DNA, 21 bp, Artificial sequence
  SiRNA target sequence
acaacggccaattataggtat

SEQ ID NO: 17625 - DNA, 21 bp, Artificial sequence
  SiRNA target sequence
caacggccaattataggtatc

SEQ ID NO: 17626 - DNA, 21 bp, Artificial sequence
  SiRNA target sequence
aacggccaattataggtatcc

SEQ ID NO: 17627 - DNA, 21 bp, Artificial sequence
  SiRNA target sequence
acggccaattataggtatcca

SEQ ID NO: 17628 - DNA, 21 bp, Artificial sequence
  SiRNA target sequence
cggccaattataggtatccat

SEQ ID NO: 17629 - DNA, 21 bp, Artificial sequence
  SiRNA target sequence
ggccaattataggtatccatg

SEQ ID NO: 17630 - DNA, 21 bp, Artificial sequence
  SiRNA target sequence
gccaattataggtatccatgt

SEQ ID NO: 17631 - DNA, 21 bp, Artificial sequence
  SiRNA target sequence
ccaattataggtatccatgtt

SEQ ID NO: 17632 - DNA, 21 bp, Artificial sequence
  SiRNA target sequence
caattataggtatccatgttg

SEQ ID NO: 17633 - DNA, 21 bp, Artificial sequence
  SiRNA target sequence
aattataggtatccatgttgc

SEQ ID NO: 17634 - DNA, 21 bp, Artificial sequence
  SiRNA target sequence
attataggtatccatgttgct

SEQ ID NO: 17635 - DNA, 21 bp, Artificial sequence
  SiRNA target sequence
ttataggtatccatgttgctg

SEQ ID NO: 17636 - DNA, 21 bp, Artificial sequence
  SiRNA target sequence
tataggtatccatgttgctgg

SEQ ID NO: 17637 - DNA, 21 bp, Artificial sequence
  SiRNA target sequence
ataggtatccatgttgctggt

SEQ ID NO: 17638 - DNA, 21 bp, Artificial sequence
  SiRNA target sequence
taggtatccatgttgctggta

SEQ ID NO: 17639 - DNA, 21 bp, Artificial sequence
  SiRNA target sequence
aggtatccatgttgctggtac

SEQ ID NO: 17640 - DNA, 21 bp, Artificial sequence
  SiRNA target sequence
ggtatccatgttgctggtact

SEQ ID NO: 17641 - DNA, 21 bp, Artificial sequence
  SiRNA target sequence
gtatccatgttgctggtactg

SEQ ID NO: 17642 - DNA, 21 bp, Artificial sequence
  SiRNA target sequence
tatccatgttgctggtactga

SEQ ID NO: 17643 - DNA, 21 bp, Artificial sequence
  SiRNA target sequence
atccatgttgctggtactgaa

SEQ ID NO: 17644 - DNA, 21 bp, Artificial sequence
  SiRNA target sequence
tccatgttgctggtactgaag

SEQ ID NO: 17645 - DNA, 21 bp, Artificial sequence
  SiRNA target sequence
ccatgttgctggtactgaagg

SEQ ID NO: 17646 - DNA, 21 bp, Artificial sequence
  SiRNA target sequence
catgttgctggtactgaagga

SEQ ID NO: 17647 - DNA, 21 bp, Artificial sequence
  SiRNA target sequence
atgttgctggtactgaaggat

SEQ ID NO: 17648 - DNA, 21 bp, Artificial sequence
  SiRNA target sequence
tgttgctggtactgaaggatt

SEQ ID NO: 17649 - DNA, 21 bp, Artificial sequence
  SiRNA target sequence
gttgctggtactgaaggattg

SEQ ID NO: 17650 - DNA, 21 bp, Artificial sequence
  SiRNA target sequence
ttgctggtactgaaggattgc

SEQ ID NO: 17651 - DNA, 21 bp, Artificial sequence
  SiRNA target sequence
tgctggtactgaaggattgca

SEQ ID NO: 17652 - DNA, 21 bp, Artificial sequence
  SiRNA target sequence
gctggtactgaaggattgcat

SEQ ID NO: 17653 - DNA, 21 bp, Artificial sequence
  SiRNA target sequence
ctggtactgaaggattgcatg

SEQ ID NO: 17654 - DNA, 21 bp, Artificial sequence
  SiRNA target sequence
tggtactgaaggattgcatgg

SEQ ID NO: 17655 - DNA, 21 bp, Artificial sequence
  SiRNA target sequence
ggtactgaaggattgcatggc

SEQ ID NO: 17656 - DNA, 21 bp, Artificial sequence
  SiRNA target sequence
gtactgaaggattgcatggct

SEQ ID NO: 17657 - DNA, 21 bp, Artificial sequence
  SiRNA target sequence
tactgaaggattgcatggctt

SEQ ID NO: 17658 - DNA, 21 bp, Artificial sequence
  SiRNA target sequence
actgaaggattgcatggcttt

SEQ ID NO: 17659 - DNA, 21 bp, Artificial sequence
  SiRNA target sequence
ctgaaggattgcatggctttg

SEQ ID NO: 17660 - DNA, 21 bp, Artificial sequence
  SiRNA target sequence
tgaaggattgcatggctttgg

SEQ ID NO: 17661 - DNA, 21 bp, Artificial sequence
  SiRNA target sequence
gaaggattgcatggctttgga

SEQ ID NO: 17662 - DNA, 21 bp, Artificial sequence
  SiRNA target sequence
aaggattgcatggctttggag

SEQ ID NO: 17663 - DNA, 21 bp, Artificial sequence
  SiRNA target sequence
aggattgcatggctttggagt

SEQ ID NO: 17664 - DNA, 21 bp, Artificial sequence
  SiRNA target sequence
  misc_feature (21)..(21): n is a, c, g, or t
ggattgcatggctttggagtn

SEQ ID NO: 17665 - DNA, 21 bp, Artificial sequence
  SiRNA target sequence
  misc_feature (20)..(20): n is a, c, g, or t
gattgcatggctttggagtng

SEQ ID NO: 17666 - DNA, 21 bp, Artificial sequence
  SiRNA target sequence
  misc_feature (19)..(19): n is a, c, g, or t
attgcatggctttggagtngc

SEQ ID NO: 17667 - DNA, 21 bp, Artificial sequence
  SiRNA target sequence
  misc_feature (18)..(18): n is a, c, g, or t
ttgcatggctttggagtngct

SEQ ID NO: 17668 - DNA, 21 bp, Artificial sequence
  SiRNA target sequence
  misc_feature (17)..(17): n is a, c, g, or t
tgcatggctttggagtngctg

SEQ ID NO: 17669 - DNA, 21 bp, Artificial sequence
  SiRNA target sequence
  misc_feature (16)..(16): n is a, c, g, or t
gcatggctttggagtngctga

SEQ ID NO: 17670 - DNA, 21 bp, Artificial sequence
  SiRNA target sequence
  misc_feature (15)..(15): n is a, c, g, or t
catggctttggagtngctgaa

SEQ ID NO: 17671 - DNA, 21 bp, Artificial sequence
  SiRNA target sequence
  misc_feature (14)..(14): n is a, c, g, or t
atggctttggagtngctgaac

SEQ ID NO: 17672 - DNA, 21 bp, Artificial sequence
  SiRNA target sequence
  misc_feature (13)..(13): n is a, c, g, or t
tggctttggagtngctgaacc

SEQ ID NO: 17673 - DNA, 21 bp, Artificial sequence
  SiRNA target sequence
  misc_feature (12)..(12): n is a, c, g, or t
ggctttggagtngctgaacca

SEQ ID NO: 17674 - DNA, 21 bp, Artificial sequence
  SiRNA target sequence
  misc_feature (11)..(11): n is a, c, g, or t
  misc_feature (21)..(21): n is a, c, g, or t
gctttggagtngctgaaccan

SEQ ID NO: 17675 - DNA, 21 bp, Artificial sequence
  SiRNA target sequence
  misc_feature (10)..(10): n is a, c, g, or t
  misc_feature (20)..(20): n is a, c, g, or t
ctttggagtngctgaaccant

SEQ ID NO: 17676 - DNA, 21 bp, Artificial sequence
  SiRNA target sequence
  misc_feature (9)..(9): n is a, c, g, or t
  misc_feature (19)..(19): n is a, c, g, or t
tttggagtngctgaaccantg

SEQ ID NO: 17677 - DNA, 21 bp, Artificial sequence
  SiRNA target sequence
  misc_feature (8)..(8): n is a, c, g, or t
  misc_feature (18)..(18): n is a, c, g, or t
ttggagtngctgaaccantgg

SEQ ID NO: 17678 - DNA, 21 bp, Artificial sequence
  SiRNA target sequence
  misc_feature (7)..(7): n is a, c, g, or t
  misc_feature (17)..(17): n is a, c, g, or t
tggagtngctgaaccantggt

SEQ ID NO: 17679 - DNA, 21 bp, Artificial sequence
  SiRNA target sequence
  misc_feature (6)..(6): n is a, c, g, or t
  misc_feature (16)..(16): n is a, c, g, or t
ggagtngctgaaccantggta

SEQ ID NO: 17680 - DNA, 21 bp, Artificial sequence
  SiRNA target sequence
  misc_feature (5)..(5): n is a, c, g, or t
  misc_feature (15)..(15): n is a, c, g, or t
gagtngctgaaccantggtac

SEQ ID NO: 17681 - DNA, 21 bp, Artificial sequence
  SiRNA target sequence
  misc_feature (4)..(4): n is a, c, g, or t
  misc_feature (14)..(14): n is a, c, g, or t
agtngctgaaccantggtaca

SEQ ID NO: 17682 - DNA, 21 bp, Artificial sequence
  SiRNA target sequence
  misc_feature (3)..(3): n is a, c, g, or t
  misc_feature (13)..(13): n is a, c, g, or t
gtngctgaaccantggtacat

SEQ ID NO: 17683 - DNA, 21 bp, Artificial sequence
  SiRNA target sequence
  misc_feature (2)..(2): n is a, c, g, or t
  misc_feature (12)..(12): n is a, c, g, or t
tngctgaaccantggtacatg

SEQ ID NO: 17684 - DNA, 21 bp, Artificial sequence
  SiRNA target sequence
  misc_feature (1)..(1): n is a, c, g, or t
  misc_feature (11)..(11): n is a, c, g, or t
ngctgaaccantggtacatga

SEQ ID NO: 17685 - DNA, 21 bp, Artificial sequence
  SiRNA target sequence
  misc_feature (10)..(10): n is a, c, g, or t
gctgaaccantggtacatgaa

SEQ ID NO: 17686 - DNA, 21 bp, Artificial sequence
  SiRNA target sequence
  misc_feature (9)..(9): n is a, c, g, or t
ctgaaccantggtacatgaaa

SEQ ID NO: 17687 - DNA, 21 bp, Artificial sequence
  SiRNA target sequence
  misc_feature (8)..(8): n is a, c, g, or t
tgaaccantggtacatgaaat

SEQ ID NO: 17688 - DNA, 21 bp, Artificial sequence
  SiRNA target sequence
  misc_feature (7)..(7): n is a, c, g, or t
gaaccantggtacatgaaatg

SEQ ID NO: 17689 - DNA, 21 bp, Artificial sequence
  SiRNA target sequence
  misc_feature (6)..(6): n is a, c, g, or t
aaccantggtacatgaaatgt

SEQ ID NO: 17690 - DNA, 21 bp, Artificial sequence
  SiRNA target sequence
  misc_feature (5)..(5): n is a, c, g, or t
accantggtacatgaaatgtt

SEQ ID NO: 17691 - DNA, 21 bp, Artificial sequence
  SiRNA target sequence
  misc_feature (4)..(4): n is a, c, g, or t
ccantggtacatgaaatgttc

SEQ ID NO: 17692 - DNA, 21 bp, Artificial sequence
  SiRNA target sequence
  misc_feature (3)..(3): n is a, c, g, or t
cantggtacatgaaatgttca

SEQ ID NO: 17693 - DNA, 21 bp, Artificial sequence
  SiRNA target sequence
  misc_feature (2)..(2): n is a, c, g, or t
antggtacatgaaatgttcac

SEQ ID NO: 17694 - DNA, 21 bp, Artificial sequence
  SiRNA target sequence
  misc_feature (1)..(1): n is a, c, g, or t
ntggtacatgaaatgttcacc

SEQ ID NO: 17695 - DNA, 21 bp, Artificial sequence
  SiRNA target sequence
tggtacatgaaatgttcaccg

SEQ ID NO: 17696 - DNA, 21 bp, Artificial sequence
  SiRNA target sequence
ggtacatgaaatgttcaccgg

SEQ ID NO: 17697 - DNA, 21 bp, Artificial sequence
  SiRNA target sequence
gtacatgaaatgttcaccggt

SEQ ID NO: 17698 - DNA, 21 bp, Artificial sequence
  SiRNA target sequence
tacatgaaatgttcaccggta

SEQ ID NO: 17699 - DNA, 21 bp, Artificial sequence
  SiRNA target sequence
acatgaaatgttcaccggtaa

SEQ ID NO: 17700 - DNA, 21 bp, Artificial sequence
  SiRNA target sequence
catgaaatgttcaccggtaaa

SEQ ID NO: 17701 - DNA, 21 bp, Artificial sequence
  SiRNA target sequence
atgaaatgttcaccggtaaag

SEQ ID NO: 17702 - DNA, 21 bp, Artificial sequence
  SiRNA target sequence
tgaaatgttcaccggtaaagc

SEQ ID NO: 17703 - DNA, 21 bp, Artificial sequence
  SiRNA target sequence
gaaatgttcaccggtaaagca

SEQ ID NO: 17704 - DNA, 21 bp, Artificial sequence
  SiRNA target sequence
aaatgttcaccggtaaagcaa

SEQ ID NO: 17705 - DNA, 21 bp, Artificial sequence
  SiRNA target sequence
aatgttcaccggtaaagcaat

SEQ ID NO: 17706 - DNA, 21 bp, Artificial sequence
  SiRNA target sequence
atgttcaccggtaaagcaatc

SEQ ID NO: 17707 - DNA, 21 bp, Artificial sequence
  SiRNA target sequence
tgttcaccggtaaagcaatcg

SEQ ID NO: 17708 - DNA, 21 bp, Artificial sequence
  SiRNA target sequence
gttcaccggtaaagcaatcga

SEQ ID NO: 17709 - DNA, 21 bp, Artificial sequence
  SiRNA target sequence
ttcaccggtaaagcaatcgag

SEQ ID NO: 17710 - DNA, 21 bp, Artificial sequence
  SiRNA target sequence
tcaccggtaaagcaatcgaga

SEQ ID NO: 17711 - DNA, 21 bp, Artificial sequence
  SiRNA target sequence
caccggtaaagcaatcgagag

SEQ ID NO: 17712 - DNA, 21 bp, Artificial sequence
  SiRNA target sequence
accggtaaagcaatcgagagt

SEQ ID NO: 17713 - DNA, 21 bp, Artificial sequence
  SiRNA target sequence
ccggtaaagcaatcgagagtg

SEQ ID NO: 17714 - DNA, 21 bp, Artificial sequence
  SiRNA target sequence
cggtaaagcaatcgagagtga

SEQ ID NO: 17715 - DNA, 21 bp, Artificial sequence
  SiRNA target sequence
ggtaaagcaatcgagagtgaa

SEQ ID NO: 17716 - DNA, 21 bp, Artificial sequence
  SiRNA target sequence
gtaaagcaatcgagagtgaaa

SEQ ID NO: 17717 - DNA, 21 bp, Artificial sequence
  SiRNA target sequence
taaagcaatcgagagtgaaag

SEQ ID NO: 17718 - DNA, 21 bp, Artificial sequence
  SiRNA target sequence
aaagcaatcgagagtgaaaga

SEQ ID NO: 17719 - DNA, 21 bp, Artificial sequence
  SiRNA target sequence
aagcaatcgagagtgaaagag

SEQ ID NO: 17720 - DNA, 21 bp, Artificial sequence
  SiRNA target sequence
agcaatcgagagtgaaagaga

SEQ ID NO: 17721 - DNA, 21 bp, Artificial sequence
  SiRNA target sequence
gcaatcgagagtgaaagagag

SEQ ID NO: 17722 - DNA, 21 bp, Artificial sequence
  SiRNA target sequence
caatcgagagtgaaagagagc

SEQ ID NO: 17723 - DNA, 21 bp, Artificial sequence
  SiRNA target sequence
aatcgagagtgaaagagagcc

SEQ ID NO: 17724 - DNA, 21 bp, Artificial sequence
  SiRNA target sequence
atcgagagtgaaagagagccg

SEQ ID NO: 17725 - DNA, 21 bp, Artificial sequence
  SiRNA target sequence
tcgagagtgaaagagagccgt

SEQ ID NO: 17726 - DNA, 21 bp, Artificial sequence
  SiRNA target sequence
cgagagtgaaagagagccgta

SEQ ID NO: 17727 - DNA, 21 bp, Artificial sequence
  SiRNA target sequence
gagagtgaaagagagccgtat

SEQ ID NO: 17728 - DNA, 21 bp, Artificial sequence
  SiRNA target sequence
agagtgaaagagagccgtatg

SEQ ID NO: 17729 - DNA, 21 bp, Artificial sequence
  SiRNA target sequence
gagtgaaagagagccgtatga

SEQ ID NO: 17730 - DNA, 21 bp, Artificial sequence
  SiRNA target sequence
agtgaaagagagccgtatgat

SEQ ID NO: 17731 - DNA, 21 bp, Artificial sequence
  SiRNA target sequence
gtgaaagagagccgtatgatc

SEQ ID NO: 17732 - DNA, 21 bp, Artificial sequence
  SiRNA target sequence
tgaaagagagccgtatgatcg

SEQ ID NO: 17733 - DNA, 21 bp, Artificial sequence
  SiRNA target sequence
gaaagagagccgtatgatcgt

SEQ ID NO: 17734 - DNA, 21 bp, Artificial sequence
  SiRNA target sequence
aaagagagccgtatgatcgtg

SEQ ID NO: 17735 - DNA, 21 bp, Artificial sequence
  SiRNA target sequence
aagagagccgtatgatcgtgt

SEQ ID NO: 17736 - DNA, 21 bp, Artificial sequence
  SiRNA target sequence
agagagccgtatgatcgtgtg

SEQ ID NO: 17737 - DNA, 21 bp, Artificial sequence
  SiRNA target sequence
gagagccgtatgatcgtgtgt

SEQ ID NO: 17738 - DNA, 21 bp, Artificial sequence
  SiRNA target sequence
agagccgtatgatcgtgtgta

SEQ ID NO: 17739 - DNA, 21 bp, Artificial sequence
  SiRNA target sequence
gagccgtatgatcgtgtgtat

SEQ ID NO: 17740 - DNA, 21 bp, Artificial sequence
  SiRNA target sequence
agccgtatgatcgtgtgtatg

SEQ ID NO: 17741 - DNA, 21 bp, Artificial sequence
  SiRNA target sequence
gccgtatgatcgtgtgtatga

SEQ ID NO: 17742 - DNA, 21 bp, Artificial sequence
  SiRNA target sequence
ccgtatgatcgtgtgtatgaa

SEQ ID NO: 17743 - DNA, 21 bp, Artificial sequence
  SiRNA target sequence
cgtatgatcgtgtgtatgaac

SEQ ID NO: 17744 - DNA, 21 bp, Artificial sequence
  SiRNA target sequence
gtatgatcgtgtgtatgaact

SEQ ID NO: 17745 - DNA, 21 bp, Artificial sequence
  SiRNA target sequence
tatgatcgtgtgtatgaactt

SEQ ID NO: 17746 - DNA, 21 bp, Artificial sequence
  SiRNA target sequence
atgatcgtgtgtatgaacttc

SEQ ID NO: 17747 - DNA, 21 bp, Artificial sequence
  SiRNA target sequence
tgatcgtgtgtatgaacttcc

SEQ ID NO: 17748 - DNA, 21 bp, Artificial sequence
  SiRNA target sequence
gatcgtgtgtatgaacttccg

SEQ ID NO: 17749 - DNA, 21 bp, Artificial sequence
  SiRNA target sequence
atcgtgtgtatgaacttccgt

SEQ ID NO: 17750 - DNA, 21 bp, Artificial sequence
  SiRNA target sequence
tcgtgtgtatgaacttccgtt

SEQ ID NO: 17751 - DNA, 21 bp, Artificial sequence
  SiRNA target sequence
cgtgtgtatgaacttccgttg

SEQ ID NO: 17752 - DNA, 21 bp, Artificial sequence
  SiRNA target sequence
gtgtgtatgaacttccgttgc

SEQ ID NO: 17753 - DNA, 21 bp, Artificial sequence
  SiRNA target sequence
tgtgtatgaacttccgttgcg

SEQ ID NO: 17754 - DNA, 21 bp, Artificial sequence
  SiRNA target sequence
gtgtatgaacttccgttgcgt

SEQ ID NO: 17755 - DNA, 21 bp, Artificial sequence
  SiRNA target sequence
tgtatgaacttccgttgcgtg

SEQ ID NO: 17756 - DNA, 21 bp, Artificial sequence
  SiRNA target sequence
gtatgaacttccgttgcgtga

SEQ ID NO: 17757 - DNA, 21 bp, Artificial sequence
  SiRNA target sequence
tatgaacttccgttgcgtgaa

SEQ ID NO: 17758 - DNA, 21 bp, Artificial sequence
  SiRNA target sequence
atgaacttccgttgcgtgaat

SEQ ID NO: 17759 - DNA, 21 bp, Artificial sequence
  SiRNA target sequence
tgaacttccgttgcgtgaatt

SEQ ID NO: 17760 - DNA, 21 bp, Artificial sequence
  SiRNA target sequence
gaacttccgttgcgtgaatta

SEQ ID NO: 17761 - DNA, 21 bp, Artificial sequence
  SiRNA target sequence
aacttccgttgcgtgaattag

SEQ ID NO: 17762 - DNA, 21 bp, Artificial sequence
  SiRNA target sequence
acttccgttgcgtgaattaga

SEQ ID NO: 17763 - DNA, 21 bp, Artificial sequence
  SiRNA target sequence
cttccgttgcgtgaattagat

SEQ ID NO: 17764 - DNA, 21 bp, Artificial sequence
  SiRNA target sequence
ttccgttgcgtgaattagatg

SEQ ID NO: 17765 - DNA, 21 bp, Artificial sequence
  SiRNA target sequence
tccgttgcgtgaattagatga

SEQ ID NO: 17766 - DNA, 21 bp, Artificial sequence
  SiRNA target sequence
ccgttgcgtgaattagatgaa

SEQ ID NO: 17767 - DNA, 21 bp, Artificial sequence
  SiRNA target sequence
cgttgcgtgaattagatgaat

SEQ ID NO: 17768 - DNA, 21 bp, Artificial sequence
  SiRNA target sequence
gttgcgtgaattagatgaatc

SEQ ID NO: 17769 - DNA, 21 bp, Artificial sequence
  SiRNA target sequence
ttgcgtgaattagatgaatct

SEQ ID NO: 17770 - DNA, 21 bp, Artificial sequence
  SiRNA target sequence
tgcgtgaattagatgaatctg

SEQ ID NO: 17771 - DNA, 21 bp, Artificial sequence
  SiRNA target sequence
gcgtgaattagatgaatctga

SEQ ID NO: 17772 - DNA, 21 bp, Artificial sequence
  SiRNA target sequence
cgtgaattagatgaatctgat

SEQ ID NO: 17773 - DNA, 21 bp, Artificial sequence
  SiRNA target sequence
gtgaattagatgaatctgata

SEQ ID NO: 17774 - DNA, 21 bp, Artificial sequence
  SiRNA target sequence
tgaattagatgaatctgatat

SEQ ID NO: 17775 - DNA, 21 bp, Artificial sequence
  SiRNA target sequence
gaattagatgaatctgatatt

SEQ ID NO: 17776 - DNA, 21 bp, Artificial sequence
  SiRNA target sequence
aattagatgaatctgatattg

SEQ ID NO: 17777 - DNA, 21 bp, Artificial sequence
  SiRNA target sequence
attagatgaatctgatattgg

SEQ ID NO: 17778 - DNA, 21 bp, Artificial sequence
  SiRNA target sequence
ttagatgaatctgatattggt

SEQ ID NO: 17779 - DNA, 21 bp, Artificial sequence
  SiRNA target sequence
tagatgaatctgatattggtt

SEQ ID NO: 17780 - DNA, 21 bp, Artificial sequence
  SiRNA target sequence
agatgaatctgatattggttt

SEQ ID NO: 17781 - DNA, 21 bp, Artificial sequence
  SiRNA target sequence
gatgaatctgatattggttta

SEQ ID NO: 17782 - DNA, 21 bp, Artificial sequence
  SiRNA target sequence
atgaatctgatattggtttag

SEQ ID NO: 17783 - DNA, 21 bp, Artificial sequence
  SiRNA target sequence
tgaatctgatattggtttaga

SEQ ID NO: 17784 - DNA, 21 bp, Artificial sequence
  SiRNA target sequence
gaatctgatattggtttagat

SEQ ID NO: 17785 - DNA, 21 bp, Artificial sequence
  SiRNA target sequence
aatctgatattggtttagata

SEQ ID NO: 17786 - DNA, 21 bp, Artificial sequence
  SiRNA target sequence
atctgatattggtttagatac

SEQ ID NO: 17787 - DNA, 21 bp, Artificial sequence
  SiRNA target sequence
tctgatattggtttagatacc

SEQ ID NO: 17788 - DNA, 21 bp, Artificial sequence
  SiRNA target sequence
ctgatattggtttagataccg

SEQ ID NO: 17789 - DNA, 21 bp, Artificial sequence
  SiRNA target sequence
tgatattggtttagataccga

SEQ ID NO: 17790 - DNA, 21 bp, Artificial sequence
  SiRNA target sequence
gatattggtttagataccgat

SEQ ID NO: 17791 - DNA, 21 bp, Artificial sequence
  SiRNA target sequence
atattggtttagataccgatt

SEQ ID NO: 17792 - DNA, 21 bp, Artificial sequence
  SiRNA target sequence
tattggtttagataccgattt

SEQ ID NO: 17793 - DNA, 21 bp, Artificial sequence
  SiRNA target sequence
attggtttagataccgattta

SEQ ID NO: 17794 - DNA, 21 bp, Artificial sequence
  SiRNA target sequence
ttggtttagataccgatttat

SEQ ID NO: 17795 - DNA, 21 bp, Artificial sequence
  SiRNA target sequence
tggtttagataccgatttata

SEQ ID NO: 17796 - DNA, 21 bp, Artificial sequence
  SiRNA target sequence
ggtttagataccgatttatat

SEQ ID NO: 17797 - DNA, 21 bp, Artificial sequence
  SiRNA target sequence
gtttagataccgatttatatc

SEQ ID NO: 17798 - DNA, 21 bp, Artificial sequence
  SiRNA target sequence
tttagataccgatttatatcc

SEQ ID NO: 17799 - DNA, 21 bp, Artificial sequence
  SiRNA target sequence
ttagataccgatttatatccg

SEQ ID NO: 17800 - DNA, 21 bp, Artificial sequence
  SiRNA target sequence
tagataccgatttatatccga

SEQ ID NO: 17801 - DNA, 21 bp, Artificial sequence
  SiRNA target sequence
agataccgatttatatccgat

SEQ ID NO: 17802 - DNA, 21 bp, Artificial sequence
  SiRNA target sequence
gataccgatttatatccgatt

SEQ ID NO: 17803 - DNA, 21 bp, Artificial sequence
  SiRNA target sequence
ataccgatttatatccgattg

SEQ ID NO: 17804 - DNA, 21 bp, Artificial sequence
  SiRNA target sequence
taccgatttatatccgattgg

SEQ ID NO: 17805 - DNA, 21 bp, Artificial sequence
  SiRNA target sequence
accgatttatatccgattggt

SEQ ID NO: 17806 - DNA, 21 bp, Artificial sequence
  SiRNA target sequence
ccgatttatatccgattggta

SEQ ID NO: 17807 - DNA, 21 bp, Artificial sequence
  SiRNA target sequence
cgatttatatccgattggtag

SEQ ID NO: 17808 - DNA, 21 bp, Artificial sequence
  SiRNA target sequence
gatttatatccgattggtaga

SEQ ID NO: 17809 - DNA, 21 bp, Artificial sequence
  SiRNA target sequence
atttatatccgattggtagag

SEQ ID NO: 17810 - DNA, 21 bp, Artificial sequence
  SiRNA target sequence
tttatatccgattggtagagt

SEQ ID NO: 17811 - DNA, 21 bp, Artificial sequence
  SiRNA target sequence
ttatatccgattggtagagtg

SEQ ID NO: 17812 - DNA, 21 bp, Artificial sequence
  SiRNA target sequence
tatatccgattggtagagtgg

SEQ ID NO: 17813 - DNA, 21 bp, Artificial sequence
  SiRNA target sequence
atatccgattggtagagtgga

SEQ ID NO: 17814 - DNA, 21 bp, Artificial sequence
  SiRNA target sequence
tatccgattggtagagtggat

SEQ ID NO: 17815 - DNA, 21 bp, Artificial sequence
  SiRNA target sequence
atccgattggtagagtggatg

SEQ ID NO: 17816 - DNA, 21 bp, Artificial sequence
  SiRNA target sequence
tccgattggtagagtggatgc

SEQ ID NO: 17817 - DNA, 21 bp, Artificial sequence
  SiRNA target sequence
ccgattggtagagtggatgca

SEQ ID NO: 17818 - DNA, 21 bp, Artificial sequence
  SiRNA target sequence
cgattggtagagtggatgcaa

SEQ ID NO: 17819 - DNA, 21 bp, Artificial sequence
  SiRNA target sequence
gattggtagagtggatgcaaa

SEQ ID NO: 17820 - DNA, 21 bp, Artificial sequence
  SiRNA target sequence
attggtagagtggatgcaaag

SEQ ID NO: 17821 - DNA, 21 bp, Artificial sequence
  SiRNA target sequence
ttggtagagtggatgcaaagt

SEQ ID NO: 17822 - DNA, 21 bp, Artificial sequence
  SiRNA target sequence
tggtagagtggatgcaaagtt

SEQ ID NO: 17823 - DNA, 21 bp, Artificial sequence
  SiRNA target sequence
ggtagagtggatgcaaagtta

SEQ ID NO: 17824 - DNA, 21 bp, Artificial sequence
  SiRNA target sequence
gtagagtggatgcaaagttag

SEQ ID NO: 17825 - DNA, 21 bp, Artificial sequence
  SiRNA target sequence
tagagtggatgcaaagttagc

SEQ ID NO: 17826 - DNA, 21 bp, Artificial sequence
  SiRNA target sequence
agagtggatgcaaagttagct

SEQ ID NO: 17827 - DNA, 21 bp, Artificial sequence
  SiRNA target sequence
gagtggatgcaaagttagctc

SEQ ID NO: 17828 - DNA, 21 bp, Artificial sequence
  SiRNA target sequence
agtggatgcaaagttagctca

SEQ ID NO: 17829 - DNA, 21 bp, Artificial sequence
  SiRNA target sequence
gtggatgcaaagttagctcat

SEQ ID NO: 17830 - DNA, 21 bp, Artificial sequence
  SiRNA target sequence
tggatgcaaagttagctcatg

SEQ ID NO: 17831 - DNA, 21 bp, Artificial sequence
  SiRNA target sequence
ggatgcaaagttagctcatgc

SEQ ID NO: 17832 - DNA, 21 bp, Artificial sequence
  SiRNA target sequence
gatgcaaagttagctcatgct

SEQ ID NO: 17833 - DNA, 21 bp, Artificial sequence
  SiRNA target sequence
atgcaaagttagctcatgctc

SEQ ID NO: 17834 - DNA, 21 bp, Artificial sequence
  SiRNA target sequence
tgcaaagttagctcatgctca

SEQ ID NO: 17835 - DNA, 21 bp, Artificial sequence
  SiRNA target sequence
gcaaagttagctcatgctcaa

SEQ ID NO: 17836 - DNA, 21 bp, Artificial sequence
  SiRNA target sequence
caaagttagctcatgctcaaa

SEQ ID NO: 17837 - DNA, 21 bp, Artificial sequence
  SiRNA target sequence
aaagttagctcatgctcaaag

SEQ ID NO: 17838 - DNA, 21 bp, Artificial sequence
  SiRNA target sequence
aagttagctcatgctcaaagc

SEQ ID NO: 17839 - DNA, 21 bp, Artificial sequence
  SiRNA target sequence
agttagctcatgctcaaagcc

SEQ ID NO: 17840 - DNA, 21 bp, Artificial sequence
  SiRNA target sequence
gttagctcatgctcaaagccc

SEQ ID NO: 17841 - DNA, 21 bp, Artificial sequence
  SiRNA target sequence
ttagctcatgctcaaagccct

SEQ ID NO: 17842 - DNA, 21 bp, Artificial sequence
  SiRNA target sequence
tagctcatgctcaaagccctt

SEQ ID NO: 17843 - DNA, 21 bp, Artificial sequence
  SiRNA target sequence
agctcatgctcaaagcccttc

SEQ ID NO: 17844 - DNA, 21 bp, Artificial sequence
  SiRNA target sequence
gctcatgctcaaagcccttct

SEQ ID NO: 17845 - DNA, 21 bp, Artificial sequence
  SiRNA target sequence
ctcatgctcaaagcccttcta

SEQ ID NO: 17846 - DNA, 21 bp, Artificial sequence
  SiRNA target sequence
tcatgctcaaagcccttctac

SEQ ID NO: 17847 - DNA, 21 bp, Artificial sequence
  SiRNA target sequence
catgctcaaagcccttctact

SEQ ID NO: 17848 - DNA, 21 bp, Artificial sequence
  SiRNA target sequence
atgctcaaagcccttctactg

SEQ ID NO: 17849 - DNA, 21 bp, Artificial sequence
  SiRNA target sequence
tgctcaaagcccttctactgg

SEQ ID NO: 17850 - DNA, 21 bp, Artificial sequence
  SiRNA target sequence
gctcaaagcccttctactggg

SEQ ID NO: 17851 - DNA, 21 bp, Artificial sequence
  SiRNA target sequence
ctcaaagcccttctactggga

SEQ ID NO: 17852 - DNA, 21 bp, Artificial sequence
  SiRNA target sequence
tcaaagcccttctactgggat

SEQ ID NO: 17853 - DNA, 21 bp, Artificial sequence
  SiRNA target sequence
caaagcccttctactgggatc

SEQ ID NO: 17854 - DNA, 21 bp, Artificial sequence
  SiRNA target sequence
aaagcccttctactgggatca

SEQ ID NO: 17855 - DNA, 21 bp, Artificial sequence
  SiRNA target sequence
aagcccttctactgggatcaa

SEQ ID NO: 17856 - DNA, 21 bp, Artificial sequence
  SiRNA target sequence
agcccttctactgggatcaaa

SEQ ID NO: 17857 - DNA, 21 bp, Artificial sequence
  SiRNA target sequence
gcccttctactgggatcaaaa

SEQ ID NO: 17858 - DNA, 21 bp, Artificial sequence
  SiRNA target sequence
cccttctactgggatcaaaaa

SEQ ID NO: 17859 - DNA, 21 bp, Artificial sequence
  SiRNA target sequence
ccttctactgggatcaaaaag

SEQ ID NO: 17860 - DNA, 21 bp, Artificial sequence
  SiRNA target sequence
cttctactgggatcaaaaaga

SEQ ID NO: 17861 - DNA, 21 bp, Artificial sequence
  SiRNA target sequence
ttctactgggatcaaaaagac

SEQ ID NO: 17862 - DNA, 21 bp, Artificial sequence
  SiRNA target sequence
tctactgggatcaaaaagacg

SEQ ID NO: 17863 - DNA, 21 bp, Artificial sequence
  SiRNA target sequence
ctactgggatcaaaaagacgc

SEQ ID NO: 17864 - DNA, 21 bp, Artificial sequence
  SiRNA target sequence
tactgggatcaaaaagacgct

SEQ ID NO: 17865 - DNA, 21 bp, Artificial sequence
  SiRNA target sequence
actgggatcaaaaagacgctt

SEQ ID NO: 17866 - DNA, 21 bp, Artificial sequence
  SiRNA target sequence
ctgggatcaaaaagacgctta

SEQ ID NO: 17867 - DNA, 21 bp, Artificial sequence
  SiRNA target sequence
tgggatcaaaaagacgcttat

SEQ ID NO: 17868 - DNA, 21 bp, Artificial sequence
  SiRNA target sequence
gggatcaaaaagacgcttatc

SEQ ID NO: 17869 - DNA, 21 bp, Artificial sequence
  SiRNA target sequence
ggatcaaaaagacgcttatcc

SEQ ID NO: 17870 - DNA, 21 bp, Artificial sequence
  SiRNA target sequence
gatcaaaaagacgcttatcca

SEQ ID NO: 17871 - DNA, 21 bp, Artificial sequence
  SiRNA target sequence
atcaaaaagacgcttatccat

SEQ ID NO: 17872 - DNA, 21 bp, Artificial sequence
  SiRNA target sequence
tcaaaaagacgcttatccatg

SEQ ID NO: 17873 - DNA, 21 bp, Artificial sequence
  SiRNA target sequence
caaaaagacgcttatccatgg

SEQ ID NO: 17874 - DNA, 21 bp, Artificial sequence
  SiRNA target sequence
aaaaagacgcttatccatgga

SEQ ID NO: 17875 - DNA, 21 bp, Artificial sequence
  SiRNA target sequence
aaaagacgcttatccatggaa

SEQ ID NO: 17876 - DNA, 21 bp, Artificial sequence
  SiRNA target sequence
aaagacgcttatccatggaac

SEQ ID NO: 17877 - DNA, 21 bp, Artificial sequence
  SiRNA target sequence
aagacgcttatccatggaaca

SEQ ID NO: 17878 - DNA, 21 bp, Artificial sequence
  SiRNA target sequence
agacgcttatccatggaacat

SEQ ID NO: 17879 - DNA, 21 bp, Artificial sequence
  SiRNA target sequence
gacgcttatccatggaacatt

SEQ ID NO: 17880 - DNA, 21 bp, Artificial sequence
  SiRNA target sequence
acgcttatccatggaacattt

SEQ ID NO: 17881 - DNA, 21 bp, Artificial sequence
  SiRNA target sequence
cgcttatccatggaacatttg

SEQ ID NO: 17882 - DNA, 21 bp, Artificial sequence
  SiRNA target sequence
gcttatccatggaacatttga

SEQ ID NO: 17883 - DNA, 21 bp, Artificial sequence
  SiRNA target sequence
cttatccatggaacatttgat

SEQ ID NO: 17884 - DNA, 21 bp, Artificial sequence
  SiRNA target sequence
ttatccatggaacatttgatg

SEQ ID NO: 17885 - DNA, 21 bp, Artificial sequence
  SiRNA target sequence
tatccatggaacatttgatgt

SEQ ID NO: 17886 - DNA, 21 bp, Artificial sequence
  SiRNA target sequence
atccatggaacatttgatgta

SEQ ID NO: 17887 - DNA, 21 bp, Artificial sequence
  SiRNA target sequence
tccatggaacatttgatgtaa

SEQ ID NO: 17888 - DNA, 21 bp, Artificial sequence
  SiRNA target sequence
ccatggaacatttgatgtaag

SEQ ID NO: 17889 - DNA, 21 bp, Artificial sequence
  SiRNA target sequence
catggaacatttgatgtaagg

SEQ ID NO: 17890 - DNA, 21 bp, Artificial sequence
  SiRNA target sequence
atggaacatttgatgtaagga

SEQ ID NO: 17891 - DNA, 21 bp, Artificial sequence
  SiRNA target sequence
tggaacatttgatgtaaggac

SEQ ID NO: 17892 - DNA, 21 bp, Artificial sequence
  SiRNA target sequence
ggaacatttgatgtaaggact

SEQ ID NO: 17893 - DNA, 21 bp, Artificial sequence
  SiRNA target sequence
gaacatttgatgtaaggactg

SEQ ID NO: 17894 - DNA, 21 bp, Artificial sequence
  SiRNA target sequence
aacatttgatgtaaggactga

SEQ ID NO: 17895 - DNA, 21 bp, Artificial sequence
  SiRNA target sequence
acatttgatgtaaggactgaa

SEQ ID NO: 17896 - DNA, 21 bp, Artificial sequence
  SiRNA target sequence
catttgatgtaaggactgaac

SEQ ID NO: 17897 - DNA, 21 bp, Artificial sequence
  SiRNA target sequence
atttgatgtaaggactgaacc

SEQ ID NO: 17898 - DNA, 21 bp, Artificial sequence
  SiRNA target sequence
tttgatgtaaggactgaacca

SEQ ID NO: 17899 - DNA, 21 bp, Artificial sequence
  SiRNA target sequence
ttgatgtaaggactgaaccaa

SEQ ID NO: 17900 - DNA, 21 bp, Artificial sequence
  SiRNA target sequence
tgatgtaaggactgaaccaaa

SEQ ID NO: 17901 - DNA, 21 bp, Artificial sequence
  SiRNA target sequence
gatgtaaggactgaaccaaat

SEQ ID NO: 17902 - DNA, 21 bp, Artificial sequence
  SiRNA target sequence
atgtaaggactgaaccaaatc

SEQ ID NO: 17903 - DNA, 21 bp, Artificial sequence
  SiRNA target sequence
tgtaaggactgaaccaaatcc

SEQ ID NO: 17904 - DNA, 21 bp, Artificial sequence
  SiRNA target sequence
gtaaggactgaaccaaatccg

SEQ ID NO: 17905 - DNA, 21 bp, Artificial sequence
  SiRNA target sequence
taaggactgaaccaaatccga

SEQ ID NO: 17906 - DNA, 21 bp, Artificial sequence
  SiRNA target sequence
aaggactgaaccaaatccgat

SEQ ID NO: 17907 - DNA, 21 bp, Artificial sequence
  SiRNA target sequence
aggactgaaccaaatccgatg

SEQ ID NO: 17908 - DNA, 21 bp, Artificial sequence
  SiRNA target sequence
ggactgaaccaaatccgatgt

SEQ ID NO: 17909 - DNA, 21 bp, Artificial sequence
  SiRNA target sequence
gactgaaccaaatccgatgtc

SEQ ID NO: 17910 - DNA, 21 bp, Artificial sequence
  SiRNA target sequence
actgaaccaaatccgatgtcg

SEQ ID NO: 17911 - DNA, 21 bp, Artificial sequence
  SiRNA target sequence
ctgaaccaaatccgatgtcgt

SEQ ID NO: 17912 - DNA, 21 bp, Artificial sequence
  SiRNA target sequence
tgaaccaaatccgatgtcgtc

SEQ ID NO: 17913 - DNA, 21 bp, Artificial sequence
  SiRNA target sequence
gaaccaaatccgatgtcgtca

SEQ ID NO: 17914 - DNA, 21 bp, Artificial sequence
  SiRNA target sequence
aaccaaatccgatgtcgtcac

SEQ ID NO: 17915 - DNA, 21 bp, Artificial sequence
  SiRNA target sequence
accaaatccgatgtcgtcacg

SEQ ID NO: 17916 - DNA, 21 bp, Artificial sequence
  SiRNA target sequence
ccaaatccgatgtcgtcacgt

SEQ ID NO: 17917 - DNA, 21 bp, Artificial sequence
  SiRNA target sequence
caaatccgatgtcgtcacgtg

SEQ ID NO: 17918 - DNA, 21 bp, Artificial sequence
  SiRNA target sequence
aaatccgatgtcgtcacgtga

SEQ ID NO: 17919 - DNA, 21 bp, Artificial sequence
  SiRNA target sequence
aatccgatgtcgtcacgtgat

SEQ ID NO: 17920 - DNA, 21 bp, Artificial sequence
  SiRNA target sequence
atccgatgtcgtcacgtgatc

SEQ ID NO: 17921 - DNA, 21 bp, Artificial sequence
  SiRNA target sequence
tccgatgtcgtcacgtgatcc

SEQ ID NO: 17922 - DNA, 21 bp, Artificial sequence
  SiRNA target sequence
ccgatgtcgtcacgtgatcca

SEQ ID NO: 17923 - DNA, 21 bp, Artificial sequence
  SiRNA target sequence
cgatgtcgtcacgtgatccaa

SEQ ID NO: 17924 - DNA, 21 bp, Artificial sequence
  SiRNA target sequence
gatgtcgtcacgtgatccaag

SEQ ID NO: 17925 - DNA, 21 bp, Artificial sequence
  SiRNA target sequence
atgtcgtcacgtgatccaaga

SEQ ID NO: 17926 - DNA, 21 bp, Artificial sequence
  SiRNA target sequence
tgtcgtcacgtgatccaagaa

SEQ ID NO: 17927 - DNA, 21 bp, Artificial sequence
  SiRNA target sequence
gtcgtcacgtgatccaagaat

SEQ ID NO: 17928 - DNA, 21 bp, Artificial sequence
  SiRNA target sequence
tcgtcacgtgatccaagaata

SEQ ID NO: 17929 - DNA, 21 bp, Artificial sequence
  SiRNA target sequence
cgtcacgtgatccaagaatag

SEQ ID NO: 17930 - DNA, 21 bp, Artificial sequence
  SiRNA target sequence
gtcacgtgatccaagaatagc

SEQ ID NO: 17931 - DNA, 21 bp, Artificial sequence
  SiRNA target sequence
tcacgtgatccaagaatagcg

SEQ ID NO: 17932 - DNA, 21 bp, Artificial sequence
  SiRNA target sequence
cacgtgatccaagaatagcgc

SEQ ID NO: 17933 - DNA, 21 bp, Artificial sequence
  SiRNA target sequence
acgtgatccaagaatagcgcc

SEQ ID NO: 17934 - DNA, 21 bp, Artificial sequence
  SiRNA target sequence
cgtgatccaagaatagcgccg

SEQ ID NO: 17935 - DNA, 21 bp, Artificial sequence
  SiRNA target sequence
gtgatccaagaatagcgccgc

SEQ ID NO: 17936 - DNA, 21 bp, Artificial sequence
  SiRNA target sequence
tgatccaagaatagcgccgca

SEQ ID NO: 17937 - DNA, 21 bp, Artificial sequence
  SiRNA target sequence
gatccaagaatagcgccgcat

SEQ ID NO: 17938 - DNA, 21 bp, Artificial sequence
  SiRNA target sequence
atccaagaatagcgccgcatg

SEQ ID NO: 17939 - DNA, 21 bp, Artificial sequence
  SiRNA target sequence
tccaagaatagcgccgcatga

SEQ ID NO: 17940 - DNA, 21 bp, Artificial sequence
  SiRNA target sequence
ccaagaatagcgccgcatgat

SEQ ID NO: 17941 - DNA, 21 bp, Artificial sequence
  SiRNA target sequence
caagaatagcgccgcatgatc

SEQ ID NO: 17942 - DNA, 21 bp, Artificial sequence
  SiRNA target sequence
aagaatagcgccgcatgatcc

SEQ ID NO: 17943 - DNA, 21 bp, Artificial sequence
  SiRNA target sequence
agaatagcgccgcatgatcct

SEQ ID NO: 17944 - DNA, 21 bp, Artificial sequence
  SiRNA target sequence
gaatagcgccgcatgatcctt

SEQ ID NO: 17945 - DNA, 21 bp, Artificial sequence
  SiRNA target sequence
aatagcgccgcatgatccttt

SEQ ID NO: 17946 - DNA, 21 bp, Artificial sequence
  SiRNA target sequence
atagcgccgcatgatcctttg

SEQ ID NO: 17947 - DNA, 21 bp, Artificial sequence
  SiRNA target sequence
tagcgccgcatgatcctttga

SEQ ID NO: 17948 - DNA, 21 bp, Artificial sequence
  SiRNA target sequence
agcgccgcatgatcctttgaa

SEQ ID NO: 17949 - DNA, 21 bp, Artificial sequence
  SiRNA target sequence
gcgccgcatgatcctttgaag

SEQ ID NO: 17950 - DNA, 21 bp, Artificial sequence
  SiRNA target sequence
cgccgcatgatcctttgaagt

SEQ ID NO: 17951 - DNA, 21 bp, Artificial sequence
  SiRNA target sequence
gccgcatgatcctttgaagtt

SEQ ID NO: 17952 - DNA, 21 bp, Artificial sequence
  SiRNA target sequence
ccgcatgatcctttgaagtta

SEQ ID NO: 17953 - DNA, 21 bp, Artificial sequence
  SiRNA target sequence
cgcatgatcctttgaagttag

SEQ ID NO: 17954 - DNA, 21 bp, Artificial sequence
  SiRNA target sequence
gcatgatcctttgaagttagg

SEQ ID NO: 17955 - DNA, 21 bp, Artificial sequence
  SiRNA target sequence
catgatcctttgaagttaggg

SEQ ID NO: 17956 - DNA, 21 bp, Artificial sequence
  SiRNA target sequence
atgatcctttgaagttagggt

SEQ ID NO: 17957 - DNA, 21 bp, Artificial sequence
  SiRNA target sequence
tgatcctttgaagttagggtg

SEQ ID NO: 17958 - DNA, 21 bp, Artificial sequence
  SiRNA target sequence
gatcctttgaagttagggtgt

SEQ ID NO: 17959 - DNA, 21 bp, Artificial sequence
  SiRNA target sequence
atcctttgaagttagggtgtg

SEQ ID NO: 17960 - DNA, 21 bp, Artificial sequence
  SiRNA target sequence
tcctttgaagttagggtgtga

SEQ ID NO: 17961 - DNA, 21 bp, Artificial sequence
  SiRNA target sequence
cctttgaagttagggtgtgaa

SEQ ID NO: 17962 - DNA, 21 bp, Artificial sequence
  SiRNA target sequence
ctttgaagttagggtgtgaaa

SEQ ID NO: 17963 - DNA, 21 bp, Artificial sequence
  SiRNA target sequence
tttgaagttagggtgtgaaaa

SEQ ID NO: 17964 - DNA, 21 bp, Artificial sequence
  SiRNA target sequence
ttgaagttagggtgtgaaaag

SEQ ID NO: 17965 - DNA, 21 bp, Artificial sequence
  SiRNA target sequence
tgaagttagggtgtgaaaagc

SEQ ID NO: 17966 - DNA, 21 bp, Artificial sequence
  SiRNA target sequence
gaagttagggtgtgaaaagca

SEQ ID NO: 17967 - DNA, 21 bp, Artificial sequence
  SiRNA target sequence
aagttagggtgtgaaaagcat

SEQ ID NO: 17968 - DNA, 21 bp, Artificial sequence
  SiRNA target sequence
agttagggtgtgaaaagcatg

SEQ ID NO: 17969 - DNA, 21 bp, Artificial sequence
  SiRNA target sequence
gttagggtgtgaaaagcatgg

SEQ ID NO: 17970 - DNA, 21 bp, Artificial sequence
  SiRNA target sequence
ttagggtgtgaaaagcatggt

SEQ ID NO: 17971 - DNA, 21 bp, Artificial sequence
  SiRNA target sequence
tagggtgtgaaaagcatggta

SEQ ID NO: 17972 - DNA, 21 bp, Artificial sequence
  SiRNA target sequence
agggtgtgaaaagcatggtat

SEQ ID NO: 17973 - DNA, 21 bp, Artificial sequence
  SiRNA target sequence
gggtgtgaaaagcatggtatg

SEQ ID NO: 17974 - DNA, 21 bp, Artificial sequence
  SiRNA target sequence
ggtgtgaaaagcatggtatgc

SEQ ID NO: 17975 - DNA, 21 bp, Artificial sequence
  SiRNA target sequence
gtgtgaaaagcatggtatgcc

SEQ ID NO: 17976 - DNA, 21 bp, Artificial sequence
  SiRNA target sequence
tgtgaaaagcatggtatgcct

SEQ ID NO: 17977 - DNA, 21 bp, Artificial sequence
  SiRNA target sequence
gtgaaaagcatggtatgcctt

SEQ ID NO: 17978 - DNA, 21 bp, Artificial sequence
  SiRNA target sequence
tgaaaagcatggtatgccttg

SEQ ID NO: 17979 - DNA, 21 bp, Artificial sequence
  SiRNA target sequence
gaaaagcatggtatgccttgt

SEQ ID NO: 17980 - DNA, 21 bp, Artificial sequence
  SiRNA target sequence
aaaagcatggtatgccttgtt

SEQ ID NO: 17981 - DNA, 21 bp, Artificial sequence
  SiRNA target sequence
aaagcatggtatgccttgttc

SEQ ID NO: 17982 - DNA, 21 bp, Artificial sequence
  SiRNA target sequence
aagcatggtatgccttgttca

SEQ ID NO: 17983 - DNA, 21 bp, Artificial sequence
  SiRNA target sequence
agcatggtatgccttgttcac

SEQ ID NO: 17984 - DNA, 21 bp, Artificial sequence
  SiRNA target sequence
gcatggtatgccttgttcacc

SEQ ID NO: 17985 - DNA, 21 bp, Artificial sequence
  SiRNA target sequence
catggtatgccttgttcaccg

SEQ ID NO: 17986 - DNA, 21 bp, Artificial sequence
  SiRNA target sequence
atggtatgccttgttcaccgt

SEQ ID NO: 17987 - DNA, 21 bp, Artificial sequence
  SiRNA target sequence
tggtatgccttgttcaccgtt

SEQ ID NO: 17988 - DNA, 21 bp, Artificial sequence
  SiRNA target sequence
ggtatgccttgttcaccgttt

SEQ ID NO: 17989 - DNA, 21 bp, Artificial sequence
  SiRNA target sequence
gtatgccttgttcaccgttta

SEQ ID NO: 17990 - DNA, 21 bp, Artificial sequence
  SiRNA target sequence
tatgccttgttcaccgtttaa

SEQ ID NO: 17991 - DNA, 21 bp, Artificial sequence
  SiRNA target sequence
atgccttgttcaccgtttaat

SEQ ID NO: 17992 - DNA, 21 bp, Artificial sequence
  SiRNA target sequence
tgccttgttcaccgtttaata

SEQ ID NO: 17993 - DNA, 21 bp, Artificial sequence
  SiRNA target sequence
gccttgttcaccgtttaatag

SEQ ID NO: 17994 - DNA, 21 bp, Artificial sequence
  SiRNA target sequence
ccttgttcaccgtttaatagg

SEQ ID NO: 17995 - DNA, 21 bp, Artificial sequence
  SiRNA target sequence
cttgttcaccgtttaatagga

SEQ ID NO: 17996 - DNA, 21 bp, Artificial sequence
  SiRNA target sequence
ttgttcaccgtttaataggaa

SEQ ID NO: 17997 - DNA, 21 bp, Artificial sequence
  SiRNA target sequence
tgttcaccgtttaataggaaa

SEQ ID NO: 17998 - DNA, 21 bp, Artificial sequence
  SiRNA target sequence
gttcaccgtttaataggaaac

SEQ ID NO: 17999 - DNA, 21 bp, Artificial sequence
  SiRNA target sequence
ttcaccgtttaataggaaaca

SEQ ID NO: 18000 - DNA, 21 bp, Artificial sequence
  SiRNA target sequence
tcaccgtttaataggaaacat

SEQ ID NO: 18001 - DNA, 21 bp, Artificial sequence
  SiRNA target sequence
caccgtttaataggaaacatc

SEQ ID NO: 18002 - DNA, 21 bp, Artificial sequence
  SiRNA target sequence
accgtttaataggaaacatct

SEQ ID NO: 18003 - DNA, 21 bp, Artificial sequence
  SiRNA target sequence
ccgtttaataggaaacatctg

SEQ ID NO: 18004 - DNA, 21 bp, Artificial sequence
  SiRNA target sequence
cgtttaataggaaacatctgg

SEQ ID NO: 18005 - DNA, 21 bp, Artificial sequence
  SiRNA target sequence
gtttaataggaaacatctgga

SEQ ID NO: 18006 - DNA, 21 bp, Artificial sequence
  SiRNA target sequence
tttaataggaaacatctggaa

SEQ ID NO: 18007 - DNA, 21 bp, Artificial sequence
  SiRNA target sequence
ttaataggaaacatctggaat

SEQ ID NO: 18008 - DNA, 21 bp, Artificial sequence
  SiRNA target sequence
taataggaaacatctggaatt

SEQ ID NO: 18009 - DNA, 21 bp, Artificial sequence
  SiRNA target sequence
aataggaaacatctggaatta

SEQ ID NO: 18010 - DNA, 21 bp, Artificial sequence
  SiRNA target sequence
ataggaaacatctggaattag

SEQ ID NO: 18011 - DNA, 21 bp, Artificial sequence
  SiRNA target sequence
taggaaacatctggaattagc

SEQ ID NO: 18012 - DNA, 21 bp, Artificial sequence
  SiRNA target sequence
aggaaacatctggaattagcg

SEQ ID NO: 18013 - DNA, 21 bp, Artificial sequence
  SiRNA target sequence
ggaaacatctggaattagcga

SEQ ID NO: 18014 - DNA, 21 bp, Artificial sequence
  SiRNA target sequence
gaaacatctggaattagcgac

SEQ ID NO: 18015 - DNA, 21 bp, Artificial sequence
  SiRNA target sequence
aaacatctggaattagcgaca

SEQ ID NO: 18016 - DNA, 21 bp, Artificial sequence
  SiRNA target sequence
aacatctggaattagcgacaa

SEQ ID NO: 18017 - DNA, 21 bp, Artificial sequence
  SiRNA target sequence
acatctggaattagcgacaaa

SEQ ID NO: 18018 - DNA, 21 bp, Artificial sequence
  SiRNA target sequence
catctggaattagcgacaaat

SEQ ID NO: 18019 - DNA, 21 bp, Artificial sequence
  SiRNA target sequence
atctggaattagcgacaaatc

SEQ ID NO: 18020 - DNA, 21 bp, Artificial sequence
  SiRNA target sequence
tctggaattagcgacaaatca

SEQ ID NO: 18021 - DNA, 21 bp, Artificial sequence
  SiRNA target sequence
ctggaattagcgacaaatcat

SEQ ID NO: 18022 - DNA, 21 bp, Artificial sequence
  SiRNA target sequence
tggaattagcgacaaatcatt

SEQ ID NO: 18023 - DNA, 21 bp, Artificial sequence
  SiRNA target sequence
ggaattagcgacaaatcattt

SEQ ID NO: 18024 - DNA, 21 bp, Artificial sequence
  SiRNA target sequence
gaattagcgacaaatcatttg

SEQ ID NO: 18025 - DNA, 21 bp, Artificial sequence
  SiRNA target sequence
aattagcgacaaatcatttga

SEQ ID NO: 18026 - DNA, 21 bp, Artificial sequence
  SiRNA target sequence
attagcgacaaatcatttgaa

SEQ ID NO: 18027 - DNA, 21 bp, Artificial sequence
  SiRNA target sequence
ttagcgacaaatcatttgaaa

SEQ ID NO: 18028 - DNA, 21 bp, Artificial sequence
  SiRNA target sequence
tagcgacaaatcatttgaaag

SEQ ID NO: 18029 - DNA, 21 bp, Artificial sequence
  SiRNA target sequence
agcgacaaatcatttgaaaga

SEQ ID NO: 18030 - DNA, 21 bp, Artificial sequence
  SiRNA target sequence
gcgacaaatcatttgaaagaa

SEQ ID NO: 18031 - DNA, 21 bp, Artificial sequence
  SiRNA target sequence
cgacaaatcatttgaaagaaa

SEQ ID NO: 18032 - DNA, 21 bp, Artificial sequence
  SiRNA target sequence
gacaaatcatttgaaagaaaa

SEQ ID NO: 18033 - DNA, 21 bp, Artificial sequence
  SiRNA target sequence
acaaatcatttgaaagaaaaa

SEQ ID NO: 18034 - DNA, 21 bp, Artificial sequence
  SiRNA target sequence
caaatcatttgaaagaaaaat

SEQ ID NO: 18035 - DNA, 21 bp, Artificial sequence
  SiRNA target sequence
aaatcatttgaaagaaaaatt

SEQ ID NO: 18036 - DNA, 21 bp, Artificial sequence
  SiRNA target sequence
aatcatttgaaagaaaaatta

SEQ ID NO: 18037 - DNA, 21 bp, Artificial sequence
  SiRNA target sequence
atcatttgaaagaaaaattag

SEQ ID NO: 18038 - DNA, 21 bp, Artificial sequence
  SiRNA target sequence
tcatttgaaagaaaaattagt

SEQ ID NO: 18039 - DNA, 21 bp, Artificial sequence
  SiRNA target sequence
catttgaaagaaaaattagtt

SEQ ID NO: 18040 - DNA, 21 bp, Artificial sequence
  SiRNA target sequence
atttgaaagaaaaattagttt

SEQ ID NO: 18041 - DNA, 21 bp, Artificial sequence
  SiRNA target sequence
tttgaaagaaaaattagtttc

SEQ ID NO: 18042 - DNA, 21 bp, Artificial sequence
  SiRNA target sequence
ttgaaagaaaaattagtttca

SEQ ID NO: 18043 - DNA, 21 bp, Artificial sequence
  SiRNA target sequence
tgaaagaaaaattagtttcag

SEQ ID NO: 18044 - DNA, 21 bp, Artificial sequence
  SiRNA target sequence
gaaagaaaaattagtttcagt

SEQ ID NO: 18045 - DNA, 21 bp, Artificial sequence
  SiRNA target sequence
aaagaaaaattagtttcagta

SEQ ID NO: 18046 - DNA, 21 bp, Artificial sequence
  SiRNA target sequence
aagaaaaattagtttcagtag

SEQ ID NO: 18047 - DNA, 21 bp, Artificial sequence
  SiRNA target sequence
agaaaaattagtttcagtagt

SEQ ID NO: 18048 - DNA, 21 bp, Artificial sequence
  SiRNA target sequence
gaaaaattagtttcagtagtt

SEQ ID NO: 18049 - DNA, 21 bp, Artificial sequence
  SiRNA target sequence
aaaaattagtttcagtagtta

SEQ ID NO: 18050 - DNA, 21 bp, Artificial sequence
  SiRNA target sequence
aaaattagtttcagtagttaa

SEQ ID NO: 18051 - DNA, 21 bp, Artificial sequence
  SiRNA target sequence
aaattagtttcagtagttaaa

SEQ ID NO: 18052 - DNA, 21 bp, Artificial sequence
  SiRNA target sequence
aattagtttcagtagttaaac

SEQ ID NO: 18053 - DNA, 21 bp, Artificial sequence
  SiRNA target sequence
attagtttcagtagttaaacc

SEQ ID NO: 18054 - DNA, 21 bp, Artificial sequence
  SiRNA target sequence
ttagtttcagtagttaaacca

SEQ ID NO: 18055 - DNA, 21 bp, Artificial sequence
  SiRNA target sequence
tagtttcagtagttaaaccaa

SEQ ID NO: 18056 - DNA, 21 bp, Artificial sequence
  SiRNA target sequence
agtttcagtagttaaaccaat

SEQ ID NO: 18057 - DNA, 21 bp, Artificial sequence
  SiRNA target sequence
gtttcagtagttaaaccaata

SEQ ID NO: 18058 - DNA, 21 bp, Artificial sequence
  SiRNA target sequence
tttcagtagttaaaccaataa

SEQ ID NO: 18059 - DNA, 21 bp, Artificial sequence
  SiRNA target sequence
ttcagtagttaaaccaataaa

SEQ ID NO: 18060 - DNA, 21 bp, Artificial sequence
  SiRNA target sequence
tcagtagttaaaccaataaat

SEQ ID NO: 18061 - DNA, 21 bp, Artificial sequence
  SiRNA target sequence
cagtagttaaaccaataaatg

SEQ ID NO: 18062 - DNA, 21 bp, Artificial sequence
  SiRNA target sequence
agtagttaaaccaataaatgg

SEQ ID NO: 18063 - DNA, 21 bp, Artificial sequence
  SiRNA target sequence
gtagttaaaccaataaatggt

SEQ ID NO: 18064 - DNA, 21 bp, Artificial sequence
  SiRNA target sequence
tagttaaaccaataaatggtt

SEQ ID NO: 18065 - DNA, 21 bp, Artificial sequence
  SiRNA target sequence
agttaaaccaataaatggttg

SEQ ID NO: 18066 - DNA, 21 bp, Artificial sequence
  SiRNA target sequence
gttaaaccaataaatggttgc

SEQ ID NO: 18067 - DNA, 21 bp, Artificial sequence
  SiRNA target sequence
ttaaaccaataaatggttgca

SEQ ID NO: 18068 - DNA, 21 bp, Artificial sequence
  SiRNA target sequence
taaaccaataaatggttgcaa

SEQ ID NO: 18069 - DNA, 21 bp, Artificial sequence
  SiRNA target sequence
aaaccaataaatggttgcaag

SEQ ID NO: 18070 - DNA, 21 bp, Artificial sequence
  SiRNA target sequence
aaccaataaatggttgcaaga

SEQ ID NO: 18071 - DNA, 21 bp, Artificial sequence
  SiRNA target sequence
accaataaatggttgcaagat

SEQ ID NO: 18072 - DNA, 21 bp, Artificial sequence
  SiRNA target sequence
ccaataaatggttgcaagatt

SEQ ID NO: 18073 - DNA, 21 bp, Artificial sequence
  SiRNA target sequence
caataaatggttgcaagatta

SEQ ID NO: 18074 - DNA, 21 bp, Artificial sequence
  SiRNA target sequence
aataaatggttgcaagattag

SEQ ID NO: 18075 - DNA, 21 bp, Artificial sequence
  SiRNA target sequence
ataaatggttgcaagattaga

SEQ ID NO: 18076 - DNA, 21 bp, Artificial sequence
  SiRNA target sequence
taaatggttgcaagattagaa

SEQ ID NO: 18077 - DNA, 21 bp, Artificial sequence
  SiRNA target sequence
aaatggttgcaagattagaag

SEQ ID NO: 18078 - DNA, 21 bp, Artificial sequence
  SiRNA target sequence
aatggttgcaagattagaagt

SEQ ID NO: 18079 - DNA, 21 bp, Artificial sequence
  SiRNA target sequence
atggttgcaagattagaagtt

SEQ ID NO: 18080 - DNA, 21 bp, Artificial sequence
  SiRNA target sequence
tggttgcaagattagaagttt

SEQ ID NO: 18081 - DNA, 21 bp, Artificial sequence
  SiRNA target sequence
ggttgcaagattagaagtttg

SEQ ID NO: 18082 - DNA, 21 bp, Artificial sequence
  SiRNA target sequence
gttgcaagattagaagtttgc

SEQ ID NO: 18083 - DNA, 21 bp, Artificial sequence
  SiRNA target sequence
ttgcaagattagaagtttgca

SEQ ID NO: 18084 - DNA, 21 bp, Artificial sequence
  SiRNA target sequence
tgcaagattagaagtttgcaa

SEQ ID NO: 18085 - DNA, 21 bp, Artificial sequence
  SiRNA target sequence
gcaagattagaagtttgcaag

SEQ ID NO: 18086 - DNA, 21 bp, Artificial sequence
  SiRNA target sequence
caagattagaagtttgcaaga

SEQ ID NO: 18087 - DNA, 21 bp, Artificial sequence
  SiRNA target sequence
aagattagaagtttgcaagat

SEQ ID NO: 18088 - DNA, 21 bp, Artificial sequence
  SiRNA target sequence
agattagaagtttgcaagatg

SEQ ID NO: 18089 - DNA, 21 bp, Artificial sequence
  SiRNA target sequence
gattagaagtttgcaagatgc

SEQ ID NO: 18090 - DNA, 21 bp, Artificial sequence
  SiRNA target sequence
attagaagtttgcaagatgct

SEQ ID NO: 18091 - DNA, 21 bp, Artificial sequence
  SiRNA target sequence
  misc_feature (21)..(21): n is a, c, g, or t
ttagaagtttgcaagatgctn

SEQ ID NO: 18092 - DNA, 21 bp, Artificial sequence
  SiRNA target sequence
  misc_feature (20)..(20): n is a, c, g, or t
tagaagtttgcaagatgctnt

SEQ ID NO: 18093 - DNA, 21 bp, Artificial sequence
  SiRNA target sequence
  misc_feature (19)..(19): n is a, c, g, or t
agaagtttgcaagatgctnta

SEQ ID NO: 18094 - DNA, 21 bp, Artificial sequence
  SiRNA target sequence
  misc_feature (18)..(18): n is a, c, g, or t
gaagtttgcaagatgctntat

SEQ ID NO: 18095 - DNA, 21 bp, Artificial sequence
  SiRNA target sequence
  misc_feature (17)..(17): n is a, c, g, or t
aagtttgcaagatgctntatg

SEQ ID NO: 18096 - DNA, 21 bp, Artificial sequence
  SiRNA target sequence
  misc_feature (16)..(16): n is a, c, g, or t
agtttgcaagatgctntatgt

SEQ ID NO: 18097 - DNA, 21 bp, Artificial sequence
  SiRNA target sequence
  misc_feature (15)..(15): n is a, c, g, or t
gtttgcaagatgctntatgtg

SEQ ID NO: 18098 - DNA, 21 bp, Artificial sequence
  SiRNA target sequence
  misc_feature (14)..(14): n is a, c, g, or t
tttgcaagatgctntatgtgg

SEQ ID NO: 18099 - DNA, 21 bp, Artificial sequence
  SiRNA target sequence
  misc_feature (13)..(13): n is a, c, g, or t
ttgcaagatgctntatgtggt

SEQ ID NO: 18100 - DNA, 21 bp, Artificial sequence
  SiRNA target sequence
  misc_feature (12)..(12): n is a, c, g, or t
tgcaagatgctntatgtggtg

SEQ ID NO: 18101 - DNA, 21 bp, Artificial sequence
  SiRNA target sequence
  misc_feature (11)..(11): n is a, c, g, or t
gcaagatgctntatgtggtgt

SEQ ID NO: 18102 - DNA, 21 bp, Artificial sequence
  SiRNA target sequence
  misc_feature (10)..(10): n is a, c, g, or t
caagatgctntatgtggtgtg

SEQ ID NO: 18103 - DNA, 21 bp, Artificial sequence
  SiRNA target sequence
  misc_feature (9)..(9): n is a, c, g, or t
aagatgctntatgtggtgtgc

SEQ ID NO: 18104 - DNA, 21 bp, Artificial sequence
  SiRNA target sequence
  misc_feature (8)..(8): n is a, c, g, or t
agatgctntatgtggtgtgcc

SEQ ID NO: 18105 - DNA, 21 bp, Artificial sequence
  SiRNA target sequence
  misc_feature (7)..(7): n is a, c, g, or t
gatgctntatgtggtgtgcct

SEQ ID NO: 18106 - DNA, 21 bp, Artificial sequence
  SiRNA target sequence
  misc_feature (6)..(6): n is a, c, g, or t
atgctntatgtggtgtgcctg

SEQ ID NO: 18107 - DNA, 21 bp, Artificial sequence
  SiRNA target sequence
  misc_feature (5)..(5): n is a, c, g, or t
tgctntatgtggtgtgcctgg

SEQ ID NO: 18108 - DNA, 21 bp, Artificial sequence
  SiRNA target sequence
  misc_feature (4)..(4): n is a, c, g, or t
gctntatgtggtgtgcctggt

SEQ ID NO: 18109 - DNA, 21 bp, Artificial sequence
  SiRNA target sequence
  misc_feature (3)..(3): n is a, c, g, or t
ctntatgtggtgtgcctggtt

SEQ ID NO: 18110 - DNA, 21 bp, Artificial sequence
  SiRNA target sequence
  misc_feature (2)..(2): n is a, c, g, or t
tntatgtggtgtgcctggttt

SEQ ID NO: 18111 - DNA, 21 bp, Artificial sequence
  SiRNA target sequence
  misc_feature (1)..(1): n is a, c, g, or t
ntatgtggtgtgcctggttta

SEQ ID NO: 18112 - DNA, 21 bp, Artificial sequence
  SiRNA target sequence
tatgtggtgtgcctggtttag

SEQ ID NO: 18113 - DNA, 21 bp, Artificial sequence
  SiRNA target sequence
atgtggtgtgcctggtttaga

SEQ ID NO: 18114 - DNA, 21 bp, Artificial sequence
  SiRNA target sequence
tgtggtgtgcctggtttagat

SEQ ID NO: 18115 - DNA, 21 bp, Artificial sequence
  SiRNA target sequence
gtggtgtgcctggtttagatg

SEQ ID NO: 18116 - DNA, 21 bp, Artificial sequence
  SiRNA target sequence
tggtgtgcctggtttagatgg

SEQ ID NO: 18117 - DNA, 21 bp, Artificial sequence
  SiRNA target sequence
ggtgtgcctggtttagatggg

SEQ ID NO: 18118 - DNA, 21 bp, Artificial sequence
  SiRNA target sequence
gtgtgcctggtttagatgggt

SEQ ID NO: 18119 - DNA, 21 bp, Artificial sequence
  SiRNA target sequence
tgtgcctggtttagatgggtt

SEQ ID NO: 18120 - DNA, 21 bp, Artificial sequence
  SiRNA target sequence
gtgcctggtttagatgggttt

SEQ ID NO: 18121 - DNA, 21 bp, Artificial sequence
  SiRNA target sequence
tgcctggtttagatgggtttg

SEQ ID NO: 18122 - DNA, 21 bp, Artificial sequence
  SiRNA target sequence
gcctggtttagatgggtttga

SEQ ID NO: 18123 - DNA, 21 bp, Artificial sequence
  SiRNA target sequence
cctggtttagatgggtttgat

SEQ ID NO: 18124 - DNA, 21 bp, Artificial sequence
  SiRNA target sequence
ctggtttagatgggtttgatt

SEQ ID NO: 18125 - DNA, 21 bp, Artificial sequence
  SiRNA target sequence
tggtttagatgggtttgattc

SEQ ID NO: 18126 - DNA, 21 bp, Artificial sequence
  SiRNA target sequence
ggtttagatgggtttgattcg

SEQ ID NO: 18127 - DNA, 21 bp, Artificial sequence
  SiRNA target sequence
gtttagatgggtttgattcga

SEQ ID NO: 18128 - DNA, 21 bp, Artificial sequence
  SiRNA target sequence
tttagatgggtttgattcgat

SEQ ID NO: 18129 - DNA, 21 bp, Artificial sequence
  SiRNA target sequence
ttagatgggtttgattcgata

SEQ ID NO: 18130 - DNA, 21 bp, Artificial sequence
  SiRNA target sequence
tagatgggtttgattcgatat

SEQ ID NO: 18131 - DNA, 21 bp, Artificial sequence
  SiRNA target sequence
agatgggtttgattcgatatc

SEQ ID NO: 18132 - DNA, 21 bp, Artificial sequence
  SiRNA target sequence
gatgggtttgattcgatatct

SEQ ID NO: 18133 - DNA, 21 bp, Artificial sequence
  SiRNA target sequence
atgggtttgattcgatatctt

SEQ ID NO: 18134 - DNA, 21 bp, Artificial sequence
  SiRNA target sequence
tgggtttgattcgatatcttg

SEQ ID NO: 18135 - DNA, 21 bp, Artificial sequence
  SiRNA target sequence
gggtttgattcgatatcttgg

SEQ ID NO: 18136 - DNA, 21 bp, Artificial sequence
  SiRNA target sequence
ggtttgattcgatatcttgga

SEQ ID NO: 18137 - DNA, 21 bp, Artificial sequence
  SiRNA target sequence
gtttgattcgatatcttggaa

SEQ ID NO: 18138 - DNA, 21 bp, Artificial sequence
  SiRNA target sequence
tttgattcgatatcttggaat

SEQ ID NO: 18139 - DNA, 21 bp, Artificial sequence
  SiRNA target sequence
ttgattcgatatcttggaata

SEQ ID NO: 18140 - DNA, 21 bp, Artificial sequence
  SiRNA target sequence
tgattcgatatcttggaatac

SEQ ID NO: 18141 - DNA, 21 bp, Artificial sequence
  SiRNA target sequence
gattcgatatcttggaatact

SEQ ID NO: 18142 - DNA, 21 bp, Artificial sequence
  SiRNA target sequence
attcgatatcttggaatacta

SEQ ID NO: 18143 - DNA, 21 bp, Artificial sequence
  SiRNA target sequence
ttcgatatcttggaatactag

SEQ ID NO: 18144 - DNA, 21 bp, Artificial sequence
  SiRNA target sequence
tcgatatcttggaatactagt

SEQ ID NO: 18145 - DNA, 21 bp, Artificial sequence
  SiRNA target sequence
cgatatcttggaatactagtg

SEQ ID NO: 18146 - DNA, 21 bp, Artificial sequence
  SiRNA target sequence
gatatcttggaatactagtgc

SEQ ID NO: 18147 - DNA, 21 bp, Artificial sequence
  SiRNA target sequence
atatcttggaatactagtgct

SEQ ID NO: 18148 - DNA, 21 bp, Artificial sequence
  SiRNA target sequence
tatcttggaatactagtgctg

SEQ ID NO: 18149 - DNA, 21 bp, Artificial sequence
  SiRNA target sequence
atcttggaatactagtgctgg

SEQ ID NO: 18150 - DNA, 21 bp, Artificial sequence
  SiRNA target sequence
tcttggaatactagtgctggt

SEQ ID NO: 18151 - DNA, 21 bp, Artificial sequence
  SiRNA target sequence
cttggaatactagtgctggtt

SEQ ID NO: 18152 - DNA, 21 bp, Artificial sequence
  SiRNA target sequence
ttggaatactagtgctggttt

SEQ ID NO: 18153 - DNA, 21 bp, Artificial sequence
  SiRNA target sequence
tggaatactagtgctggtttt

SEQ ID NO: 18154 - DNA, 21 bp, Artificial sequence
  SiRNA target sequence
ggaatactagtgctggttttc

SEQ ID NO: 18155 - DNA, 21 bp, Artificial sequence
  SiRNA target sequence
gaatactagtgctggttttcc

SEQ ID NO: 18156 - DNA, 21 bp, Artificial sequence
  SiRNA target sequence
aatactagtgctggttttcct

SEQ ID NO: 18157 - DNA, 21 bp, Artificial sequence
  SiRNA target sequence
atactagtgctggttttcctt

SEQ ID NO: 18158 - DNA, 21 bp, Artificial sequence
  SiRNA target sequence
tactagtgctggttttccttt

SEQ ID NO: 18159 - DNA, 21 bp, Artificial sequence
  SiRNA target sequence
actagtgctggttttcctttg

SEQ ID NO: 18160 - DNA, 21 bp, Artificial sequence
  SiRNA target sequence
ctagtgctggttttcctttgt

SEQ ID NO: 18161 - DNA, 21 bp, Artificial sequence
  SiRNA target sequence
tagtgctggttttcctttgtc

SEQ ID NO: 18162 - DNA, 21 bp, Artificial sequence
  SiRNA target sequence
agtgctggttttcctttgtct

SEQ ID NO: 18163 - DNA, 21 bp, Artificial sequence
  SiRNA target sequence
gtgctggttttcctttgtctt

SEQ ID NO: 18164 - DNA, 21 bp, Artificial sequence
  SiRNA target sequence
tgctggttttcctttgtcttc

SEQ ID NO: 18165 - DNA, 21 bp, Artificial sequence
  SiRNA target sequence
gctggttttcctttgtcttca

SEQ ID NO: 18166 - DNA, 21 bp, Artificial sequence
  SiRNA target sequence
ctggttttcctttgtcttcat

SEQ ID NO: 18167 - DNA, 21 bp, Artificial sequence
  SiRNA target sequence
tggttttcctttgtcttcatt

SEQ ID NO: 18168 - DNA, 21 bp, Artificial sequence
  SiRNA target sequence
ggttttcctttgtcttcatta

SEQ ID NO: 18169 - DNA, 21 bp, Artificial sequence
  SiRNA target sequence
gttttcctttgtcttcattaa

SEQ ID NO: 18170 - DNA, 21 bp, Artificial sequence
  SiRNA target sequence
ttttcctttgtcttcattaaa

SEQ ID NO: 18171 - DNA, 21 bp, Artificial sequence
  SiRNA target sequence
tttcctttgtcttcattaaag

SEQ ID NO: 18172 - DNA, 21 bp, Artificial sequence
  SiRNA target sequence
ttcctttgtcttcattaaagc

SEQ ID NO: 18173 - DNA, 21 bp, Artificial sequence
  SiRNA target sequence
tcctttgtcttcattaaagcc

SEQ ID NO: 18174 - DNA, 21 bp, Artificial sequence
  SiRNA target sequence
cctttgtcttcattaaagcca

SEQ ID NO: 18175 - DNA, 21 bp, Artificial sequence
  SiRNA target sequence
ctttgtcttcattaaagccac

SEQ ID NO: 18176 - DNA, 21 bp, Artificial sequence
  SiRNA target sequence
tttgtcttcattaaagccacc

SEQ ID NO: 18177 - DNA, 21 bp, Artificial sequence
  SiRNA target sequence
ttgtcttcattaaagccacct

SEQ ID NO: 18178 - DNA, 21 bp, Artificial sequence
  SiRNA target sequence
tgtcttcattaaagccacctg

SEQ ID NO: 18179 - DNA, 21 bp, Artificial sequence
  SiRNA target sequence
gtcttcattaaagccacctgg

SEQ ID NO: 18180 - DNA, 21 bp, Artificial sequence
  SiRNA target sequence
tcttcattaaagccacctgga

SEQ ID NO: 18181 - DNA, 21 bp, Artificial sequence
  SiRNA target sequence
cttcattaaagccacctggaa

SEQ ID NO: 18182 - DNA, 21 bp, Artificial sequence
  SiRNA target sequence
ttcattaaagccacctggaac

SEQ ID NO: 18183 - DNA, 21 bp, Artificial sequence
  SiRNA target sequence
tcattaaagccacctggaaca

SEQ ID NO: 18184 - DNA, 21 bp, Artificial sequence
  SiRNA target sequence
cattaaagccacctggaacat

SEQ ID NO: 18185 - DNA, 21 bp, Artificial sequence
  SiRNA target sequence
attaaagccacctggaacatc

SEQ ID NO: 18186 - DNA, 21 bp, Artificial sequence
  SiRNA target sequence
ttaaagccacctggaacatca

SEQ ID NO: 18187 - DNA, 21 bp, Artificial sequence
  SiRNA target sequence
taaagccacctggaacatcag

SEQ ID NO: 18188 - DNA, 21 bp, Artificial sequence
  SiRNA target sequence
aaagccacctggaacatcagg

SEQ ID NO: 18189 - DNA, 21 bp, Artificial sequence
  SiRNA target sequence
  misc_feature (21)..(21): n is a, c, g, or t
aagccacctggaacatcaggn

SEQ ID NO: 18190 - DNA, 21 bp, Artificial sequence
  SiRNA target sequence
  misc_feature (20)..(20): n is a, c, g, or t
agccacctggaacatcaggna

SEQ ID NO: 18191 - DNA, 21 bp, Artificial sequence
  SiRNA target sequence
  misc_feature (19)..(19): n is a, c, g, or t
gccacctggaacatcaggnaa

SEQ ID NO: 18192 - DNA, 21 bp, Artificial sequence
  SiRNA target sequence
  misc_feature (18)..(18): n is a, c, g, or t
ccacctggaacatcaggnaag

SEQ ID NO: 18193 - DNA, 21 bp, Artificial sequence
  SiRNA target sequence
  misc_feature (17)..(17): n is a, c, g, or t
cacctggaacatcaggnaagc

SEQ ID NO: 18194 - DNA, 21 bp, Artificial sequence
  SiRNA target sequence
  misc_feature (16)..(16): n is a, c, g, or t
acctggaacatcaggnaagcg

SEQ ID NO: 18195 - DNA, 21 bp, Artificial sequence
  SiRNA target sequence
  misc_feature (15)..(15): n is a, c, g, or t
cctggaacatcaggnaagcga

SEQ ID NO: 18196 - DNA, 21 bp, Artificial sequence
  SiRNA target sequence
  misc_feature (14)..(14): n is a, c, g, or t
ctggaacatcaggnaagcgat

SEQ ID NO: 18197 - DNA, 21 bp, Artificial sequence
  SiRNA target sequence
  misc_feature (13)..(13): n is a, c, g, or t
tggaacatcaggnaagcgatg

SEQ ID NO: 18198 - DNA, 21 bp, Artificial sequence
  SiRNA target sequence
  misc_feature (12)..(12): n is a, c, g, or t
ggaacatcaggnaagcgatgg

SEQ ID NO: 18199 - DNA, 21 bp, Artificial sequence
  SiRNA target sequence
  misc_feature (11)..(11): n is a, c, g, or t
gaacatcaggnaagcgatggt

SEQ ID NO: 18200 - DNA, 21 bp, Artificial sequence
  SiRNA target sequence
  misc_feature (10)..(10): n is a, c, g, or t
aacatcaggnaagcgatggtt

SEQ ID NO: 18201 - DNA, 21 bp, Artificial sequence
  SiRNA target sequence
  misc_feature (9)..(9): n is a, c, g, or t
acatcaggnaagcgatggttg

SEQ ID NO: 18202 - DNA, 21 bp, Artificial sequence
  SiRNA target sequence
  misc_feature (8)..(8): n is a, c, g, or t
catcaggnaagcgatggttgt

SEQ ID NO: 18203 - DNA, 21 bp, Artificial sequence
  SiRNA target sequence
  misc_feature (7)..(7): n is a, c, g, or t
atcaggnaagcgatggttgtt

SEQ ID NO: 18204 - DNA, 21 bp, Artificial sequence
  SiRNA target sequence
  misc_feature (6)..(6): n is a, c, g, or t
tcaggnaagcgatggttgttt

SEQ ID NO: 18205 - DNA, 21 bp, Artificial sequence
  SiRNA target sequence
  misc_feature (5)..(5): n is a, c, g, or t
caggnaagcgatggttgtttg

SEQ ID NO: 18206 - DNA, 21 bp, Artificial sequence
  SiRNA target sequence
  misc_feature (4)..(4): n is a, c, g, or t
aggnaagcgatggttgtttga

SEQ ID NO: 18207 - DNA, 21 bp, Artificial sequence
  SiRNA target sequence
  misc_feature (3)..(3): n is a, c, g, or t
  misc_feature (21)..(21): n is a, c, g, or t
ggnaagcgatggttgtttgan

SEQ ID NO: 18208 - DNA, 21 bp, Artificial sequence
  SiRNA target sequence
  misc_feature (2)..(2): n is a, c, g, or t
  misc_feature (20)..(20): n is a, c, g, or t
gnaagcgatggttgtttgana

SEQ ID NO: 18209 - DNA, 21 bp, Artificial sequence
  SiRNA target sequence
  misc_feature (1)..(1): n is a, c, g, or t
  misc_feature (19)..(19): n is a, c, g, or t
naagcgatggttgtttganat

SEQ ID NO: 18210 - DNA, 21 bp, Artificial sequence
  SiRNA target sequence
  misc_feature (18)..(18): n is a, c, g, or t
aagcgatggttgtttganatt

SEQ ID NO: 18211 - DNA, 21 bp, Artificial sequence
  SiRNA target sequence
  misc_feature (17)..(17): n is a, c, g, or t
agcgatggttgtttganattg

SEQ ID NO: 18212 - DNA, 21 bp, Artificial sequence
  SiRNA target sequence
  misc_feature (16)..(16): n is a, c, g, or t
gcgatggttgtttganattga

SEQ ID NO: 18213 - DNA, 21 bp, Artificial sequence
  SiRNA target sequence
  misc_feature (15)..(15): n is a, c, g, or t
cgatggttgtttganattgag

SEQ ID NO: 18214 - DNA, 21 bp, Artificial sequence
  SiRNA target sequence
  misc_feature (14)..(14): n is a, c, g, or t
gatggttgtttganattgagc

SEQ ID NO: 18215 - DNA, 21 bp, Artificial sequence
  SiRNA target sequence
  misc_feature (13)..(13): n is a, c, g, or t
atggttgtttganattgagct

SEQ ID NO: 18216 - DNA, 21 bp, Artificial sequence
  SiRNA target sequence
  misc_feature (12)..(12): n is a, c, g, or t
tggttgtttganattgagcta

SEQ ID NO: 18217 - DNA, 21 bp, Artificial sequence
  SiRNA target sequence
  misc_feature (11)..(11): n is a, c, g, or t
ggttgtttganattgagctac

SEQ ID NO: 18218 - DNA, 21 bp, Artificial sequence
  SiRNA target sequence
  misc_feature (10)..(10): n is a, c, g, or t
gttgtttganattgagctaca

SEQ ID NO: 18219 - DNA, 21 bp, Artificial sequence
  SiRNA target sequence
  misc_feature (9)..(9): n is a, c, g, or t
ttgtttganattgagctacaa

SEQ ID NO: 18220 - DNA, 21 bp, Artificial sequence
  SiRNA target sequence
  misc_feature (8)..(8): n is a, c, g, or t
tgtttganattgagctacaag

SEQ ID NO: 18221 - DNA, 21 bp, Artificial sequence
  SiRNA target sequence
  misc_feature (7)..(7): n is a, c, g, or t
gtttganattgagctacaaga

SEQ ID NO: 18222 - DNA, 21 bp, Artificial sequence
  SiRNA target sequence
  misc_feature (6)..(6): n is a, c, g, or t
  misc_feature (21)..(21): n is a, c, g, or t
tttganattgagctacaagan

SEQ ID NO: 18223 - DNA, 21 bp, Artificial sequence
  SiRNA target sequence
  misc_feature (5)..(5): n is a, c, g, or t
  misc_feature (20)..(20): n is a, c, g, or t
ttganattgagctacaagant

SEQ ID NO: 18224 - DNA, 21 bp, Artificial sequence
  SiRNA target sequence
  misc_feature (4)..(4): n is a, c, g, or t
  misc_feature (19)..(19): n is a, c, g, or t
tganattgagctacaagantc

SEQ ID NO: 18225 - DNA, 21 bp, Artificial sequence
  SiRNA target sequence
  misc_feature (3)..(3): n is a, c, g, or t
  misc_feature (18)..(18): n is a, c, g, or t
ganattgagctacaagantcg

SEQ ID NO: 18226 - DNA, 21 bp, Artificial sequence
  SiRNA target sequence
  misc_feature (2)..(2): n is a, c, g, or t
  misc_feature (17)..(17): n is a, c, g, or t
anattgagctacaagantcgg

SEQ ID NO: 18227 - DNA, 21 bp, Artificial sequence
  SiRNA target sequence
  misc_feature (1)..(1): n is a, c, g, or t
  misc_feature (16)..(16): n is a, c, g, or t
nattgagctacaagantcggg

SEQ ID NO: 18228 - DNA, 21 bp, Artificial sequence
  SiRNA target sequence
  misc_feature (15)..(15): n is a, c, g, or t
attgagctacaagantcggga

SEQ ID NO: 18229 - DNA, 21 bp, Artificial sequence
  SiRNA target sequence
  misc_feature (14)..(14): n is a, c, g, or t
ttgagctacaagantcgggat

SEQ ID NO: 18230 - DNA, 21 bp, Artificial sequence
  SiRNA target sequence
  misc_feature (13)..(13): n is a, c, g, or t
tgagctacaagantcgggatg

SEQ ID NO: 18231 - DNA, 21 bp, Artificial sequence
  SiRNA target sequence
  misc_feature (12)..(12): n is a, c, g, or t
gagctacaagantcgggatgt

SEQ ID NO: 18232 - DNA, 21 bp, Artificial sequence
  SiRNA target sequence
  misc_feature (11)..(11): n is a, c, g, or t
agctacaagantcgggatgtt

SEQ ID NO: 18233 - DNA, 21 bp, Artificial sequence
  SiRNA target sequence
  misc_feature (10)..(10): n is a, c, g, or t
gctacaagantcgggatgtta

SEQ ID NO: 18234 - DNA, 21 bp, Artificial sequence
  SiRNA target sequence
  misc_feature (9)..(9): n is a, c, g, or t
ctacaagantcgggatgttat

SEQ ID NO: 18235 - DNA, 21 bp, Artificial sequence
  SiRNA target sequence
  misc_feature (8)..(8): n is a, c, g, or t
tacaagantcgggatgttatc

SEQ ID NO: 18236 - DNA, 21 bp, Artificial sequence
  SiRNA target sequence
  misc_feature (7)..(7): n is a, c, g, or t
acaagantcgggatgttatct

SEQ ID NO: 18237 - DNA, 21 bp, Artificial sequence
  SiRNA target sequence
  misc_feature (6)..(6): n is a, c, g, or t
caagantcgggatgttatctc

SEQ ID NO: 18238 - DNA, 21 bp, Artificial sequence
  SiRNA target sequence
  misc_feature (5)..(5): n is a, c, g, or t
  misc_feature (21)..(21): n is a, c, g, or t
aagantcgggatgttatctcn

SEQ ID NO: 18239 - DNA, 21 bp, Artificial sequence
  SiRNA target sequence
  misc_feature (4)..(4): n is a, c, g, or t
  misc_feature (20)..(20): n is a, c, g, or t
agantcgggatgttatctcnt

SEQ ID NO: 18240 - DNA, 21 bp, Artificial sequence
  SiRNA target sequence
  misc_feature (3)..(3): n is a, c, g, or t
  misc_feature (19)..(19): n is a, c, g, or t
gantcgggatgttatctcntg

SEQ ID NO: 18241 - DNA, 21 bp, Artificial sequence
  SiRNA target sequence
  misc_feature (2)..(2): n is a, c, g, or t
  misc_feature (18)..(18): n is a, c, g, or t
antcgggatgttatctcntgc

SEQ ID NO: 18242 - DNA, 21 bp, Artificial sequence
  SiRNA target sequence
  misc_feature (1)..(1): n is a, c, g, or t
  misc_feature (17)..(17): n is a, c, g, or t
ntcgggatgttatctcntgcg

SEQ ID NO: 18243 - DNA, 21 bp, Artificial sequence
  SiRNA target sequence
  misc_feature (16)..(16): n is a, c, g, or t
tcgggatgttatctcntgcgt

SEQ ID NO: 18244 - DNA, 21 bp, Artificial sequence
  SiRNA target sequence
  misc_feature (15)..(15): n is a, c, g, or t
cgggatgttatctcntgcgtg

SEQ ID NO: 18245 - DNA, 21 bp, Artificial sequence
  SiRNA target sequence
  misc_feature (14)..(14): n is a, c, g, or t
gggatgttatctcntgcgtgg

SEQ ID NO: 18246 - DNA, 21 bp, Artificial sequence
  SiRNA target sequence
  misc_feature (13)..(13): n is a, c, g, or t
ggatgttatctcntgcgtgga

SEQ ID NO: 18247 - DNA, 21 bp, Artificial sequence
  SiRNA target sequence
  misc_feature (12)..(12): n is a, c, g, or t
gatgttatctcntgcgtggaa

SEQ ID NO: 18248 - DNA, 21 bp, Artificial sequence
  SiRNA target sequence
  misc_feature (11)..(11): n is a, c, g, or t
atgttatctcntgcgtggaat

SEQ ID NO: 18249 - DNA, 21 bp, Artificial sequence
  SiRNA target sequence
  misc_feature (10)..(10): n is a, c, g, or t
tgttatctcntgcgtggaatg

SEQ ID NO: 18250 - DNA, 21 bp, Artificial sequence
  SiRNA target sequence
  misc_feature (9)..(9): n is a, c, g, or t
gttatctcntgcgtggaatgc

SEQ ID NO: 18251 - DNA, 21 bp, Artificial sequence
  SiRNA target sequence
  misc_feature (8)..(8): n is a, c, g, or t
ttatctcntgcgtggaatgcg

SEQ ID NO: 18252 - DNA, 21 bp, Artificial sequence
  SiRNA target sequence
  misc_feature (7)..(7): n is a, c, g, or t
tatctcntgcgtggaatgcgt

SEQ ID NO: 18253 - DNA, 21 bp, Artificial sequence
  SiRNA target sequence
  misc_feature (6)..(6): n is a, c, g, or t
atctcntgcgtggaatgcgtc

SEQ ID NO: 18254 - DNA, 21 bp, Artificial sequence
  SiRNA target sequence
  misc_feature (5)..(5): n is a, c, g, or t
tctcntgcgtggaatgcgtcc

SEQ ID NO: 18255 - DNA, 21 bp, Artificial sequence
  SiRNA target sequence
  misc_feature (4)..(4): n is a, c, g, or t
ctcntgcgtggaatgcgtccc

SEQ ID NO: 18256 - DNA, 21 bp, Artificial sequence
  SiRNA target sequence
  misc_feature (3)..(3): n is a, c, g, or t
tcntgcgtggaatgcgtcccg

SEQ ID NO: 18257 - DNA, 21 bp, Artificial sequence
  SiRNA target sequence
  misc_feature (2)..(2): n is a, c, g, or t
cntgcgtggaatgcgtcccga

SEQ ID NO: 18258 - DNA, 21 bp, Artificial sequence
  SiRNA target sequence
  misc_feature (1)..(1): n is a, c, g, or t
ntgcgtggaatgcgtcccgaa

SEQ ID NO: 18259 - DNA, 21 bp, Artificial sequence
  SiRNA target sequence
tgcgtggaatgcgtcccgaac

SEQ ID NO: 18260 - DNA, 21 bp, Artificial sequence
  SiRNA target sequence
gcgtggaatgcgtcccgaact

SEQ ID NO: 18261 - DNA, 21 bp, Artificial sequence
  SiRNA target sequence
cgtggaatgcgtcccgaactt

SEQ ID NO: 18262 - DNA, 21 bp, Artificial sequence
  SiRNA target sequence
gtggaatgcgtcccgaacttg

SEQ ID NO: 18263 - DNA, 21 bp, Artificial sequence
  SiRNA target sequence
tggaatgcgtcccgaacttga

SEQ ID NO: 18264 - DNA, 21 bp, Artificial sequence
  SiRNA target sequence
ggaatgcgtcccgaacttgag

SEQ ID NO: 18265 - DNA, 21 bp, Artificial sequence
  SiRNA target sequence
gaatgcgtcccgaacttgaga

SEQ ID NO: 18266 - DNA, 21 bp, Artificial sequence
  SiRNA target sequence
aatgcgtcccgaacttgagat

SEQ ID NO: 18267 - DNA, 21 bp, Artificial sequence
  SiRNA target sequence
atgcgtcccgaacttgagatt

SEQ ID NO: 18268 - DNA, 21 bp, Artificial sequence
  SiRNA target sequence
tgcgtcccgaacttgagattc

SEQ ID NO: 18269 - DNA, 21 bp, Artificial sequence
  SiRNA target sequence
gcgtcccgaacttgagattca

SEQ ID NO: 18270 - DNA, 21 bp, Artificial sequence
  SiRNA target sequence
cgtcccgaacttgagattcaa

SEQ ID NO: 18271 - DNA, 21 bp, Artificial sequence
  SiRNA target sequence
gtcccgaacttgagattcaat

SEQ ID NO: 18272 - DNA, 21 bp, Artificial sequence
  SiRNA target sequence
tcccgaacttgagattcaatt

SEQ ID NO: 18273 - DNA, 21 bp, Artificial sequence
  SiRNA target sequence
cccgaacttgagattcaatta

SEQ ID NO: 18274 - DNA, 21 bp, Artificial sequence
  SiRNA target sequence
ccgaacttgagattcaattat

SEQ ID NO: 18275 - DNA, 21 bp, Artificial sequence
  SiRNA target sequence
cgaacttgagattcaattatc

SEQ ID NO: 18276 - DNA, 21 bp, Artificial sequence
  SiRNA target sequence
gaacttgagattcaattatca

SEQ ID NO: 18277 - DNA, 21 bp, Artificial sequence
  SiRNA target sequence
aacttgagattcaattatcaa

SEQ ID NO: 18278 - DNA, 21 bp, Artificial sequence
  SiRNA target sequence
acttgagattcaattatcaac

SEQ ID NO: 18279 - DNA, 21 bp, Artificial sequence
  SiRNA target sequence
cttgagattcaattatcaacg

SEQ ID NO: 18280 - DNA, 21 bp, Artificial sequence
  SiRNA target sequence
ttgagattcaattatcaacga

SEQ ID NO: 18281 - DNA, 21 bp, Artificial sequence
  SiRNA target sequence
tgagattcaattatcaacgac

SEQ ID NO: 18282 - DNA, 21 bp, Artificial sequence
  SiRNA target sequence
gagattcaattatcaacgaca

SEQ ID NO: 18283 - DNA, 21 bp, Artificial sequence
  SiRNA target sequence
agattcaattatcaacgacac

SEQ ID NO: 18284 - DNA, 21 bp, Artificial sequence
  SiRNA target sequence
gattcaattatcaacgacaca

SEQ ID NO: 18285 - DNA, 21 bp, Artificial sequence
  SiRNA target sequence
attcaattatcaacgacacag

SEQ ID NO: 18286 - DNA, 21 bp, Artificial sequence
  SiRNA target sequence
ttcaattatcaacgacacagt

SEQ ID NO: 18287 - DNA, 21 bp, Artificial sequence
  SiRNA target sequence
tcaattatcaacgacacagtt

SEQ ID NO: 18288 - DNA, 21 bp, Artificial sequence
  SiRNA target sequence
caattatcaacgacacagtta

SEQ ID NO: 18289 - DNA, 21 bp, Artificial sequence
  SiRNA target sequence
aattatcaacgacacagttaa

SEQ ID NO: 18290 - DNA, 21 bp, Artificial sequence
  SiRNA target sequence
attatcaacgacacagttaat

SEQ ID NO: 18291 - DNA, 21 bp, Artificial sequence
  SiRNA target sequence
ttatcaacgacacagttaatg

SEQ ID NO: 18292 - DNA, 21 bp, Artificial sequence
  SiRNA target sequence
tatcaacgacacagttaatga

SEQ ID NO: 18293 - DNA, 21 bp, Artificial sequence
  SiRNA target sequence
atcaacgacacagttaatgag

SEQ ID NO: 18294 - DNA, 21 bp, Artificial sequence
  SiRNA target sequence
tcaacgacacagttaatgagg

SEQ ID NO: 18295 - DNA, 21 bp, Artificial sequence
  SiRNA target sequence
caacgacacagttaatgagga

SEQ ID NO: 18296 - DNA, 21 bp, Artificial sequence
  SiRNA target sequence
aacgacacagttaatgaggaa

SEQ ID NO: 18297 - DNA, 21 bp, Artificial sequence
  SiRNA target sequence
acgacacagttaatgaggaaa

SEQ ID NO: 18298 - DNA, 21 bp, Artificial sequence
  SiRNA target sequence
cgacacagttaatgaggaaaa

SEQ ID NO: 18299 - DNA, 21 bp, Artificial sequence
  SiRNA target sequence
gacacagttaatgaggaaaaa

SEQ ID NO: 18300 - DNA, 21 bp, Artificial sequence
  SiRNA target sequence
acacagttaatgaggaaaaag

SEQ ID NO: 18301 - DNA, 21 bp, Artificial sequence
  SiRNA target sequence
cacagttaatgaggaaaaagg

SEQ ID NO: 18302 - DNA, 21 bp, Artificial sequence
  SiRNA target sequence
acagttaatgaggaaaaaggg

SEQ ID NO: 18303 - DNA, 21 bp, Artificial sequence
  SiRNA target sequence
cagttaatgaggaaaaaggga

SEQ ID NO: 18304 - DNA, 21 bp, Artificial sequence
  SiRNA target sequence
agttaatgaggaaaaagggaa

SEQ ID NO: 18305 - DNA, 21 bp, Artificial sequence
  SiRNA target sequence
gttaatgaggaaaaagggaat

SEQ ID NO: 18306 - DNA, 21 bp, Artificial sequence
  SiRNA target sequence
ttaatgaggaaaaagggaata

SEQ ID NO: 18307 - DNA, 21 bp, Artificial sequence
  SiRNA target sequence
taatgaggaaaaagggaataa

SEQ ID NO: 18308 - DNA, 21 bp, Artificial sequence
  SiRNA target sequence
aatgaggaaaaagggaataaa

SEQ ID NO: 18309 - DNA, 21 bp, Artificial sequence
  SiRNA target sequence
atgaggaaaaagggaataaaa

SEQ ID NO: 18310 - DNA, 21 bp, Artificial sequence
  SiRNA target sequence
tgaggaaaaagggaataaaac

SEQ ID NO: 18311 - DNA, 21 bp, Artificial sequence
  SiRNA target sequence
gaggaaaaagggaataaaacc

SEQ ID NO: 18312 - DNA, 21 bp, Artificial sequence
  SiRNA target sequence
aggaaaaagggaataaaacct

SEQ ID NO: 18313 - DNA, 21 bp, Artificial sequence
  SiRNA target sequence
ggaaaaagggaataaaacctc

SEQ ID NO: 18314 - DNA, 21 bp, Artificial sequence
  SiRNA target sequence
gaaaaagggaataaaacctca

SEQ ID NO: 18315 - DNA, 21 bp, Artificial sequence
  SiRNA target sequence
aaaaagggaataaaacctcac

SEQ ID NO: 18316 - DNA, 21 bp, Artificial sequence
  SiRNA target sequence
aaaagggaataaaacctcaca

SEQ ID NO: 18317 - DNA, 21 bp, Artificial sequence
  SiRNA target sequence
aaagggaataaaacctcacac

SEQ ID NO: 18318 - DNA, 21 bp, Artificial sequence
  SiRNA target sequence
aagggaataaaacctcacact

SEQ ID NO: 18319 - DNA, 21 bp, Artificial sequence
  SiRNA target sequence
agggaataaaacctcacacta

SEQ ID NO: 18320 - DNA, 21 bp, Artificial sequence
  SiRNA target sequence
gggaataaaacctcacactat

SEQ ID NO: 18321 - DNA, 21 bp, Artificial sequence
  SiRNA target sequence
ggaataaaacctcacactata

SEQ ID NO: 18322 - DNA, 21 bp, Artificial sequence
  SiRNA target sequence
gaataaaacctcacactatat

SEQ ID NO: 18323 - DNA, 21 bp, Artificial sequence
  SiRNA target sequence
aataaaacctcacactatatt

SEQ ID NO: 18324 - DNA, 21 bp, Artificial sequence
  SiRNA target sequence
ataaaacctcacactatattc

SEQ ID NO: 18325 - DNA, 21 bp, Artificial sequence
  SiRNA target sequence
taaaacctcacactatattca

SEQ ID NO: 18326 - DNA, 21 bp, Artificial sequence
  SiRNA target sequence
aaaacctcacactatattcac

SEQ ID NO: 18327 - DNA, 21 bp, Artificial sequence
  SiRNA target sequence
aaacctcacactatattcacg

SEQ ID NO: 18328 - DNA, 21 bp, Artificial sequence
  SiRNA target sequence
aacctcacactatattcacgg

SEQ ID NO: 18329 - DNA, 21 bp, Artificial sequence
  SiRNA target sequence
acctcacactatattcacgga

SEQ ID NO: 18330 - DNA, 21 bp, Artificial sequence
  SiRNA target sequence
cctcacactatattcacggat

SEQ ID NO: 18331 - DNA, 21 bp, Artificial sequence
  SiRNA target sequence
ctcacactatattcacggatt

SEQ ID NO: 18332 - DNA, 21 bp, Artificial sequence
  SiRNA target sequence
tcacactatattcacggattg

SEQ ID NO: 18333 - DNA, 21 bp, Artificial sequence
  SiRNA target sequence
cacactatattcacggattgt

SEQ ID NO: 18334 - DNA, 21 bp, Artificial sequence
  SiRNA target sequence
acactatattcacggattgtt

SEQ ID NO: 18335 - DNA, 21 bp, Artificial sequence
  SiRNA target sequence
cactatattcacggattgttt

SEQ ID NO: 18336 - DNA, 21 bp, Artificial sequence
  SiRNA target sequence
actatattcacggattgtttg

SEQ ID NO: 18337 - DNA, 21 bp, Artificial sequence
  SiRNA target sequence
ctatattcacggattgtttga

SEQ ID NO: 18338 - DNA, 21 bp, Artificial sequence
  SiRNA target sequence
tatattcacggattgtttgaa

SEQ ID NO: 18339 - DNA, 21 bp, Artificial sequence
  SiRNA target sequence
atattcacggattgtttgaaa

SEQ ID NO: 18340 - DNA, 21 bp, Artificial sequence
  SiRNA target sequence
tattcacggattgtttgaaag

SEQ ID NO: 18341 - DNA, 21 bp, Artificial sequence
  SiRNA target sequence
attcacggattgtttgaaaga

SEQ ID NO: 18342 - DNA, 21 bp, Artificial sequence
  SiRNA target sequence
ttcacggattgtttgaaagat

SEQ ID NO: 18343 - DNA, 21 bp, Artificial sequence
  SiRNA target sequence
tcacggattgtttgaaagata

SEQ ID NO: 18344 - DNA, 21 bp, Artificial sequence
  SiRNA target sequence
cacggattgtttgaaagatac

SEQ ID NO: 18345 - DNA, 21 bp, Artificial sequence
  SiRNA target sequence
acggattgtttgaaagatact

SEQ ID NO: 18346 - DNA, 21 bp, Artificial sequence
  SiRNA target sequence
cggattgtttgaaagatactt

SEQ ID NO: 18347 - DNA, 21 bp, Artificial sequence
  SiRNA target sequence
ggattgtttgaaagatacttg

SEQ ID NO: 18348 - DNA, 21 bp, Artificial sequence
  SiRNA target sequence
gattgtttgaaagatacttgt

SEQ ID NO: 18349 - DNA, 21 bp, Artificial sequence
  SiRNA target sequence
attgtttgaaagatacttgtt

SEQ ID NO: 18350 - DNA, 21 bp, Artificial sequence
  SiRNA target sequence
ttgtttgaaagatacttgttt

SEQ ID NO: 18351 - DNA, 21 bp, Artificial sequence
  SiRNA target sequence
tgtttgaaagatacttgtttg

SEQ ID NO: 18352 - DNA, 21 bp, Artificial sequence
  SiRNA target sequence
gtttgaaagatacttgtttgc

SEQ ID NO: 18353 - DNA, 21 bp, Artificial sequence
  SiRNA target sequence
tttgaaagatacttgtttgcc

SEQ ID NO: 18354 - DNA, 21 bp, Artificial sequence
  SiRNA target sequence
ttgaaagatacttgtttgcct

SEQ ID NO: 18355 - DNA, 21 bp, Artificial sequence
  SiRNA target sequence
tgaaagatacttgtttgcctg

SEQ ID NO: 18356 - DNA, 21 bp, Artificial sequence
  SiRNA target sequence
gaaagatacttgtttgcctgt

SEQ ID NO: 18357 - DNA, 21 bp, Artificial sequence
  SiRNA target sequence
aaagatacttgtttgcctgtt

SEQ ID NO: 18358 - DNA, 21 bp, Artificial sequence
  SiRNA target sequence
aagatacttgtttgcctgttg

SEQ ID NO: 18359 - DNA, 21 bp, Artificial sequence
  SiRNA target sequence
agatacttgtttgcctgttga

SEQ ID NO: 18360 - DNA, 21 bp, Artificial sequence
  SiRNA target sequence
gatacttgtttgcctgttgaa

SEQ ID NO: 18361 - DNA, 21 bp, Artificial sequence
  SiRNA target sequence
atacttgtttgcctgttgaaa

SEQ ID NO: 18362 - DNA, 21 bp, Artificial sequence
  SiRNA target sequence
tacttgtttgcctgttgaaaa

SEQ ID NO: 18363 - DNA, 21 bp, Artificial sequence
  SiRNA target sequence
acttgtttgcctgttgaaaaa

SEQ ID NO: 18364 - DNA, 21 bp, Artificial sequence
  SiRNA target sequence
cttgtttgcctgttgaaaaat

SEQ ID NO: 18365 - DNA, 21 bp, Artificial sequence
  SiRNA target sequence
ttgtttgcctgttgaaaaatg

SEQ ID NO: 18366 - DNA, 21 bp, Artificial sequence
  SiRNA target sequence
tgtttgcctgttgaaaaatgt

SEQ ID NO: 18367 - DNA, 21 bp, Artificial sequence
  SiRNA target sequence
gtttgcctgttgaaaaatgta

SEQ ID NO: 18368 - DNA, 21 bp, Artificial sequence
  SiRNA target sequence
tttgcctgttgaaaaatgtag

SEQ ID NO: 18369 - DNA, 21 bp, Artificial sequence
  SiRNA target sequence
ttgcctgttgaaaaatgtaga

SEQ ID NO: 18370 - DNA, 21 bp, Artificial sequence
  SiRNA target sequence
tgcctgttgaaaaatgtagaa

SEQ ID NO: 18371 - DNA, 21 bp, Artificial sequence
  SiRNA target sequence
gcctgttgaaaaatgtagaat

SEQ ID NO: 18372 - DNA, 21 bp, Artificial sequence
  SiRNA target sequence
cctgttgaaaaatgtagaata

SEQ ID NO: 18373 - DNA, 21 bp, Artificial sequence
  SiRNA target sequence
ctgttgaaaaatgtagaatac

SEQ ID NO: 18374 - DNA, 21 bp, Artificial sequence
  SiRNA target sequence
tgttgaaaaatgtagaatacc

SEQ ID NO: 18375 - DNA, 21 bp, Artificial sequence
  SiRNA target sequence
gttgaaaaatgtagaatacct

SEQ ID NO: 18376 - DNA, 21 bp, Artificial sequence
  SiRNA target sequence
ttgaaaaatgtagaatacctg

SEQ ID NO: 18377 - DNA, 21 bp, Artificial sequence
  SiRNA target sequence
tgaaaaatgtagaatacctgg

SEQ ID NO: 18378 - DNA, 21 bp, Artificial sequence
  SiRNA target sequence
gaaaaatgtagaatacctggt

SEQ ID NO: 18379 - DNA, 21 bp, Artificial sequence
  SiRNA target sequence
aaaaatgtagaatacctggta

SEQ ID NO: 18380 - DNA, 21 bp, Artificial sequence
  SiRNA target sequence
aaaatgtagaatacctggtaa

SEQ ID NO: 18381 - DNA, 21 bp, Artificial sequence
  SiRNA target sequence
aaatgtagaatacctggtaag

SEQ ID NO: 18382 - DNA, 21 bp, Artificial sequence
  SiRNA target sequence
aatgtagaatacctggtaaga

SEQ ID NO: 18383 - DNA, 21 bp, Artificial sequence
  SiRNA target sequence
atgtagaatacctggtaagac

SEQ ID NO: 18384 - DNA, 21 bp, Artificial sequence
  SiRNA target sequence
tgtagaatacctggtaagact

SEQ ID NO: 18385 - DNA, 21 bp, Artificial sequence
  SiRNA target sequence
gtagaatacctggtaagacta

SEQ ID NO: 18386 - DNA, 21 bp, Artificial sequence
  SiRNA target sequence
tagaatacctggtaagactag

SEQ ID NO: 18387 - DNA, 21 bp, Artificial sequence
  SiRNA target sequence
agaatacctggtaagactaga

SEQ ID NO: 18388 - DNA, 21 bp, Artificial sequence
  SiRNA target sequence
gaatacctggtaagactagaa

SEQ ID NO: 18389 - DNA, 21 bp, Artificial sequence
  SiRNA target sequence
aatacctggtaagactagaat

SEQ ID NO: 18390 - DNA, 21 bp, Artificial sequence
  SiRNA target sequence
atacctggtaagactagaata

SEQ ID NO: 18391 - DNA, 21 bp, Artificial sequence
  SiRNA target sequence
tacctggtaagactagaatat

SEQ ID NO: 18392 - DNA, 21 bp, Artificial sequence
  SiRNA target sequence
acctggtaagactagaatatt

SEQ ID NO: 18393 - DNA, 21 bp, Artificial sequence
  SiRNA target sequence
cctggtaagactagaatattt

SEQ ID NO: 18394 - DNA, 21 bp, Artificial sequence
  SiRNA target sequence
ctggtaagactagaatattta

SEQ ID NO: 18395 - DNA, 21 bp, Artificial sequence
  SiRNA target sequence
tggtaagactagaatatttag

SEQ ID NO: 18396 - DNA, 21 bp, Artificial sequence
  SiRNA target sequence
ggtaagactagaatatttagt

SEQ ID NO: 18397 - DNA, 21 bp, Artificial sequence
  SiRNA target sequence
gtaagactagaatatttagta

SEQ ID NO: 18398 - DNA, 21 bp, Artificial sequence
  SiRNA target sequence
taagactagaatatttagtat

SEQ ID NO: 18399 - DNA, 21 bp, Artificial sequence
  SiRNA target sequence
aagactagaatatttagtata

SEQ ID NO: 18400 - DNA, 21 bp, Artificial sequence
  SiRNA target sequence
agactagaatatttagtataa

SEQ ID NO: 18401 - DNA, 21 bp, Artificial sequence
  SiRNA target sequence
gactagaatatttagtataag

SEQ ID NO: 18402 - DNA, 21 bp, Artificial sequence
  SiRNA target sequence
actagaatatttagtataagt

SEQ ID NO: 18403 - DNA, 21 bp, Artificial sequence
  SiRNA target sequence
ctagaatatttagtataagtc

SEQ ID NO: 18404 - DNA, 21 bp, Artificial sequence
  SiRNA target sequence
tagaatatttagtataagtcc

SEQ ID NO: 18405 - DNA, 21 bp, Artificial sequence
  SiRNA target sequence
agaatatttagtataagtccg

SEQ ID NO: 18406 - DNA, 21 bp, Artificial sequence
  SiRNA target sequence
gaatatttagtataagtccgg

SEQ ID NO: 18407 - DNA, 21 bp, Artificial sequence
  SiRNA target sequence
aatatttagtataagtccggt

SEQ ID NO: 18408 - DNA, 21 bp, Artificial sequence
  SiRNA target sequence
atatttagtataagtccggta

SEQ ID NO: 18409 - DNA, 21 bp, Artificial sequence
  SiRNA target sequence
tatttagtataagtccggtac

SEQ ID NO: 18410 - DNA, 21 bp, Artificial sequence
  SiRNA target sequence
atttagtataagtccggtaca

SEQ ID NO: 18411 - DNA, 21 bp, Artificial sequence
  SiRNA target sequence
tttagtataagtccggtacag

SEQ ID NO: 18412 - DNA, 21 bp, Artificial sequence
  SiRNA target sequence
ttagtataagtccggtacagt

SEQ ID NO: 18413 - DNA, 21 bp, Artificial sequence
  SiRNA target sequence
tagtataagtccggtacagtt

SEQ ID NO: 18414 - DNA, 21 bp, Artificial sequence
  SiRNA target sequence
agtataagtccggtacagttt

SEQ ID NO: 18415 - DNA, 21 bp, Artificial sequence
  SiRNA target sequence
gtataagtccggtacagttta

SEQ ID NO: 18416 - DNA, 21 bp, Artificial sequence
  SiRNA target sequence
tataagtccggtacagtttac

SEQ ID NO: 18417 - DNA, 21 bp, Artificial sequence
  SiRNA target sequence
ataagtccggtacagtttacc

SEQ ID NO: 18418 - DNA, 21 bp, Artificial sequence
  SiRNA target sequence
taagtccggtacagtttacca

SEQ ID NO: 18419 - DNA, 21 bp, Artificial sequence
  SiRNA target sequence
aagtccggtacagtttaccat

SEQ ID NO: 18420 - DNA, 21 bp, Artificial sequence
  SiRNA target sequence
agtccggtacagtttaccata

SEQ ID NO: 18421 - DNA, 21 bp, Artificial sequence
  SiRNA target sequence
gtccggtacagtttaccatac

SEQ ID NO: 18422 - DNA, 21 bp, Artificial sequence
  SiRNA target sequence
tccggtacagtttaccatacc

SEQ ID NO: 18423 - DNA, 21 bp, Artificial sequence
  SiRNA target sequence
ccggtacagtttaccataccg

SEQ ID NO: 18424 - DNA, 21 bp, Artificial sequence
  SiRNA target sequence
cggtacagtttaccataccgt

SEQ ID NO: 18425 - DNA, 21 bp, Artificial sequence
  SiRNA target sequence
ggtacagtttaccataccgtt

SEQ ID NO: 18426 - DNA, 21 bp, Artificial sequence
  SiRNA target sequence
gtacagtttaccataccgttt

SEQ ID NO: 18427 - DNA, 21 bp, Artificial sequence
  SiRNA target sequence
tacagtttaccataccgtttc

SEQ ID NO: 18428 - DNA, 21 bp, Artificial sequence
  SiRNA target sequence
acagtttaccataccgtttcg

SEQ ID NO: 18429 - DNA, 21 bp, Artificial sequence
  SiRNA target sequence
cagtttaccataccgtttcga

SEQ ID NO: 18430 - DNA, 21 bp, Artificial sequence
  SiRNA target sequence
agtttaccataccgtttcgac

SEQ ID NO: 18431 - DNA, 21 bp, Artificial sequence
  SiRNA target sequence
gtttaccataccgtttcgaca

SEQ ID NO: 18432 - DNA, 21 bp, Artificial sequence
  SiRNA target sequence
tttaccataccgtttcgacag

SEQ ID NO: 18433 - DNA, 21 bp, Artificial sequence
  SiRNA target sequence
ttaccataccgtttcgacagt

SEQ ID NO: 18434 - DNA, 21 bp, Artificial sequence
  SiRNA target sequence
taccataccgtttcgacagta

SEQ ID NO: 18435 - DNA, 21 bp, Artificial sequence
  SiRNA target sequence
accataccgtttcgacagtat

SEQ ID NO: 18436 - DNA, 21 bp, Artificial sequence
  SiRNA target sequence
ccataccgtttcgacagtatt

SEQ ID NO: 18437 - DNA, 21 bp, Artificial sequence
  SiRNA target sequence
cataccgtttcgacagtatta

SEQ ID NO: 18438 - DNA, 21 bp, Artificial sequence
  SiRNA target sequence
ataccgtttcgacagtattac

SEQ ID NO: 18439 - DNA, 21 bp, Artificial sequence
  SiRNA target sequence
taccgtttcgacagtattact

SEQ ID NO: 18440 - DNA, 21 bp, Artificial sequence
  SiRNA target sequence
accgtttcgacagtattactt

SEQ ID NO: 18441 - DNA, 21 bp, Artificial sequence
  SiRNA target sequence
ccgtttcgacagtattactta

SEQ ID NO: 18442 - DNA, 21 bp, Artificial sequence
  SiRNA target sequence
cgtttcgacagtattacttag

SEQ ID NO: 18443 - DNA, 21 bp, Artificial sequence
  SiRNA target sequence
gtttcgacagtattacttaga

SEQ ID NO: 18444 - DNA, 21 bp, Artificial sequence
  SiRNA target sequence
tttcgacagtattacttagac

SEQ ID NO: 18445 - DNA, 21 bp, Artificial sequence
  SiRNA target sequence
ttcgacagtattacttagact

SEQ ID NO: 18446 - DNA, 21 bp, Artificial sequence
  SiRNA target sequence
tcgacagtattacttagactt

SEQ ID NO: 18447 - DNA, 21 bp, Artificial sequence
  SiRNA target sequence
cgacagtattacttagacttt

SEQ ID NO: 18448 - DNA, 21 bp, Artificial sequence
  SiRNA target sequence
gacagtattacttagacttta

SEQ ID NO: 18449 - DNA, 21 bp, Artificial sequence
  SiRNA target sequence
acagtattacttagactttat

SEQ ID NO: 18450 - DNA, 21 bp, Artificial sequence
  SiRNA target sequence
cagtattacttagactttatg

SEQ ID NO: 18451 - DNA, 21 bp, Artificial sequence
  SiRNA target sequence
agtattacttagactttatgg

SEQ ID NO: 18452 - DNA, 21 bp, Artificial sequence
  SiRNA target sequence
gtattacttagactttatggc

SEQ ID NO: 18453 - DNA, 21 bp, Artificial sequence
  SiRNA target sequence
tattacttagactttatggca

SEQ ID NO: 18454 - DNA, 21 bp, Artificial sequence
  SiRNA target sequence
attacttagactttatggcat

SEQ ID NO: 18455 - DNA, 21 bp, Artificial sequence
  SiRNA target sequence
ttacttagactttatggcatc

SEQ ID NO: 18456 - DNA, 21 bp, Artificial sequence
  SiRNA target sequence
tacttagactttatggcatcc

SEQ ID NO: 18457 - DNA, 21 bp, Artificial sequence
  SiRNA target sequence
acttagactttatggcatcct

SEQ ID NO: 18458 - DNA, 21 bp, Artificial sequence
  SiRNA target sequence
cttagactttatggcatccta

SEQ ID NO: 18459 - DNA, 21 bp, Artificial sequence
  SiRNA target sequence
ttagactttatggcatcctat

SEQ ID NO: 18460 - DNA, 21 bp, Artificial sequence
  SiRNA target sequence
tagactttatggcatcctatc

SEQ ID NO: 18461 - DNA, 21 bp, Artificial sequence
  SiRNA target sequence
agactttatggcatcctatcg

SEQ ID NO: 18462 - DNA, 21 bp, Artificial sequence
  SiRNA target sequence
gactttatggcatcctatcga

SEQ ID NO: 18463 - DNA, 21 bp, Artificial sequence
  SiRNA target sequence
actttatggcatcctatcgag

SEQ ID NO: 18464 - DNA, 21 bp, Artificial sequence
  SiRNA target sequence
ctttatggcatcctatcgagc

SEQ ID NO: 18465 - DNA, 21 bp, Artificial sequence
  SiRNA target sequence
tttatggcatcctatcgagct

SEQ ID NO: 18466 - DNA, 21 bp, Artificial sequence
  SiRNA target sequence
ttatggcatcctatcgagctg

SEQ ID NO: 18467 - DNA, 21 bp, Artificial sequence
  SiRNA target sequence
tatggcatcctatcgagctgc

SEQ ID NO: 18468 - DNA, 21 bp, Artificial sequence
  SiRNA target sequence
atggcatcctatcgagctgca

SEQ ID NO: 18469 - DNA, 21 bp, Artificial sequence
  SiRNA target sequence
tggcatcctatcgagctgcac

SEQ ID NO: 18470 - DNA, 21 bp, Artificial sequence
  SiRNA target sequence
ggcatcctatcgagctgcacg

SEQ ID NO: 18471 - DNA, 21 bp, Artificial sequence
  SiRNA target sequence
gcatcctatcgagctgcacga

SEQ ID NO: 18472 - DNA, 21 bp, Artificial sequence
  SiRNA target sequence
catcctatcgagctgcacgac

SEQ ID NO: 18473 - DNA, 21 bp, Artificial sequence
  SiRNA target sequence
atcctatcgagctgcacgact

SEQ ID NO: 18474 - DNA, 21 bp, Artificial sequence
  SiRNA target sequence
tcctatcgagctgcacgactt

SEQ ID NO: 18475 - DNA, 21 bp, Artificial sequence
  SiRNA target sequence
cctatcgagctgcacgactta

SEQ ID NO: 18476 - DNA, 21 bp, Artificial sequence
  SiRNA target sequence
ctatcgagctgcacgacttaa

SEQ ID NO: 18477 - DNA, 21 bp, Artificial sequence
  SiRNA target sequence
tatcgagctgcacgacttaat

SEQ ID NO: 18478 - DNA, 21 bp, Artificial sequence
  SiRNA target sequence
atcgagctgcacgacttaatg

SEQ ID NO: 18479 - DNA, 21 bp, Artificial sequence
  SiRNA target sequence
tcgagctgcacgacttaatgc

SEQ ID NO: 18480 - DNA, 21 bp, Artificial sequence
  SiRNA target sequence
cgagctgcacgacttaatgct

SEQ ID NO: 18481 - DNA, 21 bp, Artificial sequence
  SiRNA target sequence
gagctgcacgacttaatgctg

SEQ ID NO: 18482 - DNA, 21 bp, Artificial sequence
  SiRNA target sequence
agctgcacgacttaatgctga

SEQ ID NO: 18483 - DNA, 21 bp, Artificial sequence
  SiRNA target sequence
gctgcacgacttaatgctgag

SEQ ID NO: 18484 - DNA, 21 bp, Artificial sequence
  SiRNA target sequence
ctgcacgacttaatgctgagc

SEQ ID NO: 18485 - DNA, 21 bp, Artificial sequence
  SiRNA target sequence
tgcacgacttaatgctgagca

SEQ ID NO: 18486 - DNA, 21 bp, Artificial sequence
  SiRNA target sequence
gcacgacttaatgctgagcat

SEQ ID NO: 18487 - DNA, 21 bp, Artificial sequence
  SiRNA target sequence
cacgacttaatgctgagcatg

SEQ ID NO: 18488 - DNA, 21 bp, Artificial sequence
  SiRNA target sequence
acgacttaatgctgagcatgg

SEQ ID NO: 18489 - DNA, 21 bp, Artificial sequence
  SiRNA target sequence
cgacttaatgctgagcatggt

SEQ ID NO: 18490 - DNA, 21 bp, Artificial sequence
  SiRNA target sequence
gacttaatgctgagcatggta

SEQ ID NO: 18491 - DNA, 21 bp, Artificial sequence
  SiRNA target sequence
acttaatgctgagcatggtat

SEQ ID NO: 18492 - DNA, 21 bp, Artificial sequence
  SiRNA target sequence
cttaatgctgagcatggtatt

SEQ ID NO: 18493 - DNA, 21 bp, Artificial sequence
  SiRNA target sequence
ttaatgctgagcatggtattg

SEQ ID NO: 18494 - DNA, 21 bp, Artificial sequence
  SiRNA target sequence
taatgctgagcatggtattgg

SEQ ID NO: 18495 - DNA, 21 bp, Artificial sequence
  SiRNA target sequence
aatgctgagcatggtattggt

SEQ ID NO: 18496 - DNA, 21 bp, Artificial sequence
  SiRNA target sequence
atgctgagcatggtattggta

SEQ ID NO: 18497 - DNA, 21 bp, Artificial sequence
  SiRNA target sequence
tgctgagcatggtattggtat

SEQ ID NO: 18498 - DNA, 21 bp, Artificial sequence
  SiRNA target sequence
gctgagcatggtattggtatt

SEQ ID NO: 18499 - DNA, 21 bp, Artificial sequence
  SiRNA target sequence
ctgagcatggtattggtattg

SEQ ID NO: 18500 - DNA, 21 bp, Artificial sequence
  SiRNA target sequence
tgagcatggtattggtattga

SEQ ID NO: 18501 - DNA, 21 bp, Artificial sequence
  SiRNA target sequence
gagcatggtattggtattgat

SEQ ID NO: 18502 - DNA, 21 bp, Artificial sequence
  SiRNA target sequence
agcatggtattggtattgatg

SEQ ID NO: 18503 - DNA, 21 bp, Artificial sequence
  SiRNA target sequence
gcatggtattggtattgatgt

SEQ ID NO: 18504 - DNA, 21 bp, Artificial sequence
  SiRNA target sequence
catggtattggtattgatgtt

SEQ ID NO: 18505 - DNA, 21 bp, Artificial sequence
  SiRNA target sequence
atggtattggtattgatgtta

SEQ ID NO: 18506 - DNA, 21 bp, Artificial sequence
  SiRNA target sequence
tggtattggtattgatgttaa

SEQ ID NO: 18507 - DNA, 21 bp, Artificial sequence
  SiRNA target sequence
ggtattggtattgatgttaac

SEQ ID NO: 18508 - DNA, 21 bp, Artificial sequence
  SiRNA target sequence
gtattggtattgatgttaaca

SEQ ID NO: 18509 - DNA, 21 bp, Artificial sequence
  SiRNA target sequence
tattggtattgatgttaacag

SEQ ID NO: 18510 - DNA, 21 bp, Artificial sequence
  SiRNA target sequence
attggtattgatgttaacagc

SEQ ID NO: 18511 - DNA, 21 bp, Artificial sequence
  SiRNA target sequence
ttggtattgatgttaacagct

SEQ ID NO: 18512 - DNA, 21 bp, Artificial sequence
  SiRNA target sequence
tggtattgatgttaacagctt

SEQ ID NO: 18513 - DNA, 21 bp, Artificial sequence
  SiRNA target sequence
ggtattgatgttaacagctta

SEQ ID NO: 18514 - DNA, 21 bp, Artificial sequence
  SiRNA target sequence
gtattgatgttaacagcttag

SEQ ID NO: 18515 - DNA, 21 bp, Artificial sequence
  SiRNA target sequence
tattgatgttaacagcttaga

SEQ ID NO: 18516 - DNA, 21 bp, Artificial sequence
  SiRNA target sequence
attgatgttaacagcttagag

SEQ ID NO: 18517 - DNA, 21 bp, Artificial sequence
  SiRNA target sequence
ttgatgttaacagcttagagt

SEQ ID NO: 18518 - DNA, 21 bp, Artificial sequence
  SiRNA target sequence
tgatgttaacagcttagagtg

SEQ ID NO: 18519 - DNA, 21 bp, Artificial sequence
  SiRNA target sequence
gatgttaacagcttagagtgg

SEQ ID NO: 18520 - DNA, 21 bp, Artificial sequence
  SiRNA target sequence
atgttaacagcttagagtgga

SEQ ID NO: 18521 - DNA, 21 bp, Artificial sequence
  SiRNA target sequence
tgttaacagcttagagtggac

SEQ ID NO: 18522 - DNA, 21 bp, Artificial sequence
  SiRNA target sequence
gttaacagcttagagtggaca

SEQ ID NO: 18523 - DNA, 21 bp, Artificial sequence
  SiRNA target sequence
ttaacagcttagagtggacaa

SEQ ID NO: 18524 - DNA, 21 bp, Artificial sequence
  SiRNA target sequence
taacagcttagagtggacaaa

SEQ ID NO: 18525 - DNA, 21 bp, Artificial sequence
  SiRNA target sequence
aacagcttagagtggacaaat

SEQ ID NO: 18526 - DNA, 21 bp, Artificial sequence
  SiRNA target sequence
acagcttagagtggacaaatt

SEQ ID NO: 18527 - DNA, 21 bp, Artificial sequence
  SiRNA target sequence
cagcttagagtggacaaattt

SEQ ID NO: 18528 - DNA, 21 bp, Artificial sequence
  SiRNA target sequence
agcttagagtggacaaatttg

SEQ ID NO: 18529 - DNA, 21 bp, Artificial sequence
  SiRNA target sequence
gcttagagtggacaaatttgg

SEQ ID NO: 18530 - DNA, 21 bp, Artificial sequence
  SiRNA target sequence
cttagagtggacaaatttggc

SEQ ID NO: 18531 - DNA, 21 bp, Artificial sequence
  SiRNA target sequence
ttagagtggacaaatttggca

SEQ ID NO: 18532 - DNA, 21 bp, Artificial sequence
  SiRNA target sequence
tagagtggacaaatttggcaa

SEQ ID NO: 18533 - DNA, 21 bp, Artificial sequence
  SiRNA target sequence
agagtggacaaatttggcaac

SEQ ID NO: 18534 - DNA, 21 bp, Artificial sequence
  SiRNA target sequence
gagtggacaaatttggcaaca

SEQ ID NO: 18535 - DNA, 21 bp, Artificial sequence
  SiRNA target sequence
agtggacaaatttggcaacaa

SEQ ID NO: 18536 - DNA, 21 bp, Artificial sequence
  SiRNA target sequence
gtggacaaatttggcaacaag

SEQ ID NO: 18537 - DNA, 21 bp, Artificial sequence
  SiRNA target sequence
tggacaaatttggcaacaagg

SEQ ID NO: 18538 - DNA, 21 bp, Artificial sequence
  SiRNA target sequence
ggacaaatttggcaacaaggt

SEQ ID NO: 18539 - DNA, 21 bp, Artificial sequence
  SiRNA target sequence
gacaaatttggcaacaaggtt

SEQ ID NO: 18540 - DNA, 21 bp, Artificial sequence
  SiRNA target sequence
acaaatttggcaacaaggttg

SEQ ID NO: 18541 - DNA, 21 bp, Artificial sequence
  SiRNA target sequence
caaatttggcaacaaggttgt

SEQ ID NO: 18542 - DNA, 21 bp, Artificial sequence
  SiRNA target sequence
aaatttggcaacaaggttgtc

SEQ ID NO: 18543 - DNA, 21 bp, Artificial sequence
  SiRNA target sequence
aatttggcaacaaggttgtct

SEQ ID NO: 18544 - DNA, 21 bp, Artificial sequence
  SiRNA target sequence
atttggcaacaaggttgtcta

SEQ ID NO: 18545 - DNA, 21 bp, Artificial sequence
  SiRNA target sequence
tttggcaacaaggttgtctaa

SEQ ID NO: 18546 - DNA, 21 bp, Artificial sequence
  SiRNA target sequence
ttggcaacaaggttgtctaag

SEQ ID NO: 18547 - DNA, 21 bp, Artificial sequence
  SiRNA target sequence
tggcaacaaggttgtctaagt

SEQ ID NO: 18548 - DNA, 21 bp, Artificial sequence
  SiRNA target sequence
  misc_feature (21)..(21): n is a, c, g, or t
ggcaacaaggttgtctaagtn

SEQ ID NO: 18549 - DNA, 21 bp, Artificial sequence
  SiRNA target sequence
  misc_feature (20)..(20): n is a, c, g, or t
gcaacaaggttgtctaagtnt

SEQ ID NO: 18550 - DNA, 21 bp, Artificial sequence
  SiRNA target sequence
  misc_feature (19)..(19): n is a, c, g, or t
caacaaggttgtctaagtntg

SEQ ID NO: 18551 - DNA, 21 bp, Artificial sequence
  SiRNA target sequence
  misc_feature (18)..(18): n is a, c, g, or t
aacaaggttgtctaagtntgg

SEQ ID NO: 18552 - DNA, 21 bp, Artificial sequence
  SiRNA target sequence
  misc_feature (17)..(17): n is a, c, g, or t
acaaggttgtctaagtntggc

SEQ ID NO: 18553 - DNA, 21 bp, Artificial sequence
  SiRNA target sequence
  misc_feature (16)..(16): n is a, c, g, or t
caaggttgtctaagtntggca

SEQ ID NO: 18554 - DNA, 21 bp, Artificial sequence
  SiRNA target sequence
  misc_feature (15)..(15): n is a, c, g, or t
aaggttgtctaagtntggcac

SEQ ID NO: 18555 - DNA, 21 bp, Artificial sequence
  SiRNA target sequence
  misc_feature (14)..(14): n is a, c, g, or t
aggttgtctaagtntggcact

SEQ ID NO: 18556 - DNA, 21 bp, Artificial sequence
  SiRNA target sequence
  misc_feature (13)..(13): n is a, c, g, or t
ggttgtctaagtntggcactc

SEQ ID NO: 18557 - DNA, 21 bp, Artificial sequence
  SiRNA target sequence
  misc_feature (12)..(12): n is a, c, g, or t
gttgtctaagtntggcactca

SEQ ID NO: 18558 - DNA, 21 bp, Artificial sequence
  SiRNA target sequence
  misc_feature (11)..(11): n is a, c, g, or t
ttgtctaagtntggcactcac

SEQ ID NO: 18559 - DNA, 21 bp, Artificial sequence
  SiRNA target sequence
  misc_feature (10)..(10): n is a, c, g, or t
tgtctaagtntggcactcaca

SEQ ID NO: 18560 - DNA, 21 bp, Artificial sequence
  SiRNA target sequence
  misc_feature (9)..(9): n is a, c, g, or t
gtctaagtntggcactcacat

SEQ ID NO: 18561 - DNA, 21 bp, Artificial sequence
  SiRNA target sequence
  misc_feature (8)..(8): n is a, c, g, or t
tctaagtntggcactcacatc

SEQ ID NO: 18562 - DNA, 21 bp, Artificial sequence
  SiRNA target sequence
  misc_feature (7)..(7): n is a, c, g, or t
ctaagtntggcactcacatcg

SEQ ID NO: 18563 - DNA, 21 bp, Artificial sequence
  SiRNA target sequence
  misc_feature (6)..(6): n is a, c, g, or t
taagtntggcactcacatcgt

SEQ ID NO: 18564 - DNA, 21 bp, Artificial sequence
  SiRNA target sequence
  misc_feature (5)..(5): n is a, c, g, or t
aagtntggcactcacatcgtg

SEQ ID NO: 18565 - DNA, 21 bp, Artificial sequence
  SiRNA target sequence
  misc_feature (4)..(4): n is a, c, g, or t
agtntggcactcacatcgtga

SEQ ID NO: 18566 - DNA, 21 bp, Artificial sequence
  SiRNA target sequence
  misc_feature (3)..(3): n is a, c, g, or t
gtntggcactcacatcgtgac

SEQ ID NO: 18567 - DNA, 21 bp, Artificial sequence
  SiRNA target sequence
  misc_feature (2)..(2): n is a, c, g, or t
tntggcactcacatcgtgaca

SEQ ID NO: 18568 - DNA, 21 bp, Artificial sequence
  SiRNA target sequence
  misc_feature (1)..(1): n is a, c, g, or t
ntggcactcacatcgtgacag

SEQ ID NO: 18569 - DNA, 21 bp, Artificial sequence
  SiRNA target sequence
tggcactcacatcgtgacagg

SEQ ID NO: 18570 - DNA, 21 bp, Artificial sequence
  SiRNA target sequence
ggcactcacatcgtgacagga

SEQ ID NO: 18571 - DNA, 21 bp, Artificial sequence
  SiRNA target sequence
gcactcacatcgtgacaggag

SEQ ID NO: 18572 - DNA, 21 bp, Artificial sequence
  SiRNA target sequence
cactcacatcgtgacaggaga

SEQ ID NO: 18573 - DNA, 21 bp, Artificial sequence
  SiRNA target sequence
actcacatcgtgacaggagat

SEQ ID NO: 18574 - DNA, 21 bp, Artificial sequence
  SiRNA target sequence
ctcacatcgtgacaggagatt

SEQ ID NO: 18575 - DNA, 21 bp, Artificial sequence
  SiRNA target sequence
tcacatcgtgacaggagatta

SEQ ID NO: 18576 - DNA, 21 bp, Artificial sequence
  SiRNA target sequence
cacatcgtgacaggagattat

SEQ ID NO: 18577 - DNA, 21 bp, Artificial sequence
  SiRNA target sequence
acatcgtgacaggagattata

SEQ ID NO: 18578 - DNA, 21 bp, Artificial sequence
  SiRNA target sequence
catcgtgacaggagattataa

SEQ ID NO: 18579 - DNA, 21 bp, Artificial sequence
  SiRNA target sequence
atcgtgacaggagattataag

SEQ ID NO: 18580 - DNA, 21 bp, Artificial sequence
  SiRNA target sequence
tcgtgacaggagattataaga

SEQ ID NO: 18581 - DNA, 21 bp, Artificial sequence
  SiRNA target sequence
cgtgacaggagattataagaa

SEQ ID NO: 18582 - DNA, 21 bp, Artificial sequence
  SiRNA target sequence
gtgacaggagattataagaat

SEQ ID NO: 18583 - DNA, 21 bp, Artificial sequence
  SiRNA target sequence
tgacaggagattataagaatt

SEQ ID NO: 18584 - DNA, 21 bp, Artificial sequence
  SiRNA target sequence
gacaggagattataagaattt

SEQ ID NO: 18585 - DNA, 21 bp, Artificial sequence
  SiRNA target sequence
acaggagattataagaatttt

SEQ ID NO: 18586 - DNA, 21 bp, Artificial sequence
  SiRNA target sequence
caggagattataagaattttg

SEQ ID NO: 18587 - DNA, 21 bp, Artificial sequence
  SiRNA target sequence
aggagattataagaattttgg

SEQ ID NO: 18588 - DNA, 21 bp, Artificial sequence
  SiRNA target sequence
ggagattataagaattttggt

SEQ ID NO: 18589 - DNA, 21 bp, Artificial sequence
  SiRNA target sequence
gagattataagaattttggtc

SEQ ID NO: 18590 - DNA, 21 bp, Artificial sequence
  SiRNA target sequence
agattataagaattttggtcc

SEQ ID NO: 18591 - DNA, 21 bp, Artificial sequence
  SiRNA target sequence
gattataagaattttggtcct

SEQ ID NO: 18592 - DNA, 21 bp, Artificial sequence
  SiRNA target sequence
attataagaattttggtcctg

SEQ ID NO: 18593 - DNA, 21 bp, Artificial sequence
  SiRNA target sequence
ttataagaattttggtcctgg

SEQ ID NO: 18594 - DNA, 21 bp, Artificial sequence
  SiRNA target sequence
tataagaattttggtcctggg

SEQ ID NO: 18595 - DNA, 21 bp, Artificial sequence
  SiRNA target sequence
ataagaattttggtcctgggt

SEQ ID NO: 18596 - DNA, 21 bp, Artificial sequence
  SiRNA target sequence
taagaattttggtcctgggtt

SEQ ID NO: 18597 - DNA, 21 bp, Artificial sequence
  SiRNA target sequence
aagaattttggtcctgggtta

SEQ ID NO: 18598 - DNA, 21 bp, Artificial sequence
  SiRNA target sequence
agaattttggtcctgggttag

SEQ ID NO: 18599 - DNA, 21 bp, Artificial sequence
  SiRNA target sequence
gaattttggtcctgggttaga

SEQ ID NO: 18600 - DNA, 21 bp, Artificial sequence
  SiRNA target sequence
aattttggtcctgggttagat

SEQ ID NO: 18601 - DNA, 21 bp, Artificial sequence
  SiRNA target sequence
attttggtcctgggttagatt

SEQ ID NO: 18602 - DNA, 21 bp, Artificial sequence
  SiRNA target sequence
ttttggtcctgggttagattc

SEQ ID NO: 18603 - DNA, 21 bp, Artificial sequence
  SiRNA target sequence
tttggtcctgggttagattcc

SEQ ID NO: 18604 - DNA, 21 bp, Artificial sequence
  SiRNA target sequence
ttggtcctgggttagattccg

SEQ ID NO: 18605 - DNA, 21 bp, Artificial sequence
  SiRNA target sequence
tggtcctgggttagattccga

SEQ ID NO: 18606 - DNA, 21 bp, Artificial sequence
  SiRNA target sequence
ggtcctgggttagattccgat

SEQ ID NO: 18607 - DNA, 21 bp, Artificial sequence
  SiRNA target sequence
gtcctgggttagattccgatg

SEQ ID NO: 18608 - DNA, 21 bp, Artificial sequence
  SiRNA target sequence
tcctgggttagattccgatgt

SEQ ID NO: 18609 - DNA, 21 bp, Artificial sequence
  SiRNA target sequence
cctgggttagattccgatgtt

SEQ ID NO: 18610 - DNA, 21 bp, Artificial sequence
  SiRNA target sequence
ctgggttagattccgatgttg

SEQ ID NO: 18611 - DNA, 21 bp, Artificial sequence
  SiRNA target sequence
tgggttagattccgatgttgc

SEQ ID NO: 18612 - DNA, 21 bp, Artificial sequence
  SiRNA target sequence
gggttagattccgatgttgca

SEQ ID NO: 18613 - DNA, 21 bp, Artificial sequence
  SiRNA target sequence
ggttagattccgatgttgcag

SEQ ID NO: 18614 - DNA, 21 bp, Artificial sequence
  SiRNA target sequence
gttagattccgatgttgcagc

SEQ ID NO: 18615 - DNA, 21 bp, Artificial sequence
  SiRNA target sequence
ttagattccgatgttgcagct

SEQ ID NO: 18616 - DNA, 21 bp, Artificial sequence
  SiRNA target sequence
tagattccgatgttgcagctt

SEQ ID NO: 18617 - DNA, 21 bp, Artificial sequence
  SiRNA target sequence
agattccgatgttgcagcttc

SEQ ID NO: 18618 - DNA, 21 bp, Artificial sequence
  SiRNA target sequence
gattccgatgttgcagcttca

SEQ ID NO: 18619 - DNA, 21 bp, Artificial sequence
  SiRNA target sequence
attccgatgttgcagcttcag

SEQ ID NO: 18620 - DNA, 21 bp, Artificial sequence
  SiRNA target sequence
ttccgatgttgcagcttcagc

SEQ ID NO: 18621 - DNA, 21 bp, Artificial sequence
  SiRNA target sequence
tccgatgttgcagcttcagcg

SEQ ID NO: 18622 - DNA, 21 bp, Artificial sequence
  SiRNA target sequence
ccgatgttgcagcttcagcgt

SEQ ID NO: 18623 - DNA, 21 bp, Artificial sequence
  SiRNA target sequence
cgatgttgcagcttcagcgtt

SEQ ID NO: 18624 - DNA, 21 bp, Artificial sequence
  SiRNA target sequence
gatgttgcagcttcagcgttc

SEQ ID NO: 18625 - DNA, 21 bp, Artificial sequence
  SiRNA target sequence
atgttgcagcttcagcgttcg

SEQ ID NO: 18626 - DNA, 21 bp, Artificial sequence
  SiRNA target sequence
tgttgcagcttcagcgttcga

SEQ ID NO: 18627 - DNA, 21 bp, Artificial sequence
  SiRNA target sequence
gttgcagcttcagcgttcgaa

SEQ ID NO: 18628 - DNA, 21 bp, Artificial sequence
  SiRNA target sequence
ttgcagcttcagcgttcgaaa

SEQ ID NO: 18629 - DNA, 21 bp, Artificial sequence
  SiRNA target sequence
tgcagcttcagcgttcgaaat

SEQ ID NO: 18630 - DNA, 21 bp, Artificial sequence
  SiRNA target sequence
gcagcttcagcgttcgaaatt

SEQ ID NO: 18631 - DNA, 21 bp, Artificial sequence
  SiRNA target sequence
cagcttcagcgttcgaaatta

SEQ ID NO: 18632 - DNA, 21 bp, Artificial sequence
  SiRNA target sequence
agcttcagcgttcgaaattat

SEQ ID NO: 18633 - DNA, 21 bp, Artificial sequence
  SiRNA target sequence
gcttcagcgttcgaaattatt

SEQ ID NO: 18634 - DNA, 21 bp, Artificial sequence
  SiRNA target sequence
cttcagcgttcgaaattatta

SEQ ID NO: 18635 - DNA, 21 bp, Artificial sequence
  SiRNA target sequence
ttcagcgttcgaaattattat

SEQ ID NO: 18636 - DNA, 21 bp, Artificial sequence
  SiRNA target sequence
tcagcgttcgaaattattatc

SEQ ID NO: 18637 - DNA, 21 bp, Artificial sequence
  SiRNA target sequence
cagcgttcgaaattattatcg

SEQ ID NO: 18638 - DNA, 21 bp, Artificial sequence
  SiRNA target sequence
agcgttcgaaattattatcga

SEQ ID NO: 18639 - DNA, 21 bp, Artificial sequence
  SiRNA target sequence
gcgttcgaaattattatcgac

SEQ ID NO: 18640 - DNA, 21 bp, Artificial sequence
  SiRNA target sequence
cgttcgaaattattatcgact

SEQ ID NO: 18641 - DNA, 21 bp, Artificial sequence
  SiRNA target sequence
gttcgaaattattatcgactg

SEQ ID NO: 18642 - DNA, 21 bp, Artificial sequence
  SiRNA target sequence
ttcgaaattattatcgactgg

SEQ ID NO: 18643 - DNA, 21 bp, Artificial sequence
  SiRNA target sequence
tcgaaattattatcgactggg

SEQ ID NO: 18644 - DNA, 21 bp, Artificial sequence
  SiRNA target sequence
cgaaattattatcgactgggt

SEQ ID NO: 18645 - DNA, 21 bp, Artificial sequence
  SiRNA target sequence
gaaattattatcgactgggta

SEQ ID NO: 18646 - DNA, 21 bp, Artificial sequence
  SiRNA target sequence
aaattattatcgactgggtat

SEQ ID NO: 18647 - DNA, 21 bp, Artificial sequence
  SiRNA target sequence
aattattatcgactgggtatt

SEQ ID NO: 18648 - DNA, 21 bp, Artificial sequence
  SiRNA target sequence
attattatcgactgggtatta

SEQ ID NO: 18649 - DNA, 21 bp, Artificial sequence
  SiRNA target sequence
ttattatcgactgggtattac

SEQ ID NO: 18650 - DNA, 21 bp, Artificial sequence
  SiRNA target sequence
tattatcgactgggtattaca

SEQ ID NO: 18651 - DNA, 21 bp, Artificial sequence
  SiRNA target sequence
attatcgactgggtattacat

SEQ ID NO: 18652 - DNA, 21 bp, Artificial sequence
  SiRNA target sequence
ttatcgactgggtattacatt

SEQ ID NO: 18653 - DNA, 21 bp, Artificial sequence
  SiRNA target sequence
tatcgactgggtattacatta

SEQ ID NO: 18654 - DNA, 21 bp, Artificial sequence
  SiRNA target sequence
atcgactgggtattacattac

SEQ ID NO: 18655 - DNA, 21 bp, Artificial sequence
  SiRNA target sequence
tcgactgggtattacattaca

SEQ ID NO: 18656 - DNA, 21 bp, Artificial sequence
  SiRNA target sequence
cgactgggtattacattacac

SEQ ID NO: 18657 - DNA, 21 bp, Artificial sequence
  SiRNA target sequence
gactgggtattacattacacc

SEQ ID NO: 18658 - DNA, 21 bp, Artificial sequence
  SiRNA target sequence
actgggtattacattacaccg

SEQ ID NO: 18659 - DNA, 21 bp, Artificial sequence
  SiRNA target sequence
ctgggtattacattacaccga

SEQ ID NO: 18660 - DNA, 21 bp, Artificial sequence
  SiRNA target sequence
tgggtattacattacaccgaa

SEQ ID NO: 18661 - DNA, 21 bp, Artificial sequence
  SiRNA target sequence
gggtattacattacaccgaag

SEQ ID NO: 18662 - DNA, 21 bp, Artificial sequence
  SiRNA target sequence
ggtattacattacaccgaaga

SEQ ID NO: 18663 - DNA, 21 bp, Artificial sequence
  SiRNA target sequence
gtattacattacaccgaagaa

SEQ ID NO: 18664 - DNA, 21 bp, Artificial sequence
  SiRNA target sequence
tattacattacaccgaagaag

SEQ ID NO: 18665 - DNA, 21 bp, Artificial sequence
  SiRNA target sequence
attacattacaccgaagaaga

SEQ ID NO: 18666 - DNA, 21 bp, Artificial sequence
  SiRNA target sequence
ttacattacaccgaagaagat

SEQ ID NO: 18667 - DNA, 21 bp, Artificial sequence
  SiRNA target sequence
tacattacaccgaagaagata

SEQ ID NO: 18668 - DNA, 21 bp, Artificial sequence
  SiRNA target sequence
acattacaccgaagaagataa

SEQ ID NO: 18669 - DNA, 21 bp, Artificial sequence
  SiRNA target sequence
cattacaccgaagaagataat

SEQ ID NO: 18670 - DNA, 21 bp, Artificial sequence
  SiRNA target sequence
attacaccgaagaagataata

SEQ ID NO: 18671 - DNA, 21 bp, Artificial sequence
  SiRNA target sequence
ttacaccgaagaagataataa

SEQ ID NO: 18672 - DNA, 21 bp, Artificial sequence
  SiRNA target sequence
tacaccgaagaagataataaa

SEQ ID NO: 18673 - DNA, 21 bp, Artificial sequence
  SiRNA target sequence
acaccgaagaagataataaag

SEQ ID NO: 18674 - DNA, 21 bp, Artificial sequence
  SiRNA target sequence
caccgaagaagataataaaga

SEQ ID NO: 18675 - DNA, 21 bp, Artificial sequence
  SiRNA target sequence
  misc_feature (21)..(21): n is a, c, g, or t
accgaagaagataataaagan

SEQ ID NO: 18676 - DNA, 21 bp, Artificial sequence
  SiRNA target sequence
  misc_feature (20)..(20): n is a, c, g, or t
ccgaagaagataataaagang

SEQ ID NO: 18677 - DNA, 21 bp, Artificial sequence
  SiRNA target sequence
  misc_feature (19)..(19): n is a, c, g, or t
cgaagaagataataaaganga

SEQ ID NO: 18678 - DNA, 21 bp, Artificial sequence
  SiRNA target sequence
  misc_feature (18)..(18): n is a, c, g, or t
gaagaagataataaagangaa

SEQ ID NO: 18679 - DNA, 21 bp, Artificial sequence
  SiRNA target sequence
  misc_feature (17)..(17): n is a, c, g, or t
aagaagataataaagangaaa

SEQ ID NO: 18680 - DNA, 21 bp, Artificial sequence
  SiRNA target sequence
  misc_feature (16)..(16): n is a, c, g, or t
agaagataataaagangaaat

SEQ ID NO: 18681 - DNA, 21 bp, Artificial sequence
  SiRNA target sequence
  misc_feature (15)..(15): n is a, c, g, or t
gaagataataaagangaaatg

SEQ ID NO: 18682 - DNA, 21 bp, Artificial sequence
  SiRNA target sequence
  misc_feature (14)..(14): n is a, c, g, or t
aagataataaagangaaatga

SEQ ID NO: 18683 - DNA, 21 bp, Artificial sequence
  SiRNA target sequence
  misc_feature (13)..(13): n is a, c, g, or t
agataataaagangaaatgaa

SEQ ID NO: 18684 - DNA, 21 bp, Artificial sequence
  SiRNA target sequence
  misc_feature (12)..(12): n is a, c, g, or t
gataataaagangaaatgaag

SEQ ID NO: 18685 - DNA, 21 bp, Artificial sequence
  SiRNA target sequence
  misc_feature (11)..(11): n is a, c, g, or t
ataataaagangaaatgaagc

SEQ ID NO: 18686 - DNA, 21 bp, Artificial sequence
  SiRNA target sequence
  misc_feature (10)..(10): n is a, c, g, or t
taataaagangaaatgaagcg

SEQ ID NO: 18687 - DNA, 21 bp, Artificial sequence
  SiRNA target sequence
  misc_feature (9)..(9): n is a, c, g, or t
aataaagangaaatgaagcga

SEQ ID NO: 18688 - DNA, 21 bp, Artificial sequence
  SiRNA target sequence
  misc_feature (8)..(8): n is a, c, g, or t
ataaagangaaatgaagcgag

SEQ ID NO: 18689 - DNA, 21 bp, Artificial sequence
  SiRNA target sequence
  misc_feature (7)..(7): n is a, c, g, or t
taaagangaaatgaagcgagt

SEQ ID NO: 18690 - DNA, 21 bp, Artificial sequence
  SiRNA target sequence
  misc_feature (6)..(6): n is a, c, g, or t
aaagangaaatgaagcgagta

SEQ ID NO: 18691 - DNA, 21 bp, Artificial sequence
  SiRNA target sequence
  misc_feature (5)..(5): n is a, c, g, or t
aagangaaatgaagcgagtaa

SEQ ID NO: 18692 - DNA, 21 bp, Artificial sequence
  SiRNA target sequence
  misc_feature (4)..(4): n is a, c, g, or t
agangaaatgaagcgagtaat

SEQ ID NO: 18693 - DNA, 21 bp, Artificial sequence
  SiRNA target sequence
  misc_feature (3)..(3): n is a, c, g, or t
gangaaatgaagcgagtaatg

SEQ ID NO: 18694 - DNA, 21 bp, Artificial sequence
  SiRNA target sequence
  misc_feature (2)..(2): n is a, c, g, or t
angaaatgaagcgagtaatgt

SEQ ID NO: 18695 - DNA, 21 bp, Artificial sequence
  SiRNA target sequence
  misc_feature (1)..(1): n is a, c, g, or t
ngaaatgaagcgagtaatgtg

SEQ ID NO: 18696 - DNA, 21 bp, Artificial sequence
  SiRNA target sequence
gaaatgaagcgagtaatgtgg

SEQ ID NO: 18697 - DNA, 21 bp, Artificial sequence
  SiRNA target sequence
aaatgaagcgagtaatgtgga

SEQ ID NO: 18698 - DNA, 21 bp, Artificial sequence
  SiRNA target sequence
aatgaagcgagtaatgtggac

SEQ ID NO: 18699 - DNA, 21 bp, Artificial sequence
  SiRNA target sequence
atgaagcgagtaatgtggacc

SEQ ID NO: 18700 - DNA, 21 bp, Artificial sequence
  SiRNA target sequence
tgaagcgagtaatgtggacca

SEQ ID NO: 18701 - DNA, 21 bp, Artificial sequence
  SiRNA target sequence
gaagcgagtaatgtggaccat

SEQ ID NO: 18702 - DNA, 21 bp, Artificial sequence
  SiRNA target sequence
aagcgagtaatgtggaccatg

SEQ ID NO: 18703 - DNA, 21 bp, Artificial sequence
  SiRNA target sequence
agcgagtaatgtggaccatgg

SEQ ID NO: 18704 - DNA, 21 bp, Artificial sequence
  SiRNA target sequence
gcgagtaatgtggaccatggc

SEQ ID NO: 18705 - DNA, 21 bp, Artificial sequence
  SiRNA target sequence
cgagtaatgtggaccatggcg

SEQ ID NO: 18706 - DNA, 21 bp, Artificial sequence
  SiRNA target sequence
gagtaatgtggaccatggcgc

SEQ ID NO: 18707 - DNA, 21 bp, Artificial sequence
  SiRNA target sequence
agtaatgtggaccatggcgca

SEQ ID NO: 18708 - DNA, 21 bp, Artificial sequence
  SiRNA target sequence
gtaatgtggaccatggcgcaa

SEQ ID NO: 18709 - DNA, 21 bp, Artificial sequence
  SiRNA target sequence
taatgtggaccatggcgcaag

SEQ ID NO: 18710 - DNA, 21 bp, Artificial sequence
  SiRNA target sequence
aatgtggaccatggcgcaaga

SEQ ID NO: 18711 - DNA, 21 bp, Artificial sequence
  SiRNA target sequence
atgtggaccatggcgcaagag

SEQ ID NO: 18712 - DNA, 21 bp, Artificial sequence
  SiRNA target sequence
tgtggaccatggcgcaagaga

SEQ ID NO: 18713 - DNA, 21 bp, Artificial sequence
  SiRNA target sequence
gtggaccatggcgcaagagat

SEQ ID NO: 18714 - DNA, 21 bp, Artificial sequence
  SiRNA target sequence
tggaccatggcgcaagagatc

SEQ ID NO: 18715 - DNA, 21 bp, Artificial sequence
  SiRNA target sequence
ggaccatggcgcaagagatct

SEQ ID NO: 18716 - DNA, 21 bp, Artificial sequence
  SiRNA target sequence
gaccatggcgcaagagatctt

SEQ ID NO: 18717 - DNA, 21 bp, Artificial sequence
  SiRNA target sequence
accatggcgcaagagatctta

SEQ ID NO: 18718 - DNA, 21 bp, Artificial sequence
  SiRNA target sequence
ccatggcgcaagagatcttag

SEQ ID NO: 18719 - DNA, 21 bp, Artificial sequence
  SiRNA target sequence
catggcgcaagagatcttagc

SEQ ID NO: 18720 - DNA, 21 bp, Artificial sequence
  SiRNA target sequence
atggcgcaagagatcttagcg

SEQ ID NO: 18721 - DNA, 21 bp, Artificial sequence
  SiRNA target sequence
tggcgcaagagatcttagcgc

SEQ ID NO: 18722 - DNA, 21 bp, Artificial sequence
  SiRNA target sequence
ggcgcaagagatcttagcgcc

SEQ ID NO: 18723 - DNA, 21 bp, Artificial sequence
  SiRNA target sequence
gcgcaagagatcttagcgcct

SEQ ID NO: 18724 - DNA, 21 bp, Artificial sequence
  SiRNA target sequence
cgcaagagatcttagcgccta

SEQ ID NO: 18725 - DNA, 21 bp, Artificial sequence
  SiRNA target sequence
gcaagagatcttagcgcctag

SEQ ID NO: 18726 - DNA, 21 bp, Artificial sequence
  SiRNA target sequence
caagagatcttagcgcctagt

SEQ ID NO: 18727 - DNA, 21 bp, Artificial sequence
  SiRNA target sequence
aagagatcttagcgcctagtc

SEQ ID NO: 18728 - DNA, 21 bp, Artificial sequence
  SiRNA target sequence
agagatcttagcgcctagtca

SEQ ID NO: 18729 - DNA, 21 bp, Artificial sequence
  SiRNA target sequence
gagatcttagcgcctagtcat

SEQ ID NO: 18730 - DNA, 21 bp, Artificial sequence
  SiRNA target sequence
agatcttagcgcctagtcatc

SEQ ID NO: 18731 - DNA, 21 bp, Artificial sequence
  SiRNA target sequence
gatcttagcgcctagtcatct

SEQ ID NO: 18732 - DNA, 21 bp, Artificial sequence
  SiRNA target sequence
atcttagcgcctagtcatcta

SEQ ID NO: 18733 - DNA, 21 bp, Artificial sequence
  SiRNA target sequence
tcttagcgcctagtcatctat

SEQ ID NO: 18734 - DNA, 21 bp, Artificial sequence
  SiRNA target sequence
cttagcgcctagtcatctata

SEQ ID NO: 18735 - DNA, 21 bp, Artificial sequence
  SiRNA target sequence
ttagcgcctagtcatctatat

SEQ ID NO: 18736 - DNA, 21 bp, Artificial sequence
  SiRNA target sequence
tagcgcctagtcatctatatc

SEQ ID NO: 18737 - DNA, 21 bp, Artificial sequence
  SiRNA target sequence
agcgcctagtcatctatatcg

SEQ ID NO: 18738 - DNA, 21 bp, Artificial sequence
  SiRNA target sequence
gcgcctagtcatctatatcgc

SEQ ID NO: 18739 - DNA, 21 bp, Artificial sequence
  SiRNA target sequence
cgcctagtcatctatatcgcg

SEQ ID NO: 18740 - DNA, 21 bp, Artificial sequence
  SiRNA target sequence
gcctagtcatctatatcgcga

SEQ ID NO: 18741 - DNA, 21 bp, Artificial sequence
  SiRNA target sequence
cctagtcatctatatcgcgac

SEQ ID NO: 18742 - DNA, 21 bp, Artificial sequence
  SiRNA target sequence
  misc_feature (21)..(21): n is a, c, g, or t
ctagtcatctatatcgcgacn

SEQ ID NO: 18743 - DNA, 21 bp, Artificial sequence
  SiRNA target sequence
  misc_feature (20)..(20): n is a, c, g, or t
tagtcatctatatcgcgacnt

SEQ ID NO: 18744 - DNA, 21 bp, Artificial sequence
  SiRNA target sequence
  misc_feature (19)..(19): n is a, c, g, or t
agtcatctatatcgcgacntg

SEQ ID NO: 18745 - DNA, 21 bp, Artificial sequence
  SiRNA target sequence
  misc_feature (18)..(18): n is a, c, g, or t
gtcatctatatcgcgacntgg

SEQ ID NO: 18746 - DNA, 21 bp, Artificial sequence
  SiRNA target sequence
  misc_feature (17)..(17): n is a, c, g, or t
tcatctatatcgcgacntggt

SEQ ID NO: 18747 - DNA, 21 bp, Artificial sequence
  SiRNA target sequence
  misc_feature (16)..(16): n is a, c, g, or t
catctatatcgcgacntggtg

SEQ ID NO: 18748 - DNA, 21 bp, Artificial sequence
  SiRNA target sequence
  misc_feature (15)..(15): n is a, c, g, or t
atctatatcgcgacntggtgt

SEQ ID NO: 18749 - DNA, 21 bp, Artificial sequence
  SiRNA target sequence
  misc_feature (14)..(14): n is a, c, g, or t
tctatatcgcgacntggtgta

SEQ ID NO: 18750 - DNA, 21 bp, Artificial sequence
  SiRNA target sequence
  misc_feature (13)..(13): n is a, c, g, or t
ctatatcgcgacntggtgtac

SEQ ID NO: 18751 - DNA, 21 bp, Artificial sequence
  SiRNA target sequence
  misc_feature (12)..(12): n is a, c, g, or t
tatatcgcgacntggtgtacc

SEQ ID NO: 18752 - DNA, 21 bp, Artificial sequence
  SiRNA target sequence
  misc_feature (11)..(11): n is a, c, g, or t
atatcgcgacntggtgtaccg

SEQ ID NO: 18753 - DNA, 21 bp, Artificial sequence
  SiRNA target sequence
  misc_feature (10)..(10): n is a, c, g, or t
tatcgcgacntggtgtaccga

SEQ ID NO: 18754 - DNA, 21 bp, Artificial sequence
  SiRNA target sequence
  misc_feature (9)..(9): n is a, c, g, or t
atcgcgacntggtgtaccgag

SEQ ID NO: 18755 - DNA, 21 bp, Artificial sequence
  SiRNA target sequence
  misc_feature (8)..(8): n is a, c, g, or t
tcgcgacntggtgtaccgagt

SEQ ID NO: 18756 - DNA, 21 bp, Artificial sequence
  SiRNA target sequence
  misc_feature (7)..(7): n is a, c, g, or t
cgcgacntggtgtaccgagta

SEQ ID NO: 18757 - DNA, 21 bp, Artificial sequence
  SiRNA target sequence
  misc_feature (6)..(6): n is a, c, g, or t
gcgacntggtgtaccgagtac

SEQ ID NO: 18758 - DNA, 21 bp, Artificial sequence
  SiRNA target sequence
  misc_feature (5)..(5): n is a, c, g, or t
cgacntggtgtaccgagtacc

SEQ ID NO: 18759 - DNA, 21 bp, Artificial sequence
  SiRNA target sequence
  misc_feature (4)..(4): n is a, c, g, or t
gacntggtgtaccgagtacct

SEQ ID NO: 18760 - DNA, 21 bp, Artificial sequence
  SiRNA target sequence
  misc_feature (3)..(3): n is a, c, g, or t
acntggtgtaccgagtacctt

SEQ ID NO: 18761 - DNA, 21 bp, Artificial sequence
  SiRNA target sequence
  misc_feature (2)..(2): n is a, c, g, or t
cntggtgtaccgagtaccttg

SEQ ID NO: 18762 - DNA, 21 bp, Artificial sequence
  SiRNA target sequence
  misc_feature (1)..(1): n is a, c, g, or t
ntggtgtaccgagtaccttgt

SEQ ID NO: 18763 - DNA, 21 bp, Artificial sequence
  SiRNA target sequence
tggtgtaccgagtaccttgtg

SEQ ID NO: 18764 - DNA, 21 bp, Artificial sequence
  SiRNA target sequence
ggtgtaccgagtaccttgtgg

SEQ ID NO: 18765 - DNA, 21 bp, Artificial sequence
  SiRNA target sequence
gtgtaccgagtaccttgtgga

SEQ ID NO: 18766 - DNA, 21 bp, Artificial sequence
  SiRNA target sequence
tgtaccgagtaccttgtggaa

SEQ ID NO: 18767 - DNA, 21 bp, Artificial sequence
  SiRNA target sequence
gtaccgagtaccttgtggaat

SEQ ID NO: 18768 - DNA, 21 bp, Artificial sequence
  SiRNA target sequence
taccgagtaccttgtggaatt

SEQ ID NO: 18769 - DNA, 21 bp, Artificial sequence
  SiRNA target sequence
accgagtaccttgtggaattc

SEQ ID NO: 18770 - DNA, 21 bp, Artificial sequence
  SiRNA target sequence
ccgagtaccttgtggaattcc

SEQ ID NO: 18771 - DNA, 21 bp, Artificial sequence
  SiRNA target sequence
cgagtaccttgtggaattcca

SEQ ID NO: 18772 - DNA, 21 bp, Artificial sequence
  SiRNA target sequence
gagtaccttgtggaattccat

SEQ ID NO: 18773 - DNA, 21 bp, Artificial sequence
  SiRNA target sequence
agtaccttgtggaattccatc

SEQ ID NO: 18774 - DNA, 21 bp, Artificial sequence
  SiRNA target sequence
gtaccttgtggaattccatca

SEQ ID NO: 18775 - DNA, 21 bp, Artificial sequence
  SiRNA target sequence
taccttgtggaattccatcag

SEQ ID NO: 18776 - DNA, 21 bp, Artificial sequence
  SiRNA target sequence
accttgtggaattccatcagg

SEQ ID NO: 18777 - DNA, 21 bp, Artificial sequence
  SiRNA target sequence
ccttgtggaattccatcaggt

SEQ ID NO: 18778 - DNA, 21 bp, Artificial sequence
  SiRNA target sequence
cttgtggaattccatcaggtt

SEQ ID NO: 18779 - DNA, 21 bp, Artificial sequence
  SiRNA target sequence
ttgtggaattccatcaggttc

SEQ ID NO: 18780 - DNA, 21 bp, Artificial sequence
  SiRNA target sequence
tgtggaattccatcaggttct

SEQ ID NO: 18781 - DNA, 21 bp, Artificial sequence
  SiRNA target sequence
gtggaattccatcaggttctc

SEQ ID NO: 18782 - DNA, 21 bp, Artificial sequence
  SiRNA target sequence
tggaattccatcaggttctcc

SEQ ID NO: 18783 - DNA, 21 bp, Artificial sequence
  SiRNA target sequence
ggaattccatcaggttctcca

SEQ ID NO: 18784 - DNA, 21 bp, Artificial sequence
  SiRNA target sequence
gaattccatcaggttctccaa

SEQ ID NO: 18785 - DNA, 21 bp, Artificial sequence
  SiRNA target sequence
aattccatcaggttctccaat

SEQ ID NO: 18786 - DNA, 21 bp, Artificial sequence
  SiRNA target sequence
attccatcaggttctccaata

SEQ ID NO: 18787 - DNA, 21 bp, Artificial sequence
  SiRNA target sequence
ttccatcaggttctccaataa

SEQ ID NO: 18788 - DNA, 21 bp, Artificial sequence
  SiRNA target sequence
tccatcaggttctccaataac

SEQ ID NO: 18789 - DNA, 21 bp, Artificial sequence
  SiRNA target sequence
ccatcaggttctccaataacg

SEQ ID NO: 18790 - DNA, 21 bp, Artificial sequence
  SiRNA target sequence
catcaggttctccaataacgg

SEQ ID NO: 18791 - DNA, 21 bp, Artificial sequence
  SiRNA target sequence
atcaggttctccaataacgga

SEQ ID NO: 18792 - DNA, 21 bp, Artificial sequence
  SiRNA target sequence
tcaggttctccaataacggac

SEQ ID NO: 18793 - DNA, 21 bp, Artificial sequence
  SiRNA target sequence
caggttctccaataacggaca

SEQ ID NO: 18794 - DNA, 21 bp, Artificial sequence
  SiRNA target sequence
aggttctccaataacggacat

SEQ ID NO: 18795 - DNA, 21 bp, Artificial sequence
  SiRNA target sequence
ggttctccaataacggacata

SEQ ID NO: 18796 - DNA, 21 bp, Artificial sequence
  SiRNA target sequence
gttctccaataacggacatat

SEQ ID NO: 18797 - DNA, 21 bp, Artificial sequence
  SiRNA target sequence
ttctccaataacggacatatt

SEQ ID NO: 18798 - DNA, 21 bp, Artificial sequence
  SiRNA target sequence
tctccaataacggacatattg

SEQ ID NO: 18799 - DNA, 21 bp, Artificial sequence
  SiRNA target sequence
ctccaataacggacatattga

SEQ ID NO: 18800 - DNA, 21 bp, Artificial sequence
  SiRNA target sequence
tccaataacggacatattgaa

SEQ ID NO: 18801 - DNA, 21 bp, Artificial sequence
  SiRNA target sequence
  misc_feature (21)..(21): n is a, c, g, or t
ccaataacggacatattgaan

SEQ ID NO: 18802 - DNA, 21 bp, Artificial sequence
  SiRNA target sequence
  misc_feature (20)..(20): n is a, c, g, or t
caataacggacatattgaana

SEQ ID NO: 18803 - DNA, 21 bp, Artificial sequence
  SiRNA target sequence
  misc_feature (19)..(19): n is a, c, g, or t
aataacggacatattgaanac

SEQ ID NO: 18804 - DNA, 21 bp, Artificial sequence
  SiRNA target sequence
  misc_feature (18)..(18): n is a, c, g, or t
ataacggacatattgaanaca

SEQ ID NO: 18805 - DNA, 21 bp, Artificial sequence
  SiRNA target sequence
  misc_feature (17)..(17): n is a, c, g, or t
taacggacatattgaanacaa

SEQ ID NO: 18806 - DNA, 21 bp, Artificial sequence
  SiRNA target sequence
  misc_feature (16)..(16): n is a, c, g, or t
aacggacatattgaanacaat

SEQ ID NO: 18807 - DNA, 21 bp, Artificial sequence
  SiRNA target sequence
  misc_feature (15)..(15): n is a, c, g, or t
acggacatattgaanacaatt

SEQ ID NO: 18808 - DNA, 21 bp, Artificial sequence
  SiRNA target sequence
  misc_feature (14)..(14): n is a, c, g, or t
cggacatattgaanacaattt

SEQ ID NO: 18809 - DNA, 21 bp, Artificial sequence
  SiRNA target sequence
  misc_feature (13)..(13): n is a, c, g, or t
ggacatattgaanacaatttc

SEQ ID NO: 18810 - DNA, 21 bp, Artificial sequence
  SiRNA target sequence
  misc_feature (12)..(12): n is a, c, g, or t
gacatattgaanacaatttca

SEQ ID NO: 18811 - DNA, 21 bp, Artificial sequence
  SiRNA target sequence
  misc_feature (11)..(11): n is a, c, g, or t
acatattgaanacaatttcaa

SEQ ID NO: 18812 - DNA, 21 bp, Artificial sequence
  SiRNA target sequence
  misc_feature (10)..(10): n is a, c, g, or t
catattgaanacaatttcaaa

SEQ ID NO: 18813 - DNA, 21 bp, Artificial sequence
  SiRNA target sequence
  misc_feature (9)..(9): n is a, c, g, or t
atattgaanacaatttcaaat

SEQ ID NO: 18814 - DNA, 21 bp, Artificial sequence
  SiRNA target sequence
  misc_feature (8)..(8): n is a, c, g, or t
tattgaanacaatttcaaatt

SEQ ID NO: 18815 - DNA, 21 bp, Artificial sequence
  SiRNA target sequence
  misc_feature (7)..(7): n is a, c, g, or t
attgaanacaatttcaaattg

SEQ ID NO: 18816 - DNA, 21 bp, Artificial sequence
  SiRNA target sequence
  misc_feature (6)..(6): n is a, c, g, or t
ttgaanacaatttcaaattgt

SEQ ID NO: 18817 - DNA, 21 bp, Artificial sequence
  SiRNA target sequence
  misc_feature (5)..(5): n is a, c, g, or t
tgaanacaatttcaaattgtt

SEQ ID NO: 18818 - DNA, 21 bp, Artificial sequence
  SiRNA target sequence
  misc_feature (4)..(4): n is a, c, g, or t
gaanacaatttcaaattgttt

SEQ ID NO: 18819 - DNA, 21 bp, Artificial sequence
  SiRNA target sequence
  misc_feature (3)..(3): n is a, c, g, or t
aanacaatttcaaattgtttg

SEQ ID NO: 18820 - DNA, 21 bp, Artificial sequence
  SiRNA target sequence
  misc_feature (2)..(2): n is a, c, g, or t
anacaatttcaaattgtttgt

SEQ ID NO: 18821 - DNA, 21 bp, Artificial sequence
  SiRNA target sequence
  misc_feature (1)..(1): n is a, c, g, or t
nacaatttcaaattgtttgtt

SEQ ID NO: 18822 - DNA, 21 bp, Artificial sequence
  SiRNA target sequence
acaatttcaaattgtttgtta

SEQ ID NO: 18823 - DNA, 21 bp, Artificial sequence
  SiRNA target sequence
caatttcaaattgtttgttaa

SEQ ID NO: 18824 - DNA, 21 bp, Artificial sequence
  SiRNA target sequence
aatttcaaattgtttgttaat

SEQ ID NO: 18825 - DNA, 21 bp, Artificial sequence
  SiRNA target sequence
atttcaaattgtttgttaatt

SEQ ID NO: 18826 - DNA, 21 bp, Artificial sequence
  SiRNA target sequence
tttcaaattgtttgttaatta

SEQ ID NO: 18827 - DNA, 21 bp, Artificial sequence
  SiRNA target sequence
ttcaaattgtttgttaattag

SEQ ID NO: 18828 - DNA, 21 bp, Artificial sequence
  SiRNA target sequence
tcaaattgtttgttaattagg

SEQ ID NO: 18829 - DNA, 21 bp, Artificial sequence
  SiRNA target sequence
caaattgtttgttaattaggt

SEQ ID NO: 18830 - DNA, 21 bp, Artificial sequence
  SiRNA target sequence
aaattgtttgttaattaggtt

SEQ ID NO: 18831 - DNA, 21 bp, Artificial sequence
  SiRNA target sequence
aattgtttgttaattaggtta

SEQ ID NO: 18832 - DNA, 21 bp, Artificial sequence
  SiRNA target sequence
attgtttgttaattaggttag

SEQ ID NO: 18833 - DNA, 21 bp, Artificial sequence
  SiRNA target sequence
ttgtttgttaattaggttagc

SEQ ID NO: 18834 - DNA, 21 bp, Artificial sequence
  SiRNA target sequence
tgtttgttaattaggttagct

SEQ ID NO: 18835 - DNA, 21 bp, Artificial sequence
  SiRNA target sequence
gtttgttaattaggttagctt

SEQ ID NO: 18836 - DNA, 21 bp, Artificial sequence
  SiRNA target sequence
tttgttaattaggttagcttg

SEQ ID NO: 18837 - DNA, 21 bp, Artificial sequence
  SiRNA target sequence
ttgttaattaggttagcttgg

SEQ ID NO: 18838 - DNA, 21 bp, Artificial sequence
  SiRNA target sequence
tgttaattaggttagcttggt

SEQ ID NO: 18839 - DNA, 21 bp, Artificial sequence
  SiRNA target sequence
gttaattaggttagcttggtt

SEQ ID NO: 18840 - DNA, 21 bp, Artificial sequence
  SiRNA target sequence
ttaattaggttagcttggtta

SEQ ID NO: 18841 - DNA, 21 bp, Artificial sequence
  SiRNA target sequence
taattaggttagcttggttag

SEQ ID NO: 18842 - DNA, 21 bp, Artificial sequence
  SiRNA target sequence
aattaggttagcttggttagg

SEQ ID NO: 18843 - DNA, 21 bp, Artificial sequence
  SiRNA target sequence
attaggttagcttggttaggt

SEQ ID NO: 18844 - DNA, 21 bp, Artificial sequence
  SiRNA target sequence
ttaggttagcttggttaggta

SEQ ID NO: 18845 - DNA, 21 bp, Artificial sequence
  SiRNA target sequence
taggttagcttggttaggtat

SEQ ID NO: 18846 - DNA, 21 bp, Artificial sequence
  SiRNA target sequence
aggttagcttggttaggtatt

SEQ ID NO: 18847 - DNA, 21 bp, Artificial sequence
  SiRNA target sequence
ggttagcttggttaggtatta

SEQ ID NO: 18848 - DNA, 21 bp, Artificial sequence
  SiRNA target sequence
gttagcttggttaggtattac

SEQ ID NO: 18849 - DNA, 21 bp, Artificial sequence
  SiRNA target sequence
ttagcttggttaggtattact

SEQ ID NO: 18850 - DNA, 21 bp, Artificial sequence
  SiRNA target sequence
tagcttggttaggtattactg

SEQ ID NO: 18851 - DNA, 21 bp, Artificial sequence
  SiRNA target sequence
agcttggttaggtattactga

SEQ ID NO: 18852 - DNA, 21 bp, Artificial sequence
  SiRNA target sequence
gcttggttaggtattactgac

SEQ ID NO: 18853 - DNA, 21 bp, Artificial sequence
  SiRNA target sequence
cttggttaggtattactgact

SEQ ID NO: 18854 - DNA, 21 bp, Artificial sequence
  SiRNA target sequence
ttggttaggtattactgactt

SEQ ID NO: 18855 - DNA, 21 bp, Artificial sequence
  SiRNA target sequence
tggttaggtattactgacttg

SEQ ID NO: 18856 - DNA, 21 bp, Artificial sequence
  SiRNA target sequence
ggttaggtattactgacttgc

SEQ ID NO: 18857 - DNA, 21 bp, Artificial sequence
  SiRNA target sequence
gttaggtattactgacttgcc

SEQ ID NO: 18858 - DNA, 21 bp, Artificial sequence
  SiRNA target sequence
ttaggtattactgacttgcct

SEQ ID NO: 18859 - DNA, 21 bp, Artificial sequence
  SiRNA target sequence
taggtattactgacttgcctt

SEQ ID NO: 18860 - DNA, 21 bp, Artificial sequence
  SiRNA target sequence
aggtattactgacttgccttt

SEQ ID NO: 18861 - DNA, 21 bp, Artificial sequence
  SiRNA target sequence
ggtattactgacttgcctttg

SEQ ID NO: 18862 - DNA, 21 bp, Artificial sequence
  SiRNA target sequence
gtattactgacttgcctttgt

SEQ ID NO: 18863 - DNA, 21 bp, Artificial sequence
  SiRNA target sequence
tattactgacttgcctttgtc

SEQ ID NO: 18864 - DNA, 21 bp, Artificial sequence
  SiRNA target sequence
attactgacttgcctttgtcc

SEQ ID NO: 18865 - DNA, 21 bp, Artificial sequence
  SiRNA target sequence
ttactgacttgcctttgtccg

SEQ ID NO: 18866 - DNA, 21 bp, Artificial sequence
  SiRNA target sequence
tactgacttgcctttgtccga

SEQ ID NO: 18867 - DNA, 21 bp, Artificial sequence
  SiRNA target sequence
actgacttgcctttgtccgag

SEQ ID NO: 18868 - DNA, 21 bp, Artificial sequence
  SiRNA target sequence
ctgacttgcctttgtccgagt

SEQ ID NO: 18869 - DNA, 21 bp, Artificial sequence
  SiRNA target sequence
tgacttgcctttgtccgagtt

SEQ ID NO: 18870 - DNA, 21 bp, Artificial sequence
  SiRNA target sequence
gacttgcctttgtccgagttc

SEQ ID NO: 18871 - DNA, 21 bp, Artificial sequence
  SiRNA target sequence
acttgcctttgtccgagttct

SEQ ID NO: 18872 - DNA, 21 bp, Artificial sequence
  SiRNA target sequence
cttgcctttgtccgagttctc

SEQ ID NO: 18873 - DNA, 21 bp, Artificial sequence
  SiRNA target sequence
ttgcctttgtccgagttctct

SEQ ID NO: 18874 - DNA, 21 bp, Artificial sequence
  SiRNA target sequence
tgcctttgtccgagttctctc

SEQ ID NO: 18875 - DNA, 21 bp, Artificial sequence
  SiRNA target sequence
gcctttgtccgagttctctca

SEQ ID NO: 18876 - DNA, 21 bp, Artificial sequence
  SiRNA target sequence
cctttgtccgagttctctcaa

SEQ ID NO: 18877 - DNA, 21 bp, Artificial sequence
  SiRNA target sequence
ctttgtccgagttctctcaaa

SEQ ID NO: 18878 - DNA, 21 bp, Artificial sequence
  SiRNA target sequence
tttgtccgagttctctcaaaa

SEQ ID NO: 18879 - DNA, 21 bp, Artificial sequence
  SiRNA target sequence
ttgtccgagttctctcaaaat

SEQ ID NO: 18880 - DNA, 21 bp, Artificial sequence
  SiRNA target sequence
tgtccgagttctctcaaaatg

SEQ ID NO: 18881 - DNA, 21 bp, Artificial sequence
  SiRNA target sequence
gtccgagttctctcaaaatgt

SEQ ID NO: 18882 - DNA, 21 bp, Artificial sequence
  SiRNA target sequence
tccgagttctctcaaaatgtt

SEQ ID NO: 18883 - DNA, 21 bp, Artificial sequence
  SiRNA target sequence
ccgagttctctcaaaatgttg

SEQ ID NO: 18884 - DNA, 21 bp, Artificial sequence
  SiRNA target sequence
cgagttctctcaaaatgttgt

SEQ ID NO: 18885 - DNA, 21 bp, Artificial sequence
  SiRNA target sequence
gagttctctcaaaatgttgtt

SEQ ID NO: 18886 - DNA, 21 bp, Artificial sequence
  SiRNA target sequence
agttctctcaaaatgttgttc

SEQ ID NO: 18887 - DNA, 21 bp, Artificial sequence
  SiRNA target sequence
gttctctcaaaatgttgttct

SEQ ID NO: 18888 - DNA, 21 bp, Artificial sequence
  SiRNA target sequence
ttctctcaaaatgttgttctt

SEQ ID NO: 18889 - DNA, 21 bp, Artificial sequence
  SiRNA target sequence
tctctcaaaatgttgttcttg

SEQ ID NO: 18890 - DNA, 21 bp, Artificial sequence
  SiRNA target sequence
ctctcaaaatgttgttcttgt

SEQ ID NO: 18891 - DNA, 21 bp, Artificial sequence
  SiRNA target sequence
tctcaaaatgttgttcttgtc

SEQ ID NO: 18892 - DNA, 21 bp, Artificial sequence
  SiRNA target sequence
ctcaaaatgttgttcttgtct

SEQ ID NO: 18893 - DNA, 21 bp, Artificial sequence
  SiRNA target sequence
tcaaaatgttgttcttgtctg

SEQ ID NO: 18894 - DNA, 21 bp, Artificial sequence
  SiRNA target sequence
caaaatgttgttcttgtctgt

SEQ ID NO: 18895 - DNA, 21 bp, Artificial sequence
  SiRNA target sequence
aaaatgttgttcttgtctgtt

SEQ ID NO: 18896 - DNA, 21 bp, Artificial sequence
  SiRNA target sequence
aaatgttgttcttgtctgtta

SEQ ID NO: 18897 - DNA, 21 bp, Artificial sequence
  SiRNA target sequence
aatgttgttcttgtctgttat

SEQ ID NO: 18898 - DNA, 21 bp, Artificial sequence
  SiRNA target sequence
atgttgttcttgtctgttatg

SEQ ID NO: 18899 - DNA, 21 bp, Artificial sequence
  SiRNA target sequence
tgttgttcttgtctgttatgg

SEQ ID NO: 18900 - DNA, 21 bp, Artificial sequence
  SiRNA target sequence
gttgttcttgtctgttatggc

SEQ ID NO: 18901 - DNA, 21 bp, Artificial sequence
  SiRNA target sequence
ttgttcttgtctgttatggcg

SEQ ID NO: 18902 - DNA, 21 bp, Artificial sequence
  SiRNA target sequence
tgttcttgtctgttatggcga

SEQ ID NO: 18903 - DNA, 21 bp, Artificial sequence
  SiRNA target sequence
gttcttgtctgttatggcgac

SEQ ID NO: 18904 - DNA, 21 bp, Artificial sequence
  SiRNA target sequence
ttcttgtctgttatggcgacg

SEQ ID NO: 18905 - DNA, 21 bp, Artificial sequence
  SiRNA target sequence
tcttgtctgttatggcgacga

SEQ ID NO: 18906 - DNA, 21 bp, Artificial sequence
  SiRNA target sequence
cttgtctgttatggcgacgat

SEQ ID NO: 18907 - DNA, 21 bp, Artificial sequence
  SiRNA target sequence
ttgtctgttatggcgacgatc

SEQ ID NO: 18908 - DNA, 21 bp, Artificial sequence
  SiRNA target sequence
tgtctgttatggcgacgatct

SEQ ID NO: 18909 - DNA, 21 bp, Artificial sequence
  SiRNA target sequence
gtctgttatggcgacgatctt

SEQ ID NO: 18910 - DNA, 21 bp, Artificial sequence
  SiRNA target sequence
tctgttatggcgacgatctta

SEQ ID NO: 18911 - DNA, 21 bp, Artificial sequence
  SiRNA target sequence
ctgttatggcgacgatcttat

SEQ ID NO: 18912 - DNA, 21 bp, Artificial sequence
  SiRNA target sequence
tgttatggcgacgatcttatc

SEQ ID NO: 18913 - DNA, 21 bp, Artificial sequence
  SiRNA target sequence
gttatggcgacgatcttatca

SEQ ID NO: 18914 - DNA, 21 bp, Artificial sequence
  SiRNA target sequence
ttatggcgacgatcttatcat

SEQ ID NO: 18915 - DNA, 21 bp, Artificial sequence
  SiRNA target sequence
tatggcgacgatcttatcatg

SEQ ID NO: 18916 - DNA, 21 bp, Artificial sequence
  SiRNA target sequence
atggcgacgatcttatcatga

SEQ ID NO: 18917 - DNA, 21 bp, Artificial sequence
  SiRNA target sequence
tggcgacgatcttatcatgaa

SEQ ID NO: 18918 - DNA, 21 bp, Artificial sequence
  SiRNA target sequence
ggcgacgatcttatcatgaat

SEQ ID NO: 18919 - DNA, 21 bp, Artificial sequence
  SiRNA target sequence
gcgacgatcttatcatgaatg

SEQ ID NO: 18920 - DNA, 21 bp, Artificial sequence
  SiRNA target sequence
cgacgatcttatcatgaatgt

SEQ ID NO: 18921 - DNA, 21 bp, Artificial sequence
  SiRNA target sequence
gacgatcttatcatgaatgtt

SEQ ID NO: 18922 - DNA, 21 bp, Artificial sequence
  SiRNA target sequence
acgatcttatcatgaatgtta

SEQ ID NO: 18923 - DNA, 21 bp, Artificial sequence
  SiRNA target sequence
cgatcttatcatgaatgttag

SEQ ID NO: 18924 - DNA, 21 bp, Artificial sequence
  SiRNA target sequence
  misc_feature (21)..(21): n is a, c, g, or t
gatcttatcatgaatgttagn

SEQ ID NO: 18925 - DNA, 21 bp, Artificial sequence
  SiRNA target sequence
  misc_feature (20)..(20): n is a, c, g, or t
atcttatcatgaatgttagng

SEQ ID NO: 18926 - DNA, 21 bp, Artificial sequence
  SiRNA target sequence
  misc_feature (19)..(19): n is a, c, g, or t
tcttatcatgaatgttagnga

SEQ ID NO: 18927 - DNA, 21 bp, Artificial sequence
  SiRNA target sequence
  misc_feature (18)..(18): n is a, c, g, or t
cttatcatgaatgttagngat

SEQ ID NO: 18928 - DNA, 21 bp, Artificial sequence
  SiRNA target sequence
  misc_feature (17)..(17): n is a, c, g, or t
ttatcatgaatgttagngata

SEQ ID NO: 18929 - DNA, 21 bp, Artificial sequence
  SiRNA target sequence
  misc_feature (16)..(16): n is a, c, g, or t
tatcatgaatgttagngataa

SEQ ID NO: 18930 - DNA, 21 bp, Artificial sequence
  SiRNA target sequence
  misc_feature (15)..(15): n is a, c, g, or t
atcatgaatgttagngataac

SEQ ID NO: 18931 - DNA, 21 bp, Artificial sequence
  SiRNA target sequence
  misc_feature (14)..(14): n is a, c, g, or t
tcatgaatgttagngataaca

SEQ ID NO: 18932 - DNA, 21 bp, Artificial sequence
  SiRNA target sequence
  misc_feature (13)..(13): n is a, c, g, or t
catgaatgttagngataacat

SEQ ID NO: 18933 - DNA, 21 bp, Artificial sequence
  SiRNA target sequence
  misc_feature (12)..(12): n is a, c, g, or t
atgaatgttagngataacatg

SEQ ID NO: 18934 - DNA, 21 bp, Artificial sequence
  SiRNA target sequence
  misc_feature (11)..(11): n is a, c, g, or t
tgaatgttagngataacatga

SEQ ID NO: 18935 - DNA, 21 bp, Artificial sequence
  SiRNA target sequence
  misc_feature (10)..(10): n is a, c, g, or t
gaatgttagngataacatgat

SEQ ID NO: 18936 - DNA, 21 bp, Artificial sequence
  SiRNA target sequence
  misc_feature (9)..(9): n is a, c, g, or t
aatgttagngataacatgatt

SEQ ID NO: 18937 - DNA, 21 bp, Artificial sequence
  SiRNA target sequence
  misc_feature (8)..(8): n is a, c, g, or t
atgttagngataacatgattg

SEQ ID NO: 18938 - DNA, 21 bp, Artificial sequence
  SiRNA target sequence
  misc_feature (7)..(7): n is a, c, g, or t
tgttagngataacatgattga

SEQ ID NO: 18939 - DNA, 21 bp, Artificial sequence
  SiRNA target sequence
  misc_feature (6)..(6): n is a, c, g, or t
gttagngataacatgattgat

SEQ ID NO: 18940 - DNA, 21 bp, Artificial sequence
  SiRNA target sequence
  misc_feature (5)..(5): n is a, c, g, or t
ttagngataacatgattgata

SEQ ID NO: 18941 - DNA, 21 bp, Artificial sequence
  SiRNA target sequence
  misc_feature (4)..(4): n is a, c, g, or t
tagngataacatgattgataa

SEQ ID NO: 18942 - DNA, 21 bp, Artificial sequence
  SiRNA target sequence
  misc_feature (3)..(3): n is a, c, g, or t
agngataacatgattgataag

SEQ ID NO: 18943 - DNA, 21 bp, Artificial sequence
  SiRNA target sequence
  misc_feature (2)..(2): n is a, c, g, or t
gngataacatgattgataagt

SEQ ID NO: 18944 - DNA, 21 bp, Artificial sequence
  SiRNA target sequence
  misc_feature (1)..(1): n is a, c, g, or t
ngataacatgattgataagtt

SEQ ID NO: 18945 - DNA, 21 bp, Artificial sequence
  SiRNA target sequence
gataacatgattgataagttt

SEQ ID NO: 18946 - DNA, 21 bp, Artificial sequence
  SiRNA target sequence
ataacatgattgataagttta

SEQ ID NO: 18947 - DNA, 21 bp, Artificial sequence
  SiRNA target sequence
taacatgattgataagtttaa

SEQ ID NO: 18948 - DNA, 21 bp, Artificial sequence
  SiRNA target sequence
aacatgattgataagtttaat

SEQ ID NO: 18949 - DNA, 21 bp, Artificial sequence
  SiRNA target sequence
acatgattgataagtttaatg

SEQ ID NO: 18950 - DNA, 21 bp, Artificial sequence
  SiRNA target sequence
catgattgataagtttaatgc

SEQ ID NO: 18951 - DNA, 21 bp, Artificial sequence
  SiRNA target sequence
atgattgataagtttaatgcc

SEQ ID NO: 18952 - DNA, 21 bp, Artificial sequence
  SiRNA target sequence
tgattgataagtttaatgccg

SEQ ID NO: 18953 - DNA, 21 bp, Artificial sequence
  SiRNA target sequence
gattgataagtttaatgccgt

SEQ ID NO: 18954 - DNA, 21 bp, Artificial sequence
  SiRNA target sequence
attgataagtttaatgccgtg

SEQ ID NO: 18955 - DNA, 21 bp, Artificial sequence
  SiRNA target sequence
ttgataagtttaatgccgtga

SEQ ID NO: 18956 - DNA, 21 bp, Artificial sequence
  SiRNA target sequence
tgataagtttaatgccgtgac

SEQ ID NO: 18957 - DNA, 21 bp, Artificial sequence
  SiRNA target sequence
gataagtttaatgccgtgacg

SEQ ID NO: 18958 - DNA, 21 bp, Artificial sequence
  SiRNA target sequence
ataagtttaatgccgtgacga

SEQ ID NO: 18959 - DNA, 21 bp, Artificial sequence
  SiRNA target sequence
taagtttaatgccgtgacgat

SEQ ID NO: 18960 - DNA, 21 bp, Artificial sequence
  SiRNA target sequence
aagtttaatgccgtgacgata

SEQ ID NO: 18961 - DNA, 21 bp, Artificial sequence
  SiRNA target sequence
agtttaatgccgtgacgatag

SEQ ID NO: 18962 - DNA, 21 bp, Artificial sequence
  SiRNA target sequence
gtttaatgccgtgacgatagg

SEQ ID NO: 18963 - DNA, 21 bp, Artificial sequence
  SiRNA target sequence
tttaatgccgtgacgatagga

SEQ ID NO: 18964 - DNA, 21 bp, Artificial sequence
  SiRNA target sequence
ttaatgccgtgacgataggaa

SEQ ID NO: 18965 - DNA, 21 bp, Artificial sequence
  SiRNA target sequence
taatgccgtgacgataggaaa

SEQ ID NO: 18966 - DNA, 21 bp, Artificial sequence
  SiRNA target sequence
aatgccgtgacgataggaaaa

SEQ ID NO: 18967 - DNA, 21 bp, Artificial sequence
  SiRNA target sequence
atgccgtgacgataggaaaat

SEQ ID NO: 18968 - DNA, 21 bp, Artificial sequence
  SiRNA target sequence
tgccgtgacgataggaaaatt

SEQ ID NO: 18969 - DNA, 21 bp, Artificial sequence
  SiRNA target sequence
gccgtgacgataggaaaattc

SEQ ID NO: 18970 - DNA, 21 bp, Artificial sequence
  SiRNA target sequence
ccgtgacgataggaaaattct

SEQ ID NO: 18971 - DNA, 21 bp, Artificial sequence
  SiRNA target sequence
cgtgacgataggaaaattctt

SEQ ID NO: 18972 - DNA, 21 bp, Artificial sequence
  SiRNA target sequence
gtgacgataggaaaattcttt

SEQ ID NO: 18973 - DNA, 21 bp, Artificial sequence
  SiRNA target sequence
tgacgataggaaaattctttt

SEQ ID NO: 18974 - DNA, 21 bp, Artificial sequence
  SiRNA target sequence
gacgataggaaaattcttttc

SEQ ID NO: 18975 - DNA, 21 bp, Artificial sequence
  SiRNA target sequence
acgataggaaaattcttttca

SEQ ID NO: 18976 - DNA, 21 bp, Artificial sequence
  SiRNA target sequence
cgataggaaaattcttttcac

SEQ ID NO: 18977 - DNA, 21 bp, Artificial sequence
  SiRNA target sequence
gataggaaaattcttttcaca

SEQ ID NO: 18978 - DNA, 21 bp, Artificial sequence
  SiRNA target sequence
ataggaaaattcttttcacaa

SEQ ID NO: 18979 - DNA, 21 bp, Artificial sequence
  SiRNA target sequence
taggaaaattcttttcacaat

SEQ ID NO: 18980 - DNA, 21 bp, Artificial sequence
  SiRNA target sequence
aggaaaattcttttcacaata

SEQ ID NO: 18981 - DNA, 21 bp, Artificial sequence
  SiRNA target sequence
ggaaaattcttttcacaatat

SEQ ID NO: 18982 - DNA, 21 bp, Artificial sequence
  SiRNA target sequence
gaaaattcttttcacaatata

SEQ ID NO: 18983 - DNA, 21 bp, Artificial sequence
  SiRNA target sequence
aaaattcttttcacaatataa

SEQ ID NO: 18984 - DNA, 21 bp, Artificial sequence
  SiRNA target sequence
aaattcttttcacaatataag

SEQ ID NO: 18985 - DNA, 21 bp, Artificial sequence
  SiRNA target sequence
aattcttttcacaatataaga

SEQ ID NO: 18986 - DNA, 21 bp, Artificial sequence
  SiRNA target sequence
attcttttcacaatataagat

SEQ ID NO: 18987 - DNA, 21 bp, Artificial sequence
  SiRNA target sequence
ttcttttcacaatataagatg

SEQ ID NO: 18988 - DNA, 21 bp, Artificial sequence
  SiRNA target sequence
tcttttcacaatataagatgg

SEQ ID NO: 18989 - DNA, 21 bp, Artificial sequence
  SiRNA target sequence
cttttcacaatataagatgga

SEQ ID NO: 18990 - DNA, 21 bp, Artificial sequence
  SiRNA target sequence
ttttcacaatataagatggaa

SEQ ID NO: 18991 - DNA, 21 bp, Artificial sequence
  SiRNA target sequence
tttcacaatataagatggaat

SEQ ID NO: 18992 - DNA, 21 bp, Artificial sequence
  SiRNA target sequence
ttcacaatataagatggaatt

SEQ ID NO: 18993 - DNA, 21 bp, Artificial sequence
  SiRNA target sequence
tcacaatataagatggaattt

SEQ ID NO: 18994 - DNA, 21 bp, Artificial sequence
  SiRNA target sequence
cacaatataagatggaattta

SEQ ID NO: 18995 - DNA, 21 bp, Artificial sequence
  SiRNA target sequence
acaatataagatggaatttac

SEQ ID NO: 18996 - DNA, 21 bp, Artificial sequence
  SiRNA target sequence
caatataagatggaatttacg

SEQ ID NO: 18997 - DNA, 21 bp, Artificial sequence
  SiRNA target sequence
aatataagatggaatttacgg

SEQ ID NO: 18998 - DNA, 21 bp, Artificial sequence
  SiRNA target sequence
atataagatggaatttacgga

SEQ ID NO: 18999 - DNA, 21 bp, Artificial sequence
  SiRNA target sequence
tataagatggaatttacggat

SEQ ID NO: 19000 - DNA, 21 bp, Artificial sequence
  SiRNA target sequence
ataagatggaatttacggatc

SEQ ID NO: 19001 - DNA, 21 bp, Artificial sequence
  SiRNA target sequence
taagatggaatttacggatca

SEQ ID NO: 19002 - DNA, 21 bp, Artificial sequence
  SiRNA target sequence
aagatggaatttacggatcag

SEQ ID NO: 19003 - DNA, 21 bp, Artificial sequence
  SiRNA target sequence
agatggaatttacggatcagg

SEQ ID NO: 19004 - DNA, 21 bp, Artificial sequence
  SiRNA target sequence
gatggaatttacggatcagga

SEQ ID NO: 19005 - DNA, 21 bp, Artificial sequence
  SiRNA target sequence
atggaatttacggatcaggat

SEQ ID NO: 19006 - DNA, 21 bp, Artificial sequence
  SiRNA target sequence
tggaatttacggatcaggata

SEQ ID NO: 19007 - DNA, 21 bp, Artificial sequence
  SiRNA target sequence
ggaatttacggatcaggataa

SEQ ID NO: 19008 - DNA, 21 bp, Artificial sequence
  SiRNA target sequence
gaatttacggatcaggataaa

SEQ ID NO: 19009 - DNA, 21 bp, Artificial sequence
  SiRNA target sequence
aatttacggatcaggataaat

SEQ ID NO: 19010 - DNA, 21 bp, Artificial sequence
  SiRNA target sequence
atttacggatcaggataaatc

SEQ ID NO: 19011 - DNA, 21 bp, Artificial sequence
  SiRNA target sequence
tttacggatcaggataaatca

SEQ ID NO: 19012 - DNA, 21 bp, Artificial sequence
  SiRNA target sequence
ttacggatcaggataaatcag

SEQ ID NO: 19013 - DNA, 21 bp, Artificial sequence
  SiRNA target sequence
tacggatcaggataaatcagg

SEQ ID NO: 19014 - DNA, 21 bp, Artificial sequence
  SiRNA target sequence
acggatcaggataaatcagga

SEQ ID NO: 19015 - DNA, 21 bp, Artificial sequence
  SiRNA target sequence
cggatcaggataaatcaggaa

SEQ ID NO: 19016 - DNA, 21 bp, Artificial sequence
  SiRNA target sequence
ggatcaggataaatcaggaaa

SEQ ID NO: 19017 - DNA, 21 bp, Artificial sequence
  SiRNA target sequence
gatcaggataaatcaggaaat

SEQ ID NO: 19018 - DNA, 21 bp, Artificial sequence
  SiRNA target sequence
atcaggataaatcaggaaata

SEQ ID NO: 19019 - DNA, 21 bp, Artificial sequence
  SiRNA target sequence
tcaggataaatcaggaaatac

SEQ ID NO: 19020 - DNA, 21 bp, Artificial sequence
  SiRNA target sequence
caggataaatcaggaaatact

SEQ ID NO: 19021 - DNA, 21 bp, Artificial sequence
  SiRNA target sequence
aggataaatcaggaaatactg

SEQ ID NO: 19022 - DNA, 21 bp, Artificial sequence
  SiRNA target sequence
ggataaatcaggaaatactgt

SEQ ID NO: 19023 - DNA, 21 bp, Artificial sequence
  SiRNA target sequence
gataaatcaggaaatactgta

SEQ ID NO: 19024 - DNA, 21 bp, Artificial sequence
  SiRNA target sequence
ataaatcaggaaatactgtaa

SEQ ID NO: 19025 - DNA, 21 bp, Artificial sequence
  SiRNA target sequence
taaatcaggaaatactgtaaa

SEQ ID NO: 19026 - DNA, 21 bp, Artificial sequence
  SiRNA target sequence
aaatcaggaaatactgtaaag

SEQ ID NO: 19027 - DNA, 21 bp, Artificial sequence
  SiRNA target sequence
aatcaggaaatactgtaaagt

SEQ ID NO: 19028 - DNA, 21 bp, Artificial sequence
  SiRNA target sequence
atcaggaaatactgtaaagtg

SEQ ID NO: 19029 - DNA, 21 bp, Artificial sequence
  SiRNA target sequence
tcaggaaatactgtaaagtgg

SEQ ID NO: 19030 - DNA, 21 bp, Artificial sequence
  SiRNA target sequence
caggaaatactgtaaagtggc

SEQ ID NO: 19031 - DNA, 21 bp, Artificial sequence
  SiRNA target sequence
aggaaatactgtaaagtggcg

SEQ ID NO: 19032 - DNA, 21 bp, Artificial sequence
  SiRNA target sequence
ggaaatactgtaaagtggcgg

SEQ ID NO: 19033 - DNA, 21 bp, Artificial sequence
  SiRNA target sequence
gaaatactgtaaagtggcgga

SEQ ID NO: 19034 - DNA, 21 bp, Artificial sequence
  SiRNA target sequence
aaatactgtaaagtggcggac

SEQ ID NO: 19035 - DNA, 21 bp, Artificial sequence
  SiRNA target sequence
aatactgtaaagtggcggacg

SEQ ID NO: 19036 - DNA, 21 bp, Artificial sequence
  SiRNA target sequence
atactgtaaagtggcggacgt

SEQ ID NO: 19037 - DNA, 21 bp, Artificial sequence
  SiRNA target sequence
tactgtaaagtggcggacgtt

SEQ ID NO: 19038 - DNA, 21 bp, Artificial sequence
  SiRNA target sequence
actgtaaagtggcggacgtta

SEQ ID NO: 19039 - DNA, 21 bp, Artificial sequence
  SiRNA target sequence
ctgtaaagtggcggacgttac

SEQ ID NO: 19040 - DNA, 21 bp, Artificial sequence
  SiRNA target sequence
tgtaaagtggcggacgttaca

SEQ ID NO: 19041 - DNA, 21 bp, Artificial sequence
  SiRNA target sequence
gtaaagtggcggacgttacag

SEQ ID NO: 19042 - DNA, 21 bp, Artificial sequence
  SiRNA target sequence
taaagtggcggacgttacaga

SEQ ID NO: 19043 - DNA, 21 bp, Artificial sequence
  SiRNA target sequence
aaagtggcggacgttacagac

SEQ ID NO: 19044 - DNA, 21 bp, Artificial sequence
  SiRNA target sequence
aagtggcggacgttacagact

SEQ ID NO: 19045 - DNA, 21 bp, Artificial sequence
  SiRNA target sequence
agtggcggacgttacagactg

SEQ ID NO: 19046 - DNA, 21 bp, Artificial sequence
  SiRNA target sequence
gtggcggacgttacagactgc

SEQ ID NO: 19047 - DNA, 21 bp, Artificial sequence
  SiRNA target sequence
tggcggacgttacagactgct

SEQ ID NO: 19048 - DNA, 21 bp, Artificial sequence
  SiRNA target sequence
ggcggacgttacagactgcta

SEQ ID NO: 19049 - DNA, 21 bp, Artificial sequence
  SiRNA target sequence
gcggacgttacagactgctac

SEQ ID NO: 19050 - DNA, 21 bp, Artificial sequence
  SiRNA target sequence
cggacgttacagactgctact

SEQ ID NO: 19051 - DNA, 21 bp, Artificial sequence
  SiRNA target sequence
ggacgttacagactgctactt

SEQ ID NO: 19052 - DNA, 21 bp, Artificial sequence
  SiRNA target sequence
gacgttacagactgctacttt

SEQ ID NO: 19053 - DNA, 21 bp, Artificial sequence
  SiRNA target sequence
acgttacagactgctactttc

SEQ ID NO: 19054 - DNA, 21 bp, Artificial sequence
  SiRNA target sequence
cgttacagactgctactttct

SEQ ID NO: 19055 - DNA, 21 bp, Artificial sequence
  SiRNA target sequence
gttacagactgctactttctt

SEQ ID NO: 19056 - DNA, 21 bp, Artificial sequence
  SiRNA target sequence
ttacagactgctactttctta

SEQ ID NO: 19057 - DNA, 21 bp, Artificial sequence
  SiRNA target sequence
tacagactgctactttcttaa

SEQ ID NO: 19058 - DNA, 21 bp, Artificial sequence
  SiRNA target sequence
acagactgctactttcttaaa

SEQ ID NO: 19059 - DNA, 21 bp, Artificial sequence
  SiRNA target sequence
cagactgctactttcttaaaa

SEQ ID NO: 19060 - DNA, 21 bp, Artificial sequence
  SiRNA target sequence
agactgctactttcttaaaac

SEQ ID NO: 19061 - DNA, 21 bp, Artificial sequence
  SiRNA target sequence
gactgctactttcttaaaaca

SEQ ID NO: 19062 - DNA, 21 bp, Artificial sequence
  SiRNA target sequence
actgctactttcttaaaacat

SEQ ID NO: 19063 - DNA, 21 bp, Artificial sequence
  SiRNA target sequence
ctgctactttcttaaaacatg

SEQ ID NO: 19064 - DNA, 21 bp, Artificial sequence
  SiRNA target sequence
tgctactttcttaaaacatgg

SEQ ID NO: 19065 - DNA, 21 bp, Artificial sequence
  SiRNA target sequence
gctactttcttaaaacatggg

SEQ ID NO: 19066 - DNA, 21 bp, Artificial sequence
  SiRNA target sequence
ctactttcttaaaacatgggt

SEQ ID NO: 19067 - DNA, 21 bp, Artificial sequence
  SiRNA target sequence
tactttcttaaaacatgggtt

SEQ ID NO: 19068 - DNA, 21 bp, Artificial sequence
  SiRNA target sequence
actttcttaaaacatgggttc

SEQ ID NO: 19069 - DNA, 21 bp, Artificial sequence
  SiRNA target sequence
ctttcttaaaacatgggttct

SEQ ID NO: 19070 - DNA, 21 bp, Artificial sequence
  SiRNA target sequence
tttcttaaaacatgggttctt

SEQ ID NO: 19071 - DNA, 21 bp, Artificial sequence
  SiRNA target sequence
ttcttaaaacatgggttctta

SEQ ID NO: 19072 - DNA, 21 bp, Artificial sequence
  SiRNA target sequence
tcttaaaacatgggttcttaa

SEQ ID NO: 19073 - DNA, 21 bp, Artificial sequence
  SiRNA target sequence
cttaaaacatgggttcttaaa

SEQ ID NO: 19074 - DNA, 21 bp, Artificial sequence
  SiRNA target sequence
ttaaaacatgggttcttaaaa

SEQ ID NO: 19075 - DNA, 21 bp, Artificial sequence
  SiRNA target sequence
taaaacatgggttcttaaaac

SEQ ID NO: 19076 - DNA, 21 bp, Artificial sequence
  SiRNA target sequence
aaaacatgggttcttaaaaca

SEQ ID NO: 19077 - DNA, 21 bp, Artificial sequence
  SiRNA target sequence
aaacatgggttcttaaaacat

SEQ ID NO: 19078 - DNA, 21 bp, Artificial sequence
  SiRNA target sequence
aacatgggttcttaaaacatc

SEQ ID NO: 19079 - DNA, 21 bp, Artificial sequence
  SiRNA target sequence
acatgggttcttaaaacatcc

SEQ ID NO: 19080 - DNA, 21 bp, Artificial sequence
  SiRNA target sequence
catgggttcttaaaacatcca

SEQ ID NO: 19081 - DNA, 21 bp, Artificial sequence
  SiRNA target sequence
atgggttcttaaaacatccaa

SEQ ID NO: 19082 - DNA, 21 bp, Artificial sequence
  SiRNA target sequence
tgggttcttaaaacatccaac

SEQ ID NO: 19083 - DNA, 21 bp, Artificial sequence
  SiRNA target sequence
gggttcttaaaacatccaact

SEQ ID NO: 19084 - DNA, 21 bp, Artificial sequence
  SiRNA target sequence
ggttcttaaaacatccaacta

SEQ ID NO: 19085 - DNA, 21 bp, Artificial sequence
  SiRNA target sequence
gttcttaaaacatccaactag

SEQ ID NO: 19086 - DNA, 21 bp, Artificial sequence
  SiRNA target sequence
ttcttaaaacatccaactaga

SEQ ID NO: 19087 - DNA, 21 bp, Artificial sequence
  SiRNA target sequence
tcttaaaacatccaactagac

SEQ ID NO: 19088 - DNA, 21 bp, Artificial sequence
  SiRNA target sequence
cttaaaacatccaactagacc

SEQ ID NO: 19089 - DNA, 21 bp, Artificial sequence
  SiRNA target sequence
ttaaaacatccaactagacct

SEQ ID NO: 19090 - DNA, 21 bp, Artificial sequence
  SiRNA target sequence
taaaacatccaactagacctg

SEQ ID NO: 19091 - DNA, 21 bp, Artificial sequence
  SiRNA target sequence
aaaacatccaactagacctgt

SEQ ID NO: 19092 - DNA, 21 bp, Artificial sequence
  SiRNA target sequence
aaacatccaactagacctgtg

SEQ ID NO: 19093 - DNA, 21 bp, Artificial sequence
  SiRNA target sequence
aacatccaactagacctgtgt

SEQ ID NO: 19094 - DNA, 21 bp, Artificial sequence
  SiRNA target sequence
acatccaactagacctgtgtt

SEQ ID NO: 19095 - DNA, 21 bp, Artificial sequence
  SiRNA target sequence
catccaactagacctgtgttt

SEQ ID NO: 19096 - DNA, 21 bp, Artificial sequence
  SiRNA target sequence
atccaactagacctgtgtttc

SEQ ID NO: 19097 - DNA, 21 bp, Artificial sequence
  SiRNA target sequence
tccaactagacctgtgtttct

SEQ ID NO: 19098 - DNA, 21 bp, Artificial sequence
  SiRNA target sequence
ccaactagacctgtgtttcta

SEQ ID NO: 19099 - DNA, 21 bp, Artificial sequence
  SiRNA target sequence
caactagacctgtgtttctag

SEQ ID NO: 19100 - DNA, 21 bp, Artificial sequence
  SiRNA target sequence
aactagacctgtgtttctagc

SEQ ID NO: 19101 - DNA, 21 bp, Artificial sequence
  SiRNA target sequence
actagacctgtgtttctagct

SEQ ID NO: 19102 - DNA, 21 bp, Artificial sequence
  SiRNA target sequence
ctagacctgtgtttctagcta

SEQ ID NO: 19103 - DNA, 21 bp, Artificial sequence
  SiRNA target sequence
tagacctgtgtttctagctaa

SEQ ID NO: 19104 - DNA, 21 bp, Artificial sequence
  SiRNA target sequence
agacctgtgtttctagctaac

SEQ ID NO: 19105 - DNA, 21 bp, Artificial sequence
  SiRNA target sequence
gacctgtgtttctagctaacc

SEQ ID NO: 19106 - DNA, 21 bp, Artificial sequence
  SiRNA target sequence
acctgtgtttctagctaacct

SEQ ID NO: 19107 - DNA, 21 bp, Artificial sequence
  SiRNA target sequence
cctgtgtttctagctaacctg

SEQ ID NO: 19108 - DNA, 21 bp, Artificial sequence
  SiRNA target sequence
ctgtgtttctagctaacctgg

SEQ ID NO: 19109 - DNA, 21 bp, Artificial sequence
  SiRNA target sequence
tgtgtttctagctaacctgga

SEQ ID NO: 19110 - DNA, 21 bp, Artificial sequence
  SiRNA target sequence
gtgtttctagctaacctggac

SEQ ID NO: 19111 - DNA, 21 bp, Artificial sequence
  SiRNA target sequence
tgtttctagctaacctggaca

SEQ ID NO: 19112 - DNA, 21 bp, Artificial sequence
  SiRNA target sequence
gtttctagctaacctggacaa

SEQ ID NO: 19113 - DNA, 21 bp, Artificial sequence
  SiRNA target sequence
tttctagctaacctggacaag

SEQ ID NO: 19114 - DNA, 21 bp, Artificial sequence
  SiRNA target sequence
ttctagctaacctggacaagg

SEQ ID NO: 19115 - DNA, 21 bp, Artificial sequence
  SiRNA target sequence
tctagctaacctggacaaggt

SEQ ID NO: 19116 - DNA, 21 bp, Artificial sequence
  SiRNA target sequence
ctagctaacctggacaaggtc

SEQ ID NO: 19117 - DNA, 21 bp, Artificial sequence
  SiRNA target sequence
tagctaacctggacaaggtct

SEQ ID NO: 19118 - DNA, 21 bp, Artificial sequence
  SiRNA target sequence
agctaacctggacaaggtctc

SEQ ID NO: 19119 - DNA, 21 bp, Artificial sequence
  SiRNA target sequence
gctaacctggacaaggtctcg

SEQ ID NO: 19120 - DNA, 21 bp, Artificial sequence
  SiRNA target sequence
ctaacctggacaaggtctcgg

SEQ ID NO: 19121 - DNA, 21 bp, Artificial sequence
  SiRNA target sequence
taacctggacaaggtctcggt

SEQ ID NO: 19122 - DNA, 21 bp, Artificial sequence
  SiRNA target sequence
aacctggacaaggtctcggta

SEQ ID NO: 19123 - DNA, 21 bp, Artificial sequence
  SiRNA target sequence
acctggacaaggtctcggtag

SEQ ID NO: 19124 - DNA, 21 bp, Artificial sequence
  SiRNA target sequence
cctggacaaggtctcggtaga

SEQ ID NO: 19125 - DNA, 21 bp, Artificial sequence
  SiRNA target sequence
ctggacaaggtctcggtagaa

SEQ ID NO: 19126 - DNA, 21 bp, Artificial sequence
  SiRNA target sequence
tggacaaggtctcggtagaag

SEQ ID NO: 19127 - DNA, 21 bp, Artificial sequence
  SiRNA target sequence
ggacaaggtctcggtagaagg

SEQ ID NO: 19128 - DNA, 21 bp, Artificial sequence
  SiRNA target sequence
gacaaggtctcggtagaagga

SEQ ID NO: 19129 - DNA, 21 bp, Artificial sequence
  SiRNA target sequence
acaaggtctcggtagaaggaa

SEQ ID NO: 19130 - DNA, 21 bp, Artificial sequence
  SiRNA target sequence
caaggtctcggtagaaggaac

SEQ ID NO: 19131 - DNA, 21 bp, Artificial sequence
  SiRNA target sequence
aaggtctcggtagaaggaacg

SEQ ID NO: 19132 - DNA, 21 bp, Artificial sequence
  SiRNA target sequence
aggtctcggtagaaggaacga

SEQ ID NO: 19133 - DNA, 21 bp, Artificial sequence
  SiRNA target sequence
ggtctcggtagaaggaacgac

SEQ ID NO: 19134 - DNA, 21 bp, Artificial sequence
  SiRNA target sequence
gtctcggtagaaggaacgacg

SEQ ID NO: 19135 - DNA, 21 bp, Artificial sequence
  SiRNA target sequence
tctcggtagaaggaacgacga

SEQ ID NO: 19136 - DNA, 21 bp, Artificial sequence
  SiRNA target sequence
ctcggtagaaggaacgacgaa

SEQ ID NO: 19137 - DNA, 21 bp, Artificial sequence
  SiRNA target sequence
tcggtagaaggaacgacgaat

SEQ ID NO: 19138 - DNA, 21 bp, Artificial sequence
  SiRNA target sequence
cggtagaaggaacgacgaatt

SEQ ID NO: 19139 - DNA, 21 bp, Artificial sequence
  SiRNA target sequence
ggtagaaggaacgacgaattg

SEQ ID NO: 19140 - DNA, 21 bp, Artificial sequence
  SiRNA target sequence
gtagaaggaacgacgaattgg

SEQ ID NO: 19141 - DNA, 21 bp, Artificial sequence
  SiRNA target sequence
tagaaggaacgacgaattgga

SEQ ID NO: 19142 - DNA, 21 bp, Artificial sequence
  SiRNA target sequence
agaaggaacgacgaattggac

SEQ ID NO: 19143 - DNA, 21 bp, Artificial sequence
  SiRNA target sequence
gaaggaacgacgaattggact

SEQ ID NO: 19144 - DNA, 21 bp, Artificial sequence
  SiRNA target sequence
aaggaacgacgaattggactc

SEQ ID NO: 19145 - DNA, 21 bp, Artificial sequence
  SiRNA target sequence
aggaacgacgaattggactca

SEQ ID NO: 19146 - DNA, 21 bp, Artificial sequence
  SiRNA target sequence
ggaacgacgaattggactcat

SEQ ID NO: 19147 - DNA, 21 bp, Artificial sequence
  SiRNA target sequence
gaacgacgaattggactcatg

SEQ ID NO: 19148 - DNA, 21 bp, Artificial sequence
  SiRNA target sequence
aacgacgaattggactcatgc

SEQ ID NO: 19149 - DNA, 21 bp, Artificial sequence
  SiRNA target sequence
acgacgaattggactcatgct

SEQ ID NO: 19150 - DNA, 21 bp, Artificial sequence
  SiRNA target sequence
cgacgaattggactcatgctc

SEQ ID NO: 19151 - DNA, 21 bp, Artificial sequence
  SiRNA target sequence
gacgaattggactcatgctcg

SEQ ID NO: 19152 - DNA, 21 bp, Artificial sequence
  SiRNA target sequence
acgaattggactcatgctcga

SEQ ID NO: 19153 - DNA, 21 bp, Artificial sequence
  SiRNA target sequence
cgaattggactcatgctcgag

SEQ ID NO: 19154 - DNA, 21 bp, Artificial sequence
  SiRNA target sequence
gaattggactcatgctcgagg

SEQ ID NO: 19155 - DNA, 21 bp, Artificial sequence
  SiRNA target sequence
aattggactcatgctcgagga

SEQ ID NO: 19156 - DNA, 21 bp, Artificial sequence
  SiRNA target sequence
attggactcatgctcgaggat

SEQ ID NO: 19157 - DNA, 21 bp, Artificial sequence
  SiRNA target sequence
ttggactcatgctcgaggatt

SEQ ID NO: 19158 - DNA, 21 bp, Artificial sequence
  SiRNA target sequence
tggactcatgctcgaggattg

SEQ ID NO: 19159 - DNA, 21 bp, Artificial sequence
  SiRNA target sequence
ggactcatgctcgaggattgg

SEQ ID NO: 19160 - DNA, 21 bp, Artificial sequence
  SiRNA target sequence
gactcatgctcgaggattggg

SEQ ID NO: 19161 - DNA, 21 bp, Artificial sequence
  SiRNA target sequence
actcatgctcgaggattgggt

SEQ ID NO: 19162 - DNA, 21 bp, Artificial sequence
  SiRNA target sequence
ctcatgctcgaggattgggtc

SEQ ID NO: 19163 - DNA, 21 bp, Artificial sequence
  SiRNA target sequence
tcatgctcgaggattgggtcg

SEQ ID NO: 19164 - DNA, 21 bp, Artificial sequence
  SiRNA target sequence
catgctcgaggattgggtcgt

SEQ ID NO: 19165 - DNA, 21 bp, Artificial sequence
  SiRNA target sequence
atgctcgaggattgggtcgtc

SEQ ID NO: 19166 - DNA, 21 bp, Artificial sequence
  SiRNA target sequence
tgctcgaggattgggtcgtcg

SEQ ID NO: 19167 - DNA, 21 bp, Artificial sequence
  SiRNA target sequence
gctcgaggattgggtcgtcgt

SEQ ID NO: 19168 - DNA, 21 bp, Artificial sequence
  SiRNA target sequence
ctcgaggattgggtcgtcgta

SEQ ID NO: 19169 - DNA, 21 bp, Artificial sequence
  SiRNA target sequence
tcgaggattgggtcgtcgtac

SEQ ID NO: 19170 - DNA, 21 bp, Artificial sequence
  SiRNA target sequence
cgaggattgggtcgtcgtaca

SEQ ID NO: 19171 - DNA, 21 bp, Artificial sequence
  SiRNA target sequence
gaggattgggtcgtcgtacag

SEQ ID NO: 19172 - DNA, 21 bp, Artificial sequence
  SiRNA target sequence
aggattgggtcgtcgtacagc

SEQ ID NO: 19173 - DNA, 21 bp, Artificial sequence
  SiRNA target sequence
ggattgggtcgtcgtacagca

SEQ ID NO: 19174 - DNA, 21 bp, Artificial sequence
  SiRNA target sequence
gattgggtcgtcgtacagcaa

SEQ ID NO: 19175 - DNA, 21 bp, Artificial sequence
  SiRNA target sequence
attgggtcgtcgtacagcaac

SEQ ID NO: 19176 - DNA, 21 bp, Artificial sequence
  SiRNA target sequence
ttgggtcgtcgtacagcaacc

SEQ ID NO: 19177 - DNA, 21 bp, Artificial sequence
  SiRNA target sequence
tgggtcgtcgtacagcaacca

SEQ ID NO: 19178 - DNA, 21 bp, Artificial sequence
  SiRNA target sequence
gggtcgtcgtacagcaaccat

SEQ ID NO: 19179 - DNA, 21 bp, Artificial sequence
  SiRNA target sequence
ggtcgtcgtacagcaaccata

SEQ ID NO: 19180 - DNA, 21 bp, Artificial sequence
  SiRNA target sequence
gtcgtcgtacagcaaccatag

SEQ ID NO: 19181 - DNA, 21 bp, Artificial sequence
  SiRNA target sequence
tcgtcgtacagcaaccataga

SEQ ID NO: 19182 - DNA, 21 bp, Artificial sequence
  SiRNA target sequence
cgtcgtacagcaaccatagaa

SEQ ID NO: 19183 - DNA, 21 bp, Artificial sequence
  SiRNA target sequence
gtcgtacagcaaccatagaaa

SEQ ID NO: 19184 - DNA, 21 bp, Artificial sequence
  SiRNA target sequence
tcgtacagcaaccatagaaaa

SEQ ID NO: 19185 - DNA, 21 bp, Artificial sequence
  SiRNA target sequence
cgtacagcaaccatagaaaat

SEQ ID NO: 19186 - DNA, 21 bp, Artificial sequence
  SiRNA target sequence
gtacagcaaccatagaaaatg

SEQ ID NO: 19187 - DNA, 21 bp, Artificial sequence
  SiRNA target sequence
tacagcaaccatagaaaatgc

SEQ ID NO: 19188 - DNA, 21 bp, Artificial sequence
  SiRNA target sequence
acagcaaccatagaaaatgct

SEQ ID NO: 19189 - DNA, 21 bp, Artificial sequence
  SiRNA target sequence
cagcaaccatagaaaatgcta

SEQ ID NO: 19190 - DNA, 21 bp, Artificial sequence
  SiRNA target sequence
agcaaccatagaaaatgctaa

SEQ ID NO: 19191 - DNA, 21 bp, Artificial sequence
  SiRNA target sequence
gcaaccatagaaaatgctaaa

SEQ ID NO: 19192 - DNA, 21 bp, Artificial sequence
  SiRNA target sequence
caaccatagaaaatgctaaac

SEQ ID NO: 19193 - DNA, 21 bp, Artificial sequence
  SiRNA target sequence
aaccatagaaaatgctaaaca

SEQ ID NO: 19194 - DNA, 21 bp, Artificial sequence
  SiRNA target sequence
accatagaaaatgctaaacaa

SEQ ID NO: 19195 - DNA, 21 bp, Artificial sequence
  SiRNA target sequence
ccatagaaaatgctaaacaag

SEQ ID NO: 19196 - DNA, 21 bp, Artificial sequence
  SiRNA target sequence
catagaaaatgctaaacaagc

SEQ ID NO: 19197 - DNA, 21 bp, Artificial sequence
  SiRNA target sequence
atagaaaatgctaaacaagcg

SEQ ID NO: 19198 - DNA, 21 bp, Artificial sequence
  SiRNA target sequence
tagaaaatgctaaacaagcgt

SEQ ID NO: 19199 - DNA, 21 bp, Artificial sequence
  SiRNA target sequence
agaaaatgctaaacaagcgtt

SEQ ID NO: 19200 - DNA, 21 bp, Artificial sequence
  SiRNA target sequence
gaaaatgctaaacaagcgtta

SEQ ID NO: 19201 - DNA, 21 bp, Artificial sequence
  SiRNA target sequence
aaaatgctaaacaagcgttag

SEQ ID NO: 19202 - DNA, 21 bp, Artificial sequence
  SiRNA target sequence
aaatgctaaacaagcgttaga

SEQ ID NO: 19203 - DNA, 21 bp, Artificial sequence
  SiRNA target sequence
aatgctaaacaagcgttagag

SEQ ID NO: 19204 - DNA, 21 bp, Artificial sequence
  SiRNA target sequence
atgctaaacaagcgttagagt

SEQ ID NO: 19205 - DNA, 21 bp, Artificial sequence
  SiRNA target sequence
tgctaaacaagcgttagagtt

SEQ ID NO: 19206 - DNA, 21 bp, Artificial sequence
  SiRNA target sequence
gctaaacaagcgttagagtta

SEQ ID NO: 19207 - DNA, 21 bp, Artificial sequence
  SiRNA target sequence
ctaaacaagcgttagagttag

SEQ ID NO: 19208 - DNA, 21 bp, Artificial sequence
  SiRNA target sequence
taaacaagcgttagagttagc

SEQ ID NO: 19209 - DNA, 21 bp, Artificial sequence
  SiRNA target sequence
aaacaagcgttagagttagca

SEQ ID NO: 19210 - DNA, 21 bp, Artificial sequence
  SiRNA target sequence
aacaagcgttagagttagcat

SEQ ID NO: 19211 - DNA, 21 bp, Artificial sequence
  SiRNA target sequence
acaagcgttagagttagcatt

SEQ ID NO: 19212 - DNA, 21 bp, Artificial sequence
  SiRNA target sequence
caagcgttagagttagcattt

SEQ ID NO: 19213 - DNA, 21 bp, Artificial sequence
  SiRNA target sequence
aagcgttagagttagcatttg

SEQ ID NO: 19214 - DNA, 21 bp, Artificial sequence
  SiRNA target sequence
agcgttagagttagcatttgg

SEQ ID NO: 19215 - DNA, 21 bp, Artificial sequence
  SiRNA target sequence
gcgttagagttagcatttggg

SEQ ID NO: 19216 - DNA, 21 bp, Artificial sequence
  SiRNA target sequence
cgttagagttagcatttgggt

SEQ ID NO: 19217 - DNA, 21 bp, Artificial sequence
  SiRNA target sequence
gttagagttagcatttgggtg

SEQ ID NO: 19218 - DNA, 21 bp, Artificial sequence
  SiRNA target sequence
ttagagttagcatttgggtgg

SEQ ID NO: 19219 - DNA, 21 bp, Artificial sequence
  SiRNA target sequence
tagagttagcatttgggtggg

SEQ ID NO: 19220 - DNA, 21 bp, Artificial sequence
  SiRNA target sequence
agagttagcatttgggtgggg

SEQ ID NO: 19221 - DNA, 21 bp, Artificial sequence
  SiRNA target sequence
gagttagcatttgggtggggt

SEQ ID NO: 19222 - DNA, 21 bp, Artificial sequence
  SiRNA target sequence
agttagcatttgggtggggtc

SEQ ID NO: 19223 - DNA, 21 bp, Artificial sequence
  SiRNA target sequence
gttagcatttgggtggggtcc

SEQ ID NO: 19224 - DNA, 21 bp, Artificial sequence
  SiRNA target sequence
ttagcatttgggtggggtcct

SEQ ID NO: 19225 - DNA, 21 bp, Artificial sequence
  SiRNA target sequence
tagcatttgggtggggtcctg

SEQ ID NO: 19226 - DNA, 21 bp, Artificial sequence
  SiRNA target sequence
agcatttgggtggggtcctga

SEQ ID NO: 19227 - DNA, 21 bp, Artificial sequence
  SiRNA target sequence
gcatttgggtggggtcctgaa

SEQ ID NO: 19228 - DNA, 21 bp, Artificial sequence
  SiRNA target sequence
catttgggtggggtcctgaat

SEQ ID NO: 19229 - DNA, 21 bp, Artificial sequence
  SiRNA target sequence
atttgggtggggtcctgaata

SEQ ID NO: 19230 - DNA, 21 bp, Artificial sequence
  SiRNA target sequence
tttgggtggggtcctgaatat

SEQ ID NO: 19231 - DNA, 21 bp, Artificial sequence
  SiRNA target sequence
ttgggtggggtcctgaatatt

SEQ ID NO: 19232 - DNA, 21 bp, Artificial sequence
  SiRNA target sequence
tgggtggggtcctgaatattt

SEQ ID NO: 19233 - DNA, 21 bp, Artificial sequence
  SiRNA target sequence
gggtggggtcctgaatatttt

SEQ ID NO: 19234 - DNA, 21 bp, Artificial sequence
  SiRNA target sequence
ggtggggtcctgaatatttta

SEQ ID NO: 19235 - DNA, 21 bp, Artificial sequence
  SiRNA target sequence
gtggggtcctgaatattttaa

SEQ ID NO: 19236 - DNA, 21 bp, Artificial sequence
  SiRNA target sequence
tggggtcctgaatattttaat

SEQ ID NO: 19237 - DNA, 21 bp, Artificial sequence
  SiRNA target sequence
ggggtcctgaatattttaatt

SEQ ID NO: 19238 - DNA, 21 bp, Artificial sequence
  SiRNA target sequence
gggtcctgaatattttaatta

SEQ ID NO: 19239 - DNA, 21 bp, Artificial sequence
  SiRNA target sequence
ggtcctgaatattttaattat

SEQ ID NO: 19240 - DNA, 21 bp, Artificial sequence
  SiRNA target sequence
gtcctgaatattttaattatg

SEQ ID NO: 19241 - DNA, 21 bp, Artificial sequence
  SiRNA target sequence
tcctgaatattttaattatgt

SEQ ID NO: 19242 - DNA, 21 bp, Artificial sequence
  SiRNA target sequence
cctgaatattttaattatgtc

SEQ ID NO: 19243 - DNA, 21 bp, Artificial sequence
  SiRNA target sequence
ctgaatattttaattatgtca

SEQ ID NO: 19244 - DNA, 21 bp, Artificial sequence
  SiRNA target sequence
tgaatattttaattatgtcag

SEQ ID NO: 19245 - DNA, 21 bp, Artificial sequence
  SiRNA target sequence
gaatattttaattatgtcaga

SEQ ID NO: 19246 - DNA, 21 bp, Artificial sequence
  SiRNA target sequence
aatattttaattatgtcagaa

SEQ ID NO: 19247 - DNA, 21 bp, Artificial sequence
  SiRNA target sequence
atattttaattatgtcagaaa

SEQ ID NO: 19248 - DNA, 21 bp, Artificial sequence
  SiRNA target sequence
tattttaattatgtcagaaat

SEQ ID NO: 19249 - DNA, 21 bp, Artificial sequence
  SiRNA target sequence
attttaattatgtcagaaata

SEQ ID NO: 19250 - DNA, 21 bp, Artificial sequence
  SiRNA target sequence
ttttaattatgtcagaaatac

SEQ ID NO: 19251 - DNA, 21 bp, Artificial sequence
  SiRNA target sequence
tttaattatgtcagaaatacc

SEQ ID NO: 19252 - DNA, 21 bp, Artificial sequence
  SiRNA target sequence
ttaattatgtcagaaatacca

SEQ ID NO: 19253 - DNA, 21 bp, Artificial sequence
  SiRNA target sequence
taattatgtcagaaataccat

SEQ ID NO: 19254 - DNA, 21 bp, Artificial sequence
  SiRNA target sequence
aattatgtcagaaataccatt

SEQ ID NO: 19255 - DNA, 21 bp, Artificial sequence
  SiRNA target sequence
attatgtcagaaataccatta

SEQ ID NO: 19256 - DNA, 21 bp, Artificial sequence
  SiRNA target sequence
ttatgtcagaaataccattaa

SEQ ID NO: 19257 - DNA, 21 bp, Artificial sequence
  SiRNA target sequence
tatgtcagaaataccattaaa

SEQ ID NO: 19258 - DNA, 21 bp, Artificial sequence
  SiRNA target sequence
atgtcagaaataccattaaaa

SEQ ID NO: 19259 - DNA, 21 bp, Artificial sequence
  SiRNA target sequence
tgtcagaaataccattaaaat

SEQ ID NO: 19260 - DNA, 21 bp, Artificial sequence
  SiRNA target sequence
gtcagaaataccattaaaatg

SEQ ID NO: 19261 - DNA, 21 bp, Artificial sequence
  SiRNA target sequence
tcagaaataccattaaaatgg

SEQ ID NO: 19262 - DNA, 21 bp, Artificial sequence
  SiRNA target sequence
cagaaataccattaaaatggc

SEQ ID NO: 19263 - DNA, 21 bp, Artificial sequence
  SiRNA target sequence
agaaataccattaaaatggct

SEQ ID NO: 19264 - DNA, 21 bp, Artificial sequence
  SiRNA target sequence
gaaataccattaaaatggctt

SEQ ID NO: 19265 - DNA, 21 bp, Artificial sequence
  SiRNA target sequence
aaataccattaaaatggcttt

SEQ ID NO: 19266 - DNA, 21 bp, Artificial sequence
  SiRNA target sequence
aataccattaaaatggctttt

SEQ ID NO: 19267 - DNA, 21 bp, Artificial sequence
  SiRNA target sequence
ataccattaaaatggcttttg

SEQ ID NO: 19268 - DNA, 21 bp, Artificial sequence
  SiRNA target sequence
taccattaaaatggcttttga

SEQ ID NO: 19269 - DNA, 21 bp, Artificial sequence
  SiRNA target sequence
accattaaaatggcttttgac

SEQ ID NO: 19270 - DNA, 21 bp, Artificial sequence
  SiRNA target sequence
ccattaaaatggcttttgaca

SEQ ID NO: 19271 - DNA, 21 bp, Artificial sequence
  SiRNA target sequence
cattaaaatggcttttgacaa

SEQ ID NO: 19272 - DNA, 21 bp, Artificial sequence
  SiRNA target sequence
attaaaatggcttttgacaag

SEQ ID NO: 19273 - DNA, 21 bp, Artificial sequence
  SiRNA target sequence
ttaaaatggcttttgacaagt

SEQ ID NO: 19274 - DNA, 21 bp, Artificial sequence
  SiRNA target sequence
taaaatggcttttgacaagtt

SEQ ID NO: 19275 - DNA, 21 bp, Artificial sequence
  SiRNA target sequence
aaaatggcttttgacaagttg

SEQ ID NO: 19276 - DNA, 21 bp, Artificial sequence
  SiRNA target sequence
aaatggcttttgacaagttgg

SEQ ID NO: 19277 - DNA, 21 bp, Artificial sequence
  SiRNA target sequence
aatggcttttgacaagttggg

SEQ ID NO: 19278 - DNA, 21 bp, Artificial sequence
  SiRNA target sequence
atggcttttgacaagttgggt

SEQ ID NO: 19279 - DNA, 21 bp, Artificial sequence
  SiRNA target sequence
tggcttttgacaagttgggta

SEQ ID NO: 19280 - DNA, 21 bp, Artificial sequence
  SiRNA target sequence
ggcttttgacaagttgggtat

SEQ ID NO: 19281 - DNA, 21 bp, Artificial sequence
  SiRNA target sequence
gcttttgacaagttgggtatt

SEQ ID NO: 19282 - DNA, 21 bp, Artificial sequence
  SiRNA target sequence
cttttgacaagttgggtattt

SEQ ID NO: 19283 - DNA, 21 bp, Artificial sequence
  SiRNA target sequence
ttttgacaagttgggtattta

SEQ ID NO: 19284 - DNA, 21 bp, Artificial sequence
  SiRNA target sequence
tttgacaagttgggtatttat

SEQ ID NO: 19285 - DNA, 21 bp, Artificial sequence
  SiRNA target sequence
ttgacaagttgggtatttatg

SEQ ID NO: 19286 - DNA, 21 bp, Artificial sequence
  SiRNA target sequence
tgacaagttgggtatttatga

SEQ ID NO: 19287 - DNA, 21 bp, Artificial sequence
  SiRNA target sequence
gacaagttgggtatttatgag

SEQ ID NO: 19288 - DNA, 21 bp, Artificial sequence
  SiRNA target sequence
acaagttgggtatttatgagg

SEQ ID NO: 19289 - DNA, 21 bp, Artificial sequence
  SiRNA target sequence
caagttgggtatttatgagga

SEQ ID NO: 19290 - DNA, 21 bp, Artificial sequence
  SiRNA target sequence
aagttgggtatttatgaggac

SEQ ID NO: 19291 - DNA, 21 bp, Artificial sequence
  SiRNA target sequence
agttgggtatttatgaggacc

SEQ ID NO: 19292 - DNA, 21 bp, Artificial sequence
  SiRNA target sequence
gttgggtatttatgaggacct

SEQ ID NO: 19293 - DNA, 21 bp, Artificial sequence
  SiRNA target sequence
ttgggtatttatgaggacctt

SEQ ID NO: 19294 - DNA, 21 bp, Artificial sequence
  SiRNA target sequence
tgggtatttatgaggacctta

SEQ ID NO: 19295 - DNA, 21 bp, Artificial sequence
  SiRNA target sequence
gggtatttatgaggaccttat

SEQ ID NO: 19296 - DNA, 21 bp, Artificial sequence
  SiRNA target sequence
ggtatttatgaggaccttatc

SEQ ID NO: 19297 - DNA, 21 bp, Artificial sequence
  SiRNA target sequence
gtatttatgaggaccttatca

SEQ ID NO: 19298 - DNA, 21 bp, Artificial sequence
  SiRNA target sequence
tatttatgaggaccttatcac

SEQ ID NO: 19299 - DNA, 21 bp, Artificial sequence
  SiRNA target sequence
atttatgaggaccttatcaca

SEQ ID NO: 19300 - DNA, 21 bp, Artificial sequence
  SiRNA target sequence
tttatgaggaccttatcacat

SEQ ID NO: 19301 - DNA, 21 bp, Artificial sequence
  SiRNA target sequence
ttatgaggaccttatcacatg

SEQ ID NO: 19302 - DNA, 21 bp, Artificial sequence
  SiRNA target sequence
tatgaggaccttatcacatgg

SEQ ID NO: 19303 - DNA, 21 bp, Artificial sequence
  SiRNA target sequence
atgaggaccttatcacatggg

SEQ ID NO: 19304 - DNA, 21 bp, Artificial sequence
  SiRNA target sequence
tgaggaccttatcacatggga

SEQ ID NO: 19305 - DNA, 21 bp, Artificial sequence
  SiRNA target sequence
gaggaccttatcacatgggaa

SEQ ID NO: 19306 - DNA, 21 bp, Artificial sequence
  SiRNA target sequence
aggaccttatcacatgggaag

SEQ ID NO: 19307 - DNA, 21 bp, Artificial sequence
  SiRNA target sequence
ggaccttatcacatgggaaga

SEQ ID NO: 19308 - DNA, 21 bp, Artificial sequence
  SiRNA target sequence
gaccttatcacatgggaagaa

SEQ ID NO: 19309 - DNA, 21 bp, Artificial sequence
  SiRNA target sequence
accttatcacatgggaagaaa

SEQ ID NO: 19310 - DNA, 21 bp, Artificial sequence
  SiRNA target sequence
ccttatcacatgggaagaaat

SEQ ID NO: 19311 - DNA, 21 bp, Artificial sequence
  SiRNA target sequence
cttatcacatgggaagaaatg

SEQ ID NO: 19312 - DNA, 21 bp, Artificial sequence
  SiRNA target sequence
ttatcacatgggaagaaatgg

SEQ ID NO: 19313 - DNA, 21 bp, Artificial sequence
  SiRNA target sequence
tatcacatgggaagaaatgga

SEQ ID NO: 19314 - DNA, 21 bp, Artificial sequence
  SiRNA target sequence
atcacatgggaagaaatggat

SEQ ID NO: 19315 - DNA, 21 bp, Artificial sequence
  SiRNA target sequence
tcacatgggaagaaatggatg

SEQ ID NO: 19316 - DNA, 21 bp, Artificial sequence
  SiRNA target sequence
cacatgggaagaaatggatgt

SEQ ID NO: 19317 - DNA, 21 bp, Artificial sequence
  SiRNA target sequence
acatgggaagaaatggatgtt

SEQ ID NO: 19318 - DNA, 21 bp, Artificial sequence
  SiRNA target sequence
catgggaagaaatggatgtta

SEQ ID NO: 19319 - DNA, 21 bp, Artificial sequence
  SiRNA target sequence
atgggaagaaatggatgttag

SEQ ID NO: 19320 - DNA, 21 bp, Artificial sequence
  SiRNA target sequence
tgggaagaaatggatgttaga

SEQ ID NO: 19321 - DNA, 21 bp, Artificial sequence
  SiRNA target sequence
gggaagaaatggatgttagat

SEQ ID NO: 19322 - DNA, 21 bp, Artificial sequence
  SiRNA target sequence
ggaagaaatggatgttagatg

SEQ ID NO: 19323 - DNA, 21 bp, Artificial sequence
  SiRNA target sequence
gaagaaatggatgttagatgt

SEQ ID NO: 19324 - DNA, 21 bp, Artificial sequence
  SiRNA target sequence
aagaaatggatgttagatgtt

SEQ ID NO: 19325 - DNA, 21 bp, Artificial sequence
  SiRNA target sequence
agaaatggatgttagatgtta

SEQ ID NO: 19326 - DNA, 21 bp, Artificial sequence
  SiRNA target sequence
gaaatggatgttagatgttac

SEQ ID NO: 19327 - DNA, 21 bp, Artificial sequence
  SiRNA target sequence
aaatggatgttagatgttacg

SEQ ID NO: 19328 - DNA, 21 bp, Artificial sequence
  SiRNA target sequence
aatggatgttagatgttacgc

SEQ ID NO: 19329 - DNA, 21 bp, Artificial sequence
  SiRNA target sequence
atggatgttagatgttacgct

SEQ ID NO: 19330 - DNA, 21 bp, Artificial sequence
  SiRNA target sequence
tggatgttagatgttacgcta

SEQ ID NO: 19331 - DNA, 21 bp, Artificial sequence
  SiRNA target sequence
ggatgttagatgttacgctag

SEQ ID NO: 19332 - DNA, 21 bp, Artificial sequence
  SiRNA target sequence
gatgttagatgttacgctagt

SEQ ID NO: 19333 - DNA, 21 bp, Artificial sequence
  SiRNA target sequence
atgttagatgttacgctagtg

SEQ ID NO: 19334 - DNA, 21 bp, Artificial sequence
  SiRNA target sequence
tgttagatgttacgctagtgc

SEQ ID NO: 19335 - DNA, 21 bp, Artificial sequence
  SiRNA target sequence
gttagatgttacgctagtgcg

SEQ ID NO: 19336 - DNA, 21 bp, Artificial sequence
  SiRNA target sequence
ttagatgttacgctagtgcgt

SEQ ID NO: 19337 - DNA, 21 bp, Artificial sequence
  SiRNA target sequence
tagatgttacgctagtgcgta

SEQ ID NO: 19338 - DNA, 21 bp, Artificial sequence
  SiRNA target sequence
agatgttacgctagtgcgtaa

SEQ ID NO: 19339 - DNA, 21 bp, Artificial sequence
  SiRNA target sequence
gatgttacgctagtgcgtaat

SEQ ID NO: 19340 - DNA, 21 bp, Artificial sequence
  SiRNA target sequence
atgttacgctagtgcgtaata

SEQ ID NO: 19341 - DNA, 21 bp, Artificial sequence
  SiRNA target sequence
tgttacgctagtgcgtaatat

SEQ ID NO: 19342 - DNA, 21 bp, Artificial sequence
  SiRNA target sequence
gttacgctagtgcgtaatatt

SEQ ID NO: 19343 - DNA, 21 bp, Artificial sequence
  SiRNA target sequence
ttacgctagtgcgtaatatta

SEQ ID NO: 19344 - DNA, 21 bp, Artificial sequence
  SiRNA target sequence
tacgctagtgcgtaatattaa

SEQ ID NO: 19345 - DNA, 21 bp, Artificial sequence
  SiRNA target sequence
acgctagtgcgtaatattaaa

SEQ ID NO: 19346 - DNA, 21 bp, Artificial sequence
  SiRNA target sequence
cgctagtgcgtaatattaaat

SEQ ID NO: 19347 - DNA, 21 bp, Artificial sequence
  SiRNA target sequence
gctagtgcgtaatattaaatt

SEQ ID NO: 19348 - DNA, 21 bp, Artificial sequence
  SiRNA target sequence
ctagtgcgtaatattaaattt

SEQ ID NO: 19349 - DNA, 21 bp, Artificial sequence
  SiRNA target sequence
tagtgcgtaatattaaatttt

SEQ ID NO: 19350 - DNA, 21 bp, Artificial sequence
  SiRNA target sequence
agtgcgtaatattaaatttta

SEQ ID NO: 19351 - DNA, 21 bp, Artificial sequence
  SiRNA target sequence
gtgcgtaatattaaattttaa

SEQ ID NO: 19352 - DNA, 21 bp, Artificial sequence
  SiRNA target sequence
tgcgtaatattaaattttaaa

SEQ ID NO: 19353 - DNA, 21 bp, Artificial sequence
  SiRNA target sequence
gcgtaatattaaattttaaat

SEQ ID NO: 19354 - DNA, 21 bp, Artificial sequence
  SiRNA target sequence
cgtaatattaaattttaaata

SEQ ID NO: 19355 - DNA, 21 bp, Artificial sequence
  SiRNA target sequence
gtaatattaaattttaaatac

SEQ ID NO: 19356 - DNA, 21 bp, Artificial sequence
  SiRNA target sequence
taatattaaattttaaatact

SEQ ID NO: 19357 - DNA, 21 bp, Artificial sequence
  SiRNA target sequence
aatattaaattttaaatactc

SEQ ID NO: 19358 - DNA, 21 bp, Artificial sequence
  SiRNA target sequence
atattaaattttaaatactca

SEQ ID NO: 19359 - DNA, 21 bp, Artificial sequence
  SiRNA target sequence
tattaaattttaaatactcat

SEQ ID NO: 19360 - DNA, 21 bp, Artificial sequence
  SiRNA target sequence
attaaattttaaatactcatt

SEQ ID NO: 19361 - DNA, 21 bp, Artificial sequence
  SiRNA target sequence
ttaaattttaaatactcatta

SEQ ID NO: 19362 - DNA, 21 bp, Artificial sequence
  SiRNA target sequence
taaattttaaatactcattaa

SEQ ID NO: 19363 - DNA, 21 bp, Artificial sequence
  SiRNA target sequence
aaattttaaatactcattaat

SEQ ID NO: 19364 - DNA, 21 bp, Artificial sequence
  SiRNA target sequence
aattttaaatactcattaatt

SEQ ID NO: 19365 - DNA, 21 bp, Artificial sequence
  SiRNA target sequence
attttaaatactcattaattt

SEQ ID NO: 19366 - DNA, 21 bp, Artificial sequence
  SiRNA target sequence
ttttaaatactcattaatttt

SEQ ID NO: 19367 - DNA, 21 bp, Artificial sequence
  SiRNA target sequence
tttaaatactcattaatttta

SEQ ID NO: 19368 - DNA, 21 bp, Artificial sequence
  SiRNA target sequence
ttaaatactcattaattttaa

SEQ ID NO: 19369 - DNA, 21 bp, Artificial sequence
  SiRNA target sequence
taaatactcattaattttaat

SEQ ID NO: 19370 - DNA, 21 bp, Artificial sequence
  SiRNA target sequence
aaatactcattaattttaatt

SEQ ID NO: 19371 - DNA, 21 bp, Artificial sequence
  SiRNA target sequence
aatactcattaattttaattt

SEQ ID NO: 19372 - DNA, 21 bp, Artificial sequence
  SiRNA target sequence
atactcattaattttaatttt

SEQ ID NO: 19373 - DNA, 21 bp, Artificial sequence
  SiRNA target sequence
tactcattaattttaatttta

SEQ ID NO: 19374 - DNA, 21 bp, Artificial sequence
  SiRNA target sequence
actcattaattttaattttat

SEQ ID NO: 19375 - DNA, 21 bp, Artificial sequence
  SiRNA target sequence
ctcattaattttaattttatt

SEQ ID NO: 19376 - DNA, 21 bp, Artificial sequence
  SiRNA target sequence
tcattaattttaattttattt

SEQ ID NO: 19377 - DNA, 21 bp, Artificial sequence
  SiRNA target sequence
cattaattttaattttatttt

SEQ ID NO: 19378 - DNA, 21 bp, Artificial sequence
  SiRNA target sequence
attaattttaattttatttta

SEQ ID NO: 19379 - DNA, 21 bp, Artificial sequence
  SiRNA target sequence
ttaattttaattttattttag

SEQ ID NO: 19380 - DNA, 21 bp, Artificial sequence
  SiRNA target sequence
taattttaattttattttagg

SEQ ID NO: 19381 - DNA, 21 bp, Artificial sequence
  SiRNA target sequence
aattttaattttattttaggt

SEQ ID NO: 19382 - DNA, 21 bp, Artificial sequence
  SiRNA target sequence
attttaattttattttaggtt

SEQ ID NO: 19383 - DNA, 21 bp, Artificial sequence
  SiRNA target sequence
ttttaattttattttaggtta

SEQ ID NO: 19384 - DNA, 21 bp, Artificial sequence
  SiRNA target sequence
tttaattttattttaggttat

SEQ ID NO: 19385 - DNA, 21 bp, Artificial sequence
  SiRNA target sequence
ttaattttattttaggttatt

SEQ ID NO: 19386 - DNA, 21 bp, Artificial sequence
  SiRNA target sequence
taattttattttaggttattg

SEQ ID NO: 19387 - DNA, 21 bp, Artificial sequence
  SiRNA target sequence
aattttattttaggttattgg

SEQ ID NO: 19388 - DNA, 21 bp, Artificial sequence
  SiRNA target sequence
attttattttaggttattgga

SEQ ID NO: 19389 - DNA, 21 bp, Artificial sequence
  SiRNA target sequence
ttttattttaggttattggaa

SEQ ID NO: 19390 - DNA, 21 bp, Artificial sequence
  SiRNA target sequence
tttattttaggttattggaat

SEQ ID NO: 19391 - DNA, 21 bp, Artificial sequence
  SiRNA target sequence
ttattttaggttattggaatt

SEQ ID NO: 19392 - DNA, 21 bp, Artificial sequence
  SiRNA target sequence
tattttaggttattggaattg

SEQ ID NO: 19393 - DNA, 21 bp, Artificial sequence
  SiRNA target sequence
attttaggttattggaattga

SEQ ID NO: 19394 - DNA, 21 bp, Artificial sequence
  SiRNA target sequence
ttttaggttattggaattgag

SEQ ID NO: 19395 - DNA, 21 bp, Artificial sequence
  SiRNA target sequence
tttaggttattggaattgagg

SEQ ID NO: 19396 - DNA, 21 bp, Artificial sequence
  SiRNA target sequence
ttaggttattggaattgaggg

SEQ ID NO: 19397 - DNA, 21 bp, Artificial sequence
  SiRNA target sequence
taggttattggaattgaggga

SEQ ID NO: 19398 - DNA, 21 bp, Artificial sequence
  SiRNA target sequence
aggttattggaattgagggaa

SEQ ID NO: 19399 - DNA, 21 bp, Artificial sequence
  SiRNA target sequence
ggttattggaattgagggaag

SEQ ID NO: 19400 - DNA, 21 bp, Artificial sequence
  SiRNA target sequence
gttattggaattgagggaagt

SEQ ID NO: 19401 - DNA, 21 bp, Artificial sequence
  SiRNA target sequence
ttattggaattgagggaagta

SEQ ID NO: 19402 - DNA, 21 bp, Artificial sequence
  SiRNA target sequence
tattggaattgagggaagtac

SEQ ID NO: 19403 - DNA, 21 bp, Artificial sequence
  SiRNA target sequence
attggaattgagggaagtacc

SEQ ID NO: 19404 - DNA, 21 bp, Artificial sequence
  SiRNA target sequence
ttggaattgagggaagtacca

SEQ ID NO: 19405 - DNA, 21 bp, Artificial sequence
  SiRNA target sequence
tggaattgagggaagtaccac

SEQ ID NO: 19406 - DNA, 21 bp, Artificial sequence
  SiRNA target sequence
ggaattgagggaagtaccacc

SEQ ID NO: 19407 - DNA, 21 bp, Artificial sequence
  SiRNA target sequence
gaattgagggaagtaccaccc

SEQ ID NO: 19408 - DNA, 21 bp, Artificial sequence
  SiRNA target sequence
aattgagggaagtaccacccc

SEQ ID NO: 19409 - DNA, 21 bp, Artificial sequence
  SiRNA target sequence
attgagggaagtaccaccccc

SEQ ID NO: 19410 - DNA, 21 bp, Artificial sequence
  SiRNA target sequence
ttgagggaagtaccacccccc

SEQ ID NO: 19411 - DNA, 21 bp, Artificial sequence
  SiRNA target sequence
tgagggaagtaccacccccca

SEQ ID NO: 19412 - DNA, 21 bp, Artificial sequence
  SiRNA target sequence
gagggaagtaccaccccccaa

SEQ ID NO: 19413 - DNA, 21 bp, Artificial sequence
  SiRNA target sequence
agggaagtaccaccccccaag

SEQ ID NO: 19414 - DNA, 21 bp, Artificial sequence
  SiRNA target sequence
gggaagtaccaccccccaaga

SEQ ID NO: 19415 - DNA, 21 bp, Artificial sequence
  SiRNA target sequence
ggaagtaccaccccccaagac

SEQ ID NO: 19416 - DNA, 21 bp, Artificial sequence
  SiRNA target sequence
gaagtaccaccccccaagacc

SEQ ID NO: 19417 - DNA, 21 bp, Artificial sequence
  SiRNA target sequence
aagtaccaccccccaagacct

SEQ ID NO: 19418 - DNA, 21 bp, Artificial sequence
  SiRNA target sequence
agtaccaccccccaagacctt

SEQ ID NO: 19419 - DNA, 21 bp, Artificial sequence
  SiRNA target sequence
gtaccaccccccaagaccttc

SEQ ID NO: 19420 - DNA, 21 bp, Artificial sequence
  SiRNA target sequence
taccaccccccaagaccttcg

SEQ ID NO: 19421 - DNA, 21 bp, Artificial sequence
  SiRNA target sequence
accaccccccaagaccttcgt

SEQ ID NO: 19422 - DNA, 21 bp, Artificial sequence
  SiRNA target sequence
ccaccccccaagaccttcgtt

SEQ ID NO: 19423 - DNA, 21 bp, Artificial sequence
  SiRNA target sequence
caccccccaagaccttcgttt

SEQ ID NO: 19424 - DNA, 21 bp, Artificial sequence
  SiRNA target sequence
accccccaagaccttcgtttt

SEQ ID NO: 19425 - DNA, 21 bp, Artificial sequence
  SiRNA target sequence
ccccccaagaccttcgtttta

SEQ ID NO: 19426 - DNA, 21 bp, Artificial sequence
  SiRNA target sequence
cccccaagaccttcgttttaa

SEQ ID NO: 19427 - DNA, 21 bp, Artificial sequence
  SiRNA target sequence
ccccaagaccttcgttttaaa

SEQ ID NO: 19428 - DNA, 21 bp, Artificial sequence
  SiRNA target sequence
cccaagaccttcgttttaaat

SEQ ID NO: 19429 - DNA, 21 bp, Artificial sequence
  SiRNA target sequence
ccaagaccttcgttttaaatc

SEQ ID NO: 19430 - DNA, 21 bp, Artificial sequence
  SiRNA target sequence
caagaccttcgttttaaatct

SEQ ID NO: 19431 - DNA, 21 bp, Artificial sequence
  SiRNA target sequence
aagaccttcgttttaaatcta

SEQ ID NO: 19432 - DNA, 21 bp, Artificial sequence
  SiRNA target sequence
agaccttcgttttaaatctac

SEQ ID NO: 19433 - DNA, 21 bp, Artificial sequence
  SiRNA target sequence
gaccttcgttttaaatctact

SEQ ID NO: 19434 - DNA, 21 bp, Artificial sequence
  SiRNA target sequence
accttcgttttaaatctacta

SEQ ID NO: 19435 - DNA, 21 bp, Artificial sequence
  SiRNA target sequence
ccttcgttttaaatctactaa

SEQ ID NO: 19436 - DNA, 21 bp, Artificial sequence
  SiRNA target sequence
cttcgttttaaatctactaag

SEQ ID NO: 19437 - DNA, 21 bp, Artificial sequence
  SiRNA target sequence
ttcgttttaaatctactaaga

SEQ ID NO: 19438 - DNA, 21 bp, Artificial sequence
  SiRNA target sequence
tcgttttaaatctactaagag

SEQ ID NO: 19439 - DNA, 21 bp, Artificial sequence
  SiRNA target sequence
cgttttaaatctactaagagg

SEQ ID NO: 19440 - DNA, 21 bp, Artificial sequence
  SiRNA target sequence
gttttaaatctactaagagga

SEQ ID NO: 19441 - DNA, 21 bp, Artificial sequence
  SiRNA target sequence
ttttaaatctactaagaggag

SEQ ID NO: 19442 - DNA, 21 bp, Artificial sequence
  SiRNA target sequence
tttaaatctactaagaggagt

SEQ ID NO: 19443 - DNA, 21 bp, Artificial sequence
  SiRNA target sequence
ttaaatctactaagaggagta

SEQ ID NO: 19444 - DNA, 21 bp, Artificial sequence
  SiRNA target sequence
taaatctactaagaggagtaa

SEQ ID NO: 19445 - DNA, 21 bp, Artificial sequence
  SiRNA target sequence
aaatctactaagaggagtaaa

SEQ ID NO: 19446 - DNA, 21 bp, Artificial sequence
  SiRNA target sequence
aatctactaagaggagtaaac

SEQ ID NO: 19447 - DNA, 21 bp, Artificial sequence
  SiRNA target sequence
atctactaagaggagtaaacc

SEQ ID NO: 19448 - DNA, 21 bp, Artificial sequence
  SiRNA target sequence
tctactaagaggagtaaacct

SEQ ID NO: 19449 - DNA, 21 bp, Artificial sequence
  SiRNA target sequence
ctactaagaggagtaaaccta

SEQ ID NO: 19450 - DNA, 21 bp, Artificial sequence
  SiRNA target sequence
tactaagaggagtaaacctat

SEQ ID NO: 19451 - DNA, 21 bp, Artificial sequence
  SiRNA target sequence
actaagaggagtaaacctata

SEQ ID NO: 19452 - DNA, 21 bp, Artificial sequence
  SiRNA target sequence
ctaagaggagtaaacctatat

SEQ ID NO: 19453 - DNA, 21 bp, Artificial sequence
  SiRNA target sequence
taagaggagtaaacctatata

SEQ ID NO: 19454 - DNA, 21 bp, Artificial sequence
  SiRNA target sequence
aagaggagtaaacctatatat

SEQ ID NO: 19455 - DNA, 21 bp, Artificial sequence
  SiRNA target sequence
agaggagtaaacctatatata

SEQ ID NO: 19456 - DNA, 21 bp, Artificial sequence
  SiRNA target sequence
gaggagtaaacctatatataa

SEQ ID NO: 19457 - DNA, 21 bp, Artificial sequence
  SiRNA target sequence
aggagtaaacctatatataag

SEQ ID NO: 19458 - DNA, 21 bp, Artificial sequence
  SiRNA target sequence
ggagtaaacctatatataaga

SEQ ID NO: 19459 - DNA, 21 bp, Artificial sequence
  SiRNA target sequence
gagtaaacctatatataagag

SEQ ID NO: 19460 - DNA, 21 bp, Artificial sequence
  SiRNA target sequence
agtaaacctatatataagagt

SEQ ID NO: 19461 - DNA, 21 bp, Artificial sequence
  SiRNA target sequence
gtaaacctatatataagagtc

SEQ ID NO: 19462 - DNA, 21 bp, Artificial sequence
  SiRNA target sequence
taaacctatatataagagtct

SEQ ID NO: 19463 - DNA, 21 bp, Artificial sequence
  SiRNA target sequence
aaacctatatataagagtcta

SEQ ID NO: 19464 - DNA, 21 bp, Artificial sequence
  SiRNA target sequence
aacctatatataagagtctaa

SEQ ID NO: 19465 - DNA, 21 bp, Artificial sequence
  SiRNA target sequence
acctatatataagagtctaaa

SEQ ID NO: 19466 - DNA, 21 bp, Artificial sequence
  SiRNA target sequence
cctatatataagagtctaaag

SEQ ID NO: 19467 - DNA, 21 bp, Artificial sequence
  SiRNA target sequence
ctatatataagagtctaaaga

SEQ ID NO: 19468 - DNA, 21 bp, Artificial sequence
  SiRNA target sequence
tatatataagagtctaaagac

SEQ ID NO: 19469 - DNA, 21 bp, Artificial sequence
  SiRNA target sequence
atatataagagtctaaagaca

SEQ ID NO: 19470 - DNA, 21 bp, Artificial sequence
  SiRNA target sequence
tatataagagtctaaagacag

SEQ ID NO: 19471 - DNA, 21 bp, Artificial sequence
  SiRNA target sequence
atataagagtctaaagacaga

SEQ ID NO: 19472 - DNA, 21 bp, Artificial sequence
  SiRNA target sequence
tataagagtctaaagacagag

SEQ ID NO: 19473 - DNA, 21 bp, Artificial sequence
  SiRNA target sequence
ataagagtctaaagacagagt

SEQ ID NO: 19474 - DNA, 21 bp, Artificial sequence
  SiRNA target sequence
taagagtctaaagacagagtg

SEQ ID NO: 19475 - DNA, 21 bp, Artificial sequence
  SiRNA target sequence
aagagtctaaagacagagtgg

SEQ ID NO: 19476 - DNA, 21 bp, Artificial sequence
  SiRNA target sequence
agagtctaaagacagagtgga

SEQ ID NO: 19477 - DNA, 21 bp, Artificial sequence
  SiRNA target sequence
gagtctaaagacagagtggat

SEQ ID NO: 19478 - DNA, 21 bp, Artificial sequence
  SiRNA target sequence
agtctaaagacagagtggatt

SEQ ID NO: 19479 - DNA, 21 bp, Artificial sequence
  SiRNA target sequence
gtctaaagacagagtggatta

SEQ ID NO: 19480 - DNA, 21 bp, Artificial sequence
  SiRNA target sequence
tctaaagacagagtggattag

SEQ ID NO: 19481 - DNA, 21 bp, Artificial sequence
  SiRNA target sequence
ctaaagacagagtggattaga

SEQ ID NO: 19482 - DNA, 21 bp, Artificial sequence
  SiRNA target sequence
taaagacagagtggattagac

SEQ ID NO: 19483 - DNA, 21 bp, Artificial sequence
  SiRNA target sequence
aaagacagagtggattagacc

SEQ ID NO: 19484 - DNA, 21 bp, Artificial sequence
  SiRNA target sequence
aagacagagtggattagacca

SEQ ID NO: 19485 - DNA, 21 bp, Artificial sequence
  SiRNA target sequence
agacagagtggattagaccat

SEQ ID NO: 19486 - DNA, 21 bp, Artificial sequence
  SiRNA target sequence
gacagagtggattagaccatc

SEQ ID NO: 19487 - DNA, 21 bp, Artificial sequence
  SiRNA target sequence
acagagtggattagaccatca

SEQ ID NO: 19488 - DNA, 21 bp, Artificial sequence
  SiRNA target sequence
cagagtggattagaccatcat

SEQ ID NO: 19489 - DNA, 21 bp, Artificial sequence
  SiRNA target sequence
agagtggattagaccatcatc

SEQ ID NO: 19490 - DNA, 21 bp, Artificial sequence
  SiRNA target sequence
gagtggattagaccatcatct

SEQ ID NO: 19491 - DNA, 21 bp, Artificial sequence
  SiRNA target sequence
agtggattagaccatcatctt

SEQ ID NO: 19492 - DNA, 21 bp, Artificial sequence
  SiRNA target sequence
gtggattagaccatcatcttt

SEQ ID NO: 19493 - DNA, 21 bp, Artificial sequence
  SiRNA target sequence
tggattagaccatcatcttta

SEQ ID NO: 19494 - DNA, 21 bp, Artificial sequence
  SiRNA target sequence
ggattagaccatcatctttag

SEQ ID NO: 19495 - DNA, 21 bp, Artificial sequence
  SiRNA target sequence
gattagaccatcatctttagc

SEQ ID NO: 19496 - DNA, 21 bp, Artificial sequence
  SiRNA target sequence
attagaccatcatctttagct

SEQ ID NO: 19497 - DNA, 21 bp, Artificial sequence
  SiRNA target sequence
ttagaccatcatctttagctt

SEQ ID NO: 19498 - DNA, 21 bp, Artificial sequence
  SiRNA target sequence
tagaccatcatctttagctta

SEQ ID NO: 19499 - DNA, 21 bp, Artificial sequence
  SiRNA target sequence
agaccatcatctttagcttat

SEQ ID NO: 19500 - DNA, 21 bp, Artificial sequence
  SiRNA target sequence
gaccatcatctttagcttata

SEQ ID NO: 19501 - DNA, 21 bp, Artificial sequence
  SiRNA target sequence
accatcatctttagcttatat

SEQ ID NO: 19502 - DNA, 21 bp, Artificial sequence
  SiRNA target sequence
ccatcatctttagcttatata

SEQ ID NO: 19503 - DNA, 21 bp, Artificial sequence
  SiRNA target sequence
catcatctttagcttatatac

SEQ ID NO: 19504 - DNA, 21 bp, Artificial sequence
  SiRNA target sequence
atcatctttagcttatatacg

SEQ ID NO: 19505 - DNA, 21 bp, Artificial sequence
  SiRNA target sequence
tcatctttagcttatatacgg

SEQ ID NO: 19506 - DNA, 21 bp, Artificial sequence
  SiRNA target sequence
catctttagcttatatacggg

SEQ ID NO: 19507 - DNA, 21 bp, Artificial sequence
  SiRNA target sequence
atctttagcttatatacgggg

SEQ ID NO: 19508 - DNA, 21 bp, Artificial sequence
  SiRNA target sequence
tctttagcttatatacgggga

SEQ ID NO: 19509 - DNA, 21 bp, Artificial sequence
  SiRNA target sequence
ctttagcttatatacggggaa

SEQ ID NO: 19510 - DNA, 21 bp, Artificial sequence
  SiRNA target sequence
tttagcttatatacggggaag

SEQ ID NO: 19511 - DNA, 21 bp, Artificial sequence
  SiRNA target sequence
ttagcttatatacggggaagg

SEQ ID NO: 19512 - DNA, 21 bp, Artificial sequence
  SiRNA target sequence
tagcttatatacggggaaggt

SEQ ID NO: 19513 - DNA, 21 bp, Artificial sequence
  SiRNA target sequence
agcttatatacggggaaggtt

SEQ ID NO: 19514 - DNA, 21 bp, Artificial sequence
  SiRNA target sequence
gcttatatacggggaaggttg

SEQ ID NO: 19515 - DNA, 21 bp, Artificial sequence
  SiRNA target sequence
cttatatacggggaaggttga

SEQ ID NO: 19516 - DNA, 21 bp, Artificial sequence
  SiRNA target sequence
ttatatacggggaaggttgag

SEQ ID NO: 19517 - DNA, 21 bp, Artificial sequence
  SiRNA target sequence
tatatacggggaaggttgagt

SEQ ID NO: 19518 - DNA, 21 bp, Artificial sequence
  SiRNA target sequence
atatacggggaaggttgagtt

SEQ ID NO: 19519 - DNA, 21 bp, Artificial sequence
  SiRNA target sequence
tatacggggaaggttgagttg

SEQ ID NO: 19520 - DNA, 21 bp, Artificial sequence
  SiRNA target sequence
atacggggaaggttgagttgc

SEQ ID NO: 19521 - DNA, 21 bp, Artificial sequence
  SiRNA target sequence
tacggggaaggttgagttgcc

SEQ ID NO: 19522 - DNA, 21 bp, Artificial sequence
  SiRNA target sequence
acggggaaggttgagttgcct

SEQ ID NO: 19523 - DNA, 21 bp, Artificial sequence
  SiRNA target sequence
cggggaaggttgagttgcctc

SEQ ID NO: 19524 - DNA, 21 bp, Artificial sequence
  SiRNA target sequence
ggggaaggttgagttgcctct

SEQ ID NO: 19525 - DNA, 21 bp, Artificial sequence
  SiRNA target sequence
gggaaggttgagttgcctcta

SEQ ID NO: 19526 - DNA, 21 bp, Artificial sequence
  SiRNA target sequence
ggaaggttgagttgcctctaa

SEQ ID NO: 19527 - DNA, 21 bp, Artificial sequence
  SiRNA target sequence
gaaggttgagttgcctctaaa

SEQ ID NO: 19528 - DNA, 21 bp, Artificial sequence
  SiRNA target sequence
aaggttgagttgcctctaaag

SEQ ID NO: 19529 - DNA, 21 bp, Artificial sequence
  SiRNA target sequence
aggttgagttgcctctaaaga

SEQ ID NO: 19530 - DNA, 21 bp, Artificial sequence
  SiRNA target sequence
ggttgagttgcctctaaagac

SEQ ID NO: 19531 - DNA, 21 bp, Artificial sequence
  SiRNA target sequence
gttgagttgcctctaaagact

SEQ ID NO: 19532 - DNA, 21 bp, Artificial sequence
  SiRNA target sequence
ttgagttgcctctaaagactc

SEQ ID NO: 19533 - DNA, 21 bp, Artificial sequence
  SiRNA target sequence
tgagttgcctctaaagactca

SEQ ID NO: 19534 - DNA, 21 bp, Artificial sequence
  SiRNA target sequence
gagttgcctctaaagactcag

SEQ ID NO: 19535 - DNA, 21 bp, Artificial sequence
  SiRNA target sequence
agttgcctctaaagactcagc

SEQ ID NO: 19536 - DNA, 21 bp, Artificial sequence
  SiRNA target sequence
gttgcctctaaagactcagct

SEQ ID NO: 19537 - DNA, 21 bp, Artificial sequence
  SiRNA target sequence
ttgcctctaaagactcagctc

SEQ ID NO: 19538 - DNA, 21 bp, Artificial sequence
  SiRNA target sequence
tgcctctaaagactcagctcc

SEQ ID NO: 19539 - DNA, 21 bp, Artificial sequence
  SiRNA target sequence
gcctctaaagactcagctcca

SEQ ID NO: 19540 - DNA, 21 bp, Artificial sequence
  SiRNA target sequence
cctctaaagactcagctccat

SEQ ID NO: 19541 - DNA, 21 bp, Artificial sequence
  SiRNA target sequence
ctctaaagactcagctccata

SEQ ID NO: 19542 - DNA, 21 bp, Artificial sequence
  SiRNA target sequence
tctaaagactcagctccatag

SEQ ID NO: 19543 - DNA, 21 bp, Artificial sequence
  SiRNA target sequence
ctaaagactcagctccatagt

SEQ ID NO: 19544 - DNA, 21 bp, Artificial sequence
  SiRNA target sequence
taaagactcagctccatagta

SEQ ID NO: 19545 - DNA, 21 bp, Artificial sequence
  SiRNA target sequence
aaagactcagctccatagtag

SEQ ID NO: 19546 - DNA, 21 bp, Artificial sequence
  SiRNA target sequence
aagactcagctccatagtaga

SEQ ID NO: 19547 - DNA, 21 bp, Artificial sequence
  SiRNA target sequence
agactcagctccatagtagag

SEQ ID NO: 19548 - DNA, 21 bp, Artificial sequence
  SiRNA target sequence
gactcagctccatagtagagt

SEQ ID NO: 19549 - DNA, 21 bp, Artificial sequence
  SiRNA target sequence
actcagctccatagtagagta

SEQ ID NO: 19550 - DNA, 21 bp, Artificial sequence
  SiRNA target sequence
ctcagctccatagtagagtag

SEQ ID NO: 19551 - DNA, 21 bp, Artificial sequence
  SiRNA target sequence
tcagctccatagtagagtagt

SEQ ID NO: 19552 - DNA, 21 bp, Artificial sequence
  SiRNA target sequence
cagctccatagtagagtagtt

SEQ ID NO: 19553 - DNA, 21 bp, Artificial sequence
  SiRNA target sequence
agctccatagtagagtagttt

SEQ ID NO: 19554 - DNA, 21 bp, Artificial sequence
  SiRNA target sequence
gctccatagtagagtagtttt

SEQ ID NO: 19555 - DNA, 21 bp, Artificial sequence
  SiRNA target sequence
ctccatagtagagtagtttta

SEQ ID NO: 19556 - DNA, 21 bp, Artificial sequence
  SiRNA target sequence
tccatagtagagtagttttaa

SEQ ID NO: 19557 - DNA, 21 bp, Artificial sequence
  SiRNA target sequence
ccatagtagagtagttttaat

SEQ ID NO: 19558 - DNA, 21 bp, Artificial sequence
  SiRNA target sequence
catagtagagtagttttaatt

SEQ ID NO: 19559 - DNA, 21 bp, Artificial sequence
  SiRNA target sequence
atagtagagtagttttaatta

SEQ ID NO: 19560 - DNA, 21 bp, Artificial sequence
  SiRNA target sequence
tagtagagtagttttaattac

SEQ ID NO: 19561 - DNA, 21 bp, Artificial sequence
  SiRNA target sequence
agtagagtagttttaattacg

SEQ ID NO: 19562 - DNA, 21 bp, Artificial sequence
  SiRNA target sequence
gtagagtagttttaattacga

SEQ ID NO: 19563 - DNA, 21 bp, Artificial sequence
  SiRNA target sequence
tagagtagttttaattacgat

SEQ ID NO: 19564 - DNA, 21 bp, Artificial sequence
  SiRNA target sequence
agagtagttttaattacgatt

SEQ ID NO: 19565 - DNA, 21 bp, Artificial sequence
  SiRNA target sequence
gagtagttttaattacgatta

SEQ ID NO: 19566 - DNA, 21 bp, Artificial sequence
  SiRNA target sequence
agtagttttaattacgattaa

SEQ ID NO: 19567 - DNA, 21 bp, Artificial sequence
  SiRNA target sequence
gtagttttaattacgattaaa

SEQ ID NO: 19568 - DNA, 21 bp, Artificial sequence
  SiRNA target sequence
tagttttaattacgattaaag

SEQ ID NO: 19569 - DNA, 21 bp, Artificial sequence
  SiRNA target sequence
agttttaattacgattaaagt

SEQ ID NO: 19570 - DNA, 21 bp, Artificial sequence
  SiRNA target sequence
gttttaattacgattaaagtg

SEQ ID NO: 19571 - DNA, 21 bp, Artificial sequence
  SiRNA target sequence
ttttaattacgattaaagtgg

SEQ ID NO: 19572 - DNA, 21 bp, Artificial sequence
  SiRNA target sequence
tttaattacgattaaagtggt

SEQ ID NO: 19573 - DNA, 21 bp, Artificial sequence
  SiRNA target sequence
ttaattacgattaaagtggta

SEQ ID NO: 19574 - DNA, 21 bp, Artificial sequence
  SiRNA target sequence
taattacgattaaagtggtac

SEQ ID NO: 19575 - DNA, 21 bp, Artificial sequence
  SiRNA target sequence
aattacgattaaagtggtact

SEQ ID NO: 19576 - DNA, 21 bp, Artificial sequence
  SiRNA target sequence
attacgattaaagtggtactc

SEQ ID NO: 19577 - DNA, 21 bp, Artificial sequence
  SiRNA target sequence
ttacgattaaagtggtactct

SEQ ID NO: 19578 - DNA, 21 bp, Artificial sequence
  SiRNA target sequence
tacgattaaagtggtactcta

SEQ ID NO: 19579 - DNA, 21 bp, Artificial sequence
  SiRNA target sequence
acgattaaagtggtactctag

SEQ ID NO: 19580 - DNA, 21 bp, Artificial sequence
  SiRNA target sequence
cgattaaagtggtactctagg

SEQ ID NO: 19581 - DNA, 21 bp, Artificial sequence
  SiRNA target sequence
gattaaagtggtactctaggt

SEQ ID NO: 19582 - DNA, 21 bp, Artificial sequence
  SiRNA target sequence
attaaagtggtactctaggtt

SEQ ID NO: 19583 - DNA, 21 bp, Artificial sequence
  SiRNA target sequence
ttaaagtggtactctaggtta

SEQ ID NO: 19584 - DNA, 21 bp, Artificial sequence
  SiRNA target sequence
taaagtggtactctaggttag

SEQ ID NO: 19585 - DNA, 21 bp, Artificial sequence
  SiRNA target sequence
aaagtggtactctaggttagg

SEQ ID NO: 19586 - DNA, 21 bp, Artificial sequence
  SiRNA target sequence
aagtggtactctaggttaggt

SEQ ID NO: 19587 - DNA, 21 bp, Artificial sequence
  SiRNA target sequence
agtggtactctaggttaggtg

SEQ ID NO: 19588 - DNA, 21 bp, Artificial sequence
  SiRNA target sequence
gtggtactctaggttaggtgt

SEQ ID NO: 19589 - DNA, 21 bp, Artificial sequence
  SiRNA target sequence
tggtactctaggttaggtgtt

SEQ ID NO: 19590 - DNA, 21 bp, Artificial sequence
  SiRNA target sequence
ggtactctaggttaggtgtta

SEQ ID NO: 19591 - DNA, 21 bp, Artificial sequence
  SiRNA target sequence
gtactctaggttaggtgttac

SEQ ID NO: 19592 - DNA, 21 bp, Artificial sequence
  SiRNA target sequence
tactctaggttaggtgttact

SEQ ID NO: 19593 - DNA, 21 bp, Artificial sequence
  SiRNA target sequence
actctaggttaggtgttactc

SEQ ID NO: 19594 - DNA, 21 bp, Artificial sequence
  SiRNA target sequence
ctctaggttaggtgttactcg

SEQ ID NO: 19595 - DNA, 21 bp, Artificial sequence
  SiRNA target sequence
tctaggttaggtgttactcgc

SEQ ID NO: 19596 - DNA, 21 bp, Artificial sequence
  SiRNA target sequence
ctaggttaggtgttactcgcg

SEQ ID NO: 19597 - DNA, 21 bp, Artificial sequence
  SiRNA target sequence
taggttaggtgttactcgcgt

SEQ ID NO: 19598 - DNA, 21 bp, Artificial sequence
  SiRNA target sequence
aggttaggtgttactcgcgta

SEQ ID NO: 19599 - DNA, 21 bp, Artificial sequence
  SiRNA target sequence
ggttaggtgttactcgcgtat

SEQ ID NO: 19600 - DNA, 21 bp, Artificial sequence
  SiRNA target sequence
gttaggtgttactcgcgtatt

SEQ ID NO: 19601 - DNA, 21 bp, Artificial sequence
  SiRNA target sequence
ttaggtgttactcgcgtatta

SEQ ID NO: 19602 - DNA, 21 bp, Artificial sequence
  SiRNA target sequence
taggtgttactcgcgtattat

SEQ ID NO: 19603 - DNA, 21 bp, Artificial sequence
  SiRNA target sequence
aggtgttactcgcgtattatc

SEQ ID NO: 19604 - DNA, 21 bp, Artificial sequence
  SiRNA target sequence
ggtgttactcgcgtattatca

SEQ ID NO: 19605 - DNA, 21 bp, Artificial sequence
  SiRNA target sequence
gtgttactcgcgtattatcaa

SEQ ID NO: 19606 - DNA, 21 bp, Artificial sequence
  SiRNA target sequence
tgttactcgcgtattatcaac

SEQ ID NO: 19607 - DNA, 21 bp, Artificial sequence
  SiRNA target sequence
gttactcgcgtattatcaact

SEQ ID NO: 19608 - DNA, 21 bp, Artificial sequence
  SiRNA target sequence
ttactcgcgtattatcaacta

SEQ ID NO: 19609 - DNA, 21 bp, Artificial sequence
  SiRNA target sequence
tactcgcgtattatcaactag

SEQ ID NO: 19610 - DNA, 21 bp, Artificial sequence
  SiRNA target sequence
actcgcgtattatcaactagt

SEQ ID NO: 19611 - DNA, 21 bp, Artificial sequence
  SiRNA target sequence
ctcgcgtattatcaactagtg

SEQ ID NO: 19612 - DNA, 21 bp, Artificial sequence
  SiRNA target sequence
tcgcgtattatcaactagtgg

SEQ ID NO: 19613 - DNA, 21 bp, Artificial sequence
  SiRNA target sequence
cgcgtattatcaactagtggt

SEQ ID NO: 19614 - DNA, 21 bp, Artificial sequence
  SiRNA target sequence
gcgtattatcaactagtggta

SEQ ID NO: 19615 - DNA, 21 bp, Artificial sequence
  SiRNA target sequence
cgtattatcaactagtggtaa

SEQ ID NO: 19616 - DNA, 21 bp, Artificial sequence
  SiRNA target sequence
gtattatcaactagtggtaat

SEQ ID NO: 19617 - DNA, 21 bp, Artificial sequence
  SiRNA target sequence
tattatcaactagtggtaatg

SEQ ID NO: 19618 - DNA, 21 bp, Artificial sequence
  SiRNA target sequence
attatcaactagtggtaatgc

SEQ ID NO: 19619 - DNA, 21 bp, Artificial sequence
  SiRNA target sequence
ttatcaactagtggtaatgcg

SEQ ID NO: 19620 - DNA, 21 bp, Artificial sequence
  SiRNA target sequence
tatcaactagtggtaatgcgt

SEQ ID NO: 19621 - DNA, 21 bp, Artificial sequence
  SiRNA target sequence
atcaactagtggtaatgcgtc

SEQ ID NO: 19622 - DNA, 21 bp, Artificial sequence
  SiRNA target sequence
tcaactagtggtaatgcgtcc

SEQ ID NO: 19623 - DNA, 21 bp, Artificial sequence
  SiRNA target sequence
caactagtggtaatgcgtcct

SEQ ID NO: 19624 - DNA, 21 bp, Artificial sequence
  SiRNA target sequence
aactagtggtaatgcgtccta

SEQ ID NO: 19625 - DNA, 21 bp, Artificial sequence
  SiRNA target sequence
actagtggtaatgcgtcctaa

SEQ ID NO: 19626 - DNA, 21 bp, Artificial sequence
  SiRNA target sequence
ctagtggtaatgcgtcctaat

SEQ ID NO: 19627 - DNA, 21 bp, Artificial sequence
  SiRNA target sequence
tagtggtaatgcgtcctaatt

SEQ ID NO: 19628 - DNA, 21 bp, Artificial sequence
  SiRNA target sequence
agtggtaatgcgtcctaattt

SEQ ID NO: 19629 - DNA, 21 bp, Artificial sequence
  SiRNA target sequence
gtggtaatgcgtcctaatttt

SEQ ID NO: 19630 - DNA, 21 bp, Artificial sequence
  SiRNA target sequence
tggtaatgcgtcctaatttta

SEQ ID NO: 19631 - DNA, 21 bp, Artificial sequence
  SiRNA target sequence
ggtaatgcgtcctaattttag

SEQ ID NO: 19632 - DNA, 21 bp, Artificial sequence
  SiRNA target sequence
gtaatgcgtcctaattttagt

SEQ ID NO: 19633 - DNA, 21 bp, Artificial sequence
  SiRNA target sequence
taatgcgtcctaattttagta

SEQ ID NO: 19634 - DNA, 21 bp, Artificial sequence
  SiRNA target sequence
aatgcgtcctaattttagtat

SEQ ID NO: 19635 - DNA, 21 bp, Artificial sequence
  SiRNA target sequence
atgcgtcctaattttagtata

SEQ ID NO: 19636 - DNA, 21 bp, Artificial sequence
  SiRNA target sequence
tgcgtcctaattttagtatag

SEQ ID NO: 19637 - DNA, 21 bp, Artificial sequence
  SiRNA target sequence
gcgtcctaattttagtatagt

SEQ ID NO: 19638 - DNA, 21 bp, Artificial sequence
  SiRNA target sequence
cgtcctaattttagtatagtt

SEQ ID NO: 19639 - DNA, 21 bp, Artificial sequence
  SiRNA target sequence
gtcctaattttagtatagttt

SEQ ID NO: 19640 - DNA, 21 bp, Artificial sequence
  SiRNA target sequence
tcctaattttagtatagtttt

SEQ ID NO: 19641 - DNA, 21 bp, Artificial sequence
  SiRNA target sequence
cctaattttagtatagtttta

SEQ ID NO: 19642 - DNA, 21 bp, Artificial sequence
  SiRNA target sequence
ctaattttagtatagttttaa

SEQ ID NO: 19643 - DNA, 21 bp, Artificial sequence
  SiRNA target sequence
taattttagtatagttttaac

SEQ ID NO: 19644 - DNA, 21 bp, Artificial sequence
  SiRNA target sequence
aattttagtatagttttaacc

SEQ ID NO: 19645 - DNA, 21 bp, Artificial sequence
  SiRNA target sequence
attttagtatagttttaacca

SEQ ID NO: 19646 - DNA, 21 bp, Artificial sequence
  SiRNA target sequence
ttttagtatagttttaaccat

SEQ ID NO: 19647 - DNA, 21 bp, Artificial sequence
  SiRNA target sequence
tttagtatagttttaaccata

SEQ ID NO: 19648 - DNA, 21 bp, Artificial sequence
  SiRNA target sequence
ttagtatagttttaaccataa

SEQ ID NO: 19649 - DNA, 21 bp, Artificial sequence
  SiRNA target sequence
tagtatagttttaaccataat

SEQ ID NO: 19650 - DNA, 21 bp, Artificial sequence
  SiRNA target sequence
agtatagttttaaccataata

SEQ ID NO: 19651 - DNA, 21 bp, Artificial sequence
  SiRNA target sequence
gtatagttttaaccataatag

SEQ ID NO: 19652 - DNA, 21 bp, Artificial sequence
  SiRNA target sequence
tatagttttaaccataatagt

SEQ ID NO: 19653 - DNA, 21 bp, Artificial sequence
  SiRNA target sequence
catatcaagtgggttaaagcc

SEQ ID NO: 19654 - DNA, 21 bp, Artificial sequence
  SiRNA target sequence
atatcaagtgggttaaagccc

SEQ ID NO: 19655 - DNA, 21 bp, Artificial sequence
  SiRNA target sequence
tatcaagtgggttaaagcccc

SEQ ID NO: 19656 - DNA, 21 bp, Artificial sequence
  SiRNA target sequence
atcaagtgggttaaagccccg

SEQ ID NO: 19657 - DNA, 21 bp, Artificial sequence
  SiRNA target sequence
tcaagtgggttaaagccccgt

SEQ ID NO: 19658 - DNA, 21 bp, Artificial sequence
  SiRNA target sequence
caagtgggttaaagccccgta

SEQ ID NO: 19659 - DNA, 21 bp, Artificial sequence
  SiRNA target sequence
aagtgggttaaagccccgtat

SEQ ID NO: 19660 - DNA, 21 bp, Artificial sequence
  SiRNA target sequence
agtgggttaaagccccgtatg

SEQ ID NO: 19661 - DNA, 21 bp, Artificial sequence
  SiRNA target sequence
gtgggttaaagccccgtatgc

SEQ ID NO: 19662 - DNA, 21 bp, Artificial sequence
  SiRNA target sequence
tgggttaaagccccgtatgct

SEQ ID NO: 19663 - DNA, 21 bp, Artificial sequence
  SiRNA target sequence
gggttaaagccccgtatgctt

SEQ ID NO: 19664 - DNA, 21 bp, Artificial sequence
  SiRNA target sequence
ggttaaagccccgtatgcttg

SEQ ID NO: 19665 - DNA, 21 bp, Artificial sequence
  SiRNA target sequence
gttaaagccccgtatgcttgg

SEQ ID NO: 19666 - DNA, 21 bp, Artificial sequence
  SiRNA target sequence
ttaaagccccgtatgcttgga

SEQ ID NO: 19667 - DNA, 21 bp, Artificial sequence
  SiRNA target sequence
taaagccccgtatgcttggag

SEQ ID NO: 19668 - DNA, 21 bp, Artificial sequence
  SiRNA target sequence
aaagccccgtatgcttggaga

SEQ ID NO: 19669 - DNA, 21 bp, Artificial sequence
  SiRNA target sequence
aagccccgtatgcttggagac

SEQ ID NO: 19670 - DNA, 21 bp, Artificial sequence
  SiRNA target sequence
agccccgtatgcttggagacc

SEQ ID NO: 19671 - DNA, 21 bp, Artificial sequence
  SiRNA target sequence
gccccgtatgcttggagacca

SEQ ID NO: 19672 - DNA, 21 bp, Artificial sequence
  SiRNA target sequence
ccccgtatgcttggagaccag

SEQ ID NO: 19673 - DNA, 21 bp, Artificial sequence
  SiRNA target sequence
cccgtatgcttggagaccagg

SEQ ID NO: 19674 - DNA, 21 bp, Artificial sequence
  SiRNA target sequence
ccgtatgcttggagaccaggt

SEQ ID NO: 19675 - DNA, 21 bp, Artificial sequence
  SiRNA target sequence
cgtatgcttggagaccaggtt

SEQ ID NO: 19676 - DNA, 21 bp, Artificial sequence
  SiRNA target sequence
gtatgcttggagaccaggttt

SEQ ID NO: 19677 - DNA, 21 bp, Artificial sequence
  SiRNA target sequence
tatgcttggagaccaggtttg

SEQ ID NO: 19678 - DNA, 21 bp, Artificial sequence
  SiRNA target sequence
atgcttggagaccaggtttgt

SEQ ID NO: 19679 - DNA, 21 bp, Artificial sequence
  SiRNA target sequence
tgcttggagaccaggtttgtt

SEQ ID NO: 19680 - DNA, 21 bp, Artificial sequence
  SiRNA target sequence
gcttggagaccaggtttgttt

SEQ ID NO: 19681 - DNA, 21 bp, Artificial sequence
  SiRNA target sequence
cttggagaccaggtttgtttg

SEQ ID NO: 19682 - DNA, 21 bp, Artificial sequence
  SiRNA target sequence
ttggagaccaggtttgtttgc

SEQ ID NO: 19683 - DNA, 21 bp, Artificial sequence
  SiRNA target sequence
tggagaccaggtttgtttgcc

SEQ ID NO: 19684 - DNA, 21 bp, Artificial sequence
  SiRNA target sequence
ggagaccaggtttgtttgccg

SEQ ID NO: 19685 - DNA, 21 bp, Artificial sequence
  SiRNA target sequence
gagaccaggtttgtttgccga

SEQ ID NO: 19686 - DNA, 21 bp, Artificial sequence
  SiRNA target sequence
agaccaggtttgtttgccgac

SEQ ID NO: 19687 - DNA, 21 bp, Artificial sequence
  SiRNA target sequence
gaccaggtttgtttgccgact

SEQ ID NO: 19688 - DNA, 21 bp, Artificial sequence
  SiRNA target sequence
accaggtttgtttgccgactt

SEQ ID NO: 19689 - DNA, 21 bp, Artificial sequence
  SiRNA target sequence
ccaggtttgtttgccgactta

SEQ ID NO: 19690 - DNA, 21 bp, Artificial sequence
  SiRNA target sequence
caggtttgtttgccgacttac

SEQ ID NO: 19691 - DNA, 21 bp, Artificial sequence
  SiRNA target sequence
aggtttgtttgccgacttacg

SEQ ID NO: 19692 - DNA, 21 bp, Artificial sequence
  SiRNA target sequence
ggtttgtttgccgacttacgg

SEQ ID NO: 19693 - DNA, 21 bp, Artificial sequence
  SiRNA target sequence
gtttgtttgccgacttacgga

SEQ ID NO: 19694 - DNA, 21 bp, Artificial sequence
  SiRNA target sequence
tttgtttgccgacttacggaa

SEQ ID NO: 19695 - DNA, 21 bp, Artificial sequence
  SiRNA target sequence
ttgtttgccgacttacggaat

SEQ ID NO: 19696 - DNA, 21 bp, Artificial sequence
  SiRNA target sequence
tgtttgccgacttacggaatg

SEQ ID NO: 19697 - DNA, 21 bp, Artificial sequence
  SiRNA target sequence
gtttgccgacttacggaatgt

SEQ ID NO: 19698 - DNA, 21 bp, Artificial sequence
  SiRNA target sequence
tttgccgacttacggaatgtc

SEQ ID NO: 19699 - DNA, 21 bp, Artificial sequence
  SiRNA target sequence
ttgccgacttacggaatgtcg

SEQ ID NO: 19700 - DNA, 21 bp, Artificial sequence
  SiRNA target sequence
tgccgacttacggaatgtcgt

SEQ ID NO: 19701 - DNA, 21 bp, Artificial sequence
  SiRNA target sequence
gccgacttacggaatgtcgtt

SEQ ID NO: 19702 - DNA, 21 bp, Artificial sequence
  SiRNA target sequence
ccgacttacggaatgtcgtta

SEQ ID NO: 19703 - DNA, 21 bp, Artificial sequence
  SiRNA target sequence
cgacttacggaatgtcgttaa

SEQ ID NO: 19704 - DNA, 21 bp, Artificial sequence
  SiRNA target sequence
gacttacggaatgtcgttaaa

SEQ ID NO: 19705 - DNA, 21 bp, Artificial sequence
  SiRNA target sequence
acttacggaatgtcgttaaac

SEQ ID NO: 19706 - DNA, 21 bp, Artificial sequence
  SiRNA target sequence
cttacggaatgtcgttaaact

SEQ ID NO: 19707 - DNA, 21 bp, Artificial sequence
  SiRNA target sequence
ttacggaatgtcgttaaactc

SEQ ID NO: 19708 - DNA, 21 bp, Artificial sequence
  SiRNA target sequence
tacggaatgtcgttaaactct

SEQ ID NO: 19709 - DNA, 21 bp, Artificial sequence
  SiRNA target sequence
acggaatgtcgttaaactcta

SEQ ID NO: 19710 - DNA, 21 bp, Artificial sequence
  SiRNA target sequence
cggaatgtcgttaaactctag

SEQ ID NO: 19711 - DNA, 21 bp, Artificial sequence
  SiRNA target sequence
ggaatgtcgttaaactctagg

SEQ ID NO: 19712 - DNA, 21 bp, Artificial sequence
  SiRNA target sequence
gaatgtcgttaaactctaggc

SEQ ID NO: 19713 - DNA, 21 bp, Artificial sequence
  SiRNA target sequence
aatgtcgttaaactctaggct

SEQ ID NO: 19714 - DNA, 21 bp, Artificial sequence
  SiRNA target sequence
atgtcgttaaactctaggctt

SEQ ID NO: 19715 - DNA, 21 bp, Artificial sequence
  SiRNA target sequence
tgtcgttaaactctaggcttt

SEQ ID NO: 19716 - DNA, 21 bp, Artificial sequence
  SiRNA target sequence
gtcgttaaactctaggctttc

SEQ ID NO: 19717 - DNA, 21 bp, Artificial sequence
  SiRNA target sequence
tcgttaaactctaggctttcc

SEQ ID NO: 19718 - DNA, 21 bp, Artificial sequence
  SiRNA target sequence
cgttaaactctaggctttccg

SEQ ID NO: 19719 - DNA, 21 bp, Artificial sequence
  SiRNA target sequence
gttaaactctaggctttccgg

SEQ ID NO: 19720 - DNA, 21 bp, Artificial sequence
  SiRNA target sequence
ttaaactctaggctttccgga

SEQ ID NO: 19721 - DNA, 21 bp, Artificial sequence
  SiRNA target sequence
taaactctaggctttccggat

SEQ ID NO: 19722 - DNA, 21 bp, Artificial sequence
  SiRNA target sequence
aaactctaggctttccggatg

SEQ ID NO: 19723 - DNA, 21 bp, Artificial sequence
  SiRNA target sequence
aactctaggctttccggatgg

SEQ ID NO: 19724 - DNA, 21 bp, Artificial sequence
  SiRNA target sequence
actctaggctttccggatggc

SEQ ID NO: 19725 - DNA, 21 bp, Artificial sequence
  SiRNA target sequence
ctctaggctttccggatggct

SEQ ID NO: 19726 - DNA, 21 bp, Artificial sequence
  SiRNA target sequence
tctaggctttccggatggctt

SEQ ID NO: 19727 - DNA, 21 bp, Artificial sequence
  SiRNA target sequence
ctaggctttccggatggcttc

SEQ ID NO: 19728 - DNA, 21 bp, Artificial sequence
  SiRNA target sequence
taggctttccggatggcttct

SEQ ID NO: 19729 - DNA, 21 bp, Artificial sequence
  SiRNA target sequence
aggctttccggatggcttcta

SEQ ID NO: 19730 - DNA, 21 bp, Artificial sequence
  SiRNA target sequence
ggctttccggatggcttctaa

SEQ ID NO: 19731 - DNA, 21 bp, Artificial sequence
  SiRNA target sequence
gctttccggatggcttctaat

SEQ ID NO: 19732 - DNA, 21 bp, Artificial sequence
  SiRNA target sequence
ctttccggatggcttctaatt

SEQ ID NO: 19733 - DNA, 21 bp, Artificial sequence
  SiRNA target sequence
tttccggatggcttctaatta

SEQ ID NO: 19734 - DNA, 21 bp, Artificial sequence
  SiRNA target sequence
ttccggatggcttctaattat

SEQ ID NO: 19735 - DNA, 21 bp, Artificial sequence
  SiRNA target sequence
tccggatggcttctaattatc

SEQ ID NO: 19736 - DNA, 21 bp, Artificial sequence
  SiRNA target sequence
ccggatggcttctaattatcc

SEQ ID NO: 19737 - DNA, 21 bp, Artificial sequence
  SiRNA target sequence
cggatggcttctaattatccg

SEQ ID NO: 19738 - DNA, 21 bp, Artificial sequence
  SiRNA target sequence
ggatggcttctaattatccga

SEQ ID NO: 19739 - DNA, 21 bp, Artificial sequence
  SiRNA target sequence
gatggcttctaattatccgag

SEQ ID NO: 19740 - DNA, 21 bp, Artificial sequence
  SiRNA target sequence
atggcttctaattatccgagg

SEQ ID NO: 19741 - DNA, 21 bp, Artificial sequence
  SiRNA target sequence
tggcttctaattatccgaggc

SEQ ID NO: 19742 - DNA, 21 bp, Artificial sequence
  SiRNA target sequence
ggcttctaattatccgaggcc

SEQ ID NO: 19743 - DNA, 21 bp, Artificial sequence
  SiRNA target sequence
gcttctaattatccgaggccc

SEQ ID NO: 19744 - DNA, 21 bp, Artificial sequence
  SiRNA target sequence
cttctaattatccgaggcccg

SEQ ID NO: 19745 - DNA, 21 bp, Artificial sequence
  SiRNA target sequence
ttctaattatccgaggcccgt

SEQ ID NO: 19746 - DNA, 21 bp, Artificial sequence
  SiRNA target sequence
tctaattatccgaggcccgta

SEQ ID NO: 19747 - DNA, 21 bp, Artificial sequence
  SiRNA target sequence
ctaattatccgaggcccgtac

SEQ ID NO: 19748 - DNA, 21 bp, Artificial sequence
  SiRNA target sequence
taattatccgaggcccgtacg

SEQ ID NO: 19749 - DNA, 21 bp, Artificial sequence
  SiRNA target sequence
aattatccgaggcccgtacgt

SEQ ID NO: 19750 - DNA, 21 bp, Artificial sequence
  SiRNA target sequence
attatccgaggcccgtacgtg

SEQ ID NO: 19751 - DNA, 21 bp, Artificial sequence
  SiRNA target sequence
ttatccgaggcccgtacgtgg

SEQ ID NO: 19752 - DNA, 21 bp, Artificial sequence
  SiRNA target sequence
tatccgaggcccgtacgtggg

SEQ ID NO: 19753 - DNA, 21 bp, Artificial sequence
  SiRNA target sequence
atccgaggcccgtacgtgggc

SEQ ID NO: 19754 - DNA, 21 bp, Artificial sequence
  SiRNA target sequence
tccgaggcccgtacgtgggct

SEQ ID NO: 19755 - DNA, 21 bp, Artificial sequence
  SiRNA target sequence
ccgaggcccgtacgtgggctc

SEQ ID NO: 19756 - DNA, 21 bp, Artificial sequence
  SiRNA target sequence
cgaggcccgtacgtgggctcg

SEQ ID NO: 19757 - DNA, 21 bp, Artificial sequence
  SiRNA target sequence
gaggcccgtacgtgggctcga

SEQ ID NO: 19758 - DNA, 21 bp, Artificial sequence
  SiRNA target sequence
aggcccgtacgtgggctcgaa

SEQ ID NO: 19759 - DNA, 21 bp, Artificial sequence
  SiRNA target sequence
ggcccgtacgtgggctcgaag

SEQ ID NO: 19760 - DNA, 21 bp, Artificial sequence
  SiRNA target sequence
gcccgtacgtgggctcgaagt

SEQ ID NO: 19761 - DNA, 21 bp, Artificial sequence
  SiRNA target sequence
cccgtacgtgggctcgaagtt

SEQ ID NO: 19762 - DNA, 21 bp, Artificial sequence
  SiRNA target sequence
ccgtacgtgggctcgaagttt

SEQ ID NO: 19763 - DNA, 21 bp, Artificial sequence
  SiRNA target sequence
cgtacgtgggctcgaagttta

SEQ ID NO: 19764 - DNA, 21 bp, Artificial sequence
  SiRNA target sequence
gtacgtgggctcgaagtttag

SEQ ID NO: 19765 - DNA, 21 bp, Artificial sequence
  SiRNA target sequence
tacgtgggctcgaagtttagt

SEQ ID NO: 19766 - DNA, 21 bp, Artificial sequence
  SiRNA target sequence
acgtgggctcgaagtttagta

SEQ ID NO: 19767 - DNA, 21 bp, Artificial sequence
  SiRNA target sequence
cgtgggctcgaagtttagtag

SEQ ID NO: 19768 - DNA, 21 bp, Artificial sequence
  SiRNA target sequence
gtgggctcgaagtttagtaga

SEQ ID NO: 19769 - DNA, 21 bp, Artificial sequence
  SiRNA target sequence
tgggctcgaagtttagtagag

SEQ ID NO: 19770 - DNA, 21 bp, Artificial sequence
  SiRNA target sequence
gggctcgaagtttagtagaga

SEQ ID NO: 19771 - DNA, 21 bp, Artificial sequence
  SiRNA target sequence
ggctcgaagtttagtagagag

SEQ ID NO: 19772 - DNA, 21 bp, Artificial sequence
  SiRNA target sequence
gctcgaagtttagtagagagt

SEQ ID NO: 19773 - DNA, 21 bp, Artificial sequence
  SiRNA target sequence
ctcgaagtttagtagagagta

SEQ ID NO: 19774 - DNA, 21 bp, Artificial sequence
  SiRNA target sequence
tcgaagtttagtagagagtac

SEQ ID NO: 19775 - DNA, 21 bp, Artificial sequence
  SiRNA target sequence
cgaagtttagtagagagtacg

SEQ ID NO: 19776 - DNA, 21 bp, Artificial sequence
  SiRNA target sequence
gaagtttagtagagagtacgc

SEQ ID NO: 19777 - DNA, 21 bp, Artificial sequence
  SiRNA target sequence
aagtttagtagagagtacgcg

SEQ ID NO: 19778 - DNA, 21 bp, Artificial sequence
  SiRNA target sequence
agtttagtagagagtacgcgt

SEQ ID NO: 19779 - DNA, 21 bp, Artificial sequence
  SiRNA target sequence
gtttagtagagagtacgcgta

SEQ ID NO: 19780 - DNA, 21 bp, Artificial sequence
  SiRNA target sequence
tttagtagagagtacgcgtac

SEQ ID NO: 19781 - DNA, 21 bp, Artificial sequence
  SiRNA target sequence
ttagtagagagtacgcgtaca

SEQ ID NO: 19782 - DNA, 21 bp, Artificial sequence
  SiRNA target sequence
tagtagagagtacgcgtacaa

SEQ ID NO: 19783 - DNA, 21 bp, Artificial sequence
  SiRNA target sequence
agtagagagtacgcgtacaaa

SEQ ID NO: 19784 - DNA, 21 bp, Artificial sequence
  SiRNA target sequence
gtagagagtacgcgtacaaaa

SEQ ID NO: 19785 - DNA, 21 bp, Artificial sequence
  SiRNA target sequence
tagagagtacgcgtacaaaag

SEQ ID NO: 19786 - DNA, 21 bp, Artificial sequence
  SiRNA target sequence
agagagtacgcgtacaaaagt

SEQ ID NO: 19787 - DNA, 21 bp, Artificial sequence
  SiRNA target sequence
gagagtacgcgtacaaaagtc

SEQ ID NO: 19788 - DNA, 21 bp, Artificial sequence
  SiRNA target sequence
agagtacgcgtacaaaagtcc

SEQ ID NO: 19789 - DNA, 21 bp, Artificial sequence
  SiRNA target sequence
gagtacgcgtacaaaagtcct

SEQ ID NO: 19790 - DNA, 21 bp, Artificial sequence
  SiRNA target sequence
agtacgcgtacaaaagtccta

SEQ ID NO: 19791 - DNA, 21 bp, Artificial sequence
  SiRNA target sequence
gtacgcgtacaaaagtcctag

SEQ ID NO: 19792 - DNA, 21 bp, Artificial sequence
  SiRNA target sequence
tacgcgtacaaaagtcctagt

SEQ ID NO: 19793 - DNA, 21 bp, Artificial sequence
  SiRNA target sequence
acgcgtacaaaagtcctagtt

SEQ ID NO: 19794 - DNA, 21 bp, Artificial sequence
  SiRNA target sequence
cgcgtacaaaagtcctagttg

SEQ ID NO: 19795 - DNA, 21 bp, Artificial sequence
  SiRNA target sequence
gcgtacaaaagtcctagttgt

SEQ ID NO: 19796 - DNA, 21 bp, Artificial sequence
  SiRNA target sequence
cgtacaaaagtcctagttgtt

SEQ ID NO: 19797 - DNA, 21 bp, Artificial sequence
  SiRNA target sequence
gtacaaaagtcctagttgttt

SEQ ID NO: 19798 - DNA, 21 bp, Artificial sequence
  SiRNA target sequence
tacaaaagtcctagttgtttt

SEQ ID NO: 19799 - DNA, 21 bp, Artificial sequence
  SiRNA target sequence
acaaaagtcctagttgttttc

SEQ ID NO: 19800 - DNA, 21 bp, Artificial sequence
  SiRNA target sequence
caaaagtcctagttgttttca

SEQ ID NO: 19801 - DNA, 21 bp, Artificial sequence
  SiRNA target sequence
aaaagtcctagttgttttcat

SEQ ID NO: 19802 - DNA, 21 bp, Artificial sequence
  SiRNA target sequence
aaagtcctagttgttttcata

SEQ ID NO: 19803 - DNA, 21 bp, Artificial sequence
  SiRNA target sequence
aagtcctagttgttttcatac

SEQ ID NO: 19804 - DNA, 21 bp, Artificial sequence
  SiRNA target sequence
agtcctagttgttttcataca

SEQ ID NO: 19805 - DNA, 21 bp, Artificial sequence
  SiRNA target sequence
gtcctagttgttttcatacat

SEQ ID NO: 19806 - DNA, 21 bp, Artificial sequence
  SiRNA target sequence
tcctagttgttttcatacatc

SEQ ID NO: 19807 - DNA, 21 bp, Artificial sequence
  SiRNA target sequence
cctagttgttttcatacatca

SEQ ID NO: 19808 - DNA, 21 bp, Artificial sequence
  SiRNA target sequence
ctagttgttttcatacatcaa

SEQ ID NO: 19809 - DNA, 21 bp, Artificial sequence
  SiRNA target sequence
tagttgttttcatacatcaag

SEQ ID NO: 19810 - DNA, 21 bp, Artificial sequence
  SiRNA target sequence
agttgttttcatacatcaagt

SEQ ID NO: 19811 - DNA, 21 bp, Artificial sequence
  SiRNA target sequence
gttgttttcatacatcaagtg

SEQ ID NO: 19812 - DNA, 21 bp, Artificial sequence
  SiRNA target sequence
ttgttttcatacatcaagtgg

SEQ ID NO: 19813 - DNA, 21 bp, Artificial sequence
  SiRNA target sequence
tgttttcatacatcaagtggg

SEQ ID NO: 19814 - DNA, 21 bp, Artificial sequence
  SiRNA target sequence
gttttcatacatcaagtgggt

SEQ ID NO: 19815 - DNA, 21 bp, Artificial sequence
  SiRNA target sequence
ttttcatacatcaagtgggtt

SEQ ID NO: 19816 - DNA, 21 bp, Artificial sequence
  SiRNA target sequence
tttcatacatcaagtgggttg

SEQ ID NO: 19817 - DNA, 21 bp, Artificial sequence
  SiRNA target sequence
ttcatacatcaagtgggttga

SEQ ID NO: 19818 - DNA, 21 bp, Artificial sequence
  SiRNA target sequence
tcatacatcaagtgggttgaa

SEQ ID NO: 19819 - DNA, 21 bp, Artificial sequence
  SiRNA target sequence
catacatcaagtgggttgaaa

SEQ ID NO: 19820 - DNA, 21 bp, Artificial sequence
  SiRNA target sequence
atacatcaagtgggttgaaag

SEQ ID NO: 19821 - DNA, 21 bp, Artificial sequence
  SiRNA target sequence
tacatcaagtgggttgaaagc

SEQ ID NO: 19822 - DNA, 21 bp, Artificial sequence
  SiRNA target sequence
acatcaagtgggttgaaagcc

SEQ ID NO: 19823 - DNA, 21 bp, Artificial sequence
  SiRNA target sequence
catcaagtgggttgaaagccc

SEQ ID NO: 19824 - DNA, 21 bp, Artificial sequence
  SiRNA target sequence
atcaagtgggttgaaagcccc

SEQ ID NO: 19825 - DNA, 21 bp, Artificial sequence
  SiRNA target sequence
tcaagtgggttgaaagccccg

SEQ ID NO: 19826 - DNA, 21 bp, Artificial sequence
  SiRNA target sequence
caagtgggttgaaagccccgt

SEQ ID NO: 19827 - DNA, 21 bp, Artificial sequence
  SiRNA target sequence
aagtgggttgaaagccccgtg

SEQ ID NO: 19828 - DNA, 21 bp, Artificial sequence
  SiRNA target sequence
agtgggttgaaagccccgtgt

SEQ ID NO: 19829 - DNA, 21 bp, Artificial sequence
  SiRNA target sequence
gtgggttgaaagccccgtgta

SEQ ID NO: 19830 - DNA, 21 bp, Artificial sequence
  SiRNA target sequence
tgggttgaaagccccgtgtac

SEQ ID NO: 19831 - DNA, 21 bp, Artificial sequence
  SiRNA target sequence
gggttgaaagccccgtgtact

SEQ ID NO: 19832 - DNA, 21 bp, Artificial sequence
  SiRNA target sequence
ggttgaaagccccgtgtactt

SEQ ID NO: 19833 - DNA, 21 bp, Artificial sequence
  SiRNA target sequence
gttgaaagccccgtgtacttg

SEQ ID NO: 19834 - DNA, 21 bp, Artificial sequence
  SiRNA target sequence
ttgaaagccccgtgtacttgg

SEQ ID NO: 19835 - DNA, 21 bp, Artificial sequence
  SiRNA target sequence
tgaaagccccgtgtacttgga

SEQ ID NO: 19836 - DNA, 21 bp, Artificial sequence
  SiRNA target sequence
gaaagccccgtgtacttggag

SEQ ID NO: 19837 - DNA, 21 bp, Artificial sequence
  SiRNA target sequence
aaagccccgtgtacttggagg

SEQ ID NO: 19838 - DNA, 21 bp, Artificial sequence
  SiRNA target sequence
aagccccgtgtacttggaggc

SEQ ID NO: 19839 - DNA, 21 bp, Artificial sequence
  SiRNA target sequence
agccccgtgtacttggaggct

SEQ ID NO: 19840 - DNA, 21 bp, Artificial sequence
  SiRNA target sequence
gccccgtgtacttggaggcta

SEQ ID NO: 19841 - DNA, 21 bp, Artificial sequence
  SiRNA target sequence
ccccgtgtacttggaggctag

SEQ ID NO: 19842 - DNA, 21 bp, Artificial sequence
  SiRNA target sequence
cccgtgtacttggaggctagg

SEQ ID NO: 19843 - DNA, 21 bp, Artificial sequence
  SiRNA target sequence
ccgtgtacttggaggctaggc

SEQ ID NO: 19844 - DNA, 21 bp, Artificial sequence
  SiRNA target sequence
cgtgtacttggaggctaggca

SEQ ID NO: 19845 - DNA, 21 bp, Artificial sequence
  SiRNA target sequence
gtgtacttggaggctaggcag

SEQ ID NO: 19846 - DNA, 21 bp, Artificial sequence
  SiRNA target sequence
tgtacttggaggctaggcagc

SEQ ID NO: 19847 - DNA, 21 bp, Artificial sequence
  SiRNA target sequence
gtacttggaggctaggcagca

SEQ ID NO: 19848 - DNA, 21 bp, Artificial sequence
  SiRNA target sequence
tacttggaggctaggcagcac

SEQ ID NO: 19849 - DNA, 21 bp, Artificial sequence
  SiRNA target sequence
acttggaggctaggcagcacg

SEQ ID NO: 19850 - DNA, 21 bp, Artificial sequence
  SiRNA target sequence
cttggaggctaggcagcacga

SEQ ID NO: 19851 - DNA, 21 bp, Artificial sequence
  SiRNA target sequence
ttggaggctaggcagcacgat

SEQ ID NO: 19852 - DNA, 21 bp, Artificial sequence
  SiRNA target sequence
tggaggctaggcagcacgatt

SEQ ID NO: 19853 - DNA, 21 bp, Artificial sequence
  SiRNA target sequence
ggaggctaggcagcacgatta

SEQ ID NO: 19854 - DNA, 21 bp, Artificial sequence
  SiRNA target sequence
gaggctaggcagcacgattac

SEQ ID NO: 19855 - DNA, 21 bp, Artificial sequence
  SiRNA target sequence
aggctaggcagcacgattaca

SEQ ID NO: 19856 - DNA, 21 bp, Artificial sequence
  SiRNA target sequence
ggctaggcagcacgattacag

SEQ ID NO: 19857 - DNA, 21 bp, Artificial sequence
  SiRNA target sequence
gctaggcagcacgattacagt

SEQ ID NO: 19858 - DNA, 21 bp, Artificial sequence
  SiRNA target sequence
ctaggcagcacgattacagta

SEQ ID NO: 19859 - DNA, 21 bp, Artificial sequence
  SiRNA target sequence
taggcagcacgattacagtag

SEQ ID NO: 19860 - DNA, 21 bp, Artificial sequence
  SiRNA target sequence
aggcagcacgattacagtagc

SEQ ID NO: 19861 - DNA, 21 bp, Artificial sequence
  SiRNA target sequence
ggcagcacgattacagtagcc

SEQ ID NO: 19862 - DNA, 21 bp, Artificial sequence
  SiRNA target sequence
gcagcacgattacagtagcct

SEQ ID NO: 19863 - DNA, 21 bp, Artificial sequence
  SiRNA target sequence
cagcacgattacagtagcctg

SEQ ID NO: 19864 - DNA, 21 bp, Artificial sequence
  SiRNA target sequence
agcacgattacagtagcctgt

SEQ ID NO: 19865 - DNA, 21 bp, Artificial sequence
  SiRNA target sequence
gcacgattacagtagcctgta

SEQ ID NO: 19866 - DNA, 21 bp, Artificial sequence
  SiRNA target sequence
cacgattacagtagcctgtac

SEQ ID NO: 19867 - DNA, 21 bp, Artificial sequence
  SiRNA target sequence
acgattacagtagcctgtact

SEQ ID NO: 19868 - DNA, 21 bp, Artificial sequence
  SiRNA target sequence
cgattacagtagcctgtacta

SEQ ID NO: 19869 - DNA, 21 bp, Artificial sequence
  SiRNA target sequence
gattacagtagcctgtactac

SEQ ID NO: 19870 - DNA, 21 bp, Artificial sequence
  SiRNA target sequence
attacagtagcctgtactacc

SEQ ID NO: 19871 - DNA, 21 bp, Artificial sequence
  SiRNA target sequence
ttacagtagcctgtactacct

SEQ ID NO: 19872 - DNA, 21 bp, Artificial sequence
  SiRNA target sequence
tacagtagcctgtactacctg

SEQ ID NO: 19873 - DNA, 21 bp, Artificial sequence
  SiRNA target sequence
acagtagcctgtactacctga

SEQ ID NO: 19874 - DNA, 21 bp, Artificial sequence
  SiRNA target sequence
cagtagcctgtactacctgaa

SEQ ID NO: 19875 - DNA, 21 bp, Artificial sequence
  SiRNA target sequence
agtagcctgtactacctgaag

SEQ ID NO: 19876 - DNA, 21 bp, Artificial sequence
  SiRNA target sequence
gtagcctgtactacctgaagc

SEQ ID NO: 19877 - DNA, 21 bp, Artificial sequence
  SiRNA target sequence
tagcctgtactacctgaagca

SEQ ID NO: 19878 - DNA, 21 bp, Artificial sequence
  SiRNA target sequence
agcctgtactacctgaagcat

SEQ ID NO: 19879 - DNA, 21 bp, Artificial sequence
  SiRNA target sequence
gcctgtactacctgaagcatg

SEQ ID NO: 19880 - DNA, 21 bp, Artificial sequence
  SiRNA target sequence
cctgtactacctgaagcatgt

SEQ ID NO: 19881 - DNA, 21 bp, Artificial sequence
  SiRNA target sequence
ctgtactacctgaagcatgta

SEQ ID NO: 19882 - DNA, 21 bp, Artificial sequence
  SiRNA target sequence
tgtactacctgaagcatgtag

SEQ ID NO: 19883 - DNA, 21 bp, Artificial sequence
  SiRNA target sequence
gtactacctgaagcatgtagt

SEQ ID NO: 19884 - DNA, 21 bp, Artificial sequence
  SiRNA target sequence
tactacctgaagcatgtagta

SEQ ID NO: 19885 - DNA, 21 bp, Artificial sequence
  SiRNA target sequence
actacctgaagcatgtagtaa

SEQ ID NO: 19886 - DNA, 21 bp, Artificial sequence
  SiRNA target sequence
ctacctgaagcatgtagtaaa

SEQ ID NO: 19887 - DNA, 21 bp, Artificial sequence
  SiRNA target sequence
tacctgaagcatgtagtaaaa

SEQ ID NO: 19888 - DNA, 21 bp, Artificial sequence
  SiRNA target sequence
acctgaagcatgtagtaaaac

SEQ ID NO: 19889 - DNA, 21 bp, Artificial sequence
  SiRNA target sequence
cctgaagcatgtagtaaaact

SEQ ID NO: 19890 - DNA, 21 bp, Artificial sequence
  SiRNA target sequence
ctgaagcatgtagtaaaactg

SEQ ID NO: 19891 - DNA, 21 bp, Artificial sequence
  SiRNA target sequence
tgaagcatgtagtaaaactgc

SEQ ID NO: 19892 - DNA, 21 bp, Artificial sequence
  SiRNA target sequence
gaagcatgtagtaaaactgca

SEQ ID NO: 19893 - DNA, 21 bp, Artificial sequence
  SiRNA target sequence
aagcatgtagtaaaactgcac

SEQ ID NO: 19894 - DNA, 21 bp, Artificial sequence
  SiRNA target sequence
agcatgtagtaaaactgcaca

SEQ ID NO: 19895 - DNA, 21 bp, Artificial sequence
  SiRNA target sequence
gcatgtagtaaaactgcacag

SEQ ID NO: 19896 - DNA, 21 bp, Artificial sequence
  SiRNA target sequence
catgtagtaaaactgcacagt

SEQ ID NO: 19897 - DNA, 21 bp, Artificial sequence
  SiRNA target sequence
atgtagtaaaactgcacagtt

SEQ ID NO: 19898 - DNA, 21 bp, Artificial sequence
  SiRNA target sequence
tgtagtaaaactgcacagttg

SEQ ID NO: 19899 - DNA, 21 bp, Artificial sequence
  SiRNA target sequence
gtagtaaaactgcacagttga

SEQ ID NO: 19900 - DNA, 21 bp, Artificial sequence
  SiRNA target sequence
tagtaaaactgcacagttgaa

SEQ ID NO: 19901 - DNA, 21 bp, Artificial sequence
  SiRNA target sequence
agtaaaactgcacagttgaac

SEQ ID NO: 19902 - DNA, 21 bp, Artificial sequence
  SiRNA target sequence
gtaaaactgcacagttgaaca

SEQ ID NO: 19903 - DNA, 21 bp, Artificial sequence
  SiRNA target sequence
taaaactgcacagttgaacat

SEQ ID NO: 19904 - DNA, 21 bp, Artificial sequence
  SiRNA target sequence
aaaactgcacagttgaacatt

SEQ ID NO: 19905 - DNA, 21 bp, Artificial sequence
  SiRNA target sequence
aaactgcacagttgaacattg

SEQ ID NO: 19906 - DNA, 21 bp, Artificial sequence
  SiRNA target sequence
aactgcacagttgaacattgt

SEQ ID NO: 19907 - DNA, 21 bp, Artificial sequence
  SiRNA target sequence
actgcacagttgaacattgtc

SEQ ID NO: 19908 - DNA, 21 bp, Artificial sequence
  SiRNA target sequence
ctgcacagttgaacattgtca

SEQ ID NO: 19909 - DNA, 21 bp, Artificial sequence
  SiRNA target sequence
tgcacagttgaacattgtcac

SEQ ID NO: 19910 - DNA, 21 bp, Artificial sequence
  SiRNA target sequence
gcacagttgaacattgtcaca

SEQ ID NO: 19911 - DNA, 21 bp, Artificial sequence
  SiRNA target sequence
cacagttgaacattgtcacaa

SEQ ID NO: 19912 - DNA, 21 bp, Artificial sequence
  SiRNA target sequence
acagttgaacattgtcacaaa

SEQ ID NO: 19913 - DNA, 21 bp, Artificial sequence
  SiRNA target sequence
cagttgaacattgtcacaaac

SEQ ID NO: 19914 - DNA, 21 bp, Artificial sequence
  SiRNA target sequence
agttgaacattgtcacaaacg

SEQ ID NO: 19915 - DNA, 21 bp, Artificial sequence
  SiRNA target sequence
gttgaacattgtcacaaacgg

SEQ ID NO: 19916 - DNA, 21 bp, Artificial sequence
  SiRNA target sequence
ttgaacattgtcacaaacggg

SEQ ID NO: 19917 - DNA, 21 bp, Artificial sequence
  SiRNA target sequence
tgaacattgtcacaaacgggc

SEQ ID NO: 19918 - DNA, 21 bp, Artificial sequence
  SiRNA target sequence
gaacattgtcacaaacgggct

SEQ ID NO: 19919 - DNA, 21 bp, Artificial sequence
  SiRNA target sequence
aacattgtcacaaacgggctg

SEQ ID NO: 19920 - DNA, 21 bp, Artificial sequence
  SiRNA target sequence
acattgtcacaaacgggctga

SEQ ID NO: 19921 - DNA, 21 bp, Artificial sequence
  SiRNA target sequence
cattgtcacaaacgggctgat

SEQ ID NO: 19922 - DNA, 21 bp, Artificial sequence
  SiRNA target sequence
attgtcacaaacgggctgata

SEQ ID NO: 19923 - DNA, 21 bp, Artificial sequence
  SiRNA target sequence
ttgtcacaaacgggctgatag

SEQ ID NO: 19924 - DNA, 21 bp, Artificial sequence
  SiRNA target sequence
tgtcacaaacgggctgatagc

SEQ ID NO: 19925 - DNA, 21 bp, Artificial sequence
  SiRNA target sequence
gtcacaaacgggctgatagcg

SEQ ID NO: 19926 - DNA, 21 bp, Artificial sequence
  SiRNA target sequence
tcacaaacgggctgatagcgt

SEQ ID NO: 19927 - DNA, 21 bp, Artificial sequence
  SiRNA target sequence
cacaaacgggctgatagcgta

SEQ ID NO: 19928 - DNA, 21 bp, Artificial sequence
  SiRNA target sequence
acaaacgggctgatagcgtat

SEQ ID NO: 19929 - DNA, 21 bp, Artificial sequence
  SiRNA target sequence
caaacgggctgatagcgtata

SEQ ID NO: 19930 - DNA, 21 bp, Artificial sequence
  SiRNA target sequence
aaacgggctgatagcgtatag

SEQ ID NO: 19931 - DNA, 21 bp, Artificial sequence
  SiRNA target sequence
aacgggctgatagcgtatagc

SEQ ID NO: 19932 - DNA, 21 bp, Artificial sequence
  SiRNA target sequence
acgggctgatagcgtatagct

SEQ ID NO: 19933 - DNA, 21 bp, Artificial sequence
  SiRNA target sequence
cgggctgatagcgtatagctg

SEQ ID NO: 19934 - DNA, 21 bp, Artificial sequence
  SiRNA target sequence
gggctgatagcgtatagctgg

SEQ ID NO: 19935 - DNA, 21 bp, Artificial sequence
  SiRNA target sequence
ggctgatagcgtatagctgga

SEQ ID NO: 19936 - DNA, 21 bp, Artificial sequence
  SiRNA target sequence
gctgatagcgtatagctggat

SEQ ID NO: 19937 - DNA, 21 bp, Artificial sequence
  SiRNA target sequence
ctgatagcgtatagctggatt

SEQ ID NO: 19938 - DNA, 21 bp, Artificial sequence
  SiRNA target sequence
tgatagcgtatagctggattg

SEQ ID NO: 19939 - DNA, 21 bp, Artificial sequence
  SiRNA target sequence
gatagcgtatagctggattgt

SEQ ID NO: 19940 - DNA, 21 bp, Artificial sequence
  SiRNA target sequence
atagcgtatagctggattgtt

SEQ ID NO: 19941 - DNA, 21 bp, Artificial sequence
  SiRNA target sequence
tagcgtatagctggattgttg

SEQ ID NO: 19942 - DNA, 21 bp, Artificial sequence
  SiRNA target sequence
agcgtatagctggattgttga

SEQ ID NO: 19943 - DNA, 21 bp, Artificial sequence
  SiRNA target sequence
gcgtatagctggattgttgag

SEQ ID NO: 19944 - DNA, 21 bp, Artificial sequence
  SiRNA target sequence
cgtatagctggattgttgaga

SEQ ID NO: 19945 - DNA, 21 bp, Artificial sequence
  SiRNA target sequence
gtatagctggattgttgagag

SEQ ID NO: 19946 - DNA, 21 bp, Artificial sequence
  SiRNA target sequence
tatagctggattgttgagaga

SEQ ID NO: 19947 - DNA, 21 bp, Artificial sequence
  SiRNA target sequence
atagctggattgttgagagat

SEQ ID NO: 19948 - DNA, 21 bp, Artificial sequence
  SiRNA target sequence
tagctggattgttgagagata

SEQ ID NO: 19949 - DNA, 21 bp, Artificial sequence
  SiRNA target sequence
agctggattgttgagagatag

SEQ ID NO: 19950 - DNA, 21 bp, Artificial sequence
  SiRNA target sequence
gctggattgttgagagatagc

SEQ ID NO: 19951 - DNA, 21 bp, Artificial sequence
  SiRNA target sequence
ctggattgttgagagatagca

SEQ ID NO: 19952 - DNA, 21 bp, Artificial sequence
  SiRNA target sequence
tggattgttgagagatagcat

SEQ ID NO: 19953 - DNA, 21 bp, Artificial sequence
  SiRNA target sequence
ggattgttgagagatagcatc

SEQ ID NO: 19954 - DNA, 21 bp, Artificial sequence
  SiRNA target sequence
gattgttgagagatagcatct

SEQ ID NO: 19955 - DNA, 21 bp, Artificial sequence
  SiRNA target sequence
attgttgagagatagcatctt

SEQ ID NO: 19956 - DNA, 21 bp, Artificial sequence
  SiRNA target sequence
ttgttgagagatagcatcttg

SEQ ID NO: 19957 - DNA, 21 bp, Artificial sequence
  SiRNA target sequence
tgttgagagatagcatcttgc

SEQ ID NO: 19958 - DNA, 21 bp, Artificial sequence
  SiRNA target sequence
gttgagagatagcatcttgcg

SEQ ID NO: 19959 - DNA, 21 bp, Artificial sequence
  SiRNA target sequence
ttgagagatagcatcttgcgg

SEQ ID NO: 19960 - DNA, 21 bp, Artificial sequence
  SiRNA target sequence
tgagagatagcatcttgcggg

SEQ ID NO: 19961 - DNA, 21 bp, Artificial sequence
  SiRNA target sequence
gagagatagcatcttgcggga

SEQ ID NO: 19962 - DNA, 21 bp, Artificial sequence
  SiRNA target sequence
agagatagcatcttgcgggat

SEQ ID NO: 19963 - DNA, 21 bp, Artificial sequence
  SiRNA target sequence
gagatagcatcttgcgggatg

SEQ ID NO: 19964 - DNA, 21 bp, Artificial sequence
  SiRNA target sequence
agatagcatcttgcgggatgt

SEQ ID NO: 19965 - DNA, 21 bp, Artificial sequence
  SiRNA target sequence
gatagcatcttgcgggatgtg

SEQ ID NO: 19966 - DNA, 21 bp, Artificial sequence
  SiRNA target sequence
atagcatcttgcgggatgtga

SEQ ID NO: 19967 - DNA, 21 bp, Artificial sequence
  SiRNA target sequence
tagcatcttgcgggatgtgaa

SEQ ID NO: 19968 - DNA, 21 bp, Artificial sequence
  SiRNA target sequence
agcatcttgcgggatgtgaaa

SEQ ID NO: 19969 - DNA, 21 bp, Artificial sequence
  SiRNA target sequence
gcatcttgcgggatgtgaaag

SEQ ID NO: 19970 - DNA, 21 bp, Artificial sequence
  SiRNA target sequence
catcttgcgggatgtgaaaga

SEQ ID NO: 19971 - DNA, 21 bp, Artificial sequence
  SiRNA target sequence
atcttgcgggatgtgaaagag

SEQ ID NO: 19972 - DNA, 21 bp, Artificial sequence
  SiRNA target sequence
tcttgcgggatgtgaaagagc

SEQ ID NO: 19973 - DNA, 21 bp, Artificial sequence
  SiRNA target sequence
cttgcgggatgtgaaagagca

SEQ ID NO: 19974 - DNA, 21 bp, Artificial sequence
  SiRNA target sequence
ttgcgggatgtgaaagagcat

SEQ ID NO: 19975 - DNA, 21 bp, Artificial sequence
  SiRNA target sequence
tgcgggatgtgaaagagcatg

SEQ ID NO: 19976 - DNA, 21 bp, Artificial sequence
  SiRNA target sequence
gcgggatgtgaaagagcatgt

SEQ ID NO: 19977 - DNA, 21 bp, Artificial sequence
  SiRNA target sequence
cgggatgtgaaagagcatgtt

SEQ ID NO: 19978 - DNA, 21 bp, Artificial sequence
  SiRNA target sequence
gggatgtgaaagagcatgtta

SEQ ID NO: 19979 - DNA, 21 bp, Artificial sequence
  SiRNA target sequence
ggatgtgaaagagcatgttag

SEQ ID NO: 19980 - DNA, 21 bp, Artificial sequence
  SiRNA target sequence
gatgtgaaagagcatgttaga

SEQ ID NO: 19981 - DNA, 21 bp, Artificial sequence
  SiRNA target sequence
atgtgaaagagcatgttagac

SEQ ID NO: 19982 - DNA, 21 bp, Artificial sequence
  SiRNA target sequence
tgtgaaagagcatgttagaca

SEQ ID NO: 19983 - DNA, 21 bp, Artificial sequence
  SiRNA target sequence
gtgaaagagcatgttagacat

SEQ ID NO: 19984 - DNA, 21 bp, Artificial sequence
  SiRNA target sequence
tgaaagagcatgttagacatg

SEQ ID NO: 19985 - DNA, 21 bp, Artificial sequence
  SiRNA target sequence
gaaagagcatgttagacatgt

SEQ ID NO: 19986 - DNA, 21 bp, Artificial sequence
  SiRNA target sequence
aaagagcatgttagacatgta

SEQ ID NO: 19987 - DNA, 21 bp, Artificial sequence
  SiRNA target sequence
aagagcatgttagacatgtat

SEQ ID NO: 19988 - DNA, 21 bp, Artificial sequence
  SiRNA target sequence
agagcatgttagacatgtatt

SEQ ID NO: 19989 - DNA, 21 bp, Artificial sequence
  SiRNA target sequence
gagcatgttagacatgtatta

SEQ ID NO: 19990 - DNA, 21 bp, Artificial sequence
  SiRNA target sequence
agcatgttagacatgtattat

SEQ ID NO: 19991 - DNA, 21 bp, Artificial sequence
  SiRNA target sequence
gcatgttagacatgtattatg

SEQ ID NO: 19992 - DNA, 21 bp, Artificial sequence
  SiRNA target sequence
catgttagacatgtattatgg

SEQ ID NO: 19993 - DNA, 21 bp, Artificial sequence
  SiRNA target sequence
atgttagacatgtattatggc

SEQ ID NO: 19994 - DNA, 21 bp, Artificial sequence
  SiRNA target sequence
tgttagacatgtattatggct

SEQ ID NO: 19995 - DNA, 21 bp, Artificial sequence
  SiRNA target sequence
gttagacatgtattatggctt

SEQ ID NO: 19996 - DNA, 21 bp, Artificial sequence
  SiRNA target sequence
ttagacatgtattatggcttt

SEQ ID NO: 19997 - DNA, 21 bp, Artificial sequence
  SiRNA target sequence
tagacatgtattatggctttt

SEQ ID NO: 19998 - DNA, 21 bp, Artificial sequence
  SiRNA target sequence
agacatgtattatggcttttc

SEQ ID NO: 19999 - DNA, 21 bp, Artificial sequence
  SiRNA target sequence
gacatgtattatggcttttct

SEQ ID NO: 20000 - DNA, 21 bp, Artificial sequence
  SiRNA target sequence
acatgtattatggcttttctc

SEQ ID NO: 20001 - DNA, 21 bp, Artificial sequence
  SiRNA target sequence
catgtattatggcttttctca

SEQ ID NO: 20002 - DNA, 21 bp, Artificial sequence
  SiRNA target sequence
atgtattatggcttttctcaa

SEQ ID NO: 20003 - DNA, 21 bp, Artificial sequence
  SiRNA target sequence
tgtattatggcttttctcaat

SEQ ID NO: 20004 - DNA, 21 bp, Artificial sequence
  SiRNA target sequence
gtattatggcttttctcaata

SEQ ID NO: 20005 - DNA, 21 bp, Artificial sequence
  SiRNA target sequence
tattatggcttttctcaatac

SEQ ID NO: 20006 - DNA, 21 bp, Artificial sequence
  SiRNA target sequence
attatggcttttctcaatacg

SEQ ID NO: 20007 - DNA, 21 bp, Artificial sequence
  SiRNA target sequence
ttatggcttttctcaatacgc

SEQ ID NO: 20008 - DNA, 21 bp, Artificial sequence
  SiRNA target sequence
tatggcttttctcaatacgca

SEQ ID NO: 20009 - DNA, 21 bp, Artificial sequence
  SiRNA target sequence
atggcttttctcaatacgcag

SEQ ID NO: 20010 - DNA, 21 bp, Artificial sequence
  SiRNA target sequence
tggcttttctcaatacgcagt

SEQ ID NO: 20011 - DNA, 21 bp, Artificial sequence
  SiRNA target sequence
ggcttttctcaatacgcagtc

SEQ ID NO: 20012 - DNA, 21 bp, Artificial sequence
  SiRNA target sequence
gcttttctcaatacgcagtct

SEQ ID NO: 20013 - DNA, 21 bp, Artificial sequence
  SiRNA target sequence
cttttctcaatacgcagtctt

SEQ ID NO: 20014 - DNA, 21 bp, Artificial sequence
  SiRNA target sequence
ttttctcaatacgcagtcttt

SEQ ID NO: 20015 - DNA, 21 bp, Artificial sequence
  SiRNA target sequence
tttctcaatacgcagtctttg

SEQ ID NO: 20016 - DNA, 21 bp, Artificial sequence
  SiRNA target sequence
ttctcaatacgcagtctttgc

SEQ ID NO: 20017 - DNA, 21 bp, Artificial sequence
  SiRNA target sequence
tctcaatacgcagtctttgct

SEQ ID NO: 20018 - DNA, 21 bp, Artificial sequence
  SiRNA target sequence
ctcaatacgcagtctttgcta

SEQ ID NO: 20019 - DNA, 21 bp, Artificial sequence
  SiRNA target sequence
tcaatacgcagtctttgctat

SEQ ID NO: 20020 - DNA, 21 bp, Artificial sequence
  SiRNA target sequence
caatacgcagtctttgctatg

SEQ ID NO: 20021 - DNA, 21 bp, Artificial sequence
  SiRNA target sequence
aatacgcagtctttgctatgc

SEQ ID NO: 20022 - DNA, 21 bp, Artificial sequence
  SiRNA target sequence
atacgcagtctttgctatgcg

SEQ ID NO: 20023 - DNA, 21 bp, Artificial sequence
  SiRNA target sequence
tacgcagtctttgctatgcgt

SEQ ID NO: 20024 - DNA, 21 bp, Artificial sequence
  SiRNA target sequence
acgcagtctttgctatgcgtg

SEQ ID NO: 20025 - DNA, 21 bp, Artificial sequence
  SiRNA target sequence
cgcagtctttgctatgcgtgt

SEQ ID NO: 20026 - DNA, 21 bp, Artificial sequence
  SiRNA target sequence
gcagtctttgctatgcgtgtg

SEQ ID NO: 20027 - DNA, 21 bp, Artificial sequence
  SiRNA target sequence
cagtctttgctatgcgtgtgt

SEQ ID NO: 20028 - DNA, 21 bp, Artificial sequence
  SiRNA target sequence
agtctttgctatgcgtgtgta

SEQ ID NO: 20029 - DNA, 21 bp, Artificial sequence
  SiRNA target sequence
gtctttgctatgcgtgtgtag

SEQ ID NO: 20030 - DNA, 21 bp, Artificial sequence
  SiRNA target sequence
tctttgctatgcgtgtgtagg

SEQ ID NO: 20031 - DNA, 21 bp, Artificial sequence
  SiRNA target sequence
ctttgctatgcgtgtgtaggc

SEQ ID NO: 20032 - DNA, 21 bp, Artificial sequence
  SiRNA target sequence
tttgctatgcgtgtgtaggca

SEQ ID NO: 20033 - DNA, 21 bp, Artificial sequence
  SiRNA target sequence
ttgctatgcgtgtgtaggcaa

SEQ ID NO: 20034 - DNA, 21 bp, Artificial sequence
  SiRNA target sequence
tgctatgcgtgtgtaggcaaa

SEQ ID NO: 20035 - DNA, 21 bp, Artificial sequence
  SiRNA target sequence
gctatgcgtgtgtaggcaaaa

SEQ ID NO: 20036 - DNA, 21 bp, Artificial sequence
  SiRNA target sequence
ctatgcgtgtgtaggcaaaag

SEQ ID NO: 20037 - DNA, 21 bp, Artificial sequence
  SiRNA target sequence
tatgcgtgtgtaggcaaaagg

SEQ ID NO: 20038 - DNA, 21 bp, Artificial sequence
  SiRNA target sequence
atgcgtgtgtaggcaaaagga

SEQ ID NO: 20039 - DNA, 21 bp, Artificial sequence
  SiRNA target sequence
tgcgtgtgtaggcaaaaggaa

SEQ ID NO: 20040 - DNA, 21 bp, Artificial sequence
  SiRNA target sequence
gcgtgtgtaggcaaaaggaag

SEQ ID NO: 20041 - DNA, 21 bp, Artificial sequence
  SiRNA target sequence
cgtgtgtaggcaaaaggaagt

SEQ ID NO: 20042 - DNA, 21 bp, Artificial sequence
  SiRNA target sequence
gtgtgtaggcaaaaggaagtg

SEQ ID NO: 20043 - DNA, 21 bp, Artificial sequence
  SiRNA target sequence
tgtgtaggcaaaaggaagtga

SEQ ID NO: 20044 - DNA, 21 bp, Artificial sequence
  SiRNA target sequence
gtgtaggcaaaaggaagtgag

SEQ ID NO: 20045 - DNA, 21 bp, Artificial sequence
  SiRNA target sequence
tgtaggcaaaaggaagtgaga

SEQ ID NO: 20046 - DNA, 21 bp, Artificial sequence
  SiRNA target sequence
gtaggcaaaaggaagtgagag

SEQ ID NO: 20047 - DNA, 21 bp, Artificial sequence
  SiRNA target sequence
taggcaaaaggaagtgagaga

SEQ ID NO: 20048 - DNA, 21 bp, Artificial sequence
  SiRNA target sequence
aggcaaaaggaagtgagagag

SEQ ID NO: 20049 - DNA, 21 bp, Artificial sequence
  SiRNA target sequence
ggcaaaaggaagtgagagagc

SEQ ID NO: 20050 - DNA, 21 bp, Artificial sequence
  SiRNA target sequence
gcaaaaggaagtgagagagct

SEQ ID NO: 20051 - DNA, 21 bp, Artificial sequence
  SiRNA target sequence
caaaaggaagtgagagagctg

SEQ ID NO: 20052 - DNA, 21 bp, Artificial sequence
  SiRNA target sequence
aaaaggaagtgagagagctga

SEQ ID NO: 20053 - DNA, 21 bp, Artificial sequence
  SiRNA target sequence
aaaggaagtgagagagctgac

SEQ ID NO: 20054 - DNA, 21 bp, Artificial sequence
  SiRNA target sequence
aaggaagtgagagagctgacc

SEQ ID NO: 20055 - DNA, 21 bp, Artificial sequence
  SiRNA target sequence
aggaagtgagagagctgaccg

SEQ ID NO: 20056 - DNA, 21 bp, Artificial sequence
  SiRNA target sequence
ggaagtgagagagctgaccgt

SEQ ID NO: 20057 - DNA, 21 bp, Artificial sequence
  SiRNA target sequence
gaagtgagagagctgaccgtc

SEQ ID NO: 20058 - DNA, 21 bp, Artificial sequence
  SiRNA target sequence
aagtgagagagctgaccgtct

SEQ ID NO: 20059 - DNA, 21 bp, Artificial sequence
  SiRNA target sequence
agtgagagagctgaccgtctc

SEQ ID NO: 20060 - DNA, 21 bp, Artificial sequence
  SiRNA target sequence
gtgagagagctgaccgtctct

SEQ ID NO: 20061 - DNA, 21 bp, Artificial sequence
  SiRNA target sequence
tgagagagctgaccgtctctc

SEQ ID NO: 20062 - DNA, 21 bp, Artificial sequence
  SiRNA target sequence
gagagagctgaccgtctctca

SEQ ID NO: 20063 - DNA, 21 bp, Artificial sequence
  SiRNA target sequence
agagagctgaccgtctctcat

SEQ ID NO: 20064 - DNA, 21 bp, Artificial sequence
  SiRNA target sequence
gagagctgaccgtctctcatg

SEQ ID NO: 20065 - DNA, 21 bp, Artificial sequence
  SiRNA target sequence
agagctgaccgtctctcatgg

SEQ ID NO: 20066 - DNA, 21 bp, Artificial sequence
  SiRNA target sequence
gagctgaccgtctctcatggg

SEQ ID NO: 20067 - DNA, 21 bp, Artificial sequence
  SiRNA target sequence
agctgaccgtctctcatgggt

SEQ ID NO: 20068 - DNA, 21 bp, Artificial sequence
  SiRNA target sequence
gctgaccgtctctcatgggta

SEQ ID NO: 20069 - DNA, 21 bp, Artificial sequence
  SiRNA target sequence
ctgaccgtctctcatgggtat

SEQ ID NO: 20070 - DNA, 21 bp, Artificial sequence
  SiRNA target sequence
tgaccgtctctcatgggtatt

SEQ ID NO: 20071 - DNA, 21 bp, Artificial sequence
  SiRNA target sequence
gaccgtctctcatgggtattt

SEQ ID NO: 20072 - DNA, 21 bp, Artificial sequence
  SiRNA target sequence
accgtctctcatgggtattta

SEQ ID NO: 20073 - DNA, 21 bp, Artificial sequence
  SiRNA target sequence
ccgtctctcatgggtatttag

SEQ ID NO: 20074 - DNA, 21 bp, Artificial sequence
  SiRNA target sequence
cgtctctcatgggtatttagg

SEQ ID NO: 20075 - DNA, 21 bp, Artificial sequence
  SiRNA target sequence
gtctctcatgggtatttaggt

SEQ ID NO: 20076 - DNA, 21 bp, Artificial sequence
  SiRNA target sequence
tctctcatgggtatttaggtt

SEQ ID NO: 20077 - DNA, 21 bp, Artificial sequence
  SiRNA target sequence
ctctcatgggtatttaggtta

SEQ ID NO: 20078 - DNA, 21 bp, Artificial sequence
  SiRNA target sequence
tctcatgggtatttaggttat

SEQ ID NO: 20079 - DNA, 21 bp, Artificial sequence
  SiRNA target sequence
ctcatgggtatttaggttatt

SEQ ID NO: 20080 - DNA, 21 bp, Artificial sequence
  SiRNA target sequence
tcatgggtatttaggttattc

SEQ ID NO: 20081 - DNA, 21 bp, Artificial sequence
  SiRNA target sequence
catgggtatttaggttattca

SEQ ID NO: 20082 - DNA, 21 bp, Artificial sequence
  SiRNA target sequence
atgggtatttaggttattcag

SEQ ID NO: 20083 - DNA, 21 bp, Artificial sequence
  SiRNA target sequence
tgggtatttaggttattcaga

SEQ ID NO: 20084 - DNA, 21 bp, Artificial sequence
  SiRNA target sequence
gggtatttaggttattcagag

SEQ ID NO: 20085 - DNA, 21 bp, Artificial sequence
  SiRNA target sequence
ggtatttaggttattcagagt

SEQ ID NO: 20086 - DNA, 21 bp, Artificial sequence
  SiRNA target sequence
gtatttaggttattcagagta

SEQ ID NO: 20087 - DNA, 21 bp, Artificial sequence
  SiRNA target sequence
tatttaggttattcagagtac

SEQ ID NO: 20088 - DNA, 21 bp, Artificial sequence
  SiRNA target sequence
atttaggttattcagagtacg

SEQ ID NO: 20089 - DNA, 21 bp, Artificial sequence
  SiRNA target sequence
tttaggttattcagagtacgc

SEQ ID NO: 20090 - DNA, 21 bp, Artificial sequence
  SiRNA target sequence
ttaggttattcagagtacgct

SEQ ID NO: 20091 - DNA, 21 bp, Artificial sequence
  SiRNA target sequence
taggttattcagagtacgctg

SEQ ID NO: 20092 - DNA, 21 bp, Artificial sequence
  SiRNA target sequence
aggttattcagagtacgctgc

SEQ ID NO: 20093 - DNA, 21 bp, Artificial sequence
  SiRNA target sequence
ggttattcagagtacgctgct

SEQ ID NO: 20094 - DNA, 21 bp, Artificial sequence
  SiRNA target sequence
gttattcagagtacgctgcta

SEQ ID NO: 20095 - DNA, 21 bp, Artificial sequence
  SiRNA target sequence
ttattcagagtacgctgctac

SEQ ID NO: 20096 - DNA, 21 bp, Artificial sequence
  SiRNA target sequence
tattcagagtacgctgctact

SEQ ID NO: 20097 - DNA, 21 bp, Artificial sequence
  SiRNA target sequence
attcagagtacgctgctactg

SEQ ID NO: 20098 - DNA, 21 bp, Artificial sequence
  SiRNA target sequence
ttcagagtacgctgctactgc

SEQ ID NO: 20099 - DNA, 21 bp, Artificial sequence
  SiRNA target sequence
tcagagtacgctgctactgcg

SEQ ID NO: 20100 - DNA, 21 bp, Artificial sequence
  SiRNA target sequence
cagagtacgctgctactgcgg

SEQ ID NO: 20101 - DNA, 21 bp, Artificial sequence
  SiRNA target sequence
agagtacgctgctactgcggt

SEQ ID NO: 20102 - DNA, 21 bp, Artificial sequence
  SiRNA target sequence
gagtacgctgctactgcggta

SEQ ID NO: 20103 - DNA, 21 bp, Artificial sequence
  SiRNA target sequence
agtacgctgctactgcggtag

SEQ ID NO: 20104 - DNA, 21 bp, Artificial sequence
  SiRNA target sequence
gtacgctgctactgcggtagc

SEQ ID NO: 20105 - DNA, 21 bp, Artificial sequence
  SiRNA target sequence
tacgctgctactgcggtagcg

SEQ ID NO: 20106 - DNA, 21 bp, Artificial sequence
  SiRNA target sequence
acgctgctactgcggtagcgg

SEQ ID NO: 20107 - DNA, 21 bp, Artificial sequence
  SiRNA target sequence
cgctgctactgcggtagcgga

SEQ ID NO: 20108 - DNA, 21 bp, Artificial sequence
  SiRNA target sequence
gctgctactgcggtagcggac

SEQ ID NO: 20109 - DNA, 21 bp, Artificial sequence
  SiRNA target sequence
ctgctactgcggtagcggaca

SEQ ID NO: 20110 - DNA, 21 bp, Artificial sequence
  SiRNA target sequence
tgctactgcggtagcggacac

SEQ ID NO: 20111 - DNA, 21 bp, Artificial sequence
  SiRNA target sequence
gctactgcggtagcggacaca

SEQ ID NO: 20112 - DNA, 21 bp, Artificial sequence
  SiRNA target sequence
ctactgcggtagcggacacaa

SEQ ID NO: 20113 - DNA, 21 bp, Artificial sequence
  SiRNA target sequence
tactgcggtagcggacacaac

SEQ ID NO: 20114 - DNA, 21 bp, Artificial sequence
  SiRNA target sequence
actgcggtagcggacacaacc

SEQ ID NO: 20115 - DNA, 21 bp, Artificial sequence
  SiRNA target sequence
ctgcggtagcggacacaaccc

SEQ ID NO: 20116 - DNA, 21 bp, Artificial sequence
  SiRNA target sequence
tgcggtagcggacacaaccca

SEQ ID NO: 20117 - DNA, 21 bp, Artificial sequence
  SiRNA target sequence
gcggtagcggacacaacccag

SEQ ID NO: 20118 - DNA, 21 bp, Artificial sequence
  SiRNA target sequence
cggtagcggacacaacccagg

SEQ ID NO: 20119 - DNA, 21 bp, Artificial sequence
  SiRNA target sequence
ggtagcggacacaacccaggt

SEQ ID NO: 20120 - DNA, 21 bp, Artificial sequence
  SiRNA target sequence
gtagcggacacaacccaggtg

SEQ ID NO: 20121 - DNA, 21 bp, Artificial sequence
  SiRNA target sequence
tagcggacacaacccaggtgt

SEQ ID NO: 20122 - DNA, 21 bp, Artificial sequence
  SiRNA target sequence
agcggacacaacccaggtgtt

SEQ ID NO: 20123 - DNA, 21 bp, Artificial sequence
  SiRNA target sequence
gcggacacaacccaggtgttc

SEQ ID NO: 20124 - DNA, 21 bp, Artificial sequence
  SiRNA target sequence
cggacacaacccaggtgttcg

SEQ ID NO: 20125 - DNA, 21 bp, Artificial sequence
  SiRNA target sequence
ggacacaacccaggtgttcgg

SEQ ID NO: 20126 - DNA, 21 bp, Artificial sequence
  SiRNA target sequence
gacacaacccaggtgttcggg

SEQ ID NO: 20127 - DNA, 21 bp, Artificial sequence
  SiRNA target sequence
acacaacccaggtgttcgggt

SEQ ID NO: 20128 - DNA, 21 bp, Artificial sequence
  SiRNA target sequence
cacaacccaggtgttcgggtc

SEQ ID NO: 20129 - DNA, 21 bp, Artificial sequence
  SiRNA target sequence
acaacccaggtgttcgggtct

SEQ ID NO: 20130 - DNA, 21 bp, Artificial sequence
  SiRNA target sequence
caacccaggtgttcgggtctc

SEQ ID NO: 20131 - DNA, 21 bp, Artificial sequence
  SiRNA target sequence
aacccaggtgttcgggtctct

SEQ ID NO: 20132 - DNA, 21 bp, Artificial sequence
  SiRNA target sequence
acccaggtgttcgggtctctg

SEQ ID NO: 20133 - DNA, 21 bp, Artificial sequence
  SiRNA target sequence
cccaggtgttcgggtctctgt

SEQ ID NO: 20134 - DNA, 21 bp, Artificial sequence
  SiRNA target sequence
ccaggtgttcgggtctctgtc

SEQ ID NO: 20135 - DNA, 21 bp, Artificial sequence
  SiRNA target sequence
caggtgttcgggtctctgtct

SEQ ID NO: 20136 - DNA, 21 bp, Artificial sequence
  SiRNA target sequence
aggtgttcgggtctctgtctt

SEQ ID NO: 20137 - DNA, 21 bp, Artificial sequence
  SiRNA target sequence
ggtgttcgggtctctgtctta

SEQ ID NO: 20138 - DNA, 21 bp, Artificial sequence
  SiRNA target sequence
gtgttcgggtctctgtcttag

SEQ ID NO: 20139 - DNA, 21 bp, Artificial sequence
  SiRNA target sequence
tgttcgggtctctgtcttaga

SEQ ID NO: 20140 - DNA, 21 bp, Artificial sequence
  SiRNA target sequence
gttcgggtctctgtcttagaa

SEQ ID NO: 20141 - DNA, 21 bp, Artificial sequence
  SiRNA target sequence
ttcgggtctctgtcttagaaa

SEQ ID NO: 20142 - DNA, 21 bp, Artificial sequence
  SiRNA target sequence
tcgggtctctgtcttagaaac

SEQ ID NO: 20143 - DNA, 21 bp, Artificial sequence
  SiRNA target sequence
cgggtctctgtcttagaaact

SEQ ID NO: 20144 - DNA, 21 bp, Artificial sequence
  SiRNA target sequence
gggtctctgtcttagaaacta

SEQ ID NO: 20145 - DNA, 21 bp, Artificial sequence
  SiRNA target sequence
ggtctctgtcttagaaactat

SEQ ID NO: 20146 - DNA, 21 bp, Artificial sequence
  SiRNA target sequence
gtctctgtcttagaaactata

SEQ ID NO: 20147 - DNA, 21 bp, Artificial sequence
  SiRNA target sequence
tctctgtcttagaaactatat

SEQ ID NO: 20148 - DNA, 21 bp, Artificial sequence
  SiRNA target sequence
ctctgtcttagaaactatatg

SEQ ID NO: 20149 - DNA, 21 bp, Artificial sequence
  SiRNA target sequence
tctgtcttagaaactatatga

SEQ ID NO: 20150 - DNA, 21 bp, Artificial sequence
  SiRNA target sequence
ctgtcttagaaactatatgaa

SEQ ID NO: 20151 - DNA, 21 bp, Artificial sequence
  SiRNA target sequence
tgtcttagaaactatatgaaa

SEQ ID NO: 20152 - DNA, 21 bp, Artificial sequence
  SiRNA target sequence
gtcttagaaactatatgaaag

SEQ ID NO: 20153 - DNA, 21 bp, Artificial sequence
  SiRNA target sequence
tcttagaaactatatgaaagg

SEQ ID NO: 20154 - DNA, 21 bp, Artificial sequence
  SiRNA target sequence
cttagaaactatatgaaaggc

SEQ ID NO: 20155 - DNA, 21 bp, Artificial sequence
  SiRNA target sequence
ttagaaactatatgaaaggcg

SEQ ID NO: 20156 - DNA, 21 bp, Artificial sequence
  SiRNA target sequence
tagaaactatatgaaaggcga

SEQ ID NO: 20157 - DNA, 21 bp, Artificial sequence
  SiRNA target sequence
agaaactatatgaaaggcgaa

SEQ ID NO: 20158 - DNA, 21 bp, Artificial sequence
  SiRNA target sequence
gaaactatatgaaaggcgaaa

SEQ ID NO: 20159 - DNA, 21 bp, Artificial sequence
  SiRNA target sequence
aaactatatgaaaggcgaaag

SEQ ID NO: 20160 - DNA, 21 bp, Artificial sequence
  SiRNA target sequence
aactatatgaaaggcgaaagt

SEQ ID NO: 20161 - DNA, 21 bp, Artificial sequence
  SiRNA target sequence
actatatgaaaggcgaaagtt

SEQ ID NO: 20162 - DNA, 21 bp, Artificial sequence
  SiRNA target sequence
ctatatgaaaggcgaaagttg

SEQ ID NO: 20163 - DNA, 21 bp, Artificial sequence
  SiRNA target sequence
tatatgaaaggcgaaagttgt

SEQ ID NO: 20164 - DNA, 21 bp, Artificial sequence
  SiRNA target sequence
atatgaaaggcgaaagttgtg

SEQ ID NO: 20165 - DNA, 21 bp, Artificial sequence
  SiRNA target sequence
tatgaaaggcgaaagttgtga

SEQ ID NO: 20166 - DNA, 21 bp, Artificial sequence
  SiRNA target sequence
atgaaaggcgaaagttgtgat

SEQ ID NO: 20167 - DNA, 21 bp, Artificial sequence
  SiRNA target sequence
tgaaaggcgaaagttgtgatt

SEQ ID NO: 20168 - DNA, 21 bp, Artificial sequence
  SiRNA target sequence
gaaaggcgaaagttgtgattg

SEQ ID NO: 20169 - DNA, 21 bp, Artificial sequence
  SiRNA target sequence
aaaggcgaaagttgtgattga

SEQ ID NO: 20170 - DNA, 21 bp, Artificial sequence
  SiRNA target sequence
aaggcgaaagttgtgattgaa

SEQ ID NO: 20171 - DNA, 21 bp, Artificial sequence
  SiRNA target sequence
aggcgaaagttgtgattgaac

SEQ ID NO: 20172 - DNA, 21 bp, Artificial sequence
  SiRNA target sequence
ggcgaaagttgtgattgaact

SEQ ID NO: 20173 - DNA, 21 bp, Artificial sequence
  SiRNA target sequence
gcgaaagttgtgattgaactt

SEQ ID NO: 20174 - DNA, 21 bp, Artificial sequence
  SiRNA target sequence
cgaaagttgtgattgaacttt

SEQ ID NO: 20175 - DNA, 21 bp, Artificial sequence
  SiRNA target sequence
gaaagttgtgattgaactttc

SEQ ID NO: 20176 - DNA, 21 bp, Artificial sequence
  SiRNA target sequence
aaagttgtgattgaactttct

SEQ ID NO: 20177 - DNA, 21 bp, Artificial sequence
  SiRNA target sequence
aagttgtgattgaactttcta

SEQ ID NO: 20178 - DNA, 21 bp, Artificial sequence
  SiRNA target sequence
agttgtgattgaactttctaa

SEQ ID NO: 20179 - DNA, 21 bp, Artificial sequence
  SiRNA target sequence
gttgtgattgaactttctaac

SEQ ID NO: 20180 - DNA, 21 bp, Artificial sequence
  SiRNA target sequence
ttgtgattgaactttctaacg

SEQ ID NO: 20181 - DNA, 21 bp, Artificial sequence
  SiRNA target sequence
tgtgattgaactttctaacgt

SEQ ID NO: 20182 - DNA, 21 bp, Artificial sequence
  SiRNA target sequence
gtgattgaactttctaacgtc

SEQ ID NO: 20183 - DNA, 21 bp, Artificial sequence
  SiRNA target sequence
tgattgaactttctaacgtca

SEQ ID NO: 20184 - DNA, 21 bp, Artificial sequence
  SiRNA target sequence
gattgaactttctaacgtcac

SEQ ID NO: 20185 - DNA, 21 bp, Artificial sequence
  SiRNA target sequence
attgaactttctaacgtcact

SEQ ID NO: 20186 - DNA, 21 bp, Artificial sequence
  SiRNA target sequence
ttgaactttctaacgtcactc

SEQ ID NO: 20187 - DNA, 21 bp, Artificial sequence
  SiRNA target sequence
tgaactttctaacgtcactct

SEQ ID NO: 20188 - DNA, 21 bp, Artificial sequence
  SiRNA target sequence
gaactttctaacgtcactctt

SEQ ID NO: 20189 - DNA, 21 bp, Artificial sequence
  SiRNA target sequence
aactttctaacgtcactctta

SEQ ID NO: 20190 - DNA, 21 bp, Artificial sequence
  SiRNA target sequence
actttctaacgtcactcttaa

SEQ ID NO: 20191 - DNA, 21 bp, Artificial sequence
  SiRNA target sequence
ctttctaacgtcactcttaat

SEQ ID NO: 20192 - DNA, 21 bp, Artificial sequence
  SiRNA target sequence
tttctaacgtcactcttaatt

SEQ ID NO: 20193 - DNA, 21 bp, Artificial sequence
  SiRNA target sequence
ttctaacgtcactcttaattg

SEQ ID NO: 20194 - DNA, 21 bp, Artificial sequence
  SiRNA target sequence
tctaacgtcactcttaattgg

SEQ ID NO: 20195 - DNA, 21 bp, Artificial sequence
  SiRNA target sequence
ctaacgtcactcttaattggt

SEQ ID NO: 20196 - DNA, 21 bp, Artificial sequence
  SiRNA target sequence
taacgtcactcttaattggta

SEQ ID NO: 20197 - DNA, 21 bp, Artificial sequence
  SiRNA target sequence
aacgtcactcttaattggtac

SEQ ID NO: 20198 - DNA, 21 bp, Artificial sequence
  SiRNA target sequence
acgtcactcttaattggtacg

SEQ ID NO: 20199 - DNA, 21 bp, Artificial sequence
  SiRNA target sequence
cgtcactcttaattggtacgt

SEQ ID NO: 20200 - DNA, 21 bp, Artificial sequence
  SiRNA target sequence
gtcactcttaattggtacgtg

SEQ ID NO: 20201 - DNA, 21 bp, Artificial sequence
  SiRNA target sequence
tcactcttaattggtacgtgt

SEQ ID NO: 20202 - DNA, 21 bp, Artificial sequence
  SiRNA target sequence
cactcttaattggtacgtgtc

SEQ ID NO: 20203 - DNA, 21 bp, Artificial sequence
  SiRNA target sequence
actcttaattggtacgtgtcg

SEQ ID NO: 20204 - DNA, 21 bp, Artificial sequence
  SiRNA target sequence
ctcttaattggtacgtgtcga

SEQ ID NO: 20205 - DNA, 21 bp, Artificial sequence
  SiRNA target sequence
tcttaattggtacgtgtcgat

SEQ ID NO: 20206 - DNA, 21 bp, Artificial sequence
  SiRNA target sequence
cttaattggtacgtgtcgatt

SEQ ID NO: 20207 - DNA, 21 bp, Artificial sequence
  SiRNA target sequence
ttaattggtacgtgtcgatta

SEQ ID NO: 20208 - DNA, 21 bp, Artificial sequence
  SiRNA target sequence
taattggtacgtgtcgattaa

SEQ ID NO: 20209 - DNA, 21 bp, Artificial sequence
  SiRNA target sequence
aattggtacgtgtcgattaag

SEQ ID NO: 20210 - DNA, 21 bp, Artificial sequence
  SiRNA target sequence
attggtacgtgtcgattaagt

SEQ ID NO: 20211 - DNA, 21 bp, Artificial sequence
  SiRNA target sequence
ttggtacgtgtcgattaagtt

SEQ ID NO: 20212 - DNA, 21 bp, Artificial sequence
  SiRNA target sequence
tggtacgtgtcgattaagttc

SEQ ID NO: 20213 - DNA, 21 bp, Artificial sequence
  SiRNA target sequence
ggtacgtgtcgattaagttca

SEQ ID NO: 20214 - DNA, 21 bp, Artificial sequence
  SiRNA target sequence
gtacgtgtcgattaagttcat

SEQ ID NO: 20215 - DNA, 21 bp, Artificial sequence
  SiRNA target sequence
tacgtgtcgattaagttcata

SEQ ID NO: 20216 - DNA, 21 bp, Artificial sequence
  SiRNA target sequence
acgtgtcgattaagttcatag

SEQ ID NO: 20217 - DNA, 21 bp, Artificial sequence
  SiRNA target sequence
cgtgtcgattaagttcatagc

SEQ ID NO: 20218 - DNA, 21 bp, Artificial sequence
  SiRNA target sequence
gtgtcgattaagttcatagca

SEQ ID NO: 20219 - DNA, 21 bp, Artificial sequence
  SiRNA target sequence
tgtcgattaagttcatagcaa

SEQ ID NO: 20220 - DNA, 21 bp, Artificial sequence
  SiRNA target sequence
gtcgattaagttcatagcaat

SEQ ID NO: 20221 - DNA, 21 bp, Artificial sequence
  SiRNA target sequence
tcgattaagttcatagcaatg

SEQ ID NO: 20222 - DNA, 21 bp, Artificial sequence
  SiRNA target sequence
cgattaagttcatagcaatga

SEQ ID NO: 20223 - DNA, 21 bp, Artificial sequence
  SiRNA target sequence
gattaagttcatagcaatgaa

SEQ ID NO: 20224 - DNA, 21 bp, Artificial sequence
  SiRNA target sequence
attaagttcatagcaatgaat

SEQ ID NO: 20225 - DNA, 21 bp, Artificial sequence
  SiRNA target sequence
ttaagttcatagcaatgaata

SEQ ID NO: 20226 - DNA, 21 bp, Artificial sequence
  SiRNA target sequence
taagttcatagcaatgaatag

SEQ ID NO: 20227 - DNA, 21 bp, Artificial sequence
  SiRNA target sequence
aagttcatagcaatgaatagc

SEQ ID NO: 20228 - DNA, 21 bp, Artificial sequence
  SiRNA target sequence
agttcatagcaatgaatagcc

SEQ ID NO: 20229 - DNA, 21 bp, Artificial sequence
  SiRNA target sequence
gttcatagcaatgaatagcca

SEQ ID NO: 20230 - DNA, 21 bp, Artificial sequence
  SiRNA target sequence
ttcatagcaatgaatagccaa

SEQ ID NO: 20231 - DNA, 21 bp, Artificial sequence
  SiRNA target sequence
tcatagcaatgaatagccaac

SEQ ID NO: 20232 - DNA, 21 bp, Artificial sequence
  SiRNA target sequence
catagcaatgaatagccaacc

SEQ ID NO: 20233 - DNA, 21 bp, Artificial sequence
  SiRNA target sequence
atagcaatgaatagccaaccc

SEQ ID NO: 20234 - DNA, 21 bp, Artificial sequence
  SiRNA target sequence
tagcaatgaatagccaaccct

SEQ ID NO: 20235 - DNA, 21 bp, Artificial sequence
  SiRNA target sequence
agcaatgaatagccaacccta

SEQ ID NO: 20236 - DNA, 21 bp, Artificial sequence
  SiRNA target sequence
gcaatgaatagccaaccctat

SEQ ID NO: 20237 - DNA, 21 bp, Artificial sequence
  SiRNA target sequence
caatgaatagccaaccctata

SEQ ID NO: 20238 - DNA, 21 bp, Artificial sequence
  SiRNA target sequence
aatgaatagccaaccctataa

SEQ ID NO: 20239 - DNA, 21 bp, Artificial sequence
  SiRNA target sequence
atgaatagccaaccctataat

SEQ ID NO: 20240 - DNA, 21 bp, Artificial sequence
  SiRNA target sequence
tgaatagccaaccctataatg

SEQ ID NO: 20241 - DNA, 21 bp, Artificial sequence
  SiRNA target sequence
gaatagccaaccctataatga

SEQ ID NO: 20242 - DNA, 21 bp, Artificial sequence
  SiRNA target sequence
aatagccaaccctataatgat

SEQ ID NO: 20243 - DNA, 21 bp, Artificial sequence
  SiRNA target sequence
atagccaaccctataatgatg

SEQ ID NO: 20244 - DNA, 21 bp, Artificial sequence
  SiRNA target sequence
tagccaaccctataatgatgg

SEQ ID NO: 20245 - DNA, 21 bp, Artificial sequence
  SiRNA target sequence
agccaaccctataatgatgga

SEQ ID NO: 20246 - DNA, 21 bp, Artificial sequence
  SiRNA target sequence
gccaaccctataatgatggaa

SEQ ID NO: 20247 - DNA, 21 bp, Artificial sequence
  SiRNA target sequence
ccaaccctataatgatggaac

SEQ ID NO: 20248 - DNA, 21 bp, Artificial sequence
  SiRNA target sequence
caaccctataatgatggaacc

SEQ ID NO: 20249 - DNA, 21 bp, Artificial sequence
  SiRNA target sequence
aaccctataatgatggaacca

SEQ ID NO: 20250 - DNA, 21 bp, Artificial sequence
  SiRNA target sequence
accctataatgatggaaccaa

SEQ ID NO: 20251 - DNA, 21 bp, Artificial sequence
  SiRNA target sequence
ccctataatgatggaaccaat

SEQ ID NO: 20252 - DNA, 21 bp, Artificial sequence
  SiRNA target sequence
cctataatgatggaaccaatt

SEQ ID NO: 20253 - DNA, 21 bp, Artificial sequence
  SiRNA target sequence
ctataatgatggaaccaattt

SEQ ID NO: 20254 - DNA, 21 bp, Artificial sequence
  SiRNA target sequence
tataatgatggaaccaattta

SEQ ID NO: 20255 - DNA, 21 bp, Artificial sequence
  SiRNA target sequence
ataatgatggaaccaatttac

SEQ ID NO: 20256 - DNA, 21 bp, Artificial sequence
  SiRNA target sequence
taatgatggaaccaatttacg

SEQ ID NO: 20257 - DNA, 21 bp, Artificial sequence
  SiRNA target sequence
aatgatggaaccaatttacgc

SEQ ID NO: 20258 - DNA, 21 bp, Artificial sequence
  SiRNA target sequence
atgatggaaccaatttacgca

SEQ ID NO: 20259 - DNA, 21 bp, Artificial sequence
  SiRNA target sequence
tgatggaaccaatttacgcaa

SEQ ID NO: 20260 - DNA, 21 bp, Artificial sequence
  SiRNA target sequence
gatggaaccaatttacgcaaa

SEQ ID NO: 20261 - DNA, 21 bp, Artificial sequence
  SiRNA target sequence
atggaaccaatttacgcaaat

SEQ ID NO: 20262 - DNA, 21 bp, Artificial sequence
  SiRNA target sequence
tggaaccaatttacgcaaata

SEQ ID NO: 20263 - DNA, 21 bp, Artificial sequence
  SiRNA target sequence
ggaaccaatttacgcaaatag

SEQ ID NO: 20264 - DNA, 21 bp, Artificial sequence
  SiRNA target sequence
gaaccaatttacgcaaataga

SEQ ID NO: 20265 - DNA, 21 bp, Artificial sequence
  SiRNA target sequence
aaccaatttacgcaaatagac

SEQ ID NO: 20266 - DNA, 21 bp, Artificial sequence
  SiRNA target sequence
accaatttacgcaaatagacc

SEQ ID NO: 20267 - DNA, 21 bp, Artificial sequence
  SiRNA target sequence
ccaatttacgcaaatagacct

SEQ ID NO: 20268 - DNA, 21 bp, Artificial sequence
  SiRNA target sequence
caatttacgcaaatagaccta

SEQ ID NO: 20269 - DNA, 21 bp, Artificial sequence
  SiRNA target sequence
aatttacgcaaatagacctaa

SEQ ID NO: 20270 - DNA, 21 bp, Artificial sequence
  SiRNA target sequence
atttacgcaaatagacctaat

SEQ ID NO: 20271 - DNA, 21 bp, Artificial sequence
  SiRNA target sequence
tttacgcaaatagacctaatg

SEQ ID NO: 20272 - DNA, 21 bp, Artificial sequence
  SiRNA target sequence
ttacgcaaatagacctaatgt

SEQ ID NO: 20273 - DNA, 21 bp, Artificial sequence
  SiRNA target sequence
tacgcaaatagacctaatgta

SEQ ID NO: 20274 - DNA, 21 bp, Artificial sequence
  SiRNA target sequence
acgcaaatagacctaatgtat

SEQ ID NO: 20275 - DNA, 21 bp, Artificial sequence
  SiRNA target sequence
cgcaaatagacctaatgtata

SEQ ID NO: 20276 - DNA, 21 bp, Artificial sequence
  SiRNA target sequence
gcaaatagacctaatgtatac

SEQ ID NO: 20277 - DNA, 21 bp, Artificial sequence
  SiRNA target sequence
caaatagacctaatgtatact

SEQ ID NO: 20278 - DNA, 21 bp, Artificial sequence
  SiRNA target sequence
aaatagacctaatgtatacta

SEQ ID NO: 20279 - DNA, 21 bp, Artificial sequence
  SiRNA target sequence
aatagacctaatgtatactat

SEQ ID NO: 20280 - DNA, 21 bp, Artificial sequence
  SiRNA target sequence
atagacctaatgtatactatt

SEQ ID NO: 20281 - DNA, 21 bp, Artificial sequence
  SiRNA target sequence
tagacctaatgtatactatta

SEQ ID NO: 20282 - DNA, 21 bp, Artificial sequence
  SiRNA target sequence
agacctaatgtatactattat

SEQ ID NO: 20283 - DNA, 21 bp, Artificial sequence
  SiRNA target sequence
gacctaatgtatactattatc

SEQ ID NO: 20284 - DNA, 21 bp, Artificial sequence
  SiRNA target sequence
acctaatgtatactattatcc

SEQ ID NO: 20285 - DNA, 21 bp, Artificial sequence
  SiRNA target sequence
cctaatgtatactattatcct

SEQ ID NO: 20286 - DNA, 21 bp, Artificial sequence
  SiRNA target sequence
ctaatgtatactattatcctt

SEQ ID NO: 20287 - DNA, 21 bp, Artificial sequence
  SiRNA target sequence
taatgtatactattatccttt

SEQ ID NO: 20288 - DNA, 21 bp, Artificial sequence
  SiRNA target sequence
aatgtatactattatcctttc

SEQ ID NO: 20289 - DNA, 21 bp, Artificial sequence
  SiRNA target sequence
atgtatactattatcctttca

SEQ ID NO: 20290 - DNA, 21 bp, Artificial sequence
  SiRNA target sequence
tgtatactattatcctttcaa

SEQ ID NO: 20291 - DNA, 21 bp, Artificial sequence
  SiRNA target sequence
gtatactattatcctttcaaa

SEQ ID NO: 20292 - DNA, 21 bp, Artificial sequence
  SiRNA target sequence
tatactattatcctttcaaac

SEQ ID NO: 20293 - DNA, 21 bp, Artificial sequence
  SiRNA target sequence
atactattatcctttcaaaca

SEQ ID NO: 20294 - DNA, 21 bp, Artificial sequence
  SiRNA target sequence
tactattatcctttcaaacac

SEQ ID NO: 20295 - DNA, 21 bp, Artificial sequence
  SiRNA target sequence
actattatcctttcaaacaca

SEQ ID NO: 20296 - DNA, 21 bp, Artificial sequence
  SiRNA target sequence
ctattatcctttcaaacacaa

SEQ ID NO: 20297 - DNA, 21 bp, Artificial sequence
  SiRNA target sequence
tattatcctttcaaacacaac

SEQ ID NO: 20298 - DNA, 21 bp, Artificial sequence
  SiRNA target sequence
attatcctttcaaacacaact

SEQ ID NO: 20299 - DNA, 21 bp, Artificial sequence
  SiRNA target sequence
ttatcctttcaaacacaactg

SEQ ID NO: 20300 - DNA, 21 bp, Artificial sequence
  SiRNA target sequence
tatcctttcaaacacaactgg

SEQ ID NO: 20301 - DNA, 21 bp, Artificial sequence
  SiRNA target sequence
atcctttcaaacacaactggg

SEQ ID NO: 20302 - DNA, 21 bp, Artificial sequence
  SiRNA target sequence
tcctttcaaacacaactggga

SEQ ID NO: 20303 - DNA, 21 bp, Artificial sequence
  SiRNA target sequence
cctttcaaacacaactgggaa

SEQ ID NO: 20304 - DNA, 21 bp, Artificial sequence
  SiRNA target sequence
ctttcaaacacaactgggaac

SEQ ID NO: 20305 - DNA, 21 bp, Artificial sequence
  SiRNA target sequence
tttcaaacacaactgggaacc

SEQ ID NO: 20306 - DNA, 21 bp, Artificial sequence
  SiRNA target sequence
ttcaaacacaactgggaacca

SEQ ID NO: 20307 - DNA, 21 bp, Artificial sequence
  SiRNA target sequence
tcaaacacaactgggaaccaa

SEQ ID NO: 20308 - DNA, 21 bp, Artificial sequence
  SiRNA target sequence
caaacacaactgggaaccaag

SEQ ID NO: 20309 - DNA, 21 bp, Artificial sequence
  SiRNA target sequence
aaacacaactgggaaccaaga

SEQ ID NO: 20310 - DNA, 21 bp, Artificial sequence
  SiRNA target sequence
aacacaactgggaaccaagaa

SEQ ID NO: 20311 - DNA, 21 bp, Artificial sequence
  SiRNA target sequence
acacaactgggaaccaagaat

SEQ ID NO: 20312 - DNA, 21 bp, Artificial sequence
  SiRNA target sequence
cacaactgggaaccaagaatc

SEQ ID NO: 20313 - DNA, 21 bp, Artificial sequence
  SiRNA target sequence
acaactgggaaccaagaatct

SEQ ID NO: 20314 - DNA, 21 bp, Artificial sequence
  SiRNA target sequence
caactgggaaccaagaatctt

SEQ ID NO: 20315 - DNA, 21 bp, Artificial sequence
  SiRNA target sequence
aactgggaaccaagaatcttg

SEQ ID NO: 20316 - DNA, 21 bp, Artificial sequence
  SiRNA target sequence
actgggaaccaagaatcttga

SEQ ID NO: 20317 - DNA, 21 bp, Artificial sequence
  SiRNA target sequence
ctgggaaccaagaatcttgat

SEQ ID NO: 20318 - DNA, 21 bp, Artificial sequence
  SiRNA target sequence
tgggaaccaagaatcttgatc

SEQ ID NO: 20319 - DNA, 21 bp, Artificial sequence
  SiRNA target sequence
gggaaccaagaatcttgatcc

SEQ ID NO: 20320 - DNA, 21 bp, Artificial sequence
  SiRNA target sequence
ggaaccaagaatcttgatcct

SEQ ID NO: 20321 - DNA, 21 bp, Artificial sequence
  SiRNA target sequence
gaaccaagaatcttgatcctt

SEQ ID NO: 20322 - DNA, 21 bp, Artificial sequence
  SiRNA target sequence
aaccaagaatcttgatcctta

SEQ ID NO: 20323 - DNA, 21 bp, Artificial sequence
  SiRNA target sequence
accaagaatcttgatccttac

SEQ ID NO: 20324 - DNA, 21 bp, Artificial sequence
  SiRNA target sequence
ccaagaatcttgatccttact

SEQ ID NO: 20325 - DNA, 21 bp, Artificial sequence
  SiRNA target sequence
caagaatcttgatccttactg

SEQ ID NO: 20326 - DNA, 21 bp, Artificial sequence
  SiRNA target sequence
aagaatcttgatccttactga

SEQ ID NO: 20327 - DNA, 21 bp, Artificial sequence
  SiRNA target sequence
agaatcttgatccttactgat

SEQ ID NO: 20328 - DNA, 21 bp, Artificial sequence
  SiRNA target sequence
gaatcttgatccttactgata

SEQ ID NO: 20329 - DNA, 21 bp, Artificial sequence
  SiRNA target sequence
aatcttgatccttactgataa

SEQ ID NO: 20330 - DNA, 21 bp, Artificial sequence
  SiRNA target sequence
atcttgatccttactgataaa

SEQ ID NO: 20331 - DNA, 21 bp, Artificial sequence
  SiRNA target sequence
tcttgatccttactgataaag

SEQ ID NO: 20332 - DNA, 21 bp, Artificial sequence
  SiRNA target sequence
cttgatccttactgataaaga

SEQ ID NO: 20333 - DNA, 21 bp, Artificial sequence
  SiRNA target sequence
ttgatccttactgataaagaa

SEQ ID NO: 20334 - DNA, 21 bp, Artificial sequence
  SiRNA target sequence
tgatccttactgataaagaag

SEQ ID NO: 20335 - DNA, 21 bp, Artificial sequence
  SiRNA target sequence
gatccttactgataaagaagg

SEQ ID NO: 20336 - DNA, 21 bp, Artificial sequence
  SiRNA target sequence
atccttactgataaagaagga

SEQ ID NO: 20337 - DNA, 21 bp, Artificial sequence
  SiRNA target sequence
tccttactgataaagaaggac

SEQ ID NO: 20338 - DNA, 21 bp, Artificial sequence
  SiRNA target sequence
ccttactgataaagaaggaca

SEQ ID NO: 20339 - DNA, 21 bp, Artificial sequence
  SiRNA target sequence
cttactgataaagaaggacaa

SEQ ID NO: 20340 - DNA, 21 bp, Artificial sequence
  SiRNA target sequence
ttactgataaagaaggacaag

SEQ ID NO: 20341 - DNA, 21 bp, Artificial sequence
  SiRNA target sequence
tactgataaagaaggacaaga

SEQ ID NO: 20342 - DNA, 21 bp, Artificial sequence
  SiRNA target sequence
actgataaagaaggacaagag

SEQ ID NO: 20343 - DNA, 21 bp, Artificial sequence
  SiRNA target sequence
ctgataaagaaggacaagaga

SEQ ID NO: 20344 - DNA, 21 bp, Artificial sequence
  SiRNA target sequence
tgataaagaaggacaagagag

SEQ ID NO: 20345 - DNA, 21 bp, Artificial sequence
  SiRNA target sequence
gataaagaaggacaagagagc

SEQ ID NO: 20346 - DNA, 21 bp, Artificial sequence
  SiRNA target sequence
ataaagaaggacaagagagcg

SEQ ID NO: 20347 - DNA, 21 bp, Artificial sequence
  SiRNA target sequence
taaagaaggacaagagagcgt

SEQ ID NO: 20348 - DNA, 21 bp, Artificial sequence
  SiRNA target sequence
aaagaaggacaagagagcgtg

SEQ ID NO: 20349 - DNA, 21 bp, Artificial sequence
  SiRNA target sequence
aagaaggacaagagagcgtga

SEQ ID NO: 20350 - DNA, 21 bp, Artificial sequence
  SiRNA target sequence
agaaggacaagagagcgtgaa

SEQ ID NO: 20351 - DNA, 21 bp, Artificial sequence
  SiRNA target sequence
gaaggacaagagagcgtgaac

SEQ ID NO: 20352 - DNA, 21 bp, Artificial sequence
  SiRNA target sequence
aaggacaagagagcgtgaaca

SEQ ID NO: 20353 - DNA, 21 bp, Artificial sequence
  SiRNA target sequence
aggacaagagagcgtgaacaa

SEQ ID NO: 20354 - DNA, 21 bp, Artificial sequence
  SiRNA target sequence
ggacaagagagcgtgaacaag

SEQ ID NO: 20355 - DNA, 21 bp, Artificial sequence
  SiRNA target sequence
gacaagagagcgtgaacaaga

SEQ ID NO: 20356 - DNA, 21 bp, Artificial sequence
  SiRNA target sequence
acaagagagcgtgaacaagaa

SEQ ID NO: 20357 - DNA, 21 bp, Artificial sequence
  SiRNA target sequence
caagagagcgtgaacaagaag

SEQ ID NO: 20358 - DNA, 21 bp, Artificial sequence
  SiRNA target sequence
aagagagcgtgaacaagaagt

SEQ ID NO: 20359 - DNA, 21 bp, Artificial sequence
  SiRNA target sequence
agagagcgtgaacaagaagtt

SEQ ID NO: 20360 - DNA, 21 bp, Artificial sequence
  SiRNA target sequence
gagagcgtgaacaagaagttt

SEQ ID NO: 20361 - DNA, 21 bp, Artificial sequence
  SiRNA target sequence
agagcgtgaacaagaagtttc

SEQ ID NO: 20362 - DNA, 21 bp, Artificial sequence
  SiRNA target sequence
gagcgtgaacaagaagtttct

SEQ ID NO: 20363 - DNA, 21 bp, Artificial sequence
  SiRNA target sequence
agcgtgaacaagaagtttctg

SEQ ID NO: 20364 - DNA, 21 bp, Artificial sequence
  SiRNA target sequence
gcgtgaacaagaagtttctga

SEQ ID NO: 20365 - DNA, 21 bp, Artificial sequence
  SiRNA target sequence
cgtgaacaagaagtttctgag

SEQ ID NO: 20366 - DNA, 21 bp, Artificial sequence
  SiRNA target sequence
gtgaacaagaagtttctgaga

SEQ ID NO: 20367 - DNA, 21 bp, Artificial sequence
  SiRNA target sequence
tgaacaagaagtttctgagaa

SEQ ID NO: 20368 - DNA, 21 bp, Artificial sequence
  SiRNA target sequence
gaacaagaagtttctgagaaa

SEQ ID NO: 20369 - DNA, 21 bp, Artificial sequence
  SiRNA target sequence
aacaagaagtttctgagaaaa

SEQ ID NO: 20370 - DNA, 21 bp, Artificial sequence
  SiRNA target sequence
acaagaagtttctgagaaaat

SEQ ID NO: 20371 - DNA, 21 bp, Artificial sequence
  SiRNA target sequence
caagaagtttctgagaaaatt

SEQ ID NO: 20372 - DNA, 21 bp, Artificial sequence
  SiRNA target sequence
aagaagtttctgagaaaattc

SEQ ID NO: 20373 - DNA, 21 bp, Artificial sequence
  SiRNA target sequence
agaagtttctgagaaaattct

SEQ ID NO: 20374 - DNA, 21 bp, Artificial sequence
  SiRNA target sequence
gaagtttctgagaaaattctc

SEQ ID NO: 20375 - DNA, 21 bp, Artificial sequence
  SiRNA target sequence
aagtttctgagaaaattctct

SEQ ID NO: 20376 - DNA, 21 bp, Artificial sequence
  SiRNA target sequence
agtttctgagaaaattctcta

SEQ ID NO: 20377 - DNA, 21 bp, Artificial sequence
  SiRNA target sequence
gtttctgagaaaattctctaa

SEQ ID NO: 20378 - DNA, 21 bp, Artificial sequence
  SiRNA target sequence
tttctgagaaaattctctaaa

SEQ ID NO: 20379 - DNA, 21 bp, Artificial sequence
  SiRNA target sequence
ttctgagaaaattctctaaac

SEQ ID NO: 20380 - DNA, 21 bp, Artificial sequence
  SiRNA target sequence
tctgagaaaattctctaaact

SEQ ID NO: 20381 - DNA, 21 bp, Artificial sequence
  SiRNA target sequence
ctgagaaaattctctaaactt

SEQ ID NO: 20382 - DNA, 21 bp, Artificial sequence
  SiRNA target sequence
tgagaaaattctctaaacttc

SEQ ID NO: 20383 - DNA, 21 bp, Artificial sequence
  SiRNA target sequence
gagaaaattctctaaacttcg

SEQ ID NO: 20384 - DNA, 21 bp, Artificial sequence
  SiRNA target sequence
agaaaattctctaaacttcgt

SEQ ID NO: 20385 - DNA, 21 bp, Artificial sequence
  SiRNA target sequence
gaaaattctctaaacttcgta

SEQ ID NO: 20386 - DNA, 21 bp, Artificial sequence
  SiRNA target sequence
aaaattctctaaacttcgtaa

SEQ ID NO: 20387 - DNA, 21 bp, Artificial sequence
  SiRNA target sequence
aaattctctaaacttcgtaat

SEQ ID NO: 20388 - DNA, 21 bp, Artificial sequence
  SiRNA target sequence
aattctctaaacttcgtaatt

SEQ ID NO: 20389 - DNA, 21 bp, Artificial sequence
  SiRNA target sequence
attctctaaacttcgtaattt

SEQ ID NO: 20390 - DNA, 21 bp, Artificial sequence
  SiRNA target sequence
ttctctaaacttcgtaatttg

SEQ ID NO: 20391 - DNA, 21 bp, Artificial sequence
  SiRNA target sequence
tctctaaacttcgtaatttgt

SEQ ID NO: 20392 - DNA, 21 bp, Artificial sequence
  SiRNA target sequence
ctctaaacttcgtaatttgtg

SEQ ID NO: 20393 - DNA, 21 bp, Artificial sequence
  SiRNA target sequence
tctaaacttcgtaatttgtgt

SEQ ID NO: 20394 - DNA, 21 bp, Artificial sequence
  SiRNA target sequence
ctaaacttcgtaatttgtgtt

SEQ ID NO: 20395 - DNA, 21 bp, Artificial sequence
  SiRNA target sequence
taaacttcgtaatttgtgttt

SEQ ID NO: 20396 - DNA, 21 bp, Artificial sequence
  SiRNA target sequence
aaacttcgtaatttgtgtttg

SEQ ID NO: 20397 - DNA, 21 bp, Artificial sequence
  SiRNA target sequence
aacttcgtaatttgtgtttgc

SEQ ID NO: 20398 - DNA, 21 bp, Artificial sequence
  SiRNA target sequence
acttcgtaatttgtgtttgcg

SEQ ID NO: 20399 - DNA, 21 bp, Artificial sequence
  SiRNA target sequence
cttcgtaatttgtgtttgcgc

SEQ ID NO: 20400 - DNA, 21 bp, Artificial sequence
  SiRNA target sequence
ttcgtaatttgtgtttgcgcc

SEQ ID NO: 20401 - DNA, 21 bp, Artificial sequence
  SiRNA target sequence
tcgtaatttgtgtttgcgcct

SEQ ID NO: 20402 - DNA, 21 bp, Artificial sequence
  SiRNA target sequence
cgtaatttgtgtttgcgcctg

SEQ ID NO: 20403 - DNA, 21 bp, Artificial sequence
  SiRNA target sequence
gtaatttgtgtttgcgcctgc

SEQ ID NO: 20404 - DNA, 21 bp, Artificial sequence
  SiRNA target sequence
taatttgtgtttgcgcctgca

SEQ ID NO: 20405 - DNA, 21 bp, Artificial sequence
  SiRNA target sequence
aatttgtgtttgcgcctgcaa

SEQ ID NO: 20406 - DNA, 21 bp, Artificial sequence
  SiRNA target sequence
atttgtgtttgcgcctgcaaa

SEQ ID NO: 20407 - DNA, 21 bp, Artificial sequence
  SiRNA target sequence
tttgtgtttgcgcctgcaaaa

SEQ ID NO: 20408 - DNA, 21 bp, Artificial sequence
  SiRNA target sequence
ttgtgtttgcgcctgcaaaag

SEQ ID NO: 20409 - DNA, 21 bp, Artificial sequence
  SiRNA target sequence
tgtgtttgcgcctgcaaaagg

SEQ ID NO: 20410 - DNA, 21 bp, Artificial sequence
  SiRNA target sequence
gtgtttgcgcctgcaaaagga

SEQ ID NO: 20411 - DNA, 21 bp, Artificial sequence
  SiRNA target sequence
tgtttgcgcctgcaaaaggac

SEQ ID NO: 20412 - DNA, 21 bp, Artificial sequence
  SiRNA target sequence
gtttgcgcctgcaaaaggaca

SEQ ID NO: 20413 - DNA, 21 bp, Artificial sequence
  SiRNA target sequence
tttgcgcctgcaaaaggacac

SEQ ID NO: 20414 - DNA, 21 bp, Artificial sequence
  SiRNA target sequence
ttgcgcctgcaaaaggacact

SEQ ID NO: 20415 - DNA, 21 bp, Artificial sequence
  SiRNA target sequence
tgcgcctgcaaaaggacacta

SEQ ID NO: 20416 - DNA, 21 bp, Artificial sequence
  SiRNA target sequence
gcgcctgcaaaaggacactac

SEQ ID NO: 20417 - DNA, 21 bp, Artificial sequence
  SiRNA target sequence
cgcctgcaaaaggacactaca

SEQ ID NO: 20418 - DNA, 21 bp, Artificial sequence
  SiRNA target sequence
gcctgcaaaaggacactacat

SEQ ID NO: 20419 - DNA, 21 bp, Artificial sequence
  SiRNA target sequence
cctgcaaaaggacactacatt

SEQ ID NO: 20420 - DNA, 21 bp, Artificial sequence
  SiRNA target sequence
ctgcaaaaggacactacattt

SEQ ID NO: 20421 - DNA, 21 bp, Artificial sequence
  SiRNA target sequence
tgcaaaaggacactacatttt

SEQ ID NO: 20422 - DNA, 21 bp, Artificial sequence
  SiRNA target sequence
gcaaaaggacactacattttg

SEQ ID NO: 20423 - DNA, 21 bp, Artificial sequence
  SiRNA target sequence
caaaaggacactacattttgg

SEQ ID NO: 20424 - DNA, 21 bp, Artificial sequence
  SiRNA target sequence
aaaaggacactacattttgga

SEQ ID NO: 20425 - DNA, 21 bp, Artificial sequence
  SiRNA target sequence
aaaggacactacattttggaa

SEQ ID NO: 20426 - DNA, 21 bp, Artificial sequence
  SiRNA target sequence
aaggacactacattttggaaa

SEQ ID NO: 20427 - DNA, 21 bp, Artificial sequence
  SiRNA target sequence
aggacactacattttggaaaa

SEQ ID NO: 20428 - DNA, 21 bp, Artificial sequence
  SiRNA target sequence
ggacactacattttggaaaaa

SEQ ID NO: 20429 - DNA, 21 bp, Artificial sequence
  SiRNA target sequence
gacactacattttggaaaaat

SEQ ID NO: 20430 - DNA, 21 bp, Artificial sequence
  SiRNA target sequence
acactacattttggaaaaata

SEQ ID NO: 20431 - DNA, 21 bp, Artificial sequence
  SiRNA target sequence
cactacattttggaaaaatac

SEQ ID NO: 20432 - DNA, 21 bp, Artificial sequence
  SiRNA target sequence
actacattttggaaaaatact

SEQ ID NO: 20433 - DNA, 21 bp, Artificial sequence
  SiRNA target sequence
ctacattttggaaaaatactg

SEQ ID NO: 20434 - DNA, 21 bp, Artificial sequence
  SiRNA target sequence
tacattttggaaaaatactgc

SEQ ID NO: 20435 - DNA, 21 bp, Artificial sequence
  SiRNA target sequence
acattttggaaaaatactgct

SEQ ID NO: 20436 - DNA, 21 bp, Artificial sequence
  SiRNA target sequence
cattttggaaaaatactgctg

SEQ ID NO: 20437 - DNA, 21 bp, Artificial sequence
  SiRNA target sequence
attttggaaaaatactgctgg

SEQ ID NO: 20438 - DNA, 21 bp, Artificial sequence
  SiRNA target sequence
ttttggaaaaatactgctggt

SEQ ID NO: 20439 - DNA, 21 bp, Artificial sequence
  SiRNA target sequence
tttggaaaaatactgctggta

SEQ ID NO: 20440 - DNA, 21 bp, Artificial sequence
  SiRNA target sequence
ttggaaaaatactgctggtag

SEQ ID NO: 20441 - DNA, 21 bp, Artificial sequence
  SiRNA target sequence
tggaaaaatactgctggtaga

SEQ ID NO: 20442 - DNA, 21 bp, Artificial sequence
  SiRNA target sequence
ggaaaaatactgctggtagac

SEQ ID NO: 20443 - DNA, 21 bp, Artificial sequence
  SiRNA target sequence
gaaaaatactgctggtagact

SEQ ID NO: 20444 - DNA, 21 bp, Artificial sequence
  SiRNA target sequence
aaaaatactgctggtagactg

SEQ ID NO: 20445 - DNA, 21 bp, Artificial sequence
  SiRNA target sequence
aaaatactgctggtagactgg

SEQ ID NO: 20446 - DNA, 21 bp, Artificial sequence
  SiRNA target sequence
aaatactgctggtagactgga

SEQ ID NO: 20447 - DNA, 21 bp, Artificial sequence
  SiRNA target sequence
aatactgctggtagactggat

SEQ ID NO: 20448 - DNA, 21 bp, Artificial sequence
  SiRNA target sequence
atactgctggtagactggata

SEQ ID NO: 20449 - DNA, 21 bp, Artificial sequence
  SiRNA target sequence
tactgctggtagactggatat

SEQ ID NO: 20450 - DNA, 21 bp, Artificial sequence
  SiRNA target sequence
actgctggtagactggatatg

SEQ ID NO: 20451 - DNA, 21 bp, Artificial sequence
  SiRNA target sequence
ctgctggtagactggatatga

SEQ ID NO: 20452 - DNA, 21 bp, Artificial sequence
  SiRNA target sequence
tgctggtagactggatatgat

SEQ ID NO: 20453 - DNA, 21 bp, Artificial sequence
  SiRNA target sequence
gctggtagactggatatgatc

SEQ ID NO: 20454 - DNA, 21 bp, Artificial sequence
  SiRNA target sequence
ctggtagactggatatgatcc

SEQ ID NO: 20455 - DNA, 21 bp, Artificial sequence
  SiRNA target sequence
tggtagactggatatgatcca

SEQ ID NO: 20456 - DNA, 21 bp, Artificial sequence
  SiRNA target sequence
ggtagactggatatgatccag

SEQ ID NO: 20457 - DNA, 21 bp, Artificial sequence
  SiRNA target sequence
gtagactggatatgatccagg

SEQ ID NO: 20458 - DNA, 21 bp, Artificial sequence
  SiRNA target sequence
tagactggatatgatccagga

SEQ ID NO: 20459 - DNA, 21 bp, Artificial sequence
  SiRNA target sequence
agactggatatgatccaggat

SEQ ID NO: 20460 - DNA, 21 bp, Artificial sequence
  SiRNA target sequence
gactggatatgatccaggatg

SEQ ID NO: 20461 - DNA, 21 bp, Artificial sequence
  SiRNA target sequence
actggatatgatccaggatga

SEQ ID NO: 20462 - DNA, 21 bp, Artificial sequence
  SiRNA target sequence
ctggatatgatccaggatgac

SEQ ID NO: 20463 - DNA, 21 bp, Artificial sequence
  SiRNA target sequence
tggatatgatccaggatgaca

SEQ ID NO: 20464 - DNA, 21 bp, Artificial sequence
  SiRNA target sequence
ggatatgatccaggatgacat

SEQ ID NO: 20465 - DNA, 21 bp, Artificial sequence
  SiRNA target sequence
gatatgatccaggatgacatt

SEQ ID NO: 20466 - DNA, 21 bp, Artificial sequence
  SiRNA target sequence
atatgatccaggatgacattg

SEQ ID NO: 20467 - DNA, 21 bp, Artificial sequence
  SiRNA target sequence
tatgatccaggatgacattga

SEQ ID NO: 20468 - DNA, 21 bp, Artificial sequence
  SiRNA target sequence
atgatccaggatgacattgaa

SEQ ID NO: 20469 - DNA, 21 bp, Artificial sequence
  SiRNA target sequence
tgatccaggatgacattgaaa

SEQ ID NO: 20470 - DNA, 21 bp, Artificial sequence
  SiRNA target sequence
gatccaggatgacattgaaag

SEQ ID NO: 20471 - DNA, 21 bp, Artificial sequence
  SiRNA target sequence
atccaggatgacattgaaagt

SEQ ID NO: 20472 - DNA, 21 bp, Artificial sequence
  SiRNA target sequence
tccaggatgacattgaaagta

SEQ ID NO: 20473 - DNA, 21 bp, Artificial sequence
  SiRNA target sequence
ccaggatgacattgaaagtat

SEQ ID NO: 20474 - DNA, 21 bp, Artificial sequence
  SiRNA target sequence
caggatgacattgaaagtatg

SEQ ID NO: 20475 - DNA, 21 bp, Artificial sequence
  SiRNA target sequence
aggatgacattgaaagtatgg

SEQ ID NO: 20476 - DNA, 21 bp, Artificial sequence
  SiRNA target sequence
ggatgacattgaaagtatggt

SEQ ID NO: 20477 - DNA, 21 bp, Artificial sequence
  SiRNA target sequence
gatgacattgaaagtatggtt

SEQ ID NO: 20478 - DNA, 21 bp, Artificial sequence
  SiRNA target sequence
atgacattgaaagtatggttg

SEQ ID NO: 20479 - DNA, 21 bp, Artificial sequence
  SiRNA target sequence
tgacattgaaagtatggttgc

SEQ ID NO: 20480 - DNA, 21 bp, Artificial sequence
  SiRNA target sequence
gacattgaaagtatggttgct

SEQ ID NO: 20481 - DNA, 21 bp, Artificial sequence
  SiRNA target sequence
acattgaaagtatggttgctc

SEQ ID NO: 20482 - DNA, 21 bp, Artificial sequence
  SiRNA target sequence
cattgaaagtatggttgctca

SEQ ID NO: 20483 - DNA, 21 bp, Artificial sequence
  SiRNA target sequence
attgaaagtatggttgctcaa

SEQ ID NO: 20484 - DNA, 21 bp, Artificial sequence
  SiRNA target sequence
ttgaaagtatggttgctcaaa

SEQ ID NO: 20485 - DNA, 21 bp, Artificial sequence
  SiRNA target sequence
tgaaagtatggttgctcaaag

SEQ ID NO: 20486 - DNA, 21 bp, Artificial sequence
  SiRNA target sequence
gaaagtatggttgctcaaagt

SEQ ID NO: 20487 - DNA, 21 bp, Artificial sequence
  SiRNA target sequence
aaagtatggttgctcaaagtg

SEQ ID NO: 20488 - DNA, 21 bp, Artificial sequence
  SiRNA target sequence
aagtatggttgctcaaagtgg

SEQ ID NO: 20489 - DNA, 21 bp, Artificial sequence
  SiRNA target sequence
agtatggttgctcaaagtggc

SEQ ID NO: 20490 - DNA, 21 bp, Artificial sequence
  SiRNA target sequence
gtatggttgctcaaagtggcc

SEQ ID NO: 20491 - DNA, 21 bp, Artificial sequence
  SiRNA target sequence
tatggttgctcaaagtggccc

SEQ ID NO: 20492 - DNA, 21 bp, Artificial sequence
  SiRNA target sequence
atggttgctcaaagtggccct

SEQ ID NO: 20493 - DNA, 21 bp, Artificial sequence
  SiRNA target sequence
tggttgctcaaagtggccctg

SEQ ID NO: 20494 - DNA, 21 bp, Artificial sequence
  SiRNA target sequence
ggttgctcaaagtggccctgt

SEQ ID NO: 20495 - DNA, 21 bp, Artificial sequence
  SiRNA target sequence
gttgctcaaagtggccctgtt

SEQ ID NO: 20496 - DNA, 21 bp, Artificial sequence
  SiRNA target sequence
ttgctcaaagtggccctgtta

SEQ ID NO: 20497 - DNA, 21 bp, Artificial sequence
  SiRNA target sequence
tgctcaaagtggccctgttat

SEQ ID NO: 20498 - DNA, 21 bp, Artificial sequence
  SiRNA target sequence
gctcaaagtggccctgttatg

SEQ ID NO: 20499 - DNA, 21 bp, Artificial sequence
  SiRNA target sequence
ctcaaagtggccctgttatga

SEQ ID NO: 20500 - DNA, 21 bp, Artificial sequence
  SiRNA target sequence
tcaaagtggccctgttatgag

SEQ ID NO: 20501 - DNA, 21 bp, Artificial sequence
  SiRNA target sequence
caaagtggccctgttatgagt

SEQ ID NO: 20502 - DNA, 21 bp, Artificial sequence
  SiRNA target sequence
aaagtggccctgttatgagtc

SEQ ID NO: 20503 - DNA, 21 bp, Artificial sequence
  SiRNA target sequence
aagtggccctgttatgagtca

SEQ ID NO: 20504 - DNA, 21 bp, Artificial sequence
  SiRNA target sequence
agtggccctgttatgagtcag

SEQ ID NO: 20505 - DNA, 21 bp, Artificial sequence
  SiRNA target sequence
gtggccctgttatgagtcaga

SEQ ID NO: 20506 - DNA, 21 bp, Artificial sequence
  SiRNA target sequence
tggccctgttatgagtcagag

SEQ ID NO: 20507 - DNA, 21 bp, Artificial sequence
  SiRNA target sequence
ggccctgttatgagtcagagc

SEQ ID NO: 20508 - DNA, 21 bp, Artificial sequence
  SiRNA target sequence
gccctgttatgagtcagagct

SEQ ID NO: 20509 - DNA, 21 bp, Artificial sequence
  SiRNA target sequence
ccctgttatgagtcagagctt

SEQ ID NO: 20510 - DNA, 21 bp, Artificial sequence
  SiRNA target sequence
cctgttatgagtcagagctta

SEQ ID NO: 20511 - DNA, 21 bp, Artificial sequence
  SiRNA target sequence
ctgttatgagtcagagcttaa

SEQ ID NO: 20512 - DNA, 21 bp, Artificial sequence
  SiRNA target sequence
tgttatgagtcagagcttaag

SEQ ID NO: 20513 - DNA, 21 bp, Artificial sequence
  SiRNA target sequence
gttatgagtcagagcttaagt

SEQ ID NO: 20514 - DNA, 21 bp, Artificial sequence
  SiRNA target sequence
ttatgagtcagagcttaagtg

SEQ ID NO: 20515 - DNA, 21 bp, Artificial sequence
  SiRNA target sequence
tatgagtcagagcttaagtga

SEQ ID NO: 20516 - DNA, 21 bp, Artificial sequence
  SiRNA target sequence
atgagtcagagcttaagtgac

SEQ ID NO: 20517 - DNA, 21 bp, Artificial sequence
  SiRNA target sequence
tgagtcagagcttaagtgaca

SEQ ID NO: 20518 - DNA, 21 bp, Artificial sequence
  SiRNA target sequence
gagtcagagcttaagtgacag

SEQ ID NO: 20519 - DNA, 21 bp, Artificial sequence
  SiRNA target sequence
agtcagagcttaagtgacagg

SEQ ID NO: 20520 - DNA, 21 bp, Artificial sequence
  SiRNA target sequence
gtcagagcttaagtgacaggg

SEQ ID NO: 20521 - DNA, 21 bp, Artificial sequence
  SiRNA target sequence
tcagagcttaagtgacagggt

SEQ ID NO: 20522 - DNA, 21 bp, Artificial sequence
  SiRNA target sequence
cagagcttaagtgacagggtt

SEQ ID NO: 20523 - DNA, 21 bp, Artificial sequence
  SiRNA target sequence
agagcttaagtgacagggttg

SEQ ID NO: 20524 - DNA, 21 bp, Artificial sequence
  SiRNA target sequence
gagcttaagtgacagggttga

SEQ ID NO: 20525 - DNA, 21 bp, Artificial sequence
  SiRNA target sequence
agcttaagtgacagggttgac

SEQ ID NO: 20526 - DNA, 21 bp, Artificial sequence
  SiRNA target sequence
gcttaagtgacagggttgacc

SEQ ID NO: 20527 - DNA, 21 bp, Artificial sequence
  SiRNA target sequence
cttaagtgacagggttgaccg

SEQ ID NO: 20528 - DNA, 21 bp, Artificial sequence
  SiRNA target sequence
ttaagtgacagggttgaccga

SEQ ID NO: 20529 - DNA, 21 bp, Artificial sequence
  SiRNA target sequence
taagtgacagggttgaccgaa

SEQ ID NO: 20530 - DNA, 21 bp, Artificial sequence
  SiRNA target sequence
aagtgacagggttgaccgaat

SEQ ID NO: 20531 - DNA, 21 bp, Artificial sequence
  SiRNA target sequence
agtgacagggttgaccgaatg

SEQ ID NO: 20532 - DNA, 21 bp, Artificial sequence
  SiRNA target sequence
gtgacagggttgaccgaatgt

SEQ ID NO: 20533 - DNA, 21 bp, Artificial sequence
  SiRNA target sequence
tgacagggttgaccgaatgta

SEQ ID NO: 20534 - DNA, 21 bp, Artificial sequence
  SiRNA target sequence
gacagggttgaccgaatgtac

SEQ ID NO: 20535 - DNA, 21 bp, Artificial sequence
  SiRNA target sequence
acagggttgaccgaatgtacc

SEQ ID NO: 20536 - DNA, 21 bp, Artificial sequence
  SiRNA target sequence
cagggttgaccgaatgtacca

SEQ ID NO: 20537 - DNA, 21 bp, Artificial sequence
  SiRNA target sequence
agggttgaccgaatgtaccat

SEQ ID NO: 20538 - DNA, 21 bp, Artificial sequence
  SiRNA target sequence
gggttgaccgaatgtaccatg

SEQ ID NO: 20539 - DNA, 21 bp, Artificial sequence
  SiRNA target sequence
ggttgaccgaatgtaccatga

SEQ ID NO: 20540 - DNA, 21 bp, Artificial sequence
  SiRNA target sequence
gttgaccgaatgtaccatgaa

SEQ ID NO: 20541 - DNA, 21 bp, Artificial sequence
  SiRNA target sequence
ttgaccgaatgtaccatgaac

SEQ ID NO: 20542 - DNA, 21 bp, Artificial sequence
  SiRNA target sequence
tgaccgaatgtaccatgaact

SEQ ID NO: 20543 - DNA, 21 bp, Artificial sequence
  SiRNA target sequence
gaccgaatgtaccatgaactg

SEQ ID NO: 20544 - DNA, 21 bp, Artificial sequence
  SiRNA target sequence
accgaatgtaccatgaactga

SEQ ID NO: 20545 - DNA, 21 bp, Artificial sequence
  SiRNA target sequence
ccgaatgtaccatgaactgat

SEQ ID NO: 20546 - DNA, 21 bp, Artificial sequence
  SiRNA target sequence
cgaatgtaccatgaactgata

SEQ ID NO: 20547 - DNA, 21 bp, Artificial sequence
  SiRNA target sequence
gaatgtaccatgaactgatac

SEQ ID NO: 20548 - DNA, 21 bp, Artificial sequence
  SiRNA target sequence
aatgtaccatgaactgataca

SEQ ID NO: 20549 - DNA, 21 bp, Artificial sequence
  SiRNA target sequence
atgtaccatgaactgatacat

SEQ ID NO: 20550 - DNA, 21 bp, Artificial sequence
  SiRNA target sequence
tgtaccatgaactgatacata

SEQ ID NO: 20551 - DNA, 21 bp, Artificial sequence
  SiRNA target sequence
gtaccatgaactgatacatac

SEQ ID NO: 20552 - DNA, 21 bp, Artificial sequence
  SiRNA target sequence
taccatgaactgatacatact

SEQ ID NO: 20553 - DNA, 21 bp, Artificial sequence
  SiRNA target sequence
accatgaactgatacatacta

SEQ ID NO: 20554 - DNA, 21 bp, Artificial sequence
  SiRNA target sequence
ccatgaactgatacatactaa

SEQ ID NO: 20555 - DNA, 21 bp, Artificial sequence
  SiRNA target sequence
catgaactgatacatactaat

SEQ ID NO: 20556 - DNA, 21 bp, Artificial sequence
  SiRNA target sequence
atgaactgatacatactaatg

SEQ ID NO: 20557 - DNA, 21 bp, Artificial sequence
  SiRNA target sequence
tgaactgatacatactaatgt

SEQ ID NO: 20558 - DNA, 21 bp, Artificial sequence
  SiRNA target sequence
gaactgatacatactaatgtt

SEQ ID NO: 20559 - DNA, 21 bp, Artificial sequence
  SiRNA target sequence
aactgatacatactaatgttg

SEQ ID NO: 20560 - DNA, 21 bp, Artificial sequence
  SiRNA target sequence
actgatacatactaatgttgc

SEQ ID NO: 20561 - DNA, 21 bp, Artificial sequence
  SiRNA target sequence
ctgatacatactaatgttgcc

SEQ ID NO: 20562 - DNA, 21 bp, Artificial sequence
  SiRNA target sequence
tgatacatactaatgttgccc

SEQ ID NO: 20563 - DNA, 21 bp, Artificial sequence
  SiRNA target sequence
gatacatactaatgttgccca

SEQ ID NO: 20564 - DNA, 21 bp, Artificial sequence
  SiRNA target sequence
atacatactaatgttgcccag

SEQ ID NO: 20565 - DNA, 21 bp, Artificial sequence
  SiRNA target sequence
tacatactaatgttgcccaga

SEQ ID NO: 20566 - DNA, 21 bp, Artificial sequence
  SiRNA target sequence
acatactaatgttgcccagat

SEQ ID NO: 20567 - DNA, 21 bp, Artificial sequence
  SiRNA target sequence
catactaatgttgcccagatg

SEQ ID NO: 20568 - DNA, 21 bp, Artificial sequence
  SiRNA target sequence
atactaatgttgcccagatga

SEQ ID NO: 20569 - DNA, 21 bp, Artificial sequence
  SiRNA target sequence
tactaatgttgcccagatgaa

SEQ ID NO: 20570 - DNA, 21 bp, Artificial sequence
  SiRNA target sequence
actaatgttgcccagatgaac

SEQ ID NO: 20571 - DNA, 21 bp, Artificial sequence
  SiRNA target sequence
ctaatgttgcccagatgaact

SEQ ID NO: 20572 - DNA, 21 bp, Artificial sequence
  SiRNA target sequence
taatgttgcccagatgaactt

SEQ ID NO: 20573 - DNA, 21 bp, Artificial sequence
  SiRNA target sequence
aatgttgcccagatgaacttt

SEQ ID NO: 20574 - DNA, 21 bp, Artificial sequence
  SiRNA target sequence
atgttgcccagatgaactttt

SEQ ID NO: 20575 - DNA, 21 bp, Artificial sequence
  SiRNA target sequence
tgttgcccagatgaacttttc

SEQ ID NO: 20576 - DNA, 21 bp, Artificial sequence
  SiRNA target sequence
gttgcccagatgaacttttcc

SEQ ID NO: 20577 - DNA, 21 bp, Artificial sequence
  SiRNA target sequence
ttgcccagatgaacttttcca

SEQ ID NO: 20578 - DNA, 21 bp, Artificial sequence
  SiRNA target sequence
tgcccagatgaacttttccat

SEQ ID NO: 20579 - DNA, 21 bp, Artificial sequence
  SiRNA target sequence
gcccagatgaacttttccata

SEQ ID NO: 20580 - DNA, 21 bp, Artificial sequence
  SiRNA target sequence
cccagatgaacttttccatac

SEQ ID NO: 20581 - DNA, 21 bp, Artificial sequence
  SiRNA target sequence
ccagatgaacttttccatacc

SEQ ID NO: 20582 - DNA, 21 bp, Artificial sequence
  SiRNA target sequence
cagatgaacttttccatacca

SEQ ID NO: 20583 - DNA, 21 bp, Artificial sequence
  SiRNA target sequence
agatgaacttttccataccat

SEQ ID NO: 20584 - DNA, 21 bp, Artificial sequence
  SiRNA target sequence
gatgaacttttccataccatt

SEQ ID NO: 20585 - DNA, 21 bp, Artificial sequence
  SiRNA target sequence
atgaacttttccataccattt

SEQ ID NO: 20586 - DNA, 21 bp, Artificial sequence
  SiRNA target sequence
tgaacttttccataccatttt

SEQ ID NO: 20587 - DNA, 21 bp, Artificial sequence
  SiRNA target sequence
gaacttttccataccattttc

SEQ ID NO: 20588 - DNA, 21 bp, Artificial sequence
  SiRNA target sequence
aacttttccataccattttcg

SEQ ID NO: 20589 - DNA, 21 bp, Artificial sequence
  SiRNA target sequence
acttttccataccattttcgc

SEQ ID NO: 20590 - DNA, 21 bp, Artificial sequence
  SiRNA target sequence
cttttccataccattttcgca

SEQ ID NO: 20591 - DNA, 21 bp, Artificial sequence
  SiRNA target sequence
ttttccataccattttcgcat

SEQ ID NO: 20592 - DNA, 21 bp, Artificial sequence
  SiRNA target sequence
tttccataccattttcgcata

SEQ ID NO: 20593 - DNA, 21 bp, Artificial sequence
  SiRNA target sequence
ttccataccattttcgcataa

SEQ ID NO: 20594 - DNA, 21 bp, Artificial sequence
  SiRNA target sequence
tccataccattttcgcataat

SEQ ID NO: 20595 - DNA, 21 bp, Artificial sequence
  SiRNA target sequence
ccataccattttcgcataatt

SEQ ID NO: 20596 - DNA, 21 bp, Artificial sequence
  SiRNA target sequence
cataccattttcgcataattt

SEQ ID NO: 20597 - DNA, 21 bp, Artificial sequence
  SiRNA target sequence
ataccattttcgcataatttg

SEQ ID NO: 20598 - DNA, 21 bp, Artificial sequence
  SiRNA target sequence
taccattttcgcataatttgt

SEQ ID NO: 20599 - DNA, 21 bp, Artificial sequence
  SiRNA target sequence
accattttcgcataatttgtc

SEQ ID NO: 20600 - DNA, 21 bp, Artificial sequence
  SiRNA target sequence
ccattttcgcataatttgtct

SEQ ID NO: 20601 - DNA, 21 bp, Artificial sequence
  SiRNA target sequence
cattttcgcataatttgtcta

SEQ ID NO: 20602 - DNA, 21 bp, Artificial sequence
  SiRNA target sequence
attttcgcataatttgtctaa

SEQ ID NO: 20603 - DNA, 21 bp, Artificial sequence
  SiRNA target sequence
ttttcgcataatttgtctaag

SEQ ID NO: 20604 - DNA, 21 bp, Artificial sequence
  SiRNA target sequence
tttcgcataatttgtctaagg

SEQ ID NO: 20605 - DNA, 21 bp, Artificial sequence
  SiRNA target sequence
ttcgcataatttgtctaagga

SEQ ID NO: 20606 - DNA, 21 bp, Artificial sequence
  SiRNA target sequence
tcgcataatttgtctaaggac

SEQ ID NO: 20607 - DNA, 21 bp, Artificial sequence
  SiRNA target sequence
cgcataatttgtctaaggact

SEQ ID NO: 20608 - DNA, 21 bp, Artificial sequence
  SiRNA target sequence
gcataatttgtctaaggactc

SEQ ID NO: 20609 - DNA, 21 bp, Artificial sequence
  SiRNA target sequence
cataatttgtctaaggactcg

SEQ ID NO: 20610 - DNA, 21 bp, Artificial sequence
  SiRNA target sequence
ataatttgtctaaggactcga

SEQ ID NO: 20611 - DNA, 21 bp, Artificial sequence
  SiRNA target sequence
taatttgtctaaggactcgaa

SEQ ID NO: 20612 - DNA, 21 bp, Artificial sequence
  SiRNA target sequence
aatttgtctaaggactcgaaa

SEQ ID NO: 20613 - DNA, 21 bp, Artificial sequence
  SiRNA target sequence
atttgtctaaggactcgaaag

SEQ ID NO: 20614 - DNA, 21 bp, Artificial sequence
  SiRNA target sequence
tttgtctaaggactcgaaagc

SEQ ID NO: 20615 - DNA, 21 bp, Artificial sequence
  SiRNA target sequence
ttgtctaaggactcgaaagcg

SEQ ID NO: 20616 - DNA, 21 bp, Artificial sequence
  SiRNA target sequence
tgtctaaggactcgaaagcgt

SEQ ID NO: 20617 - DNA, 21 bp, Artificial sequence
  SiRNA target sequence
gtctaaggactcgaaagcgtt

SEQ ID NO: 20618 - DNA, 21 bp, Artificial sequence
  SiRNA target sequence
tctaaggactcgaaagcgttc

SEQ ID NO: 20619 - DNA, 21 bp, Artificial sequence
  SiRNA target sequence
ctaaggactcgaaagcgttcc

SEQ ID NO: 20620 - DNA, 21 bp, Artificial sequence
  SiRNA target sequence
taaggactcgaaagcgttcct

SEQ ID NO: 20621 - DNA, 21 bp, Artificial sequence
  SiRNA target sequence
aaggactcgaaagcgttcctt

SEQ ID NO: 20622 - DNA, 21 bp, Artificial sequence
  SiRNA target sequence
aggactcgaaagcgttcctta

SEQ ID NO: 20623 - DNA, 21 bp, Artificial sequence
  SiRNA target sequence
ggactcgaaagcgttccttac

SEQ ID NO: 20624 - DNA, 21 bp, Artificial sequence
  SiRNA target sequence
gactcgaaagcgttccttact

SEQ ID NO: 20625 - DNA, 21 bp, Artificial sequence
  SiRNA target sequence
actcgaaagcgttccttactc

SEQ ID NO: 20626 - DNA, 21 bp, Artificial sequence
  SiRNA target sequence
ctcgaaagcgttccttactca

SEQ ID NO: 20627 - DNA, 21 bp, Artificial sequence
  SiRNA target sequence
tcgaaagcgttccttactcaa

SEQ ID NO: 20628 - DNA, 21 bp, Artificial sequence
  SiRNA target sequence
cgaaagcgttccttactcaaa

SEQ ID NO: 20629 - DNA, 21 bp, Artificial sequence
  SiRNA target sequence
gaaagcgttccttactcaaac

SEQ ID NO: 20630 - DNA, 21 bp, Artificial sequence
  SiRNA target sequence
aaagcgttccttactcaaacc

SEQ ID NO: 20631 - DNA, 21 bp, Artificial sequence
  SiRNA target sequence
aagcgttccttactcaaaccg

SEQ ID NO: 20632 - DNA, 21 bp, Artificial sequence
  SiRNA target sequence
agcgttccttactcaaaccgt

SEQ ID NO: 20633 - DNA, 21 bp, Artificial sequence
  SiRNA target sequence
gcgttccttactcaaaccgtg

SEQ ID NO: 20634 - DNA, 21 bp, Artificial sequence
  SiRNA target sequence
cgttccttactcaaaccgtgg

SEQ ID NO: 20635 - DNA, 21 bp, Artificial sequence
  SiRNA target sequence
gttccttactcaaaccgtgga

SEQ ID NO: 20636 - DNA, 21 bp, Artificial sequence
  SiRNA target sequence
ttccttactcaaaccgtggat

SEQ ID NO: 20637 - DNA, 21 bp, Artificial sequence
  SiRNA target sequence
tccttactcaaaccgtggata

SEQ ID NO: 20638 - DNA, 21 bp, Artificial sequence
  SiRNA target sequence
ccttactcaaaccgtggatac

SEQ ID NO: 20639 - DNA, 21 bp, Artificial sequence
  SiRNA target sequence
cttactcaaaccgtggatacc

SEQ ID NO: 20640 - DNA, 21 bp, Artificial sequence
  SiRNA target sequence
ttactcaaaccgtggatacct

SEQ ID NO: 20641 - DNA, 21 bp, Artificial sequence
  SiRNA target sequence
tactcaaaccgtggatacctc

SEQ ID NO: 20642 - DNA, 21 bp, Artificial sequence
  SiRNA target sequence
actcaaaccgtggatacctct

SEQ ID NO: 20643 - DNA, 21 bp, Artificial sequence
  SiRNA target sequence
ctcaaaccgtggatacctctc

SEQ ID NO: 20644 - DNA, 21 bp, Artificial sequence
  SiRNA target sequence
tcaaaccgtggatacctctct

SEQ ID NO: 20645 - DNA, 21 bp, Artificial sequence
  SiRNA target sequence
caaaccgtggatacctctctt

SEQ ID NO: 20646 - DNA, 21 bp, Artificial sequence
  SiRNA target sequence
aaaccgtggatacctctcttg

SEQ ID NO: 20647 - DNA, 21 bp, Artificial sequence
  SiRNA target sequence
aaccgtggatacctctcttgg

SEQ ID NO: 20648 - DNA, 21 bp, Artificial sequence
  SiRNA target sequence
accgtggatacctctcttggt

SEQ ID NO: 20649 - DNA, 21 bp, Artificial sequence
  SiRNA target sequence
ccgtggatacctctcttggtg

SEQ ID NO: 20650 - DNA, 21 bp, Artificial sequence
  SiRNA target sequence
cgtggatacctctcttggtgg

SEQ ID NO: 20651 - DNA, 21 bp, Artificial sequence
  SiRNA target sequence
gtggatacctctcttggtggt

SEQ ID NO: 20652 - DNA, 21 bp, Artificial sequence
  SiRNA target sequence
tggatacctctcttggtggta

SEQ ID NO: 20653 - DNA, 21 bp, Artificial sequence
  SiRNA target sequence
ggatacctctcttggtggtat

SEQ ID NO: 20654 - DNA, 21 bp, Artificial sequence
  SiRNA target sequence
gatacctctcttggtggtatg

SEQ ID NO: 20655 - DNA, 21 bp, Artificial sequence
  SiRNA target sequence
atacctctcttggtggtatga

SEQ ID NO: 20656 - DNA, 21 bp, Artificial sequence
  SiRNA target sequence
tacctctcttggtggtatgag

SEQ ID NO: 20657 - DNA, 21 bp, Artificial sequence
  SiRNA target sequence
acctctcttggtggtatgaga

SEQ ID NO: 20658 - DNA, 21 bp, Artificial sequence
  SiRNA target sequence
cctctcttggtggtatgagac

SEQ ID NO: 20659 - DNA, 21 bp, Artificial sequence
  SiRNA target sequence
ctctcttggtggtatgagaca

SEQ ID NO: 20660 - DNA, 21 bp, Artificial sequence
  SiRNA target sequence
tctcttggtggtatgagacaa

SEQ ID NO: 20661 - DNA, 21 bp, Artificial sequence
  SiRNA target sequence
ctcttggtggtatgagacaaa

SEQ ID NO: 20662 - DNA, 21 bp, Artificial sequence
  SiRNA target sequence
tcttggtggtatgagacaaat

SEQ ID NO: 20663 - DNA, 21 bp, Artificial sequence
  SiRNA target sequence
cttggtggtatgagacaaatt

SEQ ID NO: 20664 - DNA, 21 bp, Artificial sequence
  SiRNA target sequence
ttggtggtatgagacaaattt

SEQ ID NO: 20665 - DNA, 21 bp, Artificial sequence
  SiRNA target sequence
tggtggtatgagacaaatttc

SEQ ID NO: 20666 - DNA, 21 bp, Artificial sequence
  SiRNA target sequence
ggtggtatgagacaaatttct

SEQ ID NO: 20667 - DNA, 21 bp, Artificial sequence
  SiRNA target sequence
gtggtatgagacaaatttcta

SEQ ID NO: 20668 - DNA, 21 bp, Artificial sequence
  SiRNA target sequence
tggtatgagacaaatttctaa

SEQ ID NO: 20669 - DNA, 21 bp, Artificial sequence
  SiRNA target sequence
ggtatgagacaaatttctaat

SEQ ID NO: 20670 - DNA, 21 bp, Artificial sequence
  SiRNA target sequence
gtatgagacaaatttctaatg

SEQ ID NO: 20671 - DNA, 21 bp, Artificial sequence
  SiRNA target sequence
tatgagacaaatttctaatga

SEQ ID NO: 20672 - DNA, 21 bp, Artificial sequence
  SiRNA target sequence
atgagacaaatttctaatgaa

SEQ ID NO: 20673 - DNA, 21 bp, Artificial sequence
  SiRNA target sequence
tgagacaaatttctaatgaaa

SEQ ID NO: 20674 - DNA, 21 bp, Artificial sequence
  SiRNA target sequence
gagacaaatttctaatgaaac

SEQ ID NO: 20675 - DNA, 21 bp, Artificial sequence
  SiRNA target sequence
agacaaatttctaatgaaaca

SEQ ID NO: 20676 - DNA, 21 bp, Artificial sequence
  SiRNA target sequence
gacaaatttctaatgaaacag

SEQ ID NO: 20677 - DNA, 21 bp, Artificial sequence
  SiRNA target sequence
acaaatttctaatgaaacagt

SEQ ID NO: 20678 - DNA, 21 bp, Artificial sequence
  SiRNA target sequence
caaatttctaatgaaacagtt

SEQ ID NO: 20679 - DNA, 21 bp, Artificial sequence
  SiRNA target sequence
aaatttctaatgaaacagtta

SEQ ID NO: 20680 - DNA, 21 bp, Artificial sequence
  SiRNA target sequence
aatttctaatgaaacagttaa

SEQ ID NO: 20681 - DNA, 21 bp, Artificial sequence
  SiRNA target sequence
atttctaatgaaacagttaat

SEQ ID NO: 20682 - DNA, 21 bp, Artificial sequence
  SiRNA target sequence
tttctaatgaaacagttaata

SEQ ID NO: 20683 - DNA, 21 bp, Artificial sequence
  SiRNA target sequence
ttctaatgaaacagttaatac

SEQ ID NO: 20684 - DNA, 21 bp, Artificial sequence
  SiRNA target sequence
tctaatgaaacagttaatact

SEQ ID NO: 20685 - DNA, 21 bp, Artificial sequence
  SiRNA target sequence
ctaatgaaacagttaatacta

SEQ ID NO: 20686 - DNA, 21 bp, Artificial sequence
  SiRNA target sequence
taatgaaacagttaatactat

SEQ ID NO: 20687 - DNA, 21 bp, Artificial sequence
  SiRNA target sequence
aatgaaacagttaatactatt

SEQ ID NO: 20688 - DNA, 21 bp, Artificial sequence
  SiRNA target sequence
atgaaacagttaatactatta

SEQ ID NO: 20689 - DNA, 21 bp, Artificial sequence
  SiRNA target sequence
tgaaacagttaatactattaa

SEQ ID NO: 20690 - DNA, 21 bp, Artificial sequence
  SiRNA target sequence
gaaacagttaatactattaaa

SEQ ID NO: 20691 - DNA, 21 bp, Artificial sequence
  SiRNA target sequence
aaacagttaatactattaaag

SEQ ID NO: 20692 - DNA, 21 bp, Artificial sequence
  SiRNA target sequence
aacagttaatactattaaaga

SEQ ID NO: 20693 - DNA, 21 bp, Artificial sequence
  SiRNA target sequence
acagttaatactattaaagag

SEQ ID NO: 20694 - DNA, 21 bp, Artificial sequence
  SiRNA target sequence
cagttaatactattaaagagg

SEQ ID NO: 20695 - DNA, 21 bp, Artificial sequence
  SiRNA target sequence
agttaatactattaaagaggt

SEQ ID NO: 20696 - DNA, 21 bp, Artificial sequence
  SiRNA target sequence
gttaatactattaaagaggtg

SEQ ID NO: 20697 - DNA, 21 bp, Artificial sequence
  SiRNA target sequence
ttaatactattaaagaggtgt

SEQ ID NO: 20698 - DNA, 21 bp, Artificial sequence
  SiRNA target sequence
taatactattaaagaggtgtt

SEQ ID NO: 20699 - DNA, 21 bp, Artificial sequence
  SiRNA target sequence
aatactattaaagaggtgttt

SEQ ID NO: 20700 - DNA, 21 bp, Artificial sequence
  SiRNA target sequence
atactattaaagaggtgtttg

SEQ ID NO: 20701 - DNA, 21 bp, Artificial sequence
  SiRNA target sequence
tactattaaagaggtgtttga

SEQ ID NO: 20702 - DNA, 21 bp, Artificial sequence
  SiRNA target sequence
actattaaagaggtgtttgag

SEQ ID NO: 20703 - DNA, 21 bp, Artificial sequence
  SiRNA target sequence
ctattaaagaggtgtttgaga

SEQ ID NO: 20704 - DNA, 21 bp, Artificial sequence
  SiRNA target sequence
tattaaagaggtgtttgagac

SEQ ID NO: 20705 - DNA, 21 bp, Artificial sequence
  SiRNA target sequence
attaaagaggtgtttgagaca

SEQ ID NO: 20706 - DNA, 21 bp, Artificial sequence
  SiRNA target sequence
ttaaagaggtgtttgagacat

SEQ ID NO: 20707 - DNA, 21 bp, Artificial sequence
  SiRNA target sequence
taaagaggtgtttgagacatt

SEQ ID NO: 20708 - DNA, 21 bp, Artificial sequence
  SiRNA target sequence
aaagaggtgtttgagacattt

SEQ ID NO: 20709 - DNA, 21 bp, Artificial sequence
  SiRNA target sequence
aagaggtgtttgagacatttt

SEQ ID NO: 20710 - DNA, 21 bp, Artificial sequence
  SiRNA target sequence
agaggtgtttgagacattttt

SEQ ID NO: 20711 - DNA, 21 bp, Artificial sequence
  SiRNA target sequence
gaggtgtttgagacatttttg

SEQ ID NO: 20712 - DNA, 21 bp, Artificial sequence
  SiRNA target sequence
aggtgtttgagacatttttga

SEQ ID NO: 20713 - DNA, 21 bp, Artificial sequence
  SiRNA target sequence
ggtgtttgagacatttttgac

SEQ ID NO: 20714 - DNA, 21 bp, Artificial sequence
  SiRNA target sequence
gtgtttgagacatttttgacc

SEQ ID NO: 20715 - DNA, 21 bp, Artificial sequence
  SiRNA target sequence
tgtttgagacatttttgacca

SEQ ID NO: 20716 - DNA, 21 bp, Artificial sequence
  SiRNA target sequence
gtttgagacatttttgaccaa

SEQ ID NO: 20717 - DNA, 21 bp, Artificial sequence
  SiRNA target sequence
tttgagacatttttgaccaag

SEQ ID NO: 20718 - DNA, 21 bp, Artificial sequence
  SiRNA target sequence
ttgagacatttttgaccaaga

SEQ ID NO: 20719 - DNA, 21 bp, Artificial sequence
  SiRNA target sequence
tgagacatttttgaccaagat

SEQ ID NO: 20720 - DNA, 21 bp, Artificial sequence
  SiRNA target sequence
gagacatttttgaccaagatg

SEQ ID NO: 20721 - DNA, 21 bp, Artificial sequence
  SiRNA target sequence
agacatttttgaccaagatga

SEQ ID NO: 20722 - DNA, 21 bp, Artificial sequence
  SiRNA target sequence
gacatttttgaccaagatgac

SEQ ID NO: 20723 - DNA, 21 bp, Artificial sequence
  SiRNA target sequence
acatttttgaccaagatgacg

SEQ ID NO: 20724 - DNA, 21 bp, Artificial sequence
  SiRNA target sequence
catttttgaccaagatgacga

SEQ ID NO: 20725 - DNA, 21 bp, Artificial sequence
  SiRNA target sequence
atttttgaccaagatgacgac

SEQ ID NO: 20726 - DNA, 21 bp, Artificial sequence
  SiRNA target sequence
tttttgaccaagatgacgacc

SEQ ID NO: 20727 - DNA, 21 bp, Artificial sequence
  SiRNA target sequence
ttttgaccaagatgacgacca

SEQ ID NO: 20728 - DNA, 21 bp, Artificial sequence
  SiRNA target sequence
tttgaccaagatgacgaccac

SEQ ID NO: 20729 - DNA, 21 bp, Artificial sequence
  SiRNA target sequence
ttgaccaagatgacgaccact

SEQ ID NO: 20730 - DNA, 21 bp, Artificial sequence
  SiRNA target sequence
tgaccaagatgacgaccactt

SEQ ID NO: 20731 - DNA, 21 bp, Artificial sequence
  SiRNA target sequence
gaccaagatgacgaccacttt

SEQ ID NO: 20732 - DNA, 21 bp, Artificial sequence
  SiRNA target sequence
accaagatgacgaccactttt

SEQ ID NO: 20733 - DNA, 21 bp, Artificial sequence
  SiRNA target sequence
ccaagatgacgaccacttttg

SEQ ID NO: 20734 - DNA, 21 bp, Artificial sequence
  SiRNA target sequence
caagatgacgaccacttttga

SEQ ID NO: 20735 - DNA, 21 bp, Artificial sequence
  SiRNA target sequence
aagatgacgaccacttttgaa

SEQ ID NO: 20736 - DNA, 21 bp, Artificial sequence
  SiRNA target sequence
agatgacgaccacttttgaac

SEQ ID NO: 20737 - DNA, 21 bp, Artificial sequence
  SiRNA target sequence
gatgacgaccacttttgaaca

SEQ ID NO: 20738 - DNA, 21 bp, Artificial sequence
  SiRNA target sequence
atgacgaccacttttgaacaa

SEQ ID NO: 20739 - DNA, 21 bp, Artificial sequence
  SiRNA target sequence
tgacgaccacttttgaacaat

SEQ ID NO: 20740 - DNA, 21 bp, Artificial sequence
  SiRNA target sequence
gacgaccacttttgaacaatg

SEQ ID NO: 20741 - DNA, 21 bp, Artificial sequence
  SiRNA target sequence
acgaccacttttgaacaatgt

SEQ ID NO: 20742 - DNA, 21 bp, Artificial sequence
  SiRNA target sequence
cgaccacttttgaacaatgtg

SEQ ID NO: 20743 - DNA, 21 bp, Artificial sequence
  SiRNA target sequence
gaccacttttgaacaatgtgc

SEQ ID NO: 20744 - DNA, 21 bp, Artificial sequence
  SiRNA target sequence
accacttttgaacaatgtgcc

SEQ ID NO: 20745 - DNA, 21 bp, Artificial sequence
  SiRNA target sequence
ccacttttgaacaatgtgccg

SEQ ID NO: 20746 - DNA, 21 bp, Artificial sequence
  SiRNA target sequence
cacttttgaacaatgtgccga

SEQ ID NO: 20747 - DNA, 21 bp, Artificial sequence
  SiRNA target sequence
acttttgaacaatgtgccgaa

SEQ ID NO: 20748 - DNA, 21 bp, Artificial sequence
  SiRNA target sequence
cttttgaacaatgtgccgaag

SEQ ID NO: 20749 - DNA, 21 bp, Artificial sequence
  SiRNA target sequence
ttttgaacaatgtgccgaagc

SEQ ID NO: 20750 - DNA, 21 bp, Artificial sequence
  SiRNA target sequence
tttgaacaatgtgccgaagct

SEQ ID NO: 20751 - DNA, 21 bp, Artificial sequence
  SiRNA target sequence
ttgaacaatgtgccgaagctt

SEQ ID NO: 20752 - DNA, 21 bp, Artificial sequence
  SiRNA target sequence
tgaacaatgtgccgaagcttt

SEQ ID NO: 20753 - DNA, 21 bp, Artificial sequence
  SiRNA target sequence
gaacaatgtgccgaagctttt

SEQ ID NO: 20754 - DNA, 21 bp, Artificial sequence
  SiRNA target sequence
aacaatgtgccgaagctttta

SEQ ID NO: 20755 - DNA, 21 bp, Artificial sequence
  SiRNA target sequence
acaatgtgccgaagcttttaa

SEQ ID NO: 20756 - DNA, 21 bp, Artificial sequence
  SiRNA target sequence
caatgtgccgaagcttttaac

SEQ ID NO: 20757 - DNA, 21 bp, Artificial sequence
  SiRNA target sequence
aatgtgccgaagcttttaact

SEQ ID NO: 20758 - DNA, 21 bp, Artificial sequence
  SiRNA target sequence
atgtgccgaagcttttaactt

SEQ ID NO: 20759 - DNA, 21 bp, Artificial sequence
  SiRNA target sequence
tgtgccgaagcttttaacttt

SEQ ID NO: 20760 - DNA, 21 bp, Artificial sequence
  SiRNA target sequence
gtgccgaagcttttaacttta

SEQ ID NO: 20761 - DNA, 21 bp, Artificial sequence
  SiRNA target sequence
tgccgaagcttttaactttac

SEQ ID NO: 20762 - DNA, 21 bp, Artificial sequence
  SiRNA target sequence
gccgaagcttttaactttact

SEQ ID NO: 20763 - DNA, 21 bp, Artificial sequence
  SiRNA target sequence
ccgaagcttttaactttacta

SEQ ID NO: 20764 - DNA, 21 bp, Artificial sequence
  SiRNA target sequence
cgaagcttttaactttactat

SEQ ID NO: 20765 - DNA, 21 bp, Artificial sequence
  SiRNA target sequence
gaagcttttaactttactatg

SEQ ID NO: 20766 - DNA, 21 bp, Artificial sequence
  SiRNA target sequence
aagcttttaactttactatga

SEQ ID NO: 20767 - DNA, 21 bp, Artificial sequence
  SiRNA target sequence
agcttttaactttactatgag

SEQ ID NO: 20768 - DNA, 21 bp, Artificial sequence
  SiRNA target sequence
gcttttaactttactatgagc

SEQ ID NO: 20769 - DNA, 21 bp, Artificial sequence
  SiRNA target sequence
cttttaactttactatgagct

SEQ ID NO: 20770 - DNA, 21 bp, Artificial sequence
  SiRNA target sequence
ttttaactttactatgagctt

SEQ ID NO: 20771 - DNA, 21 bp, Artificial sequence
  SiRNA target sequence
tttaactttactatgagcttt

SEQ ID NO: 20772 - DNA, 21 bp, Artificial sequence
  SiRNA target sequence
ttaactttactatgagcttta

SEQ ID NO: 20773 - DNA, 21 bp, Artificial sequence
  SiRNA target sequence
taactttactatgagctttat

SEQ ID NO: 20774 - DNA, 21 bp, Artificial sequence
  SiRNA target sequence
aactttactatgagctttatg

SEQ ID NO: 20775 - DNA, 21 bp, Artificial sequence
  SiRNA target sequence
actttactatgagctttatga

SEQ ID NO: 20776 - DNA, 21 bp, Artificial sequence
  SiRNA target sequence
ctttactatgagctttatgag

SEQ ID NO: 20777 - DNA, 21 bp, Artificial sequence
  SiRNA target sequence
tttactatgagctttatgaga

SEQ ID NO: 20778 - DNA, 21 bp, Artificial sequence
  SiRNA target sequence
ttactatgagctttatgagat

SEQ ID NO: 20779 - DNA, 21 bp, Artificial sequence
  SiRNA target sequence
tactatgagctttatgagatt

SEQ ID NO: 20780 - DNA, 21 bp, Artificial sequence
  SiRNA target sequence
actatgagctttatgagattt

SEQ ID NO: 20781 - DNA, 21 bp, Artificial sequence
  SiRNA target sequence
ctatgagctttatgagatttt

SEQ ID NO: 20782 - DNA, 21 bp, Artificial sequence
  SiRNA target sequence
tatgagctttatgagattttt

SEQ ID NO: 20783 - DNA, 21 bp, Artificial sequence
  SiRNA target sequence
atgagctttatgagattttta

SEQ ID NO: 20784 - DNA, 21 bp, Artificial sequence
  SiRNA target sequence
tgagctttatgagatttttag

SEQ ID NO: 20785 - DNA, 21 bp, Artificial sequence
  SiRNA target sequence
gagctttatgagatttttagc

SEQ ID NO: 20786 - DNA, 21 bp, Artificial sequence
  SiRNA target sequence
agctttatgagatttttagca

SEQ ID NO: 20787 - DNA, 21 bp, Artificial sequence
  SiRNA target sequence
gctttatgagatttttagcat

SEQ ID NO: 20788 - DNA, 21 bp, Artificial sequence
  SiRNA target sequence
ctttatgagatttttagcatt

SEQ ID NO: 20789 - DNA, 21 bp, Artificial sequence
  SiRNA target sequence
tttatgagatttttagcatta

SEQ ID NO: 20790 - DNA, 21 bp, Artificial sequence
  SiRNA target sequence
ttatgagatttttagcattag

SEQ ID NO: 20791 - DNA, 21 bp, Artificial sequence
  SiRNA target sequence
tatgagatttttagcattagc

SEQ ID NO: 20792 - DNA, 21 bp, Artificial sequence
  SiRNA target sequence
atgagatttttagcattagcc

SEQ ID NO: 20793 - DNA, 21 bp, Artificial sequence
  SiRNA target sequence
tgagatttttagcattagcct

SEQ ID NO: 20794 - DNA, 21 bp, Artificial sequence
  SiRNA target sequence
gagatttttagcattagccta

SEQ ID NO: 20795 - DNA, 21 bp, Artificial sequence
  SiRNA target sequence
agatttttagcattagcctat

SEQ ID NO: 20796 - DNA, 21 bp, Artificial sequence
  SiRNA target sequence
gatttttagcattagcctatg

SEQ ID NO: 20797 - DNA, 21 bp, Artificial sequence
  SiRNA target sequence
atttttagcattagcctatgc

SEQ ID NO: 20798 - DNA, 21 bp, Artificial sequence
  SiRNA target sequence
tttttagcattagcctatgct

SEQ ID NO: 20799 - DNA, 21 bp, Artificial sequence
  SiRNA target sequence
ttttagcattagcctatgcta

SEQ ID NO: 20800 - DNA, 21 bp, Artificial sequence
  SiRNA target sequence
tttagcattagcctatgctat

SEQ ID NO: 20801 - DNA, 21 bp, Artificial sequence
  SiRNA target sequence
ttagcattagcctatgctatt

SEQ ID NO: 20802 - DNA, 21 bp, Artificial sequence
  SiRNA target sequence
tagcattagcctatgctattt

SEQ ID NO: 20803 - DNA, 21 bp, Artificial sequence
  SiRNA target sequence
agcattagcctatgctatttt

SEQ ID NO: 20804 - DNA, 21 bp, Artificial sequence
  SiRNA target sequence
gcattagcctatgctattttc

SEQ ID NO: 20805 - DNA, 21 bp, Artificial sequence
  SiRNA target sequence
cattagcctatgctattttct

SEQ ID NO: 20806 - DNA, 21 bp, Artificial sequence
  SiRNA target sequence
attagcctatgctattttctt

SEQ ID NO: 20807 - DNA, 21 bp, Artificial sequence
  SiRNA target sequence
ttagcctatgctattttcttt

SEQ ID NO: 20808 - DNA, 21 bp, Artificial sequence
  SiRNA target sequence
tagcctatgctattttctttc

SEQ ID NO: 20809 - DNA, 21 bp, Artificial sequence
  SiRNA target sequence
agcctatgctattttctttct

SEQ ID NO: 20810 - DNA, 21 bp, Artificial sequence
  SiRNA target sequence
gcctatgctattttctttctt

SEQ ID NO: 20811 - DNA, 21 bp, Artificial sequence
  SiRNA target sequence
cctatgctattttctttctta

SEQ ID NO: 20812 - DNA, 21 bp, Artificial sequence
  SiRNA target sequence
ctatgctattttctttcttat

SEQ ID NO: 20813 - DNA, 21 bp, Artificial sequence
  SiRNA target sequence
tatgctattttctttcttata

SEQ ID NO: 20814 - DNA, 21 bp, Artificial sequence
  SiRNA target sequence
atgctattttctttcttatat

SEQ ID NO: 20815 - DNA, 21 bp, Artificial sequence
  SiRNA target sequence
tgctattttctttcttatatc

SEQ ID NO: 20816 - DNA, 21 bp, Artificial sequence
  SiRNA target sequence
gctattttctttcttatatct

SEQ ID NO: 20817 - DNA, 21 bp, Artificial sequence
  SiRNA target sequence
ctattttctttcttatatctc

SEQ ID NO: 20818 - DNA, 21 bp, Artificial sequence
  SiRNA target sequence
tattttctttcttatatctcg

SEQ ID NO: 20819 - DNA, 21 bp, Artificial sequence
  SiRNA target sequence
attttctttcttatatctcga

SEQ ID NO: 20820 - DNA, 21 bp, Artificial sequence
  SiRNA target sequence
ttttctttcttatatctcgag

SEQ ID NO: 20821 - DNA, 21 bp, Artificial sequence
  SiRNA target sequence
tttctttcttatatctcgagc

SEQ ID NO: 20822 - DNA, 21 bp, Artificial sequence
  SiRNA target sequence
ttctttcttatatctcgagcg

SEQ ID NO: 20823 - DNA, 21 bp, Artificial sequence
  SiRNA target sequence
tctttcttatatctcgagcga

SEQ ID NO: 20824 - DNA, 21 bp, Artificial sequence
  SiRNA target sequence
ctttcttatatctcgagcgac

SEQ ID NO: 20825 - DNA, 21 bp, Artificial sequence
  SiRNA target sequence
tttcttatatctcgagcgact

SEQ ID NO: 20826 - DNA, 21 bp, Artificial sequence
  SiRNA target sequence
ttcttatatctcgagcgacta

SEQ ID NO: 20827 - DNA, 21 bp, Artificial sequence
  SiRNA target sequence
tcttatatctcgagcgactaa

SEQ ID NO: 20828 - DNA, 21 bp, Artificial sequence
  SiRNA target sequence
cttatatctcgagcgactaaa

SEQ ID NO: 20829 - DNA, 21 bp, Artificial sequence
  SiRNA target sequence
ttatatctcgagcgactaaat

SEQ ID NO: 20830 - DNA, 21 bp, Artificial sequence
  SiRNA target sequence
tatatctcgagcgactaaatt

SEQ ID NO: 20831 - DNA, 21 bp, Artificial sequence
  SiRNA target sequence
atatctcgagcgactaaattt

SEQ ID NO: 20832 - DNA, 21 bp, Artificial sequence
  SiRNA target sequence
tatctcgagcgactaaatttt

SEQ ID NO: 20833 - DNA, 21 bp, Artificial sequence
  SiRNA target sequence
atctcgagcgactaaattttt

SEQ ID NO: 20834 - DNA, 21 bp, Artificial sequence
  SiRNA target sequence
tctcgagcgactaaatttttc

SEQ ID NO: 20835 - DNA, 21 bp, Artificial sequence
  SiRNA target sequence
ctcgagcgactaaatttttcg

SEQ ID NO: 20836 - DNA, 21 bp, Artificial sequence
  SiRNA target sequence
tcgagcgactaaatttttcgg

SEQ ID NO: 20837 - DNA, 21 bp, Artificial sequence
  SiRNA target sequence
cgagcgactaaatttttcggg

SEQ ID NO: 20838 - DNA, 21 bp, Artificial sequence
  SiRNA target sequence
gagcgactaaatttttcgggg

SEQ ID NO: 20839 - DNA, 21 bp, Artificial sequence
  SiRNA target sequence
agcgactaaatttttcggggc

SEQ ID NO: 20840 - DNA, 21 bp, Artificial sequence
  SiRNA target sequence
gcgactaaatttttcggggcc

SEQ ID NO: 20841 - DNA, 21 bp, Artificial sequence
  SiRNA target sequence
cgactaaatttttcggggcct

SEQ ID NO: 20842 - DNA, 21 bp, Artificial sequence
  SiRNA target sequence
gactaaatttttcggggcctc

SEQ ID NO: 20843 - DNA, 21 bp, Artificial sequence
  SiRNA target sequence
actaaatttttcggggcctct

SEQ ID NO: 20844 - DNA, 21 bp, Artificial sequence
  SiRNA target sequence
ctaaatttttcggggcctctt

SEQ ID NO: 20845 - DNA, 21 bp, Artificial sequence
  SiRNA target sequence
taaatttttcggggcctcttt

SEQ ID NO: 20846 - DNA, 21 bp, Artificial sequence
  SiRNA target sequence
aaatttttcggggcctctttt

SEQ ID NO: 20847 - DNA, 21 bp, Artificial sequence
  SiRNA target sequence
aatttttcggggcctcttttt

SEQ ID NO: 20848 - DNA, 21 bp, Artificial sequence
  SiRNA target sequence
atttttcggggcctctttttc

SEQ ID NO: 20849 - DNA, 21 bp, Artificial sequence
  SiRNA target sequence
tttttcggggcctctttttct

SEQ ID NO: 20850 - DNA, 21 bp, Artificial sequence
  SiRNA target sequence
ttttcggggcctctttttcta

SEQ ID NO: 20851 - DNA, 21 bp, Artificial sequence
  SiRNA target sequence
tttcggggcctctttttctac

SEQ ID NO: 20852 - DNA, 21 bp, Artificial sequence
  SiRNA target sequence
ttcggggcctctttttctact

SEQ ID NO: 20853 - DNA, 21 bp, Artificial sequence
  SiRNA target sequence
tcggggcctctttttctacta

SEQ ID NO: 20854 - DNA, 21 bp, Artificial sequence
  SiRNA target sequence
cggggcctctttttctactat

SEQ ID NO: 20855 - DNA, 21 bp, Artificial sequence
  SiRNA target sequence
ggggcctctttttctactata

SEQ ID NO: 20856 - DNA, 21 bp, Artificial sequence
  SiRNA target sequence
gggcctctttttctactatat

SEQ ID NO: 20857 - DNA, 21 bp, Artificial sequence
  SiRNA target sequence
ggcctctttttctactatatc

SEQ ID NO: 20858 - DNA, 21 bp, Artificial sequence
  SiRNA target sequence
gcctctttttctactatatct

SEQ ID NO: 20859 - DNA, 21 bp, Artificial sequence
  SiRNA target sequence
cctctttttctactatatcta

SEQ ID NO: 20860 - DNA, 21 bp, Artificial sequence
  SiRNA target sequence
ctctttttctactatatctac

SEQ ID NO: 20861 - DNA, 21 bp, Artificial sequence
  SiRNA target sequence
tctttttctactatatctact

SEQ ID NO: 20862 - DNA, 21 bp, Artificial sequence
  SiRNA target sequence
ctttttctactatatctactg

SEQ ID NO: 20863 - DNA, 21 bp, Artificial sequence
  SiRNA target sequence
tttttctactatatctactgt

SEQ ID NO: 20864 - DNA, 21 bp, Artificial sequence
  SiRNA target sequence
ttttctactatatctactgtt

SEQ ID NO: 20865 - DNA, 21 bp, Artificial sequence
  SiRNA target sequence
tttctactatatctactgttt

SEQ ID NO: 20866 - DNA, 21 bp, Artificial sequence
  SiRNA target sequence
ttctactatatctactgtttt

SEQ ID NO: 20867 - DNA, 21 bp, Artificial sequence
  SiRNA target sequence
tctactatatctactgttttg

SEQ ID NO: 20868 - DNA, 21 bp, Artificial sequence
  SiRNA target sequence
ctactatatctactgttttga

SEQ ID NO: 20869 - DNA, 21 bp, Artificial sequence
  SiRNA target sequence
tactatatctactgttttgat

SEQ ID NO: 20870 - DNA, 21 bp, Artificial sequence
  SiRNA target sequence
actatatctactgttttgata

SEQ ID NO: 20871 - DNA, 21 bp, Artificial sequence
  SiRNA target sequence
ctatatctactgttttgataa

SEQ ID NO: 20872 - DNA, 21 bp, Artificial sequence
  SiRNA target sequence
tatatctactgttttgataac

SEQ ID NO: 20873 - DNA, 21 bp, Artificial sequence
  SiRNA target sequence
atatctactgttttgataact

SEQ ID NO: 20874 - DNA, 21 bp, Artificial sequence
  SiRNA target sequence
tatctactgttttgataactc

SEQ ID NO: 20875 - DNA, 21 bp, Artificial sequence
  SiRNA target sequence
atctactgttttgataactct

SEQ ID NO: 20876 - DNA, 21 bp, Artificial sequence
  SiRNA target sequence
tctactgttttgataactctt

SEQ ID NO: 20877 - DNA, 21 bp, Artificial sequence
  SiRNA target sequence
ctactgttttgataactctta

SEQ ID NO: 20878 - DNA, 21 bp, Artificial sequence
  SiRNA target sequence
tactgttttgataactcttat

SEQ ID NO: 20879 - DNA, 21 bp, Artificial sequence
  SiRNA target sequence
actgttttgataactcttatc

SEQ ID NO: 20880 - DNA, 21 bp, Artificial sequence
  SiRNA target sequence
ctgttttgataactcttatca

SEQ ID NO: 20881 - DNA, 21 bp, Artificial sequence
  SiRNA target sequence
tgttttgataactcttatcac

SEQ ID NO: 20882 - DNA, 21 bp, Artificial sequence
  SiRNA target sequence
gttttgataactcttatcact

SEQ ID NO: 20883 - DNA, 21 bp, Artificial sequence
  SiRNA target sequence
ttttgataactcttatcacta

SEQ ID NO: 20884 - DNA, 21 bp, Artificial sequence
  SiRNA target sequence
tttgataactcttatcactat

SEQ ID NO: 20885 - DNA, 21 bp, Artificial sequence
  SiRNA target sequence
ttgataactcttatcactatg

SEQ ID NO: 20886 - DNA, 21 bp, Artificial sequence
  SiRNA target sequence
tgataactcttatcactatga

SEQ ID NO: 20887 - DNA, 21 bp, Artificial sequence
  SiRNA target sequence
gataactcttatcactatgac

SEQ ID NO: 20888 - DNA, 21 bp, Artificial sequence
  SiRNA target sequence
ataactcttatcactatgaca

SEQ ID NO: 20889 - DNA, 21 bp, Artificial sequence
  SiRNA target sequence
taactcttatcactatgacag

SEQ ID NO: 20890 - DNA, 21 bp, Artificial sequence
  SiRNA target sequence
aactcttatcactatgacagt

SEQ ID NO: 20891 - DNA, 21 bp, Artificial sequence
  SiRNA target sequence
actcttatcactatgacagtt

SEQ ID NO: 20892 - DNA, 21 bp, Artificial sequence
  SiRNA target sequence
ctcttatcactatgacagtta

SEQ ID NO: 20893 - DNA, 21 bp, Artificial sequence
  SiRNA target sequence
tcttatcactatgacagttac

SEQ ID NO: 20894 - DNA, 21 bp, Artificial sequence
  SiRNA target sequence
cttatcactatgacagttaca

SEQ ID NO: 20895 - DNA, 21 bp, Artificial sequence
  SiRNA target sequence
ttatcactatgacagttacag

SEQ ID NO: 20896 - DNA, 21 bp, Artificial sequence
  SiRNA target sequence
tatcactatgacagttacaga

SEQ ID NO: 20897 - DNA, 21 bp, Artificial sequence
  SiRNA target sequence
atcactatgacagttacagat

SEQ ID NO: 20898 - DNA, 21 bp, Artificial sequence
  SiRNA target sequence
tcactatgacagttacagata

SEQ ID NO: 20899 - DNA, 21 bp, Artificial sequence
  SiRNA target sequence
cactatgacagttacagataa

SEQ ID NO: 20900 - DNA, 21 bp, Artificial sequence
  SiRNA target sequence
actatgacagttacagataag

SEQ ID NO: 20901 - DNA, 21 bp, Artificial sequence
  SiRNA target sequence
ctatgacagttacagataagt

SEQ ID NO: 20902 - DNA, 21 bp, Artificial sequence
  SiRNA target sequence
tatgacagttacagataagtt

SEQ ID NO: 20903 - DNA, 21 bp, Artificial sequence
  SiRNA target sequence
atgacagttacagataagttg

SEQ ID NO: 20904 - DNA, 21 bp, Artificial sequence
  SiRNA target sequence
tgacagttacagataagttgg

SEQ ID NO: 20905 - DNA, 21 bp, Artificial sequence
  SiRNA target sequence
gacagttacagataagttggt

SEQ ID NO: 20906 - DNA, 21 bp, Artificial sequence
  SiRNA target sequence
acagttacagataagttggtt

SEQ ID NO: 20907 - DNA, 21 bp, Artificial sequence
  SiRNA target sequence
cagttacagataagttggtta

SEQ ID NO: 20908 - DNA, 21 bp, Artificial sequence
  SiRNA target sequence
agttacagataagttggttaa

SEQ ID NO: 20909 - DNA, 21 bp, Artificial sequence
  SiRNA target sequence
gttacagataagttggttaag

SEQ ID NO: 20910 - DNA, 21 bp, Artificial sequence
  SiRNA target sequence
ttacagataagttggttaaga

SEQ ID NO: 20911 - DNA, 21 bp, Artificial sequence
  SiRNA target sequence
tacagataagttggttaagaa

SEQ ID NO: 20912 - DNA, 21 bp, Artificial sequence
  SiRNA target sequence
acagataagttggttaagaag

SEQ ID NO: 20913 - DNA, 21 bp, Artificial sequence
  SiRNA target sequence
cagataagttggttaagaagt

SEQ ID NO: 20914 - DNA, 21 bp, Artificial sequence
  SiRNA target sequence
agataagttggttaagaagtt

SEQ ID NO: 20915 - DNA, 21 bp, Artificial sequence
  SiRNA target sequence
gataagttggttaagaagttc

SEQ ID NO: 20916 - DNA, 21 bp, Artificial sequence
  SiRNA target sequence
ataagttggttaagaagttcc

SEQ ID NO: 20917 - DNA, 21 bp, Artificial sequence
  SiRNA target sequence
taagttggttaagaagttcct

SEQ ID NO: 20918 - DNA, 21 bp, Artificial sequence
  SiRNA target sequence
aagttggttaagaagttcctc

SEQ ID NO: 20919 - DNA, 21 bp, Artificial sequence
  SiRNA target sequence
agttggttaagaagttcctcg

SEQ ID NO: 20920 - DNA, 21 bp, Artificial sequence
  SiRNA target sequence
gttggttaagaagttcctcgt

SEQ ID NO: 20921 - DNA, 21 bp, Artificial sequence
  SiRNA target sequence
ttggttaagaagttcctcgtt

SEQ ID NO: 20922 - DNA, 21 bp, Artificial sequence
  SiRNA target sequence
tggttaagaagttcctcgttg

SEQ ID NO: 20923 - DNA, 21 bp, Artificial sequence
  SiRNA target sequence
ggttaagaagttcctcgttga

SEQ ID NO: 20924 - DNA, 21 bp, Artificial sequence
  SiRNA target sequence
gttaagaagttcctcgttgat

SEQ ID NO: 20925 - DNA, 21 bp, Artificial sequence
  SiRNA target sequence
ttaagaagttcctcgttgatt

SEQ ID NO: 20926 - DNA, 21 bp, Artificial sequence
  SiRNA target sequence
taagaagttcctcgttgatta

SEQ ID NO: 20927 - DNA, 21 bp, Artificial sequence
  SiRNA target sequence
aagaagttcctcgttgattat

SEQ ID NO: 20928 - DNA, 21 bp, Artificial sequence
  SiRNA target sequence
agaagttcctcgttgattatt

SEQ ID NO: 20929 - DNA, 21 bp, Artificial sequence
  SiRNA target sequence
gaagttcctcgttgattatta

SEQ ID NO: 20930 - DNA, 21 bp, Artificial sequence
  SiRNA target sequence
aagttcctcgttgattattat

SEQ ID NO: 20931 - DNA, 21 bp, Artificial sequence
  SiRNA target sequence
agttcctcgttgattattatt

SEQ ID NO: 20932 - DNA, 21 bp, Artificial sequence
  SiRNA target sequence
gttcctcgttgattattattc

SEQ ID NO: 20933 - DNA, 21 bp, Artificial sequence
  SiRNA target sequence
ttcctcgttgattattattcg

SEQ ID NO: 20934 - DNA, 21 bp, Artificial sequence
  SiRNA target sequence
tcctcgttgattattattcga

SEQ ID NO: 20935 - DNA, 21 bp, Artificial sequence
  SiRNA target sequence
cctcgttgattattattcgaa

SEQ ID NO: 20936 - DNA, 21 bp, Artificial sequence
  SiRNA target sequence
ctcgttgattattattcgaaa

SEQ ID NO: 20937 - DNA, 21 bp, Artificial sequence
  SiRNA target sequence
tcgttgattattattcgaaac

SEQ ID NO: 20938 - DNA, 21 bp, Artificial sequence
  SiRNA target sequence
cgttgattattattcgaaaca

SEQ ID NO: 20939 - DNA, 21 bp, Artificial sequence
  SiRNA target sequence
gttgattattattcgaaacac

SEQ ID NO: 20940 - DNA, 21 bp, Artificial sequence
  SiRNA target sequence
ttgattattattcgaaacaca

SEQ ID NO: 20941 - DNA, 21 bp, Artificial sequence
  SiRNA target sequence
tgattattattcgaaacacat

SEQ ID NO: 20942 - DNA, 21 bp, Artificial sequence
  SiRNA target sequence
gattattattcgaaacacatg

SEQ ID NO: 20943 - DNA, 21 bp, Artificial sequence
  SiRNA target sequence
attattattcgaaacacatgg

SEQ ID NO: 20944 - DNA, 21 bp, Artificial sequence
  SiRNA target sequence
ttattattcgaaacacatgga

SEQ ID NO: 20945 - DNA, 21 bp, Artificial sequence
  SiRNA target sequence
tattattcgaaacacatggag

SEQ ID NO: 20946 - DNA, 21 bp, Artificial sequence
  SiRNA target sequence
attattcgaaacacatggaga

SEQ ID NO: 20947 - DNA, 21 bp, Artificial sequence
  SiRNA target sequence
ttattcgaaacacatggagaa

SEQ ID NO: 20948 - DNA, 21 bp, Artificial sequence
  SiRNA target sequence
tattcgaaacacatggagaat

SEQ ID NO: 20949 - DNA, 21 bp, Artificial sequence
  SiRNA target sequence
attcgaaacacatggagaatg

SEQ ID NO: 20950 - DNA, 21 bp, Artificial sequence
  SiRNA target sequence
ttcgaaacacatggagaatgc

SEQ ID NO: 20951 - DNA, 21 bp, Artificial sequence
  SiRNA target sequence
tcgaaacacatggagaatgcg

SEQ ID NO: 20952 - DNA, 21 bp, Artificial sequence
  SiRNA target sequence
cgaaacacatggagaatgcga

SEQ ID NO: 20953 - DNA, 21 bp, Artificial sequence
  SiRNA target sequence
gaaacacatggagaatgcgaa

SEQ ID NO: 20954 - DNA, 21 bp, Artificial sequence
  SiRNA target sequence
aaacacatggagaatgcgaaa

SEQ ID NO: 20955 - DNA, 21 bp, Artificial sequence
  SiRNA target sequence
aacacatggagaatgcgaaaa

SEQ ID NO: 20956 - DNA, 21 bp, Artificial sequence
  SiRNA target sequence
acacatggagaatgcgaaaat

SEQ ID NO: 20957 - DNA, 21 bp, Artificial sequence
  SiRNA target sequence
cacatggagaatgcgaaaatg

SEQ ID NO: 20958 - DNA, 21 bp, Artificial sequence
  SiRNA target sequence
acatggagaatgcgaaaatgt

SEQ ID NO: 20959 - DNA, 21 bp, Artificial sequence
  SiRNA target sequence
catggagaatgcgaaaatgtt

SEQ ID NO: 20960 - DNA, 21 bp, Artificial sequence
  SiRNA target sequence
atggagaatgcgaaaatgttg

SEQ ID NO: 20961 - DNA, 21 bp, Artificial sequence
  SiRNA target sequence
tggagaatgcgaaaatgttgg

SEQ ID NO: 20962 - DNA, 21 bp, Artificial sequence
  SiRNA target sequence
ggagaatgcgaaaatgttggc

SEQ ID NO: 20963 - DNA, 21 bp, Artificial sequence
  SiRNA target sequence
gagaatgcgaaaatgttggca

SEQ ID NO: 20964 - DNA, 21 bp, Artificial sequence
  SiRNA target sequence
agaatgcgaaaatgttggcac

SEQ ID NO: 20965 - DNA, 21 bp, Artificial sequence
  SiRNA target sequence
gaatgcgaaaatgttggcaca

SEQ ID NO: 20966 - DNA, 21 bp, Artificial sequence
  SiRNA target sequence
aatgcgaaaatgttggcacaa

SEQ ID NO: 20967 - DNA, 21 bp, Artificial sequence
  SiRNA target sequence
atgcgaaaatgttggcacaag

SEQ ID NO: 20968 - DNA, 21 bp, Artificial sequence
  SiRNA target sequence
tgcgaaaatgttggcacaagc

SEQ ID NO: 20969 - DNA, 21 bp, Artificial sequence
  SiRNA target sequence
gcgaaaatgttggcacaagca

SEQ ID NO: 20970 - DNA, 21 bp, Artificial sequence
  SiRNA target sequence
cgaaaatgttggcacaagcag

SEQ ID NO: 20971 - DNA, 21 bp, Artificial sequence
  SiRNA target sequence
gaaaatgttggcacaagcagg

SEQ ID NO: 20972 - DNA, 21 bp, Artificial sequence
  SiRNA target sequence
aaaatgttggcacaagcagga

SEQ ID NO: 20973 - DNA, 21 bp, Artificial sequence
  SiRNA target sequence
aaatgttggcacaagcaggag

SEQ ID NO: 20974 - DNA, 21 bp, Artificial sequence
  SiRNA target sequence
aatgttggcacaagcaggaga

SEQ ID NO: 20975 - DNA, 21 bp, Artificial sequence
  SiRNA target sequence
atgttggcacaagcaggagaa

SEQ ID NO: 20976 - DNA, 21 bp, Artificial sequence
  SiRNA target sequence
tgttggcacaagcaggagaag

SEQ ID NO: 20977 - DNA, 21 bp, Artificial sequence
  SiRNA target sequence
gttggcacaagcaggagaaga

SEQ ID NO: 20978 - DNA, 21 bp, Artificial sequence
  SiRNA target sequence
ttggcacaagcaggagaagaa

SEQ ID NO: 20979 - DNA, 21 bp, Artificial sequence
  SiRNA target sequence
tggcacaagcaggagaagaag

SEQ ID NO: 20980 - DNA, 21 bp, Artificial sequence
  SiRNA target sequence
ggcacaagcaggagaagaaga

SEQ ID NO: 20981 - DNA, 21 bp, Artificial sequence
  SiRNA target sequence
gcacaagcaggagaagaagat

SEQ ID NO: 20982 - DNA, 21 bp, Artificial sequence
  SiRNA target sequence
cacaagcaggagaagaagatt

SEQ ID NO: 20983 - DNA, 21 bp, Artificial sequence
  SiRNA target sequence
acaagcaggagaagaagattc

SEQ ID NO: 20984 - DNA, 21 bp, Artificial sequence
  SiRNA target sequence
caagcaggagaagaagattcg

SEQ ID NO: 20985 - DNA, 21 bp, Artificial sequence
  SiRNA target sequence
aagcaggagaagaagattcgt

SEQ ID NO: 20986 - DNA, 21 bp, Artificial sequence
  SiRNA target sequence
agcaggagaagaagattcgtc

SEQ ID NO: 20987 - DNA, 21 bp, Artificial sequence
  SiRNA target sequence
gcaggagaagaagattcgtca

SEQ ID NO: 20988 - DNA, 21 bp, Artificial sequence
  SiRNA target sequence
caggagaagaagattcgtcat

SEQ ID NO: 20989 - DNA, 21 bp, Artificial sequence
  SiRNA target sequence
aggagaagaagattcgtcatt

SEQ ID NO: 20990 - DNA, 21 bp, Artificial sequence
  SiRNA target sequence
ggagaagaagattcgtcattt

SEQ ID NO: 20991 - DNA, 21 bp, Artificial sequence
  SiRNA target sequence
gagaagaagattcgtcatttt

SEQ ID NO: 20992 - DNA, 21 bp, Artificial sequence
  SiRNA target sequence
agaagaagattcgtcattttt

SEQ ID NO: 20993 - DNA, 21 bp, Artificial sequence
  SiRNA target sequence
gaagaagattcgtcatttttg

SEQ ID NO: 20994 - DNA, 21 bp, Artificial sequence
  SiRNA target sequence
aagaagattcgtcatttttgt

SEQ ID NO: 20995 - DNA, 21 bp, Artificial sequence
  SiRNA target sequence
agaagattcgtcatttttgtc

SEQ ID NO: 20996 - DNA, 21 bp, Artificial sequence
  SiRNA target sequence
gaagattcgtcatttttgtct

SEQ ID NO: 20997 - DNA, 21 bp, Artificial sequence
  SiRNA target sequence
aagattcgtcatttttgtctt

SEQ ID NO: 20998 - DNA, 21 bp, Artificial sequence
  SiRNA target sequence
agattcgtcatttttgtctta

SEQ ID NO: 20999 - DNA, 21 bp, Artificial sequence
  SiRNA target sequence
gattcgtcatttttgtcttat

SEQ ID NO: 21000 - DNA, 21 bp, Artificial sequence
  SiRNA target sequence
attcgtcatttttgtcttatg

SEQ ID NO: 21001 - DNA, 21 bp, Artificial sequence
  SiRNA target sequence
ttcgtcatttttgtcttatgt

SEQ ID NO: 21002 - DNA, 21 bp, Artificial sequence
  SiRNA target sequence
tcgtcatttttgtcttatgtt

SEQ ID NO: 21003 - DNA, 21 bp, Artificial sequence
  SiRNA target sequence
cgtcatttttgtcttatgtta

SEQ ID NO: 21004 - DNA, 21 bp, Artificial sequence
  SiRNA target sequence
gtcatttttgtcttatgttat

SEQ ID NO: 21005 - DNA, 21 bp, Artificial sequence
  SiRNA target sequence
tcatttttgtcttatgttatc

SEQ ID NO: 21006 - DNA, 21 bp, Artificial sequence
  SiRNA target sequence
catttttgtcttatgttatcc

SEQ ID NO: 21007 - DNA, 21 bp, Artificial sequence
  SiRNA target sequence
atttttgtcttatgttatccc

SEQ ID NO: 21008 - DNA, 21 bp, Artificial sequence
  SiRNA target sequence
tttttgtcttatgttatccca

SEQ ID NO: 21009 - DNA, 21 bp, Artificial sequence
  SiRNA target sequence
ttttgtcttatgttatcccac

SEQ ID NO: 21010 - DNA, 21 bp, Artificial sequence
  SiRNA target sequence
tttgtcttatgttatcccacc

SEQ ID NO: 21011 - DNA, 21 bp, Artificial sequence
  SiRNA target sequence
ttgtcttatgttatcccacca

SEQ ID NO: 21012 - DNA, 21 bp, Artificial sequence
  SiRNA target sequence
tgtcttatgttatcccaccat

SEQ ID NO: 21013 - DNA, 21 bp, Artificial sequence
  SiRNA target sequence
gtcttatgttatcccaccatt

SEQ ID NO: 21014 - DNA, 21 bp, Artificial sequence
  SiRNA target sequence
tcttatgttatcccaccattg

SEQ ID NO: 21015 - DNA, 21 bp, Artificial sequence
  SiRNA target sequence
cttatgttatcccaccattgt

SEQ ID NO: 21016 - DNA, 21 bp, Artificial sequence
  SiRNA target sequence
ttatgttatcccaccattgtt

SEQ ID NO: 21017 - DNA, 21 bp, Artificial sequence
  SiRNA target sequence
tatgttatcccaccattgttc

SEQ ID NO: 21018 - DNA, 21 bp, Artificial sequence
  SiRNA target sequence
atgttatcccaccattgttcc

SEQ ID NO: 21019 - DNA, 21 bp, Artificial sequence
  SiRNA target sequence
tgttatcccaccattgttcct

SEQ ID NO: 21020 - DNA, 21 bp, Artificial sequence
  SiRNA target sequence
gttatcccaccattgttccta

SEQ ID NO: 21021 - DNA, 21 bp, Artificial sequence
  SiRNA target sequence
ttatcccaccattgttcctag

SEQ ID NO: 21022 - DNA, 21 bp, Artificial sequence
  SiRNA target sequence
tatcccaccattgttcctaga

SEQ ID NO: 21023 - DNA, 21 bp, Artificial sequence
  SiRNA target sequence
atcccaccattgttcctagaa

SEQ ID NO: 21024 - DNA, 21 bp, Artificial sequence
  SiRNA target sequence
tcccaccattgttcctagaat

SEQ ID NO: 21025 - DNA, 21 bp, Artificial sequence
  SiRNA target sequence
cccaccattgttcctagaatc

SEQ ID NO: 21026 - DNA, 21 bp, Artificial sequence
  SiRNA target sequence
ccaccattgttcctagaatct

SEQ ID NO: 21027 - DNA, 21 bp, Artificial sequence
  SiRNA target sequence
caccattgttcctagaatctg

SEQ ID NO: 21028 - DNA, 21 bp, Artificial sequence
  SiRNA target sequence
accattgttcctagaatctgt

SEQ ID NO: 21029 - DNA, 21 bp, Artificial sequence
  SiRNA target sequence
ccattgttcctagaatctgta

SEQ ID NO: 21030 - DNA, 21 bp, Artificial sequence
  SiRNA target sequence
cattgttcctagaatctgtag

SEQ ID NO: 21031 - DNA, 21 bp, Artificial sequence
  SiRNA target sequence
attgttcctagaatctgtagt

SEQ ID NO: 21032 - DNA, 21 bp, Artificial sequence
  SiRNA target sequence
ttgttcctagaatctgtagtc

SEQ ID NO: 21033 - DNA, 21 bp, Artificial sequence
  SiRNA target sequence
tgttcctagaatctgtagtcg

SEQ ID NO: 21034 - DNA, 21 bp, Artificial sequence
  SiRNA target sequence
gttcctagaatctgtagtcga

SEQ ID NO: 21035 - DNA, 21 bp, Artificial sequence
  SiRNA target sequence
ttcctagaatctgtagtcgat

SEQ ID NO: 21036 - DNA, 21 bp, Artificial sequence
  SiRNA target sequence
tcctagaatctgtagtcgatt

SEQ ID NO: 21037 - DNA, 21 bp, Artificial sequence
  SiRNA target sequence
cctagaatctgtagtcgattc

SEQ ID NO: 21038 - DNA, 21 bp, Artificial sequence
  SiRNA target sequence
ctagaatctgtagtcgattct

SEQ ID NO: 21039 - DNA, 21 bp, Artificial sequence
  SiRNA target sequence
tagaatctgtagtcgattcta

SEQ ID NO: 21040 - DNA, 21 bp, Artificial sequence
  SiRNA target sequence
agaatctgtagtcgattctaa

SEQ ID NO: 21041 - DNA, 21 bp, Artificial sequence
  SiRNA target sequence
gaatctgtagtcgattctaaa

SEQ ID NO: 21042 - DNA, 21 bp, Artificial sequence
  SiRNA target sequence
aatctgtagtcgattctaaat

SEQ ID NO: 21043 - DNA, 21 bp, Artificial sequence
  SiRNA target sequence
atctgtagtcgattctaaatc

SEQ ID NO: 21044 - DNA, 21 bp, Artificial sequence
  SiRNA target sequence
tctgtagtcgattctaaatca

SEQ ID NO: 21045 - DNA, 21 bp, Artificial sequence
  SiRNA target sequence
ctgtagtcgattctaaatcaa

SEQ ID NO: 21046 - DNA, 21 bp, Artificial sequence
  SiRNA target sequence
tgtagtcgattctaaatcaaa

SEQ ID NO: 21047 - DNA, 21 bp, Artificial sequence
  SiRNA target sequence
gtagtcgattctaaatcaaat

SEQ ID NO: 21048 - DNA, 21 bp, Artificial sequence
  SiRNA target sequence
tagtcgattctaaatcaaatt

SEQ ID NO: 21049 - DNA, 21 bp, Artificial sequence
  SiRNA target sequence
agtcgattctaaatcaaattt

SEQ ID NO: 21050 - DNA, 21 bp, Artificial sequence
  SiRNA target sequence
gtcgattctaaatcaaatttg

SEQ ID NO: 21051 - DNA, 21 bp, Artificial sequence
  SiRNA target sequence
tcgattctaaatcaaatttgt

SEQ ID NO: 21052 - DNA, 21 bp, Artificial sequence
  SiRNA target sequence
cgattctaaatcaaatttgtt

SEQ ID NO: 21053 - DNA, 21 bp, Artificial sequence
  SiRNA target sequence
gattctaaatcaaatttgttt

SEQ ID NO: 21054 - DNA, 21 bp, Artificial sequence
  SiRNA target sequence
attctaaatcaaatttgttta

SEQ ID NO: 21055 - DNA, 21 bp, Artificial sequence
  SiRNA target sequence
ttctaaatcaaatttgtttaa

SEQ ID NO: 21056 - DNA, 21 bp, Artificial sequence
  SiRNA target sequence
tctaaatcaaatttgtttaag

SEQ ID NO: 21057 - DNA, 21 bp, Artificial sequence
  SiRNA target sequence
ctaaatcaaatttgtttaagc

SEQ ID NO: 21058 - DNA, 21 bp, Artificial sequence
  SiRNA target sequence
taaatcaaatttgtttaagcg

SEQ ID NO: 21059 - DNA, 21 bp, Artificial sequence
  SiRNA target sequence
aaatcaaatttgtttaagcga

SEQ ID NO: 21060 - DNA, 21 bp, Artificial sequence
  SiRNA target sequence
aatcaaatttgtttaagcgaa

SEQ ID NO: 21061 - DNA, 21 bp, Artificial sequence
  SiRNA target sequence
atcaaatttgtttaagcgaat

SEQ ID NO: 21062 - DNA, 21 bp, Artificial sequence
  SiRNA target sequence
tcaaatttgtttaagcgaatt

SEQ ID NO: 21063 - DNA, 21 bp, Artificial sequence
  SiRNA target sequence
caaatttgtttaagcgaattt

SEQ ID NO: 21064 - DNA, 21 bp, Artificial sequence
  SiRNA target sequence
aaatttgtttaagcgaatttg

SEQ ID NO: 21065 - DNA, 21 bp, Artificial sequence
  SiRNA target sequence
aatttgtttaagcgaatttgg

SEQ ID NO: 21066 - DNA, 21 bp, Artificial sequence
  SiRNA target sequence
atttgtttaagcgaatttgga

SEQ ID NO: 21067 - DNA, 21 bp, Artificial sequence
  SiRNA target sequence
tttgtttaagcgaatttggag

SEQ ID NO: 21068 - DNA, 21 bp, Artificial sequence
  SiRNA target sequence
ttgtttaagcgaatttggaga

SEQ ID NO: 21069 - DNA, 21 bp, Artificial sequence
  SiRNA target sequence
tgtttaagcgaatttggagaa

SEQ ID NO: 21070 - DNA, 21 bp, Artificial sequence
  SiRNA target sequence
gtttaagcgaatttggagaag

SEQ ID NO: 21071 - DNA, 21 bp, Artificial sequence
  SiRNA target sequence
tttaagcgaatttggagaagt

SEQ ID NO: 21072 - DNA, 21 bp, Artificial sequence
  SiRNA target sequence
ttaagcgaatttggagaagta

SEQ ID NO: 21073 - DNA, 21 bp, Artificial sequence
  SiRNA target sequence
taagcgaatttggagaagtaa

SEQ ID NO: 21074 - DNA, 21 bp, Artificial sequence
  SiRNA target sequence
aagcgaatttggagaagtaaa

SEQ ID NO: 21075 - DNA, 21 bp, Artificial sequence
  SiRNA target sequence
agcgaatttggagaagtaaag

SEQ ID NO: 21076 - DNA, 21 bp, Artificial sequence
  SiRNA target sequence
gcgaatttggagaagtaaaga

SEQ ID NO: 21077 - DNA, 21 bp, Artificial sequence
  SiRNA target sequence
cgaatttggagaagtaaagat

SEQ ID NO: 21078 - DNA, 21 bp, Artificial sequence
  SiRNA target sequence
gaatttggagaagtaaagatt

SEQ ID NO: 21079 - DNA, 21 bp, Artificial sequence
  SiRNA target sequence
aatttggagaagtaaagattt

SEQ ID NO: 21080 - DNA, 21 bp, Artificial sequence
  SiRNA target sequence
atttggagaagtaaagatttg

SEQ ID NO: 21081 - DNA, 21 bp, Artificial sequence
  SiRNA target sequence
tttggagaagtaaagatttgg

SEQ ID NO: 21082 - DNA, 21 bp, Artificial sequence
  SiRNA target sequence
ttggagaagtaaagatttgga

SEQ ID NO: 21083 - DNA, 21 bp, Artificial sequence
  SiRNA target sequence
tggagaagtaaagatttggat

SEQ ID NO: 21084 - DNA, 21 bp, Artificial sequence
  SiRNA target sequence
ggagaagtaaagatttggatt

SEQ ID NO: 21085 - DNA, 21 bp, Artificial sequence
  SiRNA target sequence
gagaagtaaagatttggattt

SEQ ID NO: 21086 - DNA, 21 bp, Artificial sequence
  SiRNA target sequence
agaagtaaagatttggattta

SEQ ID NO: 21087 - DNA, 21 bp, Artificial sequence
  SiRNA target sequence
gaagtaaagatttggatttaa

SEQ ID NO: 21088 - DNA, 21 bp, Artificial sequence
  SiRNA target sequence
aagtaaagatttggatttaat

SEQ ID NO: 21089 - DNA, 21 bp, Artificial sequence
  SiRNA target sequence
agtaaagatttggatttaata

SEQ ID NO: 21090 - DNA, 21 bp, Artificial sequence
  SiRNA target sequence
gtaaagatttggatttaatag

SEQ ID NO: 21091 - DNA, 21 bp, Artificial sequence
  SiRNA target sequence
taaagatttggatttaatagt

SEQ ID NO: 21092 - DNA, 21 bp, Artificial sequence
  SiRNA target sequence
aaagatttggatttaatagtc

SEQ ID NO: 21093 - DNA, 21 bp, Artificial sequence
  SiRNA target sequence
aagatttggatttaatagtca

SEQ ID NO: 21094 - DNA, 21 bp, Artificial sequence
  SiRNA target sequence
agatttggatttaatagtcaa

SEQ ID NO: 21095 - DNA, 21 bp, Artificial sequence
  SiRNA target sequence
gatttggatttaatagtcaag

SEQ ID NO: 21096 - DNA, 21 bp, Artificial sequence
  SiRNA target sequence
atttggatttaatagtcaagc

SEQ ID NO: 21097 - DNA, 21 bp, Artificial sequence
  SiRNA target sequence
tttggatttaatagtcaagcg

SEQ ID NO: 21098 - DNA, 21 bp, Artificial sequence
  SiRNA target sequence
ttggatttaatagtcaagcgg

SEQ ID NO: 21099 - DNA, 21 bp, Artificial sequence
  SiRNA target sequence
tggatttaatagtcaagcggt

SEQ ID NO: 21100 - DNA, 21 bp, Artificial sequence
  SiRNA target sequence
ggatttaatagtcaagcggtt

SEQ ID NO: 21101 - DNA, 21 bp, Artificial sequence
  SiRNA target sequence
gatttaatagtcaagcggtta

SEQ ID NO: 21102 - DNA, 21 bp, Artificial sequence
  SiRNA target sequence
atttaatagtcaagcggttat

SEQ ID NO: 21103 - DNA, 21 bp, Artificial sequence
  SiRNA target sequence
tttaatagtcaagcggttatc

SEQ ID NO: 21104 - DNA, 21 bp, Artificial sequence
  SiRNA target sequence
ttaatagtcaagcggttatct

SEQ ID NO: 21105 - DNA, 21 bp, Artificial sequence
  SiRNA target sequence
taatagtcaagcggttatctt

SEQ ID NO: 21106 - DNA, 21 bp, Artificial sequence
  SiRNA target sequence
aatagtcaagcggttatctta

SEQ ID NO: 21107 - DNA, 21 bp, Artificial sequence
  SiRNA target sequence
atagtcaagcggttatcttat

SEQ ID NO: 21108 - DNA, 21 bp, Artificial sequence
  SiRNA target sequence
tagtcaagcggttatcttatt

SEQ ID NO: 21109 - DNA, 21 bp, Artificial sequence
  SiRNA target sequence
agtcaagcggttatcttattt

SEQ ID NO: 21110 - DNA, 21 bp, Artificial sequence
  SiRNA target sequence
gtcaagcggttatcttatttt

SEQ ID NO: 21111 - DNA, 21 bp, Artificial sequence
  SiRNA target sequence
tcaagcggttatcttattttg

SEQ ID NO: 21112 - DNA, 21 bp, Artificial sequence
  SiRNA target sequence
caagcggttatcttattttgg

SEQ ID NO: 21113 - DNA, 21 bp, Artificial sequence
  SiRNA target sequence
aagcggttatcttattttgga

SEQ ID NO: 21114 - DNA, 21 bp, Artificial sequence
  SiRNA target sequence
agcggttatcttattttggag

SEQ ID NO: 21115 - DNA, 21 bp, Artificial sequence
  SiRNA target sequence
gcggttatcttattttggaga

SEQ ID NO: 21116 - DNA, 21 bp, Artificial sequence
  SiRNA target sequence
cggttatcttattttggagat

SEQ ID NO: 21117 - DNA, 21 bp, Artificial sequence
  SiRNA target sequence
ggttatcttattttggagatt

SEQ ID NO: 21118 - DNA, 21 bp, Artificial sequence
  SiRNA target sequence
gttatcttattttggagattc

SEQ ID NO: 21119 - DNA, 21 bp, Artificial sequence
  SiRNA target sequence
ttatcttattttggagattcc

SEQ ID NO: 21120 - DNA, 21 bp, Artificial sequence
  SiRNA target sequence
tatcttattttggagattcca

SEQ ID NO: 21121 - DNA, 21 bp, Artificial sequence
  SiRNA target sequence
atcttattttggagattccaa

SEQ ID NO: 21122 - DNA, 21 bp, Artificial sequence
  SiRNA target sequence
tcttattttggagattccaag

SEQ ID NO: 21123 - DNA, 21 bp, Artificial sequence
  SiRNA target sequence
cttattttggagattccaaga

SEQ ID NO: 21124 - DNA, 21 bp, Artificial sequence
  SiRNA target sequence
ttattttggagattccaagat

SEQ ID NO: 21125 - DNA, 21 bp, Artificial sequence
  SiRNA target sequence
tattttggagattccaagata

SEQ ID NO: 21126 - DNA, 21 bp, Artificial sequence
  SiRNA target sequence
attttggagattccaagatat

SEQ ID NO: 21127 - DNA, 21 bp, Artificial sequence
  SiRNA target sequence
ttttggagattccaagatata

SEQ ID NO: 21128 - DNA, 21 bp, Artificial sequence
  SiRNA target sequence
tttggagattccaagatatat

SEQ ID NO: 21129 - DNA, 21 bp, Artificial sequence
  SiRNA target sequence
ttggagattccaagatatata

SEQ ID NO: 21130 - DNA, 21 bp, Artificial sequence
  SiRNA target sequence
tggagattccaagatatataa

SEQ ID NO: 21131 - DNA, 21 bp, Artificial sequence
  SiRNA target sequence
ggagattccaagatatataac

SEQ ID NO: 21132 - DNA, 21 bp, Artificial sequence
  SiRNA target sequence
gagattccaagatatataacg

SEQ ID NO: 21133 - DNA, 21 bp, Artificial sequence
  SiRNA target sequence
agattccaagatatataacgc

SEQ ID NO: 21134 - DNA, 21 bp, Artificial sequence
  SiRNA target sequence
gattccaagatatataacgcg

SEQ ID NO: 21135 - DNA, 21 bp, Artificial sequence
  SiRNA target sequence
attccaagatatataacgcgt

SEQ ID NO: 21136 - DNA, 21 bp, Artificial sequence
  SiRNA target sequence
ttccaagatatataacgcgtt

SEQ ID NO: 21137 - DNA, 21 bp, Artificial sequence
  SiRNA target sequence
tccaagatatataacgcgttt

SEQ ID NO: 21138 - DNA, 21 bp, Artificial sequence
  SiRNA target sequence
ccaagatatataacgcgtttg

SEQ ID NO: 21139 - DNA, 21 bp, Artificial sequence
  SiRNA target sequence
caagatatataacgcgtttga

SEQ ID NO: 21140 - DNA, 21 bp, Artificial sequence
  SiRNA target sequence
aagatatataacgcgtttgac

SEQ ID NO: 21141 - DNA, 21 bp, Artificial sequence
  SiRNA target sequence
agatatataacgcgtttgaca

SEQ ID NO: 21142 - DNA, 21 bp, Artificial sequence
  SiRNA target sequence
gatatataacgcgtttgacaa

SEQ ID NO: 21143 - DNA, 21 bp, Artificial sequence
  SiRNA target sequence
atatataacgcgtttgacaat

SEQ ID NO: 21144 - DNA, 21 bp, Artificial sequence
  SiRNA target sequence
tatataacgcgtttgacaata

SEQ ID NO: 21145 - DNA, 21 bp, Artificial sequence
  SiRNA target sequence
atataacgcgtttgacaatat

SEQ ID NO: 21146 - DNA, 21 bp, Artificial sequence
  SiRNA target sequence
tataacgcgtttgacaatatt

SEQ ID NO: 21147 - DNA, 21 bp, Artificial sequence
  SiRNA target sequence
ataacgcgtttgacaatattg

SEQ ID NO: 21148 - DNA, 21 bp, Artificial sequence
  SiRNA target sequence
taacgcgtttgacaatattgg

SEQ ID NO: 21149 - DNA, 21 bp, Artificial sequence
  SiRNA target sequence
aacgcgtttgacaatattgga

SEQ ID NO: 21150 - DNA, 21 bp, Artificial sequence
  SiRNA target sequence
acgcgtttgacaatattggaa

SEQ ID NO: 21151 - DNA, 21 bp, Artificial sequence
  SiRNA target sequence
cgcgtttgacaatattggaac

SEQ ID NO: 21152 - DNA, 21 bp, Artificial sequence
  SiRNA target sequence
gcgtttgacaatattggaact

SEQ ID NO: 21153 - DNA, 21 bp, Artificial sequence
  SiRNA target sequence
cgtttgacaatattggaactt

SEQ ID NO: 21154 - DNA, 21 bp, Artificial sequence
  SiRNA target sequence
gtttgacaatattggaacttg

SEQ ID NO: 21155 - DNA, 21 bp, Artificial sequence
  SiRNA target sequence
tttgacaatattggaacttgg

SEQ ID NO: 21156 - DNA, 21 bp, Artificial sequence
  SiRNA target sequence
ttgacaatattggaacttggt

SEQ ID NO: 21157 - DNA, 21 bp, Artificial sequence
  SiRNA target sequence
tgacaatattggaacttggtt

SEQ ID NO: 21158 - DNA, 21 bp, Artificial sequence
  SiRNA target sequence
gacaatattggaacttggtta

SEQ ID NO: 21159 - DNA, 21 bp, Artificial sequence
  SiRNA target sequence
acaatattggaacttggttaa

SEQ ID NO: 21160 - DNA, 21 bp, Artificial sequence
  SiRNA target sequence
caatattggaacttggttaac

SEQ ID NO: 21161 - DNA, 21 bp, Artificial sequence
  SiRNA target sequence
aatattggaacttggttaaca

SEQ ID NO: 21162 - DNA, 21 bp, Artificial sequence
  SiRNA target sequence
atattggaacttggttaacaa

SEQ ID NO: 21163 - DNA, 21 bp, Artificial sequence
  SiRNA target sequence
tattggaacttggttaacaac

SEQ ID NO: 21164 - DNA, 21 bp, Artificial sequence
  SiRNA target sequence
attggaacttggttaacaact

SEQ ID NO: 21165 - DNA, 21 bp, Artificial sequence
  SiRNA target sequence
ttggaacttggttaacaacta

SEQ ID NO: 21166 - DNA, 21 bp, Artificial sequence
  SiRNA target sequence
tggaacttggttaacaactat

SEQ ID NO: 21167 - DNA, 21 bp, Artificial sequence
  SiRNA target sequence
ggaacttggttaacaactatg

SEQ ID NO: 21168 - DNA, 21 bp, Artificial sequence
  SiRNA target sequence
gaacttggttaacaactatga

SEQ ID NO: 21169 - DNA, 21 bp, Artificial sequence
  SiRNA target sequence
aacttggttaacaactatgat

SEQ ID NO: 21170 - DNA, 21 bp, Artificial sequence
  SiRNA target sequence
acttggttaacaactatgata

SEQ ID NO: 21171 - DNA, 21 bp, Artificial sequence
  SiRNA target sequence
cttggttaacaactatgataa

SEQ ID NO: 21172 - DNA, 21 bp, Artificial sequence
  SiRNA target sequence
ttggttaacaactatgataaa

SEQ ID NO: 21173 - DNA, 21 bp, Artificial sequence
  SiRNA target sequence
tggttaacaactatgataaac

SEQ ID NO: 21174 - DNA, 21 bp, Artificial sequence
  SiRNA target sequence
ggttaacaactatgataaaca

SEQ ID NO: 21175 - DNA, 21 bp, Artificial sequence
  SiRNA target sequence
gttaacaactatgataaacac

SEQ ID NO: 21176 - DNA, 21 bp, Artificial sequence
  SiRNA target sequence
ttaacaactatgataaacaca

SEQ ID NO: 21177 - DNA, 21 bp, Artificial sequence
  SiRNA target sequence
taacaactatgataaacacaa

SEQ ID NO: 21178 - DNA, 21 bp, Artificial sequence
  SiRNA target sequence
aacaactatgataaacacaac

SEQ ID NO: 21179 - DNA, 21 bp, Artificial sequence
  SiRNA target sequence
acaactatgataaacacaacg

SEQ ID NO: 21180 - DNA, 21 bp, Artificial sequence
  SiRNA target sequence
caactatgataaacacaacgg

SEQ ID NO: 21181 - DNA, 21 bp, Artificial sequence
  SiRNA target sequence
aactatgataaacacaacggt

SEQ ID NO: 21182 - DNA, 21 bp, Artificial sequence
  SiRNA target sequence
actatgataaacacaacggtg

SEQ ID NO: 21183 - DNA, 21 bp, Artificial sequence
  SiRNA target sequence
ctatgataaacacaacggtga

SEQ ID NO: 21184 - DNA, 21 bp, Artificial sequence
  SiRNA target sequence
tatgataaacacaacggtgaa

SEQ ID NO: 21185 - DNA, 21 bp, Artificial sequence
  SiRNA target sequence
atgataaacacaacggtgaat

SEQ ID NO: 21186 - DNA, 21 bp, Artificial sequence
  SiRNA target sequence
tgataaacacaacggtgaatt

SEQ ID NO: 21187 - DNA, 21 bp, Artificial sequence
  SiRNA target sequence
gataaacacaacggtgaatta

SEQ ID NO: 21188 - DNA, 21 bp, Artificial sequence
  SiRNA target sequence
ataaacacaacggtgaattat

SEQ ID NO: 21189 - DNA, 21 bp, Artificial sequence
  SiRNA target sequence
taaacacaacggtgaattatg

SEQ ID NO: 21190 - DNA, 21 bp, Artificial sequence
  SiRNA target sequence
aaacacaacggtgaattatgt

SEQ ID NO: 21191 - DNA, 21 bp, Artificial sequence
  SiRNA target sequence
aacacaacggtgaattatgtg

SEQ ID NO: 21192 - DNA, 21 bp, Artificial sequence
  SiRNA target sequence
acacaacggtgaattatgtga

SEQ ID NO: 21193 - DNA, 21 bp, Artificial sequence
  SiRNA target sequence
cacaacggtgaattatgtgaa

SEQ ID NO: 21194 - DNA, 21 bp, Artificial sequence
  SiRNA target sequence
acaacggtgaattatgtgaag

SEQ ID NO: 21195 - DNA, 21 bp, Artificial sequence
  SiRNA target sequence
caacggtgaattatgtgaagg

SEQ ID NO: 21196 - DNA, 21 bp, Artificial sequence
  SiRNA target sequence
aacggtgaattatgtgaaggt

SEQ ID NO: 21197 - DNA, 21 bp, Artificial sequence
  SiRNA target sequence
acggtgaattatgtgaaggtt

SEQ ID NO: 21198 - DNA, 21 bp, Artificial sequence
  SiRNA target sequence
cggtgaattatgtgaaggtta

SEQ ID NO: 21199 - DNA, 21 bp, Artificial sequence
  SiRNA target sequence
ggtgaattatgtgaaggttac

SEQ ID NO: 21200 - DNA, 21 bp, Artificial sequence
  SiRNA target sequence
gtgaattatgtgaaggttacg

SEQ ID NO: 21201 - DNA, 21 bp, Artificial sequence
  SiRNA target sequence
tgaattatgtgaaggttacgc

SEQ ID NO: 21202 - DNA, 21 bp, Artificial sequence
  SiRNA target sequence
gaattatgtgaaggttacgct

SEQ ID NO: 21203 - DNA, 21 bp, Artificial sequence
  SiRNA target sequence
aattatgtgaaggttacgctc

SEQ ID NO: 21204 - DNA, 21 bp, Artificial sequence
  SiRNA target sequence
attatgtgaaggttacgctcc

SEQ ID NO: 21205 - DNA, 21 bp, Artificial sequence
  SiRNA target sequence
ttatgtgaaggttacgctcct

SEQ ID NO: 21206 - DNA, 21 bp, Artificial sequence
  SiRNA target sequence
tatgtgaaggttacgctcctg

SEQ ID NO: 21207 - DNA, 21 bp, Artificial sequence
  SiRNA target sequence
atgtgaaggttacgctcctgg

SEQ ID NO: 21208 - DNA, 21 bp, Artificial sequence
  SiRNA target sequence
tgtgaaggttacgctcctggg

SEQ ID NO: 21209 - DNA, 21 bp, Artificial sequence
  SiRNA target sequence
gtgaaggttacgctcctgggt

SEQ ID NO: 21210 - DNA, 21 bp, Artificial sequence
  SiRNA target sequence
tgaaggttacgctcctgggtc

SEQ ID NO: 21211 - DNA, 21 bp, Artificial sequence
  SiRNA target sequence
gaaggttacgctcctgggtca

SEQ ID NO: 21212 - DNA, 21 bp, Artificial sequence
  SiRNA target sequence
aaggttacgctcctgggtcat

SEQ ID NO: 21213 - DNA, 21 bp, Artificial sequence
  SiRNA target sequence
aggttacgctcctgggtcatg

SEQ ID NO: 21214 - DNA, 21 bp, Artificial sequence
  SiRNA target sequence
ggttacgctcctgggtcatga

SEQ ID NO: 21215 - DNA, 21 bp, Artificial sequence
  SiRNA target sequence
gttacgctcctgggtcatgat

SEQ ID NO: 21216 - DNA, 21 bp, Artificial sequence
  SiRNA target sequence
ttacgctcctgggtcatgatc

SEQ ID NO: 21217 - DNA, 21 bp, Artificial sequence
  SiRNA target sequence
tacgctcctgggtcatgatcc

SEQ ID NO: 21218 - DNA, 21 bp, Artificial sequence
  SiRNA target sequence
acgctcctgggtcatgatcct

SEQ ID NO: 21219 - DNA, 21 bp, Artificial sequence
  SiRNA target sequence
cgctcctgggtcatgatcctg

SEQ ID NO: 21220 - DNA, 21 bp, Artificial sequence
  SiRNA target sequence
gctcctgggtcatgatcctga

SEQ ID NO: 21221 - DNA, 21 bp, Artificial sequence
  SiRNA target sequence
ctcctgggtcatgatcctgaa

SEQ ID NO: 21222 - DNA, 21 bp, Artificial sequence
  SiRNA target sequence
tcctgggtcatgatcctgaag

SEQ ID NO: 21223 - DNA, 21 bp, Artificial sequence
  SiRNA target sequence
cctgggtcatgatcctgaaga

SEQ ID NO: 21224 - DNA, 21 bp, Artificial sequence
  SiRNA target sequence
ctgggtcatgatcctgaagaa

SEQ ID NO: 21225 - DNA, 21 bp, Artificial sequence
  SiRNA target sequence
tgggtcatgatcctgaagaat

SEQ ID NO: 21226 - DNA, 21 bp, Artificial sequence
  SiRNA target sequence
gggtcatgatcctgaagaatt

SEQ ID NO: 21227 - DNA, 21 bp, Artificial sequence
  SiRNA target sequence
ggtcatgatcctgaagaattt

SEQ ID NO: 21228 - DNA, 21 bp, Artificial sequence
  SiRNA target sequence
gtcatgatcctgaagaatttc

SEQ ID NO: 21229 - DNA, 21 bp, Artificial sequence
  SiRNA target sequence
tcatgatcctgaagaatttct

SEQ ID NO: 21230 - DNA, 21 bp, Artificial sequence
  SiRNA target sequence
catgatcctgaagaatttctg

SEQ ID NO: 21231 - DNA, 21 bp, Artificial sequence
  SiRNA target sequence
atgatcctgaagaatttctgg

SEQ ID NO: 21232 - DNA, 21 bp, Artificial sequence
  SiRNA target sequence
tgatcctgaagaatttctgga

SEQ ID NO: 21233 - DNA, 21 bp, Artificial sequence
  SiRNA target sequence
gatcctgaagaatttctggag

SEQ ID NO: 21234 - DNA, 21 bp, Artificial sequence
  SiRNA target sequence
atcctgaagaatttctggaga

SEQ ID NO: 21235 - DNA, 21 bp, Artificial sequence
  SiRNA target sequence
tcctgaagaatttctggagaa

SEQ ID NO: 21236 - DNA, 21 bp, Artificial sequence
  SiRNA target sequence
cctgaagaatttctggagaat

SEQ ID NO: 21237 - DNA, 21 bp, Artificial sequence
  SiRNA target sequence
ctgaagaatttctggagaatc

SEQ ID NO: 21238 - DNA, 21 bp, Artificial sequence
  SiRNA target sequence
tgaagaatttctggagaatca

SEQ ID NO: 21239 - DNA, 21 bp, Artificial sequence
  SiRNA target sequence
gaagaatttctggagaatcag

SEQ ID NO: 21240 - DNA, 21 bp, Artificial sequence
  SiRNA target sequence
aagaatttctggagaatcaga

SEQ ID NO: 21241 - DNA, 21 bp, Artificial sequence
  SiRNA target sequence
agaatttctggagaatcagag

SEQ ID NO: 21242 - DNA, 21 bp, Artificial sequence
  SiRNA target sequence
gaatttctggagaatcagagt

SEQ ID NO: 21243 - DNA, 21 bp, Artificial sequence
  SiRNA target sequence
aatttctggagaatcagagtg

SEQ ID NO: 21244 - DNA, 21 bp, Artificial sequence
  SiRNA target sequence
atttctggagaatcagagtga

SEQ ID NO: 21245 - DNA, 21 bp, Artificial sequence
  SiRNA target sequence
tttctggagaatcagagtgac

SEQ ID NO: 21246 - DNA, 21 bp, Artificial sequence
  SiRNA target sequence
ttctggagaatcagagtgacc

SEQ ID NO: 21247 - DNA, 21 bp, Artificial sequence
  SiRNA target sequence
tctggagaatcagagtgaccc

SEQ ID NO: 21248 - DNA, 21 bp, Artificial sequence
  SiRNA target sequence
ctggagaatcagagtgaccct

SEQ ID NO: 21249 - DNA, 21 bp, Artificial sequence
  SiRNA target sequence
tggagaatcagagtgaccctt

SEQ ID NO: 21250 - DNA, 21 bp, Artificial sequence
  SiRNA target sequence
ggagaatcagagtgacccttt

SEQ ID NO: 21251 - DNA, 21 bp, Artificial sequence
  SiRNA target sequence
gagaatcagagtgaccctttg

SEQ ID NO: 21252 - DNA, 21 bp, Artificial sequence
  SiRNA target sequence
agaatcagagtgaccctttgg

SEQ ID NO: 21253 - DNA, 21 bp, Artificial sequence
  SiRNA target sequence
gaatcagagtgaccctttggt

SEQ ID NO: 21254 - DNA, 21 bp, Artificial sequence
  SiRNA target sequence
aatcagagtgaccctttggtg

SEQ ID NO: 21255 - DNA, 21 bp, Artificial sequence
  SiRNA target sequence
atcagagtgaccctttggtgg

SEQ ID NO: 21256 - DNA, 21 bp, Artificial sequence
  SiRNA target sequence
tcagagtgaccctttggtgga

SEQ ID NO: 21257 - DNA, 21 bp, Artificial sequence
  SiRNA target sequence
cagagtgaccctttggtggat

SEQ ID NO: 21258 - DNA, 21 bp, Artificial sequence
  SiRNA target sequence
agagtgaccctttggtggatt

SEQ ID NO: 21259 - DNA, 21 bp, Artificial sequence
  SiRNA target sequence
gagtgaccctttggtggattg

SEQ ID NO: 21260 - DNA, 21 bp, Artificial sequence
  SiRNA target sequence
agtgaccctttggtggattgg

SEQ ID NO: 21261 - DNA, 21 bp, Artificial sequence
  SiRNA target sequence
gtgaccctttggtggattggg

SEQ ID NO: 21262 - DNA, 21 bp, Artificial sequence
  SiRNA target sequence
tgaccctttggtggattggga

SEQ ID NO: 21263 - DNA, 21 bp, Artificial sequence
  SiRNA target sequence
gaccctttggtggattgggaa

SEQ ID NO: 21264 - DNA, 21 bp, Artificial sequence
  SiRNA target sequence
accctttggtggattgggaag

SEQ ID NO: 21265 - DNA, 21 bp, Artificial sequence
  SiRNA target sequence
ccctttggtggattgggaaga

SEQ ID NO: 21266 - DNA, 21 bp, Artificial sequence
  SiRNA target sequence
cctttggtggattgggaagag

SEQ ID NO: 21267 - DNA, 21 bp, Artificial sequence
  SiRNA target sequence
ctttggtggattgggaagagc

SEQ ID NO: 21268 - DNA, 21 bp, Artificial sequence
  SiRNA target sequence
tttggtggattgggaagagca

SEQ ID NO: 21269 - DNA, 21 bp, Artificial sequence
  SiRNA target sequence
ttggtggattgggaagagcag

SEQ ID NO: 21270 - DNA, 21 bp, Artificial sequence
  SiRNA target sequence
tggtggattgggaagagcagt

SEQ ID NO: 21271 - DNA, 21 bp, Artificial sequence
  SiRNA target sequence
ggtggattgggaagagcagtg

SEQ ID NO: 21272 - DNA, 21 bp, Artificial sequence
  SiRNA target sequence
gtggattgggaagagcagtgt

SEQ ID NO: 21273 - DNA, 21 bp, Artificial sequence
  SiRNA target sequence
tggattgggaagagcagtgta

SEQ ID NO: 21274 - DNA, 21 bp, Artificial sequence
  SiRNA target sequence
ggattgggaagagcagtgtag

SEQ ID NO: 21275 - DNA, 21 bp, Artificial sequence
  SiRNA target sequence
gattgggaagagcagtgtagg

SEQ ID NO: 21276 - DNA, 21 bp, Artificial sequence
  SiRNA target sequence
attgggaagagcagtgtagga

SEQ ID NO: 21277 - DNA, 21 bp, Artificial sequence
  SiRNA target sequence
ttgggaagagcagtgtaggaa

SEQ ID NO: 21278 - DNA, 21 bp, Artificial sequence
  SiRNA target sequence
tgggaagagcagtgtaggaaa

SEQ ID NO: 21279 - DNA, 21 bp, Artificial sequence
  SiRNA target sequence
gggaagagcagtgtaggaaac

SEQ ID NO: 21280 - DNA, 21 bp, Artificial sequence
  SiRNA target sequence
ggaagagcagtgtaggaaaca

SEQ ID NO: 21281 - DNA, 21 bp, Artificial sequence
  SiRNA target sequence
gaagagcagtgtaggaaacat

SEQ ID NO: 21282 - DNA, 21 bp, Artificial sequence
  SiRNA target sequence
aagagcagtgtaggaaacatt

SEQ ID NO: 21283 - DNA, 21 bp, Artificial sequence
  SiRNA target sequence
agagcagtgtaggaaacattt

SEQ ID NO: 21284 - DNA, 21 bp, Artificial sequence
  SiRNA target sequence
gagcagtgtaggaaacatttt

SEQ ID NO: 21285 - DNA, 21 bp, Artificial sequence
  SiRNA target sequence
agcagtgtaggaaacattttg

SEQ ID NO: 21286 - DNA, 21 bp, Artificial sequence
  SiRNA target sequence
gcagtgtaggaaacattttgt

SEQ ID NO: 21287 - DNA, 21 bp, Artificial sequence
  SiRNA target sequence
cagtgtaggaaacattttgtt

SEQ ID NO: 21288 - DNA, 21 bp, Artificial sequence
  SiRNA target sequence
agtgtaggaaacattttgttt

SEQ ID NO: 21289 - DNA, 21 bp, Artificial sequence
  SiRNA target sequence
gtgtaggaaacattttgtttc

SEQ ID NO: 21290 - DNA, 21 bp, Artificial sequence
  SiRNA target sequence
tgtaggaaacattttgtttca

SEQ ID NO: 21291 - DNA, 21 bp, Artificial sequence
  SiRNA target sequence
gtaggaaacattttgtttcag

SEQ ID NO: 21292 - DNA, 21 bp, Artificial sequence
  SiRNA target sequence
taggaaacattttgtttcaga

SEQ ID NO: 21293 - DNA, 21 bp, Artificial sequence
  SiRNA target sequence
aggaaacattttgtttcagat

SEQ ID NO: 21294 - DNA, 21 bp, Artificial sequence
  SiRNA target sequence
ggaaacattttgtttcagata

SEQ ID NO: 21295 - DNA, 21 bp, Artificial sequence
  SiRNA target sequence
gaaacattttgtttcagatac

SEQ ID NO: 21296 - DNA, 21 bp, Artificial sequence
  SiRNA target sequence
aaacattttgtttcagatact

SEQ ID NO: 21297 - DNA, 21 bp, Artificial sequence
  SiRNA target sequence
aacattttgtttcagatactg

SEQ ID NO: 21298 - DNA, 21 bp, Artificial sequence
  SiRNA target sequence
acattttgtttcagatactga

SEQ ID NO: 21299 - DNA, 21 bp, Artificial sequence
  SiRNA target sequence
cattttgtttcagatactgac

SEQ ID NO: 21300 - DNA, 21 bp, Artificial sequence
  SiRNA target sequence
attttgtttcagatactgaca

SEQ ID NO: 21301 - DNA, 21 bp, Artificial sequence
  SiRNA target sequence
ttttgtttcagatactgacag

SEQ ID NO: 21302 - DNA, 21 bp, Artificial sequence
  SiRNA target sequence
tttgtttcagatactgacaga

SEQ ID NO: 21303 - DNA, 21 bp, Artificial sequence
  SiRNA target sequence
ttgtttcagatactgacagaa

SEQ ID NO: 21304 - DNA, 21 bp, Artificial sequence
  SiRNA target sequence
tgtttcagatactgacagaat

SEQ ID NO: 21305 - DNA, 21 bp, Artificial sequence
  SiRNA target sequence
gtttcagatactgacagaata

SEQ ID NO: 21306 - DNA, 21 bp, Artificial sequence
  SiRNA target sequence
tttcagatactgacagaatag

SEQ ID NO: 21307 - DNA, 21 bp, Artificial sequence
  SiRNA target sequence
ttcagatactgacagaatagc

SEQ ID NO: 21308 - DNA, 21 bp, Artificial sequence
  SiRNA target sequence
tcagatactgacagaatagcg

SEQ ID NO: 21309 - DNA, 21 bp, Artificial sequence
  SiRNA target sequence
cagatactgacagaatagcga

SEQ ID NO: 21310 - DNA, 21 bp, Artificial sequence
  SiRNA target sequence
agatactgacagaatagcgat

SEQ ID NO: 21311 - DNA, 21 bp, Artificial sequence
  SiRNA target sequence
gatactgacagaatagcgatc

SEQ ID NO: 21312 - DNA, 21 bp, Artificial sequence
  SiRNA target sequence
atactgacagaatagcgatct

SEQ ID NO: 21313 - DNA, 21 bp, Artificial sequence
  SiRNA target sequence
tactgacagaatagcgatcta

SEQ ID NO: 21314 - DNA, 21 bp, Artificial sequence
  SiRNA target sequence
actgacagaatagcgatctat

SEQ ID NO: 21315 - DNA, 21 bp, Artificial sequence
  SiRNA target sequence
ctgacagaatagcgatctata

SEQ ID NO: 21316 - DNA, 21 bp, Artificial sequence
  SiRNA target sequence
tgacagaatagcgatctatac

SEQ ID NO: 21317 - DNA, 21 bp, Artificial sequence
  SiRNA target sequence
gacagaatagcgatctataca

SEQ ID NO: 21318 - DNA, 21 bp, Artificial sequence
  SiRNA target sequence
acagaatagcgatctatacag

SEQ ID NO: 21319 - DNA, 21 bp, Artificial sequence
  SiRNA target sequence
cagaatagcgatctatacaga

SEQ ID NO: 21320 - DNA, 21 bp, Artificial sequence
  SiRNA target sequence
agaatagcgatctatacagag

SEQ ID NO: 21321 - DNA, 21 bp, Artificial sequence
  SiRNA target sequence
gaatagcgatctatacagagt

SEQ ID NO: 21322 - DNA, 21 bp, Artificial sequence
  SiRNA target sequence
aatagcgatctatacagagtc

SEQ ID NO: 21323 - DNA, 21 bp, Artificial sequence
  SiRNA target sequence
atagcgatctatacagagtct

SEQ ID NO: 21324 - DNA, 21 bp, Artificial sequence
  SiRNA target sequence
tagcgatctatacagagtcta

SEQ ID NO: 21325 - DNA, 21 bp, Artificial sequence
  SiRNA target sequence
agcgatctatacagagtctac

SEQ ID NO: 21326 - DNA, 21 bp, Artificial sequence
  SiRNA target sequence
gcgatctatacagagtctacg

SEQ ID NO: 21327 - DNA, 21 bp, Artificial sequence
  SiRNA target sequence
cgatctatacagagtctacgt

SEQ ID NO: 21328 - DNA, 21 bp, Artificial sequence
  SiRNA target sequence
gatctatacagagtctacgtt

SEQ ID NO: 21329 - DNA, 21 bp, Artificial sequence
  SiRNA target sequence
atctatacagagtctacgtta

SEQ ID NO: 21330 - DNA, 21 bp, Artificial sequence
  SiRNA target sequence
tctatacagagtctacgttag

SEQ ID NO: 21331 - DNA, 21 bp, Artificial sequence
  SiRNA target sequence
ctatacagagtctacgttagc

SEQ ID NO: 21332 - DNA, 21 bp, Artificial sequence
  SiRNA target sequence
tatacagagtctacgttagcg

SEQ ID NO: 21333 - DNA, 21 bp, Artificial sequence
  SiRNA target sequence
atacagagtctacgttagcgg

SEQ ID NO: 21334 - DNA, 21 bp, Artificial sequence
  SiRNA target sequence
tacagagtctacgttagcgga

SEQ ID NO: 21335 - DNA, 21 bp, Artificial sequence
  SiRNA target sequence
acagagtctacgttagcggat

SEQ ID NO: 21336 - DNA, 21 bp, Artificial sequence
  SiRNA target sequence
cagagtctacgttagcggata

SEQ ID NO: 21337 - DNA, 21 bp, Artificial sequence
  SiRNA target sequence
agagtctacgttagcggatat

SEQ ID NO: 21338 - DNA, 21 bp, Artificial sequence
  SiRNA target sequence
gagtctacgttagcggatatc

SEQ ID NO: 21339 - DNA, 21 bp, Artificial sequence
  SiRNA target sequence
agtctacgttagcggatatca

SEQ ID NO: 21340 - DNA, 21 bp, Artificial sequence
  SiRNA target sequence
gtctacgttagcggatatcaa

SEQ ID NO: 21341 - DNA, 21 bp, Artificial sequence
  SiRNA target sequence
tctacgttagcggatatcaaa

SEQ ID NO: 21342 - DNA, 21 bp, Artificial sequence
  SiRNA target sequence
ctacgttagcggatatcaaac

SEQ ID NO: 21343 - DNA, 21 bp, Artificial sequence
  SiRNA target sequence
tacgttagcggatatcaaacg

SEQ ID NO: 21344 - DNA, 21 bp, Artificial sequence
  SiRNA target sequence
acgttagcggatatcaaacgt

SEQ ID NO: 21345 - DNA, 21 bp, Artificial sequence
  SiRNA target sequence
cgttagcggatatcaaacgtc

SEQ ID NO: 21346 - DNA, 21 bp, Artificial sequence
  SiRNA target sequence
gttagcggatatcaaacgtct

SEQ ID NO: 21347 - DNA, 21 bp, Artificial sequence
  SiRNA target sequence
ttagcggatatcaaacgtctg

SEQ ID NO: 21348 - DNA, 21 bp, Artificial sequence
  SiRNA target sequence
tagcggatatcaaacgtctgt

SEQ ID NO: 21349 - DNA, 21 bp, Artificial sequence
  SiRNA target sequence
agcggatatcaaacgtctgta

SEQ ID NO: 21350 - DNA, 21 bp, Artificial sequence
  SiRNA target sequence
gcggatatcaaacgtctgtac

SEQ ID NO: 21351 - DNA, 21 bp, Artificial sequence
  SiRNA target sequence
cggatatcaaacgtctgtaca

SEQ ID NO: 21352 - DNA, 21 bp, Artificial sequence
  SiRNA target sequence
ggatatcaaacgtctgtacaa

SEQ ID NO: 21353 - DNA, 21 bp, Artificial sequence
  SiRNA target sequence
gatatcaaacgtctgtacaat

SEQ ID NO: 21354 - DNA, 21 bp, Artificial sequence
  SiRNA target sequence
atatcaaacgtctgtacaata

SEQ ID NO: 21355 - DNA, 21 bp, Artificial sequence
  SiRNA target sequence
tatcaaacgtctgtacaatat

SEQ ID NO: 21356 - DNA, 21 bp, Artificial sequence
  SiRNA target sequence
atcaaacgtctgtacaatatg

SEQ ID NO: 21357 - DNA, 21 bp, Artificial sequence
  SiRNA target sequence
tcaaacgtctgtacaatatgg

SEQ ID NO: 21358 - DNA, 21 bp, Artificial sequence
  SiRNA target sequence
caaacgtctgtacaatatggg

SEQ ID NO: 21359 - DNA, 21 bp, Artificial sequence
  SiRNA target sequence
aaacgtctgtacaatatgggc

SEQ ID NO: 21360 - DNA, 21 bp, Artificial sequence
  SiRNA target sequence
aacgtctgtacaatatgggcg

SEQ ID NO: 21361 - DNA, 21 bp, Artificial sequence
  SiRNA target sequence
acgtctgtacaatatgggcgt

SEQ ID NO: 21362 - DNA, 21 bp, Artificial sequence
  SiRNA target sequence
cgtctgtacaatatgggcgtt

SEQ ID NO: 21363 - DNA, 21 bp, Artificial sequence
  SiRNA target sequence
gtctgtacaatatgggcgtta

SEQ ID NO: 21364 - DNA, 21 bp, Artificial sequence
  SiRNA target sequence
tctgtacaatatgggcgttag

SEQ ID NO: 21365 - DNA, 21 bp, Artificial sequence
  SiRNA target sequence
ctgtacaatatgggcgttagt

SEQ ID NO: 21366 - DNA, 21 bp, Artificial sequence
  SiRNA target sequence
tgtacaatatgggcgttagtt

SEQ ID NO: 21367 - DNA, 21 bp, Artificial sequence
  SiRNA target sequence
gtacaatatgggcgttagtta

SEQ ID NO: 21368 - DNA, 21 bp, Artificial sequence
  SiRNA target sequence
tacaatatgggcgttagttat

SEQ ID NO: 21369 - DNA, 21 bp, Artificial sequence
  SiRNA target sequence
acaatatgggcgttagttata

SEQ ID NO: 21370 - DNA, 21 bp, Artificial sequence
  SiRNA target sequence
caatatgggcgttagttatat

SEQ ID NO: 21371 - DNA, 21 bp, Artificial sequence
  SiRNA target sequence
aatatgggcgttagttatatg

SEQ ID NO: 21372 - DNA, 21 bp, Artificial sequence
  SiRNA target sequence
atatgggcgttagttatatgc

SEQ ID NO: 21373 - DNA, 21 bp, Artificial sequence
  SiRNA target sequence
tatgggcgttagttatatgcg

SEQ ID NO: 21374 - DNA, 21 bp, Artificial sequence
  SiRNA target sequence
atgggcgttagttatatgcga

SEQ ID NO: 21375 - DNA, 21 bp, Artificial sequence
  SiRNA target sequence
tgggcgttagttatatgcgac

SEQ ID NO: 21376 - DNA, 21 bp, Artificial sequence
  SiRNA target sequence
gggcgttagttatatgcgaca

SEQ ID NO: 21377 - DNA, 21 bp, Artificial sequence
  SiRNA target sequence
ggcgttagttatatgcgacat

SEQ ID NO: 21378 - DNA, 21 bp, Artificial sequence
  SiRNA target sequence
gcgttagttatatgcgacatc

SEQ ID NO: 21379 - DNA, 21 bp, Artificial sequence
  SiRNA target sequence
cgttagttatatgcgacatcc

SEQ ID NO: 21380 - DNA, 21 bp, Artificial sequence
  SiRNA target sequence
gttagttatatgcgacatcct

SEQ ID NO: 21381 - DNA, 21 bp, Artificial sequence
  SiRNA target sequence
ttagttatatgcgacatcctt

SEQ ID NO: 21382 - DNA, 21 bp, Artificial sequence
  SiRNA target sequence
tagttatatgcgacatccttt

SEQ ID NO: 21383 - DNA, 21 bp, Artificial sequence
  SiRNA target sequence
agttatatgcgacatcctttg

SEQ ID NO: 21384 - DNA, 21 bp, Artificial sequence
  SiRNA target sequence
gttatatgcgacatcctttgt

SEQ ID NO: 21385 - DNA, 21 bp, Artificial sequence
  SiRNA target sequence
ttatatgcgacatcctttgta

SEQ ID NO: 21386 - DNA, 21 bp, Artificial sequence
  SiRNA target sequence
tatatgcgacatcctttgtat

SEQ ID NO: 21387 - DNA, 21 bp, Artificial sequence
  SiRNA target sequence
atatgcgacatcctttgtata

SEQ ID NO: 21388 - DNA, 21 bp, Artificial sequence
  SiRNA target sequence
tatgcgacatcctttgtataa

SEQ ID NO: 21389 - DNA, 21 bp, Artificial sequence
  SiRNA target sequence
atgcgacatcctttgtataaa

SEQ ID NO: 21390 - DNA, 21 bp, Artificial sequence
  SiRNA target sequence
tgcgacatcctttgtataaac

SEQ ID NO: 21391 - DNA, 21 bp, Artificial sequence
  SiRNA target sequence
gcgacatcctttgtataaacc

SEQ ID NO: 21392 - DNA, 21 bp, Artificial sequence
  SiRNA target sequence
cgacatcctttgtataaaccc

SEQ ID NO: 21393 - DNA, 21 bp, Artificial sequence
  SiRNA target sequence
gacatcctttgtataaacccc

SEQ ID NO: 21394 - DNA, 21 bp, Artificial sequence
  SiRNA target sequence
acatcctttgtataaacccca

SEQ ID NO: 21395 - DNA, 21 bp, Artificial sequence
  SiRNA target sequence
catcctttgtataaaccccac

SEQ ID NO: 21396 - DNA, 21 bp, Artificial sequence
  SiRNA target sequence
atcctttgtataaaccccacc

SEQ ID NO: 21397 - DNA, 21 bp, Artificial sequence
  SiRNA target sequence
tcctttgtataaaccccacca

SEQ ID NO: 21398 - DNA, 21 bp, Artificial sequence
  SiRNA target sequence
cctttgtataaaccccaccag

SEQ ID NO: 21399 - DNA, 21 bp, Artificial sequence
  SiRNA target sequence
ctttgtataaaccccaccagc

SEQ ID NO: 21400 - DNA, 21 bp, Artificial sequence
  SiRNA target sequence
tttgtataaaccccaccagcg

SEQ ID NO: 21401 - DNA, 21 bp, Artificial sequence
  SiRNA target sequence
ttgtataaaccccaccagcgt

SEQ ID NO: 21402 - DNA, 21 bp, Artificial sequence
  SiRNA target sequence
tgtataaaccccaccagcgtg

SEQ ID NO: 21403 - DNA, 21 bp, Artificial sequence
  SiRNA target sequence
gtataaaccccaccagcgtgt

SEQ ID NO: 21404 - DNA, 21 bp, Artificial sequence
  SiRNA target sequence
tataaaccccaccagcgtgtt

SEQ ID NO: 21405 - DNA, 21 bp, Artificial sequence
  SiRNA target sequence
ataaaccccaccagcgtgtta

SEQ ID NO: 21406 - DNA, 21 bp, Artificial sequence
  SiRNA target sequence
taaaccccaccagcgtgttat

SEQ ID NO: 21407 - DNA, 21 bp, Artificial sequence
  SiRNA target sequence
aaaccccaccagcgtgttatt

SEQ ID NO: 21408 - DNA, 21 bp, Artificial sequence
  SiRNA target sequence
aaccccaccagcgtgttattt

SEQ ID NO: 21409 - DNA, 21 bp, Artificial sequence
  SiRNA target sequence
accccaccagcgtgttatttc

SEQ ID NO: 21410 - DNA, 21 bp, Artificial sequence
  SiRNA target sequence
ccccaccagcgtgttatttct

SEQ ID NO: 21411 - DNA, 21 bp, Artificial sequence
  SiRNA target sequence
cccaccagcgtgttatttctg

SEQ ID NO: 21412 - DNA, 21 bp, Artificial sequence
  SiRNA target sequence
ccaccagcgtgttatttctga

SEQ ID NO: 21413 - DNA, 21 bp, Artificial sequence
  SiRNA target sequence
caccagcgtgttatttctgaa

SEQ ID NO: 21414 - DNA, 21 bp, Artificial sequence
  SiRNA target sequence
accagcgtgttatttctgaaa

SEQ ID NO: 21415 - DNA, 21 bp, Artificial sequence
  SiRNA target sequence
ccagcgtgttatttctgaaat

SEQ ID NO: 21416 - DNA, 21 bp, Artificial sequence
  SiRNA target sequence
cagcgtgttatttctgaaatt

SEQ ID NO: 21417 - DNA, 21 bp, Artificial sequence
  SiRNA target sequence
agcgtgttatttctgaaattc

SEQ ID NO: 21418 - DNA, 21 bp, Artificial sequence
  SiRNA target sequence
gcgtgttatttctgaaattct

SEQ ID NO: 21419 - DNA, 21 bp, Artificial sequence
  SiRNA target sequence
cgtgttatttctgaaattctc

SEQ ID NO: 21420 - DNA, 21 bp, Artificial sequence
  SiRNA target sequence
gtgttatttctgaaattctca

SEQ ID NO: 21421 - DNA, 21 bp, Artificial sequence
  SiRNA target sequence
tgttatttctgaaattctcaa

SEQ ID NO: 21422 - DNA, 21 bp, Artificial sequence
  SiRNA target sequence
gttatttctgaaattctcaat

SEQ ID NO: 21423 - DNA, 21 bp, Artificial sequence
  SiRNA target sequence
ttatttctgaaattctcaatc

SEQ ID NO: 21424 - DNA, 21 bp, Artificial sequence
  SiRNA target sequence
tatttctgaaattctcaatca

SEQ ID NO: 21425 - DNA, 21 bp, Artificial sequence
  SiRNA target sequence
atttctgaaattctcaatcag

SEQ ID NO: 21426 - DNA, 21 bp, Artificial sequence
  SiRNA target sequence
tttctgaaattctcaatcagt

SEQ ID NO: 21427 - DNA, 21 bp, Artificial sequence
  SiRNA target sequence
ttctgaaattctcaatcagtt

SEQ ID NO: 21428 - DNA, 21 bp, Artificial sequence
  SiRNA target sequence
tctgaaattctcaatcagttg

SEQ ID NO: 21429 - DNA, 21 bp, Artificial sequence
  SiRNA target sequence
ctgaaattctcaatcagttgc

SEQ ID NO: 21430 - DNA, 21 bp, Artificial sequence
  SiRNA target sequence
tgaaattctcaatcagttgct

SEQ ID NO: 21431 - DNA, 21 bp, Artificial sequence
  SiRNA target sequence
gaaattctcaatcagttgctt

SEQ ID NO: 21432 - DNA, 21 bp, Artificial sequence
  SiRNA target sequence
aaattctcaatcagttgctta

SEQ ID NO: 21433 - DNA, 21 bp, Artificial sequence
  SiRNA target sequence
aattctcaatcagttgcttag

SEQ ID NO: 21434 - DNA, 21 bp, Artificial sequence
  SiRNA target sequence
attctcaatcagttgcttagg

SEQ ID NO: 21435 - DNA, 21 bp, Artificial sequence
  SiRNA target sequence
ttctcaatcagttgcttaggt

SEQ ID NO: 21436 - DNA, 21 bp, Artificial sequence
  SiRNA target sequence
tctcaatcagttgcttaggtt

SEQ ID NO: 21437 - DNA, 21 bp, Artificial sequence
  SiRNA target sequence
ctcaatcagttgcttaggttt

SEQ ID NO: 21438 - DNA, 21 bp, Artificial sequence
  SiRNA target sequence
tcaatcagttgcttaggtttg

SEQ ID NO: 21439 - DNA, 21 bp, Artificial sequence
  SiRNA target sequence
caatcagttgcttaggtttgc

SEQ ID NO: 21440 - DNA, 21 bp, Artificial sequence
  SiRNA target sequence
aatcagttgcttaggtttgcg

SEQ ID NO: 21441 - DNA, 21 bp, Artificial sequence
  SiRNA target sequence
atcagttgcttaggtttgcgg

SEQ ID NO: 21442 - DNA, 21 bp, Artificial sequence
  SiRNA target sequence
tcagttgcttaggtttgcgga

SEQ ID NO: 21443 - DNA, 21 bp, Artificial sequence
  SiRNA target sequence
cagttgcttaggtttgcggat

SEQ ID NO: 21444 - DNA, 21 bp, Artificial sequence
  SiRNA target sequence
agttgcttaggtttgcggata

SEQ ID NO: 21445 - DNA, 21 bp, Artificial sequence
  SiRNA target sequence
gttgcttaggtttgcggataa

SEQ ID NO: 21446 - DNA, 21 bp, Artificial sequence
  SiRNA target sequence
ttgcttaggtttgcggataag

SEQ ID NO: 21447 - DNA, 21 bp, Artificial sequence
  SiRNA target sequence
tgcttaggtttgcggataaga

SEQ ID NO: 21448 - DNA, 21 bp, Artificial sequence
  SiRNA target sequence
gcttaggtttgcggataagat

SEQ ID NO: 21449 - DNA, 21 bp, Artificial sequence
  SiRNA target sequence
cttaggtttgcggataagata

SEQ ID NO: 21450 - DNA, 21 bp, Artificial sequence
  SiRNA target sequence
ttaggtttgcggataagataa

SEQ ID NO: 21451 - DNA, 21 bp, Artificial sequence
  SiRNA target sequence
taggtttgcggataagataaa

SEQ ID NO: 21452 - DNA, 21 bp, Artificial sequence
  SiRNA target sequence
aggtttgcggataagataaag

SEQ ID NO: 21453 - DNA, 21 bp, Artificial sequence
  SiRNA target sequence
ggtttgcggataagataaaga

SEQ ID NO: 21454 - DNA, 21 bp, Artificial sequence
  SiRNA target sequence
gtttgcggataagataaagaa

SEQ ID NO: 21455 - DNA, 21 bp, Artificial sequence
  SiRNA target sequence
tttgcggataagataaagaag

SEQ ID NO: 21456 - DNA, 21 bp, Artificial sequence
  SiRNA target sequence
ttgcggataagataaagaaga

SEQ ID NO: 21457 - DNA, 21 bp, Artificial sequence
  SiRNA target sequence
tgcggataagataaagaagaa

SEQ ID NO: 21458 - DNA, 21 bp, Artificial sequence
  SiRNA target sequence
gcggataagataaagaagaag

SEQ ID NO: 21459 - DNA, 21 bp, Artificial sequence
  SiRNA target sequence
cggataagataaagaagaagg

SEQ ID NO: 21460 - DNA, 21 bp, Artificial sequence
  SiRNA target sequence
ggataagataaagaagaaggt

SEQ ID NO: 21461 - DNA, 21 bp, Artificial sequence
  SiRNA target sequence
gataagataaagaagaaggtc

SEQ ID NO: 21462 - DNA, 21 bp, Artificial sequence
  SiRNA target sequence
ataagataaagaagaaggtcg

SEQ ID NO: 21463 - DNA, 21 bp, Artificial sequence
  SiRNA target sequence
taagataaagaagaaggtcgg

SEQ ID NO: 21464 - DNA, 21 bp, Artificial sequence
  SiRNA target sequence
aagataaagaagaaggtcggt

SEQ ID NO: 21465 - DNA, 21 bp, Artificial sequence
  SiRNA target sequence
agataaagaagaaggtcggta

SEQ ID NO: 21466 - DNA, 21 bp, Artificial sequence
  SiRNA target sequence
gataaagaagaaggtcggtac

SEQ ID NO: 21467 - DNA, 21 bp, Artificial sequence
  SiRNA target sequence
ataaagaagaaggtcggtaca

SEQ ID NO: 21468 - DNA, 21 bp, Artificial sequence
  SiRNA target sequence
taaagaagaaggtcggtacag

SEQ ID NO: 21469 - DNA, 21 bp, Artificial sequence
  SiRNA target sequence
aaagaagaaggtcggtacaga

SEQ ID NO: 21470 - DNA, 21 bp, Artificial sequence
  SiRNA target sequence
aagaagaaggtcggtacagat

SEQ ID NO: 21471 - DNA, 21 bp, Artificial sequence
  SiRNA target sequence
agaagaaggtcggtacagatg

SEQ ID NO: 21472 - DNA, 21 bp, Artificial sequence
  SiRNA target sequence
gaagaaggtcggtacagatgc

SEQ ID NO: 21473 - DNA, 21 bp, Artificial sequence
  SiRNA target sequence
aagaaggtcggtacagatgct

SEQ ID NO: 21474 - DNA, 21 bp, Artificial sequence
  SiRNA target sequence
agaaggtcggtacagatgctt

SEQ ID NO: 21475 - DNA, 21 bp, Artificial sequence
  SiRNA target sequence
gaaggtcggtacagatgcttc

SEQ ID NO: 21476 - DNA, 21 bp, Artificial sequence
  SiRNA target sequence
aaggtcggtacagatgcttct

SEQ ID NO: 21477 - DNA, 21 bp, Artificial sequence
  SiRNA target sequence
aggtcggtacagatgcttctg

SEQ ID NO: 21478 - DNA, 21 bp, Artificial sequence
  SiRNA target sequence
ggtcggtacagatgcttctgt

SEQ ID NO: 21479 - DNA, 21 bp, Artificial sequence
  SiRNA target sequence
gtcggtacagatgcttctgtt

SEQ ID NO: 21480 - DNA, 21 bp, Artificial sequence
  SiRNA target sequence
tcggtacagatgcttctgttc

SEQ ID NO: 21481 - DNA, 21 bp, Artificial sequence
  SiRNA target sequence
cggtacagatgcttctgttcg

SEQ ID NO: 21482 - DNA, 21 bp, Artificial sequence
  SiRNA target sequence
ggtacagatgcttctgttcga

SEQ ID NO: 21483 - DNA, 21 bp, Artificial sequence
  SiRNA target sequence
gtacagatgcttctgttcgaa

SEQ ID NO: 21484 - DNA, 21 bp, Artificial sequence
  SiRNA target sequence
tacagatgcttctgttcgaaa

SEQ ID NO: 21485 - DNA, 21 bp, Artificial sequence
  SiRNA target sequence
acagatgcttctgttcgaaac

SEQ ID NO: 21486 - DNA, 21 bp, Artificial sequence
  SiRNA target sequence
cagatgcttctgttcgaaacc

SEQ ID NO: 21487 - DNA, 21 bp, Artificial sequence
  SiRNA target sequence
agatgcttctgttcgaaaccc

SEQ ID NO: 21488 - DNA, 21 bp, Artificial sequence
  SiRNA target sequence
gatgcttctgttcgaaacccc

SEQ ID NO: 21489 - DNA, 21 bp, Artificial sequence
  SiRNA target sequence
atgcttctgttcgaaaccccc

SEQ ID NO: 21490 - DNA, 21 bp, Artificial sequence
  SiRNA target sequence
tgcttctgttcgaaacccccc

SEQ ID NO: 21491 - DNA, 21 bp, Artificial sequence
  SiRNA target sequence
gcttctgttcgaaacccccca

SEQ ID NO: 21492 - DNA, 21 bp, Artificial sequence
  SiRNA target sequence
cttctgttcgaaaccccccag

SEQ ID NO: 21493 - DNA, 21 bp, Artificial sequence
  SiRNA target sequence
ttctgttcgaaaccccccagt

SEQ ID NO: 21494 - DNA, 21 bp, Artificial sequence
  SiRNA target sequence
tctgttcgaaaccccccagtt

SEQ ID NO: 21495 - DNA, 21 bp, Artificial sequence
  SiRNA target sequence
ctgttcgaaaccccccagtta

SEQ ID NO: 21496 - DNA, 21 bp, Artificial sequence
  SiRNA target sequence
tgttcgaaaccccccagttac

SEQ ID NO: 21497 - DNA, 21 bp, Artificial sequence
  SiRNA target sequence
gttcgaaaccccccagttact

SEQ ID NO: 21498 - DNA, 21 bp, Artificial sequence
  SiRNA target sequence
ttcgaaaccccccagttactc

SEQ ID NO: 21499 - DNA, 21 bp, Artificial sequence
  SiRNA target sequence
tcgaaaccccccagttactct

SEQ ID NO: 21500 - DNA, 21 bp, Artificial sequence
  SiRNA target sequence
cgaaaccccccagttactctg

SEQ ID NO: 21501 - DNA, 21 bp, Artificial sequence
  SiRNA target sequence
gaaaccccccagttactctgt

SEQ ID NO: 21502 - DNA, 21 bp, Artificial sequence
  SiRNA target sequence
aaaccccccagttactctgta

SEQ ID NO: 21503 - DNA, 21 bp, Artificial sequence
  SiRNA target sequence
aaccccccagttactctgtat

SEQ ID NO: 21504 - DNA, 21 bp, Artificial sequence
  SiRNA target sequence
accccccagttactctgtatt

SEQ ID NO: 21505 - DNA, 21 bp, Artificial sequence
  SiRNA target sequence
ccccccagttactctgtattt

SEQ ID NO: 21506 - DNA, 21 bp, Artificial sequence
  SiRNA target sequence
cccccagttactctgtattta

SEQ ID NO: 21507 - DNA, 21 bp, Artificial sequence
  SiRNA target sequence
ccccagttactctgtatttat

SEQ ID NO: 21508 - DNA, 21 bp, Artificial sequence
  SiRNA target sequence
cccagttactctgtatttata

SEQ ID NO: 21509 - DNA, 21 bp, Artificial sequence
  SiRNA target sequence
ccagttactctgtatttatat

SEQ ID NO: 21510 - DNA, 21 bp, Artificial sequence
  SiRNA target sequence
cagttactctgtatttatatg

SEQ ID NO: 21511 - DNA, 21 bp, Artificial sequence
  SiRNA target sequence
agttactctgtatttatatgg

SEQ ID NO: 21512 - DNA, 21 bp, Artificial sequence
  SiRNA target sequence
gttactctgtatttatatgga

SEQ ID NO: 21513 - DNA, 21 bp, Artificial sequence
  SiRNA target sequence
ttactctgtatttatatggag

SEQ ID NO: 21514 - DNA, 21 bp, Artificial sequence
  SiRNA target sequence
tactctgtatttatatggaga

SEQ ID NO: 21515 - DNA, 21 bp, Artificial sequence
  SiRNA target sequence
actctgtatttatatggagaa

SEQ ID NO: 21516 - DNA, 21 bp, Artificial sequence
  SiRNA target sequence
ctctgtatttatatggagaaa

SEQ ID NO: 21517 - DNA, 21 bp, Artificial sequence
  SiRNA target sequence
tctgtatttatatggagaaac

SEQ ID NO: 21518 - DNA, 21 bp, Artificial sequence
  SiRNA target sequence
ctgtatttatatggagaaaca

SEQ ID NO: 21519 - DNA, 21 bp, Artificial sequence
  SiRNA target sequence
tgtatttatatggagaaacag

SEQ ID NO: 21520 - DNA, 21 bp, Artificial sequence
  SiRNA target sequence
gtatttatatggagaaacagg

SEQ ID NO: 21521 - DNA, 21 bp, Artificial sequence
  SiRNA target sequence
tatttatatggagaaacaggg

SEQ ID NO: 21522 - DNA, 21 bp, Artificial sequence
  SiRNA target sequence
atttatatggagaaacagggg

SEQ ID NO: 21523 - DNA, 21 bp, Artificial sequence
  SiRNA target sequence
tttatatggagaaacaggggt

SEQ ID NO: 21524 - DNA, 21 bp, Artificial sequence
  SiRNA target sequence
ttatatggagaaacaggggta

SEQ ID NO: 21525 - DNA, 21 bp, Artificial sequence
  SiRNA target sequence
tatatggagaaacaggggtag

SEQ ID NO: 21526 - DNA, 21 bp, Artificial sequence
  SiRNA target sequence
atatggagaaacaggggtagg

SEQ ID NO: 21527 - DNA, 21 bp, Artificial sequence
  SiRNA target sequence
tatggagaaacaggggtaggg

SEQ ID NO: 21528 - DNA, 21 bp, Artificial sequence
  SiRNA target sequence
atggagaaacaggggtaggga

SEQ ID NO: 21529 - DNA, 21 bp, Artificial sequence
  SiRNA target sequence
tggagaaacaggggtagggaa

SEQ ID NO: 21530 - DNA, 21 bp, Artificial sequence
  SiRNA target sequence
ggagaaacaggggtagggaag

SEQ ID NO: 21531 - DNA, 21 bp, Artificial sequence
  SiRNA target sequence
gagaaacaggggtagggaagt

SEQ ID NO: 21532 - DNA, 21 bp, Artificial sequence
  SiRNA target sequence
agaaacaggggtagggaagtc

SEQ ID NO: 21533 - DNA, 21 bp, Artificial sequence
  SiRNA target sequence
gaaacaggggtagggaagtct

SEQ ID NO: 21534 - DNA, 21 bp, Artificial sequence
  SiRNA target sequence
aaacaggggtagggaagtcta

SEQ ID NO: 21535 - DNA, 21 bp, Artificial sequence
  SiRNA target sequence
aacaggggtagggaagtctac

SEQ ID NO: 21536 - DNA, 21 bp, Artificial sequence
  SiRNA target sequence
acaggggtagggaagtctact

SEQ ID NO: 21537 - DNA, 21 bp, Artificial sequence
  SiRNA target sequence
caggggtagggaagtctactt

SEQ ID NO: 21538 - DNA, 21 bp, Artificial sequence
  SiRNA target sequence
aggggtagggaagtctacttt

SEQ ID NO: 21539 - DNA, 21 bp, Artificial sequence
  SiRNA target sequence
ggggtagggaagtctactttg

SEQ ID NO: 21540 - DNA, 21 bp, Artificial sequence
  SiRNA target sequence
gggtagggaagtctactttga

SEQ ID NO: 21541 - DNA, 21 bp, Artificial sequence
  SiRNA target sequence
ggtagggaagtctactttgac

SEQ ID NO: 21542 - DNA, 21 bp, Artificial sequence
  SiRNA target sequence
gtagggaagtctactttgaca

SEQ ID NO: 21543 - DNA, 21 bp, Artificial sequence
  SiRNA target sequence
tagggaagtctactttgacat

SEQ ID NO: 21544 - DNA, 21 bp, Artificial sequence
  SiRNA target sequence
agggaagtctactttgacata

SEQ ID NO: 21545 - DNA, 21 bp, Artificial sequence
  SiRNA target sequence
gggaagtctactttgacatac

SEQ ID NO: 21546 - DNA, 21 bp, Artificial sequence
  SiRNA target sequence
ggaagtctactttgacatacc

SEQ ID NO: 21547 - DNA, 21 bp, Artificial sequence
  SiRNA target sequence
gaagtctactttgacataccc

SEQ ID NO: 21548 - DNA, 21 bp, Artificial sequence
  SiRNA target sequence
aagtctactttgacataccct

SEQ ID NO: 21549 - DNA, 21 bp, Artificial sequence
  SiRNA target sequence
agtctactttgacataccctt

SEQ ID NO: 21550 - DNA, 21 bp, Artificial sequence
  SiRNA target sequence
gtctactttgacatacccttt

SEQ ID NO: 21551 - DNA, 21 bp, Artificial sequence
  SiRNA target sequence
tctactttgacataccctttg

SEQ ID NO: 21552 - DNA, 21 bp, Artificial sequence
  SiRNA target sequence
ctactttgacataccctttgt

SEQ ID NO: 21553 - DNA, 21 bp, Artificial sequence
  SiRNA target sequence
tactttgacataccctttgtg

SEQ ID NO: 21554 - DNA, 21 bp, Artificial sequence
  SiRNA target sequence
actttgacataccctttgtgt

SEQ ID NO: 21555 - DNA, 21 bp, Artificial sequence
  SiRNA target sequence
ctttgacataccctttgtgtg

SEQ ID NO: 21556 - DNA, 21 bp, Artificial sequence
  SiRNA target sequence
tttgacataccctttgtgtgc

SEQ ID NO: 21557 - DNA, 21 bp, Artificial sequence
  SiRNA target sequence
ttgacataccctttgtgtgcc

SEQ ID NO: 21558 - DNA, 21 bp, Artificial sequence
  SiRNA target sequence
tgacataccctttgtgtgcca

SEQ ID NO: 21559 - DNA, 21 bp, Artificial sequence
  SiRNA target sequence
gacataccctttgtgtgccac

SEQ ID NO: 21560 - DNA, 21 bp, Artificial sequence
  SiRNA target sequence
acataccctttgtgtgccacc

SEQ ID NO: 21561 - DNA, 21 bp, Artificial sequence
  SiRNA target sequence
cataccctttgtgtgccaccc

SEQ ID NO: 21562 - DNA, 21 bp, Artificial sequence
  SiRNA target sequence
ataccctttgtgtgccaccct

SEQ ID NO: 21563 - DNA, 21 bp, Artificial sequence
  SiRNA target sequence
taccctttgtgtgccaccctt

SEQ ID NO: 21564 - DNA, 21 bp, Artificial sequence
  SiRNA target sequence
accctttgtgtgccacccttc

SEQ ID NO: 21565 - DNA, 21 bp, Artificial sequence
  SiRNA target sequence
ccctttgtgtgccacccttct

SEQ ID NO: 21566 - DNA, 21 bp, Artificial sequence
  SiRNA target sequence
cctttgtgtgccacccttctt

SEQ ID NO: 21567 - DNA, 21 bp, Artificial sequence
  SiRNA target sequence
ctttgtgtgccacccttctta

SEQ ID NO: 21568 - DNA, 21 bp, Artificial sequence
  SiRNA target sequence
tttgtgtgccacccttcttaa

SEQ ID NO: 21569 - DNA, 21 bp, Artificial sequence
  SiRNA target sequence
ttgtgtgccacccttcttaag

SEQ ID NO: 21570 - DNA, 21 bp, Artificial sequence
  SiRNA target sequence
tgtgtgccacccttcttaaga

SEQ ID NO: 21571 - DNA, 21 bp, Artificial sequence
  SiRNA target sequence
gtgtgccacccttcttaagac

SEQ ID NO: 21572 - DNA, 21 bp, Artificial sequence
  SiRNA target sequence
tgtgccacccttcttaagact

SEQ ID NO: 21573 - DNA, 21 bp, Artificial sequence
  SiRNA target sequence
gtgccacccttcttaagacta

SEQ ID NO: 21574 - DNA, 21 bp, Artificial sequence
  SiRNA target sequence
tgccacccttcttaagactat

SEQ ID NO: 21575 - DNA, 21 bp, Artificial sequence
  SiRNA target sequence
gccacccttcttaagactatc

SEQ ID NO: 21576 - DNA, 21 bp, Artificial sequence
  SiRNA target sequence
ccacccttcttaagactatct

SEQ ID NO: 21577 - DNA, 21 bp, Artificial sequence
  SiRNA target sequence
cacccttcttaagactatctt

SEQ ID NO: 21578 - DNA, 21 bp, Artificial sequence
  SiRNA target sequence
acccttcttaagactatcttt

SEQ ID NO: 21579 - DNA, 21 bp, Artificial sequence
  SiRNA target sequence
cccttcttaagactatcttta

SEQ ID NO: 21580 - DNA, 21 bp, Artificial sequence
  SiRNA target sequence
ccttcttaagactatctttac

SEQ ID NO: 21581 - DNA, 21 bp, Artificial sequence
  SiRNA target sequence
cttcttaagactatctttacc

SEQ ID NO: 21582 - DNA, 21 bp, Artificial sequence
  SiRNA target sequence
ttcttaagactatctttacca

SEQ ID NO: 21583 - DNA, 21 bp, Artificial sequence
  SiRNA target sequence
tcttaagactatctttaccag

SEQ ID NO: 21584 - DNA, 21 bp, Artificial sequence
  SiRNA target sequence
cttaagactatctttaccaga

SEQ ID NO: 21585 - DNA, 21 bp, Artificial sequence
  SiRNA target sequence
ttaagactatctttaccagag

SEQ ID NO: 21586 - DNA, 21 bp, Artificial sequence
  SiRNA target sequence
taagactatctttaccagaga

SEQ ID NO: 21587 - DNA, 21 bp, Artificial sequence
  SiRNA target sequence
aagactatctttaccagagag

SEQ ID NO: 21588 - DNA, 21 bp, Artificial sequence
  SiRNA target sequence
agactatctttaccagagagg

SEQ ID NO: 21589 - DNA, 21 bp, Artificial sequence
  SiRNA target sequence
gactatctttaccagagaggg

SEQ ID NO: 21590 - DNA, 21 bp, Artificial sequence
  SiRNA target sequence
actatctttaccagagagggg

SEQ ID NO: 21591 - DNA, 21 bp, Artificial sequence
  SiRNA target sequence
ctatctttaccagagagggga

SEQ ID NO: 21592 - DNA, 21 bp, Artificial sequence
  SiRNA target sequence
tatctttaccagagaggggaa

SEQ ID NO: 21593 - DNA, 21 bp, Artificial sequence
  SiRNA target sequence
atctttaccagagaggggaat

SEQ ID NO: 21594 - DNA, 21 bp, Artificial sequence
  SiRNA target sequence
tctttaccagagaggggaata

SEQ ID NO: 21595 - DNA, 21 bp, Artificial sequence
  SiRNA target sequence
ctttaccagagaggggaatac

SEQ ID NO: 21596 - DNA, 21 bp, Artificial sequence
  SiRNA target sequence
tttaccagagaggggaataca

SEQ ID NO: 21597 - DNA, 21 bp, Artificial sequence
  SiRNA target sequence
ttaccagagaggggaatacag

SEQ ID NO: 21598 - DNA, 21 bp, Artificial sequence
  SiRNA target sequence
taccagagaggggaatacagt

SEQ ID NO: 21599 - DNA, 21 bp, Artificial sequence
  SiRNA target sequence
accagagaggggaatacagtg

SEQ ID NO: 21600 - DNA, 21 bp, Artificial sequence
  SiRNA target sequence
ccagagaggggaatacagtga

SEQ ID NO: 21601 - DNA, 21 bp, Artificial sequence
  SiRNA target sequence
cagagaggggaatacagtgat

SEQ ID NO: 21602 - DNA, 21 bp, Artificial sequence
  SiRNA target sequence
agagaggggaatacagtgatg

SEQ ID NO: 21603 - DNA, 21 bp, Artificial sequence
  SiRNA target sequence
gagaggggaatacagtgatgc

SEQ ID NO: 21604 - DNA, 21 bp, Artificial sequence
  SiRNA target sequence
agaggggaatacagtgatgct

SEQ ID NO: 21605 - DNA, 21 bp, Artificial sequence
  SiRNA target sequence
gaggggaatacagtgatgctt

SEQ ID NO: 21606 - DNA, 21 bp, Artificial sequence
  SiRNA target sequence
aggggaatacagtgatgcttg

SEQ ID NO: 21607 - DNA, 21 bp, Artificial sequence
  SiRNA target sequence
ggggaatacagtgatgcttga

SEQ ID NO: 21608 - DNA, 21 bp, Artificial sequence
  SiRNA target sequence
gggaatacagtgatgcttgat

SEQ ID NO: 21609 - DNA, 21 bp, Artificial sequence
  SiRNA target sequence
ggaatacagtgatgcttgatt

SEQ ID NO: 21610 - DNA, 21 bp, Artificial sequence
  SiRNA target sequence
gaatacagtgatgcttgattc

SEQ ID NO: 21611 - DNA, 21 bp, Artificial sequence
  SiRNA target sequence
aatacagtgatgcttgattct

SEQ ID NO: 21612 - DNA, 21 bp, Artificial sequence
  SiRNA target sequence
atacagtgatgcttgattctc

SEQ ID NO: 21613 - DNA, 21 bp, Artificial sequence
  SiRNA target sequence
tacagtgatgcttgattctct

SEQ ID NO: 21614 - DNA, 21 bp, Artificial sequence
  SiRNA target sequence
acagtgatgcttgattctctt

SEQ ID NO: 21615 - DNA, 21 bp, Artificial sequence
  SiRNA target sequence
cagtgatgcttgattctctta

SEQ ID NO: 21616 - DNA, 21 bp, Artificial sequence
  SiRNA target sequence
agtgatgcttgattctcttaa

SEQ ID NO: 21617 - DNA, 21 bp, Artificial sequence
  SiRNA target sequence
gtgatgcttgattctcttaaa

SEQ ID NO: 21618 - DNA, 21 bp, Artificial sequence
  SiRNA target sequence
tgatgcttgattctcttaaac

SEQ ID NO: 21619 - DNA, 21 bp, Artificial sequence
  SiRNA target sequence
gatgcttgattctcttaaaca

SEQ ID NO: 21620 - DNA, 21 bp, Artificial sequence
  SiRNA target sequence
atgcttgattctcttaaacaa

SEQ ID NO: 21621 - DNA, 21 bp, Artificial sequence
  SiRNA target sequence
tgcttgattctcttaaacaac

SEQ ID NO: 21622 - DNA, 21 bp, Artificial sequence
  SiRNA target sequence
gcttgattctcttaaacaaca

SEQ ID NO: 21623 - DNA, 21 bp, Artificial sequence
  SiRNA target sequence
cttgattctcttaaacaacat

SEQ ID NO: 21624 - DNA, 21 bp, Artificial sequence
  SiRNA target sequence
ttgattctcttaaacaacatt

SEQ ID NO: 21625 - DNA, 21 bp, Artificial sequence
  SiRNA target sequence
tgattctcttaaacaacatta

SEQ ID NO: 21626 - DNA, 21 bp, Artificial sequence
  SiRNA target sequence
gattctcttaaacaacattat

SEQ ID NO: 21627 - DNA, 21 bp, Artificial sequence
  SiRNA target sequence
attctcttaaacaacattata

SEQ ID NO: 21628 - DNA, 21 bp, Artificial sequence
  SiRNA target sequence
ttctcttaaacaacattataa

SEQ ID NO: 21629 - DNA, 21 bp, Artificial sequence
  SiRNA target sequence
tctcttaaacaacattataaa

SEQ ID NO: 21630 - DNA, 21 bp, Artificial sequence
  SiRNA target sequence
ctcttaaacaacattataaag

SEQ ID NO: 21631 - DNA, 21 bp, Artificial sequence
  SiRNA target sequence
tcttaaacaacattataaaga

SEQ ID NO: 21632 - DNA, 21 bp, Artificial sequence
  SiRNA target sequence
cttaaacaacattataaagag

SEQ ID NO: 21633 - DNA, 21 bp, Artificial sequence
  SiRNA target sequence
ttaaacaacattataaagaga

SEQ ID NO: 21634 - DNA, 21 bp, Artificial sequence
  SiRNA target sequence
taaacaacattataaagagat

SEQ ID NO: 21635 - DNA, 21 bp, Artificial sequence
  SiRNA target sequence
aaacaacattataaagagatg

SEQ ID NO: 21636 - DNA, 21 bp, Artificial sequence
  SiRNA target sequence
aacaacattataaagagatga

SEQ ID NO: 21637 - DNA, 21 bp, Artificial sequence
  SiRNA target sequence
acaacattataaagagatgat

SEQ ID NO: 21638 - DNA, 21 bp, Artificial sequence
  SiRNA target sequence
caacattataaagagatgata

SEQ ID NO: 21639 - DNA, 21 bp, Artificial sequence
  SiRNA target sequence
aacattataaagagatgatat

SEQ ID NO: 21640 - DNA, 21 bp, Artificial sequence
  SiRNA target sequence
acattataaagagatgatata

SEQ ID NO: 21641 - DNA, 21 bp, Artificial sequence
  SiRNA target sequence
cattataaagagatgatatac

SEQ ID NO: 21642 - DNA, 21 bp, Artificial sequence
  SiRNA target sequence
attataaagagatgatatacg

SEQ ID NO: 21643 - DNA, 21 bp, Artificial sequence
  SiRNA target sequence
ttataaagagatgatatacgt

SEQ ID NO: 21644 - DNA, 21 bp, Artificial sequence
  SiRNA target sequence
tataaagagatgatatacgta

SEQ ID NO: 21645 - DNA, 21 bp, Artificial sequence
  SiRNA target sequence
ataaagagatgatatacgtaa

SEQ ID NO: 21646 - DNA, 21 bp, Artificial sequence
  SiRNA target sequence
taaagagatgatatacgtaag

SEQ ID NO: 21647 - DNA, 21 bp, Artificial sequence
  SiRNA target sequence
aaagagatgatatacgtaaga

SEQ ID NO: 21648 - DNA, 21 bp, Artificial sequence
  SiRNA target sequence
aagagatgatatacgtaagag

SEQ ID NO: 21649 - DNA, 21 bp, Artificial sequence
  SiRNA target sequence
agagatgatatacgtaagagc

SEQ ID NO: 21650 - DNA, 21 bp, Artificial sequence
  SiRNA target sequence
gagatgatatacgtaagagct

SEQ ID NO: 21651 - DNA, 21 bp, Artificial sequence
  SiRNA target sequence
agatgatatacgtaagagctg

SEQ ID NO: 21652 - DNA, 21 bp, Artificial sequence
  SiRNA target sequence
gatgatatacgtaagagctgc

SEQ ID NO: 21653 - DNA, 21 bp, Artificial sequence
  SiRNA target sequence
atgatatacgtaagagctgca

SEQ ID NO: 21654 - DNA, 21 bp, Artificial sequence
  SiRNA target sequence
tgatatacgtaagagctgcag

SEQ ID NO: 21655 - DNA, 21 bp, Artificial sequence
  SiRNA target sequence
gatatacgtaagagctgcaga

SEQ ID NO: 21656 - DNA, 21 bp, Artificial sequence
  SiRNA target sequence
atatacgtaagagctgcagaa

SEQ ID NO: 21657 - DNA, 21 bp, Artificial sequence
  SiRNA target sequence
tatacgtaagagctgcagaac

SEQ ID NO: 21658 - DNA, 21 bp, Artificial sequence
  SiRNA target sequence
atacgtaagagctgcagaaca

SEQ ID NO: 21659 - DNA, 21 bp, Artificial sequence
  SiRNA target sequence
tacgtaagagctgcagaacaa

SEQ ID NO: 21660 - DNA, 21 bp, Artificial sequence
  SiRNA target sequence
acgtaagagctgcagaacaag

SEQ ID NO: 21661 - DNA, 21 bp, Artificial sequence
  SiRNA target sequence
cgtaagagctgcagaacaaga

SEQ ID NO: 21662 - DNA, 21 bp, Artificial sequence
  SiRNA target sequence
gtaagagctgcagaacaagag

SEQ ID NO: 21663 - DNA, 21 bp, Artificial sequence
  SiRNA target sequence
taagagctgcagaacaagagt

SEQ ID NO: 21664 - DNA, 21 bp, Artificial sequence
  SiRNA target sequence
aagagctgcagaacaagagtt

SEQ ID NO: 21665 - DNA, 21 bp, Artificial sequence
  SiRNA target sequence
agagctgcagaacaagagttc

SEQ ID NO: 21666 - DNA, 21 bp, Artificial sequence
  SiRNA target sequence
gagctgcagaacaagagttct

SEQ ID NO: 21667 - DNA, 21 bp, Artificial sequence
  SiRNA target sequence
agctgcagaacaagagttctg

SEQ ID NO: 21668 - DNA, 21 bp, Artificial sequence
  SiRNA target sequence
gctgcagaacaagagttctgg

SEQ ID NO: 21669 - DNA, 21 bp, Artificial sequence
  SiRNA target sequence
ctgcagaacaagagttctggg

SEQ ID NO: 21670 - DNA, 21 bp, Artificial sequence
  SiRNA target sequence
tgcagaacaagagttctggga

SEQ ID NO: 21671 - DNA, 21 bp, Artificial sequence
  SiRNA target sequence
gcagaacaagagttctgggat

SEQ ID NO: 21672 - DNA, 21 bp, Artificial sequence
  SiRNA target sequence
cagaacaagagttctgggatg

SEQ ID NO: 21673 - DNA, 21 bp, Artificial sequence
  SiRNA target sequence
agaacaagagttctgggatgg

SEQ ID NO: 21674 - DNA, 21 bp, Artificial sequence
  SiRNA target sequence
gaacaagagttctgggatggt

SEQ ID NO: 21675 - DNA, 21 bp, Artificial sequence
  SiRNA target sequence
aacaagagttctgggatggtt

SEQ ID NO: 21676 - DNA, 21 bp, Artificial sequence
  SiRNA target sequence
acaagagttctgggatggtta

SEQ ID NO: 21677 - DNA, 21 bp, Artificial sequence
  SiRNA target sequence
caagagttctgggatggttat

SEQ ID NO: 21678 - DNA, 21 bp, Artificial sequence
  SiRNA target sequence
aagagttctgggatggttata

SEQ ID NO: 21679 - DNA, 21 bp, Artificial sequence
  SiRNA target sequence
agagttctgggatggttatac

SEQ ID NO: 21680 - DNA, 21 bp, Artificial sequence
  SiRNA target sequence
gagttctgggatggttatacg

SEQ ID NO: 21681 - DNA, 21 bp, Artificial sequence
  SiRNA target sequence
agttctgggatggttatacgc

SEQ ID NO: 21682 - DNA, 21 bp, Artificial sequence
  SiRNA target sequence
gttctgggatggttatacgca

SEQ ID NO: 21683 - DNA, 21 bp, Artificial sequence
  SiRNA target sequence
ttctgggatggttatacgcag

SEQ ID NO: 21684 - DNA, 21 bp, Artificial sequence
  SiRNA target sequence
tctgggatggttatacgcagc

SEQ ID NO: 21685 - DNA, 21 bp, Artificial sequence
  SiRNA target sequence
ctgggatggttatacgcagca

SEQ ID NO: 21686 - DNA, 21 bp, Artificial sequence
  SiRNA target sequence
tgggatggttatacgcagcaa

SEQ ID NO: 21687 - DNA, 21 bp, Artificial sequence
  SiRNA target sequence
gggatggttatacgcagcaat

SEQ ID NO: 21688 - DNA, 21 bp, Artificial sequence
  SiRNA target sequence
ggatggttatacgcagcaatt

SEQ ID NO: 21689 - DNA, 21 bp, Artificial sequence
  SiRNA target sequence
gatggttatacgcagcaatta

SEQ ID NO: 21690 - DNA, 21 bp, Artificial sequence
  SiRNA target sequence
atggttatacgcagcaattag

SEQ ID NO: 21691 - DNA, 21 bp, Artificial sequence
  SiRNA target sequence
tggttatacgcagcaattagt

SEQ ID NO: 21692 - DNA, 21 bp, Artificial sequence
  SiRNA target sequence
ggttatacgcagcaattagtc

SEQ ID NO: 21693 - DNA, 21 bp, Artificial sequence
  SiRNA target sequence
gttatacgcagcaattagtca

SEQ ID NO: 21694 - DNA, 21 bp, Artificial sequence
  SiRNA target sequence
ttatacgcagcaattagtcac

SEQ ID NO: 21695 - DNA, 21 bp, Artificial sequence
  SiRNA target sequence
tatacgcagcaattagtcact

SEQ ID NO: 21696 - DNA, 21 bp, Artificial sequence
  SiRNA target sequence
atacgcagcaattagtcactg

SEQ ID NO: 21697 - DNA, 21 bp, Artificial sequence
  SiRNA target sequence
tacgcagcaattagtcactgt

SEQ ID NO: 21698 - DNA, 21 bp, Artificial sequence
  SiRNA target sequence
acgcagcaattagtcactgta

SEQ ID NO: 21699 - DNA, 21 bp, Artificial sequence
  SiRNA target sequence
cgcagcaattagtcactgtat

SEQ ID NO: 21700 - DNA, 21 bp, Artificial sequence
  SiRNA target sequence
gcagcaattagtcactgtatt

SEQ ID NO: 21701 - DNA, 21 bp, Artificial sequence
  SiRNA target sequence
cagcaattagtcactgtattt

SEQ ID NO: 21702 - DNA, 21 bp, Artificial sequence
  SiRNA target sequence
agcaattagtcactgtatttg

SEQ ID NO: 21703 - DNA, 21 bp, Artificial sequence
  SiRNA target sequence
gcaattagtcactgtatttga

SEQ ID NO: 21704 - DNA, 21 bp, Artificial sequence
  SiRNA target sequence
caattagtcactgtatttgat

SEQ ID NO: 21705 - DNA, 21 bp, Artificial sequence
  SiRNA target sequence
aattagtcactgtatttgatg

SEQ ID NO: 21706 - DNA, 21 bp, Artificial sequence
  SiRNA target sequence
attagtcactgtatttgatga

SEQ ID NO: 21707 - DNA, 21 bp, Artificial sequence
  SiRNA target sequence
ttagtcactgtatttgatgat

SEQ ID NO: 21708 - DNA, 21 bp, Artificial sequence
  SiRNA target sequence
tagtcactgtatttgatgatt

SEQ ID NO: 21709 - DNA, 21 bp, Artificial sequence
  SiRNA target sequence
agtcactgtatttgatgattt

SEQ ID NO: 21710 - DNA, 21 bp, Artificial sequence
  SiRNA target sequence
gtcactgtatttgatgatttt

SEQ ID NO: 21711 - DNA, 21 bp, Artificial sequence
  SiRNA target sequence
tcactgtatttgatgatttta

SEQ ID NO: 21712 - DNA, 21 bp, Artificial sequence
  SiRNA target sequence
cactgtatttgatgattttaa

SEQ ID NO: 21713 - DNA, 21 bp, Artificial sequence
  SiRNA target sequence
actgtatttgatgattttaat

SEQ ID NO: 21714 - DNA, 21 bp, Artificial sequence
  SiRNA target sequence
ctgtatttgatgattttaatc

SEQ ID NO: 21715 - DNA, 21 bp, Artificial sequence
  SiRNA target sequence
tgtatttgatgattttaatca

SEQ ID NO: 21716 - DNA, 21 bp, Artificial sequence
  SiRNA target sequence
gtatttgatgattttaatcaa

SEQ ID NO: 21717 - DNA, 21 bp, Artificial sequence
  SiRNA target sequence
tatttgatgattttaatcaac

SEQ ID NO: 21718 - DNA, 21 bp, Artificial sequence
  SiRNA target sequence
atttgatgattttaatcaaca

SEQ ID NO: 21719 - DNA, 21 bp, Artificial sequence
  SiRNA target sequence
tttgatgattttaatcaacaa

SEQ ID NO: 21720 - DNA, 21 bp, Artificial sequence
  SiRNA target sequence
ttgatgattttaatcaacaag

SEQ ID NO: 21721 - DNA, 21 bp, Artificial sequence
  SiRNA target sequence
tgatgattttaatcaacaagt

SEQ ID NO: 21722 - DNA, 21 bp, Artificial sequence
  SiRNA target sequence
gatgattttaatcaacaagtt

SEQ ID NO: 21723 - DNA, 21 bp, Artificial sequence
  SiRNA target sequence
atgattttaatcaacaagttg

SEQ ID NO: 21724 - DNA, 21 bp, Artificial sequence
  SiRNA target sequence
tgattttaatcaacaagttga

SEQ ID NO: 21725 - DNA, 21 bp, Artificial sequence
  SiRNA target sequence
gattttaatcaacaagttgat

SEQ ID NO: 21726 - DNA, 21 bp, Artificial sequence
  SiRNA target sequence
attttaatcaacaagttgatt

SEQ ID NO: 21727 - DNA, 21 bp, Artificial sequence
  SiRNA target sequence
ttttaatcaacaagttgattc

SEQ ID NO: 21728 - DNA, 21 bp, Artificial sequence
  SiRNA target sequence
tttaatcaacaagttgattcc

SEQ ID NO: 21729 - DNA, 21 bp, Artificial sequence
  SiRNA target sequence
ttaatcaacaagttgattcct

SEQ ID NO: 21730 - DNA, 21 bp, Artificial sequence
  SiRNA target sequence
taatcaacaagttgattcctc

SEQ ID NO: 21731 - DNA, 21 bp, Artificial sequence
  SiRNA target sequence
aatcaacaagttgattcctct

SEQ ID NO: 21732 - DNA, 21 bp, Artificial sequence
  SiRNA target sequence
atcaacaagttgattcctctg

SEQ ID NO: 21733 - DNA, 21 bp, Artificial sequence
  SiRNA target sequence
tcaacaagttgattcctctgc

SEQ ID NO: 21734 - DNA, 21 bp, Artificial sequence
  SiRNA target sequence
caacaagttgattcctctgca

SEQ ID NO: 21735 - DNA, 21 bp, Artificial sequence
  SiRNA target sequence
aacaagttgattcctctgcaa

SEQ ID NO: 21736 - DNA, 21 bp, Artificial sequence
  SiRNA target sequence
acaagttgattcctctgcaaa

SEQ ID NO: 21737 - DNA, 21 bp, Artificial sequence
  SiRNA target sequence
caagttgattcctctgcaaat

SEQ ID NO: 21738 - DNA, 21 bp, Artificial sequence
  SiRNA target sequence
aagttgattcctctgcaaatc

SEQ ID NO: 21739 - DNA, 21 bp, Artificial sequence
  SiRNA target sequence
agttgattcctctgcaaatcc

SEQ ID NO: 21740 - DNA, 21 bp, Artificial sequence
  SiRNA target sequence
gttgattcctctgcaaatcca

SEQ ID NO: 21741 - DNA, 21 bp, Artificial sequence
  SiRNA target sequence
ttgattcctctgcaaatccaa

SEQ ID NO: 21742 - DNA, 21 bp, Artificial sequence
  SiRNA target sequence
tgattcctctgcaaatccaag

SEQ ID NO: 21743 - DNA, 21 bp, Artificial sequence
  SiRNA target sequence
gattcctctgcaaatccaagt

SEQ ID NO: 21744 - DNA, 21 bp, Artificial sequence
  SiRNA target sequence
attcctctgcaaatccaagtt

SEQ ID NO: 21745 - DNA, 21 bp, Artificial sequence
  SiRNA target sequence
ttcctctgcaaatccaagttt

SEQ ID NO: 21746 - DNA, 21 bp, Artificial sequence
  SiRNA target sequence
tcctctgcaaatccaagtttg

SEQ ID NO: 21747 - DNA, 21 bp, Artificial sequence
  SiRNA target sequence
cctctgcaaatccaagtttgg

SEQ ID NO: 21748 - DNA, 21 bp, Artificial sequence
  SiRNA target sequence
ctctgcaaatccaagtttgga

SEQ ID NO: 21749 - DNA, 21 bp, Artificial sequence
  SiRNA target sequence
tctgcaaatccaagtttggag

SEQ ID NO: 21750 - DNA, 21 bp, Artificial sequence
  SiRNA target sequence
ctgcaaatccaagtttggagt

SEQ ID NO: 21751 - DNA, 21 bp, Artificial sequence
  SiRNA target sequence
tgcaaatccaagtttggagtt

SEQ ID NO: 21752 - DNA, 21 bp, Artificial sequence
  SiRNA target sequence
gcaaatccaagtttggagttg

SEQ ID NO: 21753 - DNA, 21 bp, Artificial sequence
  SiRNA target sequence
caaatccaagtttggagttgt

SEQ ID NO: 21754 - DNA, 21 bp, Artificial sequence
  SiRNA target sequence
aaatccaagtttggagttgtt

SEQ ID NO: 21755 - DNA, 21 bp, Artificial sequence
  SiRNA target sequence
aatccaagtttggagttgttt

SEQ ID NO: 21756 - DNA, 21 bp, Artificial sequence
  SiRNA target sequence
atccaagtttggagttgtttg

SEQ ID NO: 21757 - DNA, 21 bp, Artificial sequence
  SiRNA target sequence
tccaagtttggagttgtttga

SEQ ID NO: 21758 - DNA, 21 bp, Artificial sequence
  SiRNA target sequence
ccaagtttggagttgtttgaa

SEQ ID NO: 21759 - DNA, 21 bp, Artificial sequence
  SiRNA target sequence
caagtttggagttgtttgaaa

SEQ ID NO: 21760 - DNA, 21 bp, Artificial sequence
  SiRNA target sequence
aagtttggagttgtttgaaat

SEQ ID NO: 21761 - DNA, 21 bp, Artificial sequence
  SiRNA target sequence
agtttggagttgtttgaaatt

SEQ ID NO: 21762 - DNA, 21 bp, Artificial sequence
  SiRNA target sequence
gtttggagttgtttgaaatta

SEQ ID NO: 21763 - DNA, 21 bp, Artificial sequence
  SiRNA target sequence
tttggagttgtttgaaattat

SEQ ID NO: 21764 - DNA, 21 bp, Artificial sequence
  SiRNA target sequence
ttggagttgtttgaaattatt

SEQ ID NO: 21765 - DNA, 21 bp, Artificial sequence
  SiRNA target sequence
tggagttgtttgaaattatta

SEQ ID NO: 21766 - DNA, 21 bp, Artificial sequence
  SiRNA target sequence
ggagttgtttgaaattattag

SEQ ID NO: 21767 - DNA, 21 bp, Artificial sequence
  SiRNA target sequence
gagttgtttgaaattattagg

SEQ ID NO: 21768 - DNA, 21 bp, Artificial sequence
  SiRNA target sequence
agttgtttgaaattattagga

SEQ ID NO: 21769 - DNA, 21 bp, Artificial sequence
  SiRNA target sequence
gttgtttgaaattattaggag

SEQ ID NO: 21770 - DNA, 21 bp, Artificial sequence
  SiRNA target sequence
ttgtttgaaattattaggagt

SEQ ID NO: 21771 - DNA, 21 bp, Artificial sequence
  SiRNA target sequence
tgtttgaaattattaggagtt

SEQ ID NO: 21772 - DNA, 21 bp, Artificial sequence
  SiRNA target sequence
gtttgaaattattaggagttc

SEQ ID NO: 21773 - DNA, 21 bp, Artificial sequence
  SiRNA target sequence
tttgaaattattaggagttct

SEQ ID NO: 21774 - DNA, 21 bp, Artificial sequence
  SiRNA target sequence
ttgaaattattaggagttcta

SEQ ID NO: 21775 - DNA, 21 bp, Artificial sequence
  SiRNA target sequence
tgaaattattaggagttctaa

SEQ ID NO: 21776 - DNA, 21 bp, Artificial sequence
  SiRNA target sequence
gaaattattaggagttctaat

SEQ ID NO: 21777 - DNA, 21 bp, Artificial sequence
  SiRNA target sequence
aaattattaggagttctaata

SEQ ID NO: 21778 - DNA, 21 bp, Artificial sequence
  SiRNA target sequence
aattattaggagttctaatat

SEQ ID NO: 21779 - DNA, 21 bp, Artificial sequence
  SiRNA target sequence
attattaggagttctaatata

SEQ ID NO: 21780 - DNA, 21 bp, Artificial sequence
  SiRNA target sequence
ttattaggagttctaatatat

SEQ ID NO: 21781 - DNA, 21 bp, Artificial sequence
  SiRNA target sequence
tattaggagttctaatatatt

SEQ ID NO: 21782 - DNA, 21 bp, Artificial sequence
  SiRNA target sequence
attaggagttctaatatattt

SEQ ID NO: 21783 - DNA, 21 bp, Artificial sequence
  SiRNA target sequence
ttaggagttctaatatatttc

SEQ ID NO: 21784 - DNA, 21 bp, Artificial sequence
  SiRNA target sequence
taggagttctaatatatttcc

SEQ ID NO: 21785 - DNA, 21 bp, Artificial sequence
  SiRNA target sequence
aggagttctaatatatttcct

SEQ ID NO: 21786 - DNA, 21 bp, Artificial sequence
  SiRNA target sequence
ggagttctaatatatttcctt

SEQ ID NO: 21787 - DNA, 21 bp, Artificial sequence
  SiRNA target sequence
gagttctaatatatttcctta

SEQ ID NO: 21788 - DNA, 21 bp, Artificial sequence
  SiRNA target sequence
agttctaatatatttccttat

SEQ ID NO: 21789 - DNA, 21 bp, Artificial sequence
  SiRNA target sequence
gttctaatatatttccttatc

SEQ ID NO: 21790 - DNA, 21 bp, Artificial sequence
  SiRNA target sequence
ttctaatatatttccttatcc

SEQ ID NO: 21791 - DNA, 21 bp, Artificial sequence
  SiRNA target sequence
tctaatatatttccttatcca

SEQ ID NO: 21792 - DNA, 21 bp, Artificial sequence
  SiRNA target sequence
ctaatatatttccttatccat

SEQ ID NO: 21793 - DNA, 21 bp, Artificial sequence
  SiRNA target sequence
taatatatttccttatccatt

SEQ ID NO: 21794 - DNA, 21 bp, Artificial sequence
  SiRNA target sequence
aatatatttccttatccatta

SEQ ID NO: 21795 - DNA, 21 bp, Artificial sequence
  SiRNA target sequence
atatatttccttatccattac

SEQ ID NO: 21796 - DNA, 21 bp, Artificial sequence
  SiRNA target sequence
tatatttccttatccattaca

SEQ ID NO: 21797 - DNA, 21 bp, Artificial sequence
  SiRNA target sequence
atatttccttatccattacat

SEQ ID NO: 21798 - DNA, 21 bp, Artificial sequence
  SiRNA target sequence
tatttccttatccattacata

SEQ ID NO: 21799 - DNA, 21 bp, Artificial sequence
  SiRNA target sequence
atttccttatccattacatat

SEQ ID NO: 21800 - DNA, 21 bp, Artificial sequence
  SiRNA target sequence
tttccttatccattacatatg

SEQ ID NO: 21801 - DNA, 21 bp, Artificial sequence
  SiRNA target sequence
ttccttatccattacatatgg

SEQ ID NO: 21802 - DNA, 21 bp, Artificial sequence
  SiRNA target sequence
tccttatccattacatatggc

SEQ ID NO: 21803 - DNA, 21 bp, Artificial sequence
  SiRNA target sequence
ccttatccattacatatggca

SEQ ID NO: 21804 - DNA, 21 bp, Artificial sequence
  SiRNA target sequence
cttatccattacatatggcat

SEQ ID NO: 21805 - DNA, 21 bp, Artificial sequence
  SiRNA target sequence
ttatccattacatatggcatc

SEQ ID NO: 21806 - DNA, 21 bp, Artificial sequence
  SiRNA target sequence
tatccattacatatggcatcg

SEQ ID NO: 21807 - DNA, 21 bp, Artificial sequence
  SiRNA target sequence
atccattacatatggcatcga

SEQ ID NO: 21808 - DNA, 21 bp, Artificial sequence
  SiRNA target sequence
tccattacatatggcatcgat

SEQ ID NO: 21809 - DNA, 21 bp, Artificial sequence
  SiRNA target sequence
ccattacatatggcatcgatc

SEQ ID NO: 21810 - DNA, 21 bp, Artificial sequence
  SiRNA target sequence
cattacatatggcatcgatcg

SEQ ID NO: 21811 - DNA, 21 bp, Artificial sequence
  SiRNA target sequence
attacatatggcatcgatcga

SEQ ID NO: 21812 - DNA, 21 bp, Artificial sequence
  SiRNA target sequence
ttacatatggcatcgatcgaa

SEQ ID NO: 21813 - DNA, 21 bp, Artificial sequence
  SiRNA target sequence
tacatatggcatcgatcgaag

SEQ ID NO: 21814 - DNA, 21 bp, Artificial sequence
  SiRNA target sequence
acatatggcatcgatcgaaga

SEQ ID NO: 21815 - DNA, 21 bp, Artificial sequence
  SiRNA target sequence
catatggcatcgatcgaagag

SEQ ID NO: 21816 - DNA, 21 bp, Artificial sequence
  SiRNA target sequence
atatggcatcgatcgaagaga

SEQ ID NO: 21817 - DNA, 21 bp, Artificial sequence
  SiRNA target sequence
tatggcatcgatcgaagagaa

SEQ ID NO: 21818 - DNA, 21 bp, Artificial sequence
  SiRNA target sequence
atggcatcgatcgaagagaaa

SEQ ID NO: 21819 - DNA, 21 bp, Artificial sequence
  SiRNA target sequence
tggcatcgatcgaagagaaag

SEQ ID NO: 21820 - DNA, 21 bp, Artificial sequence
  SiRNA target sequence
ggcatcgatcgaagagaaagc

SEQ ID NO: 21821 - DNA, 21 bp, Artificial sequence
  SiRNA target sequence
gcatcgatcgaagagaaagct

SEQ ID NO: 21822 - DNA, 21 bp, Artificial sequence
  SiRNA target sequence
catcgatcgaagagaaagcta

SEQ ID NO: 21823 - DNA, 21 bp, Artificial sequence
  SiRNA target sequence
atcgatcgaagagaaagctaa

SEQ ID NO: 21824 - DNA, 21 bp, Artificial sequence
  SiRNA target sequence
tcgatcgaagagaaagctaac

SEQ ID NO: 21825 - DNA, 21 bp, Artificial sequence
  SiRNA target sequence
cgatcgaagagaaagctaaca

SEQ ID NO: 21826 - DNA, 21 bp, Artificial sequence
  SiRNA target sequence
gatcgaagagaaagctaacac

SEQ ID NO: 21827 - DNA, 21 bp, Artificial sequence
  SiRNA target sequence
atcgaagagaaagctaacact

SEQ ID NO: 21828 - DNA, 21 bp, Artificial sequence
  SiRNA target sequence
tcgaagagaaagctaacactg

SEQ ID NO: 21829 - DNA, 21 bp, Artificial sequence
  SiRNA target sequence
cgaagagaaagctaacactgt

SEQ ID NO: 21830 - DNA, 21 bp, Artificial sequence
  SiRNA target sequence
gaagagaaagctaacactgtt

SEQ ID NO: 21831 - DNA, 21 bp, Artificial sequence
  SiRNA target sequence
aagagaaagctaacactgttt

SEQ ID NO: 21832 - DNA, 21 bp, Artificial sequence
  SiRNA target sequence
agagaaagctaacactgtttt

SEQ ID NO: 21833 - DNA, 21 bp, Artificial sequence
  SiRNA target sequence
gagaaagctaacactgttttt

SEQ ID NO: 21834 - DNA, 21 bp, Artificial sequence
  SiRNA target sequence
agaaagctaacactgtttttc

SEQ ID NO: 21835 - DNA, 21 bp, Artificial sequence
  SiRNA target sequence
gaaagctaacactgtttttca

SEQ ID NO: 21836 - DNA, 21 bp, Artificial sequence
  SiRNA target sequence
aaagctaacactgtttttcaa

SEQ ID NO: 21837 - DNA, 21 bp, Artificial sequence
  SiRNA target sequence
aagctaacactgtttttcaat

SEQ ID NO: 21838 - DNA, 21 bp, Artificial sequence
  SiRNA target sequence
agctaacactgtttttcaatc

SEQ ID NO: 21839 - DNA, 21 bp, Artificial sequence
  SiRNA target sequence
gctaacactgtttttcaatca

SEQ ID NO: 21840 - DNA, 21 bp, Artificial sequence
  SiRNA target sequence
ctaacactgtttttcaatcaa

SEQ ID NO: 21841 - DNA, 21 bp, Artificial sequence
  SiRNA target sequence
taacactgtttttcaatcaaa

SEQ ID NO: 21842 - DNA, 21 bp, Artificial sequence
  SiRNA target sequence
aacactgtttttcaatcaaag

SEQ ID NO: 21843 - DNA, 21 bp, Artificial sequence
  SiRNA target sequence
acactgtttttcaatcaaagg

SEQ ID NO: 21844 - DNA, 21 bp, Artificial sequence
  SiRNA target sequence
cactgtttttcaatcaaaggt

SEQ ID NO: 21845 - DNA, 21 bp, Artificial sequence
  SiRNA target sequence
actgtttttcaatcaaaggtg

SEQ ID NO: 21846 - DNA, 21 bp, Artificial sequence
  SiRNA target sequence
ctgtttttcaatcaaaggtga

SEQ ID NO: 21847 - DNA, 21 bp, Artificial sequence
  SiRNA target sequence
tgtttttcaatcaaaggtgat

SEQ ID NO: 21848 - DNA, 21 bp, Artificial sequence
  SiRNA target sequence
gtttttcaatcaaaggtgata

SEQ ID NO: 21849 - DNA, 21 bp, Artificial sequence
  SiRNA target sequence
tttttcaatcaaaggtgatat

SEQ ID NO: 21850 - DNA, 21 bp, Artificial sequence
  SiRNA target sequence
ttttcaatcaaaggtgatatt

SEQ ID NO: 21851 - DNA, 21 bp, Artificial sequence
  SiRNA target sequence
tttcaatcaaaggtgatattg

SEQ ID NO: 21852 - DNA, 21 bp, Artificial sequence
  SiRNA target sequence
ttcaatcaaaggtgatattgt

SEQ ID NO: 21853 - DNA, 21 bp, Artificial sequence
  SiRNA target sequence
tcaatcaaaggtgatattgtg

SEQ ID NO: 21854 - DNA, 21 bp, Artificial sequence
  SiRNA target sequence
caatcaaaggtgatattgtgt

SEQ ID NO: 21855 - DNA, 21 bp, Artificial sequence
  SiRNA target sequence
aatcaaaggtgatattgtgtt

SEQ ID NO: 21856 - DNA, 21 bp, Artificial sequence
  SiRNA target sequence
atcaaaggtgatattgtgttc

SEQ ID NO: 21857 - DNA, 21 bp, Artificial sequence
  SiRNA target sequence
tcaaaggtgatattgtgttct

SEQ ID NO: 21858 - DNA, 21 bp, Artificial sequence
  SiRNA target sequence
caaaggtgatattgtgttctt

SEQ ID NO: 21859 - DNA, 21 bp, Artificial sequence
  SiRNA target sequence
aaaggtgatattgtgttcttc

SEQ ID NO: 21860 - DNA, 21 bp, Artificial sequence
  SiRNA target sequence
aaggtgatattgtgttcttct

SEQ ID NO: 21861 - DNA, 21 bp, Artificial sequence
  SiRNA target sequence
aggtgatattgtgttcttcta

SEQ ID NO: 21862 - DNA, 21 bp, Artificial sequence
  SiRNA target sequence
ggtgatattgtgttcttctaa

SEQ ID NO: 21863 - DNA, 21 bp, Artificial sequence
  SiRNA target sequence
gtgatattgtgttcttctaac

SEQ ID NO: 21864 - DNA, 21 bp, Artificial sequence
  SiRNA target sequence
tgatattgtgttcttctaaca

SEQ ID NO: 21865 - DNA, 21 bp, Artificial sequence
  SiRNA target sequence
gatattgtgttcttctaacaa

SEQ ID NO: 21866 - DNA, 21 bp, Artificial sequence
  SiRNA target sequence
atattgtgttcttctaacaat

SEQ ID NO: 21867 - DNA, 21 bp, Artificial sequence
  SiRNA target sequence
tattgtgttcttctaacaata

SEQ ID NO: 21868 - DNA, 21 bp, Artificial sequence
  SiRNA target sequence
attgtgttcttctaacaataa

SEQ ID NO: 21869 - DNA, 21 bp, Artificial sequence
  SiRNA target sequence
ttgtgttcttctaacaataag

SEQ ID NO: 21870 - DNA, 21 bp, Artificial sequence
  SiRNA target sequence
tgtgttcttctaacaataaga

SEQ ID NO: 21871 - DNA, 21 bp, Artificial sequence
  SiRNA target sequence
gtgttcttctaacaataagac

SEQ ID NO: 21872 - DNA, 21 bp, Artificial sequence
  SiRNA target sequence
tgttcttctaacaataagact

SEQ ID NO: 21873 - DNA, 21 bp, Artificial sequence
  SiRNA target sequence
gttcttctaacaataagactc

SEQ ID NO: 21874 - DNA, 21 bp, Artificial sequence
  SiRNA target sequence
ttcttctaacaataagactcc

SEQ ID NO: 21875 - DNA, 21 bp, Artificial sequence
  SiRNA target sequence
tcttctaacaataagactcca

SEQ ID NO: 21876 - DNA, 21 bp, Artificial sequence
  SiRNA target sequence
cttctaacaataagactccaa

SEQ ID NO: 21877 - DNA, 21 bp, Artificial sequence
  SiRNA target sequence
ttctaacaataagactccaaa

SEQ ID NO: 21878 - DNA, 21 bp, Artificial sequence
  SiRNA target sequence
tctaacaataagactccaaaa

SEQ ID NO: 21879 - DNA, 21 bp, Artificial sequence
  SiRNA target sequence
ctaacaataagactccaaaaa

SEQ ID NO: 21880 - DNA, 21 bp, Artificial sequence
  SiRNA target sequence
taacaataagactccaaaaac

SEQ ID NO: 21881 - DNA, 21 bp, Artificial sequence
  SiRNA target sequence
aacaataagactccaaaaact

SEQ ID NO: 21882 - DNA, 21 bp, Artificial sequence
  SiRNA target sequence
acaataagactccaaaaactg

SEQ ID NO: 21883 - DNA, 21 bp, Artificial sequence
  SiRNA target sequence
caataagactccaaaaactga

SEQ ID NO: 21884 - DNA, 21 bp, Artificial sequence
  SiRNA target sequence
aataagactccaaaaactgaa

SEQ ID NO: 21885 - DNA, 21 bp, Artificial sequence
  SiRNA target sequence
ataagactccaaaaactgaat

SEQ ID NO: 21886 - DNA, 21 bp, Artificial sequence
  SiRNA target sequence
taagactccaaaaactgaatc

SEQ ID NO: 21887 - DNA, 21 bp, Artificial sequence
  SiRNA target sequence
aagactccaaaaactgaatcc

SEQ ID NO: 21888 - DNA, 21 bp, Artificial sequence
  SiRNA target sequence
agactccaaaaactgaatccc

SEQ ID NO: 21889 - DNA, 21 bp, Artificial sequence
  SiRNA target sequence
gactccaaaaactgaatccct

SEQ ID NO: 21890 - DNA, 21 bp, Artificial sequence
  SiRNA target sequence
actccaaaaactgaatcccta

SEQ ID NO: 21891 - DNA, 21 bp, Artificial sequence
  SiRNA target sequence
ctccaaaaactgaatccctaa

SEQ ID NO: 21892 - DNA, 21 bp, Artificial sequence
  SiRNA target sequence
tccaaaaactgaatccctaaa

SEQ ID NO: 21893 - DNA, 21 bp, Artificial sequence
  SiRNA target sequence
ccaaaaactgaatccctaaac

SEQ ID NO: 21894 - DNA, 21 bp, Artificial sequence
  SiRNA target sequence
caaaaactgaatccctaaact

SEQ ID NO: 21895 - DNA, 21 bp, Artificial sequence
  SiRNA target sequence
aaaaactgaatccctaaacta

SEQ ID NO: 21896 - DNA, 21 bp, Artificial sequence
  SiRNA target sequence
aaaactgaatccctaaactac

SEQ ID NO: 21897 - DNA, 21 bp, Artificial sequence
  SiRNA target sequence
aaactgaatccctaaactacc

SEQ ID NO: 21898 - DNA, 21 bp, Artificial sequence
  SiRNA target sequence
aactgaatccctaaactaccc

SEQ ID NO: 21899 - DNA, 21 bp, Artificial sequence
  SiRNA target sequence
actgaatccctaaactacccg

SEQ ID NO: 21900 - DNA, 21 bp, Artificial sequence
  SiRNA target sequence
ctgaatccctaaactacccga

SEQ ID NO: 21901 - DNA, 21 bp, Artificial sequence
  SiRNA target sequence
tgaatccctaaactacccgaa

SEQ ID NO: 21902 - DNA, 21 bp, Artificial sequence
  SiRNA target sequence
gaatccctaaactacccgaaa

SEQ ID NO: 21903 - DNA, 21 bp, Artificial sequence
  SiRNA target sequence
aatccctaaactacccgaaag

SEQ ID NO: 21904 - DNA, 21 bp, Artificial sequence
  SiRNA target sequence
atccctaaactacccgaaagc

SEQ ID NO: 21905 - DNA, 21 bp, Artificial sequence
  SiRNA target sequence
tccctaaactacccgaaagct

SEQ ID NO: 21906 - DNA, 21 bp, Artificial sequence
  SiRNA target sequence
ccctaaactacccgaaagctt

SEQ ID NO: 21907 - DNA, 21 bp, Artificial sequence
  SiRNA target sequence
cctaaactacccgaaagcttt

SEQ ID NO: 21908 - DNA, 21 bp, Artificial sequence
  SiRNA target sequence
ctaaactacccgaaagctttg

SEQ ID NO: 21909 - DNA, 21 bp, Artificial sequence
  SiRNA target sequence
taaactacccgaaagctttgt

SEQ ID NO: 21910 - DNA, 21 bp, Artificial sequence
  SiRNA target sequence
aaactacccgaaagctttgtt

SEQ ID NO: 21911 - DNA, 21 bp, Artificial sequence
  SiRNA target sequence
aactacccgaaagctttgttg

SEQ ID NO: 21912 - DNA, 21 bp, Artificial sequence
  SiRNA target sequence
actacccgaaagctttgttga

SEQ ID NO: 21913 - DNA, 21 bp, Artificial sequence
  SiRNA target sequence
ctacccgaaagctttgttgag

SEQ ID NO: 21914 - DNA, 21 bp, Artificial sequence
  SiRNA target sequence
tacccgaaagctttgttgagg

SEQ ID NO: 21915 - DNA, 21 bp, Artificial sequence
  SiRNA target sequence
acccgaaagctttgttgagga

SEQ ID NO: 21916 - DNA, 21 bp, Artificial sequence
  SiRNA target sequence
cccgaaagctttgttgaggag

SEQ ID NO: 21917 - DNA, 21 bp, Artificial sequence
  SiRNA target sequence
ccgaaagctttgttgaggagg

SEQ ID NO: 21918 - DNA, 21 bp, Artificial sequence
  SiRNA target sequence
cgaaagctttgttgaggaggt

SEQ ID NO: 21919 - DNA, 21 bp, Artificial sequence
  SiRNA target sequence
gaaagctttgttgaggaggtt

SEQ ID NO: 21920 - DNA, 21 bp, Artificial sequence
  SiRNA target sequence
aaagctttgttgaggaggttt

SEQ ID NO: 21921 - DNA, 21 bp, Artificial sequence
  SiRNA target sequence
aagctttgttgaggaggtttg

SEQ ID NO: 21922 - DNA, 21 bp, Artificial sequence
  SiRNA target sequence
agctttgttgaggaggtttgc

SEQ ID NO: 21923 - DNA, 21 bp, Artificial sequence
  SiRNA target sequence
gctttgttgaggaggtttgcg

SEQ ID NO: 21924 - DNA, 21 bp, Artificial sequence
  SiRNA target sequence
ctttgttgaggaggtttgcga

SEQ ID NO: 21925 - DNA, 21 bp, Artificial sequence
  SiRNA target sequence
tttgttgaggaggtttgcgaa

SEQ ID NO: 21926 - DNA, 21 bp, Artificial sequence
  SiRNA target sequence
ttgttgaggaggtttgcgaaa

SEQ ID NO: 21927 - DNA, 21 bp, Artificial sequence
  SiRNA target sequence
tgttgaggaggtttgcgaaat

SEQ ID NO: 21928 - DNA, 21 bp, Artificial sequence
  SiRNA target sequence
gttgaggaggtttgcgaaatt

SEQ ID NO: 21929 - DNA, 21 bp, Artificial sequence
  SiRNA target sequence
ttgaggaggtttgcgaaattt

SEQ ID NO: 21930 - DNA, 21 bp, Artificial sequence
  SiRNA target sequence
tgaggaggtttgcgaaatttg

SEQ ID NO: 21931 - DNA, 21 bp, Artificial sequence
  SiRNA target sequence
gaggaggtttgcgaaatttgt

SEQ ID NO: 21932 - DNA, 21 bp, Artificial sequence
  SiRNA target sequence
aggaggtttgcgaaatttgtt

SEQ ID NO: 21933 - DNA, 21 bp, Artificial sequence
  SiRNA target sequence
ggaggtttgcgaaatttgttg

SEQ ID NO: 21934 - DNA, 21 bp, Artificial sequence
  SiRNA target sequence
gaggtttgcgaaatttgttga

SEQ ID NO: 21935 - DNA, 21 bp, Artificial sequence
  SiRNA target sequence
aggtttgcgaaatttgttgaa

SEQ ID NO: 21936 - DNA, 21 bp, Artificial sequence
  SiRNA target sequence
ggtttgcgaaatttgttgaag

SEQ ID NO: 21937 - DNA, 21 bp, Artificial sequence
  SiRNA target sequence
gtttgcgaaatttgttgaagt

SEQ ID NO: 21938 - DNA, 21 bp, Artificial sequence
  SiRNA target sequence
tttgcgaaatttgttgaagta

SEQ ID NO: 21939 - DNA, 21 bp, Artificial sequence
  SiRNA target sequence
ttgcgaaatttgttgaagtaa

SEQ ID NO: 21940 - DNA, 21 bp, Artificial sequence
  SiRNA target sequence
tgcgaaatttgttgaagtaaa

SEQ ID NO: 21941 - DNA, 21 bp, Artificial sequence
  SiRNA target sequence
gcgaaatttgttgaagtaaag

SEQ ID NO: 21942 - DNA, 21 bp, Artificial sequence
  SiRNA target sequence
cgaaatttgttgaagtaaaga

SEQ ID NO: 21943 - DNA, 21 bp, Artificial sequence
  SiRNA target sequence
gaaatttgttgaagtaaagag

SEQ ID NO: 21944 - DNA, 21 bp, Artificial sequence
  SiRNA target sequence
aaatttgttgaagtaaagaga

SEQ ID NO: 21945 - DNA, 21 bp, Artificial sequence
  SiRNA target sequence
aatttgttgaagtaaagagag

SEQ ID NO: 21946 - DNA, 21 bp, Artificial sequence
  SiRNA target sequence
atttgttgaagtaaagagagc

SEQ ID NO: 21947 - DNA, 21 bp, Artificial sequence
  SiRNA target sequence
tttgttgaagtaaagagagct

SEQ ID NO: 21948 - DNA, 21 bp, Artificial sequence
  SiRNA target sequence
ttgttgaagtaaagagagctc

SEQ ID NO: 21949 - DNA, 21 bp, Artificial sequence
  SiRNA target sequence
tgttgaagtaaagagagctcc

SEQ ID NO: 21950 - DNA, 21 bp, Artificial sequence
  SiRNA target sequence
gttgaagtaaagagagctcct

SEQ ID NO: 21951 - DNA, 21 bp, Artificial sequence
  SiRNA target sequence
ttgaagtaaagagagctcctt

SEQ ID NO: 21952 - DNA, 21 bp, Artificial sequence
  SiRNA target sequence
tgaagtaaagagagctccttc

SEQ ID NO: 21953 - DNA, 21 bp, Artificial sequence
  SiRNA target sequence
gaagtaaagagagctccttct

SEQ ID NO: 21954 - DNA, 21 bp, Artificial sequence
  SiRNA target sequence
aagtaaagagagctccttctg

SEQ ID NO: 21955 - DNA, 21 bp, Artificial sequence
  SiRNA target sequence
agtaaagagagctccttctga

SEQ ID NO: 21956 - DNA, 21 bp, Artificial sequence
  SiRNA target sequence
gtaaagagagctccttctgaa

SEQ ID NO: 21957 - DNA, 21 bp, Artificial sequence
  SiRNA target sequence
taaagagagctccttctgaaa

SEQ ID NO: 21958 - DNA, 21 bp, Artificial sequence
  SiRNA target sequence
aaagagagctccttctgaaag

SEQ ID NO: 21959 - DNA, 21 bp, Artificial sequence
  SiRNA target sequence
aagagagctccttctgaaagt

SEQ ID NO: 21960 - DNA, 21 bp, Artificial sequence
  SiRNA target sequence
agagagctccttctgaaagtg

SEQ ID NO: 21961 - DNA, 21 bp, Artificial sequence
  SiRNA target sequence
gagagctccttctgaaagtgg

SEQ ID NO: 21962 - DNA, 21 bp, Artificial sequence
  SiRNA target sequence
agagctccttctgaaagtggt

SEQ ID NO: 21963 - DNA, 21 bp, Artificial sequence
  SiRNA target sequence
gagctccttctgaaagtggta

SEQ ID NO: 21964 - DNA, 21 bp, Artificial sequence
  SiRNA target sequence
agctccttctgaaagtggtac

SEQ ID NO: 21965 - DNA, 21 bp, Artificial sequence
  SiRNA target sequence
gctccttctgaaagtggtaca

SEQ ID NO: 21966 - DNA, 21 bp, Artificial sequence
  SiRNA target sequence
ctccttctgaaagtggtacat

SEQ ID NO: 21967 - DNA, 21 bp, Artificial sequence
  SiRNA target sequence
tccttctgaaagtggtacatt

SEQ ID NO: 21968 - DNA, 21 bp, Artificial sequence
  SiRNA target sequence
ccttctgaaagtggtacattt

SEQ ID NO: 21969 - DNA, 21 bp, Artificial sequence
  SiRNA target sequence
cttctgaaagtggtacatttt

SEQ ID NO: 21970 - DNA, 21 bp, Artificial sequence
  SiRNA target sequence
ttctgaaagtggtacattttc

SEQ ID NO: 21971 - DNA, 21 bp, Artificial sequence
  SiRNA target sequence
tctgaaagtggtacattttct

SEQ ID NO: 21972 - DNA, 21 bp, Artificial sequence
  SiRNA target sequence
ctgaaagtggtacattttcta

SEQ ID NO: 21973 - DNA, 21 bp, Artificial sequence
  SiRNA target sequence
tgaaagtggtacattttctac

SEQ ID NO: 21974 - DNA, 21 bp, Artificial sequence
  SiRNA target sequence
gaaagtggtacattttctact

SEQ ID NO: 21975 - DNA, 21 bp, Artificial sequence
  SiRNA target sequence
aaagtggtacattttctactg

SEQ ID NO: 21976 - DNA, 21 bp, Artificial sequence
  SiRNA target sequence
aagtggtacattttctactga

SEQ ID NO: 21977 - DNA, 21 bp, Artificial sequence
  SiRNA target sequence
agtggtacattttctactgat

SEQ ID NO: 21978 - DNA, 21 bp, Artificial sequence
  SiRNA target sequence
gtggtacattttctactgatt

SEQ ID NO: 21979 - DNA, 21 bp, Artificial sequence
  SiRNA target sequence
tggtacattttctactgattg

SEQ ID NO: 21980 - DNA, 21 bp, Artificial sequence
  SiRNA target sequence
ggtacattttctactgattgt

SEQ ID NO: 21981 - DNA, 21 bp, Artificial sequence
  SiRNA target sequence
gtacattttctactgattgtt

SEQ ID NO: 21982 - DNA, 21 bp, Artificial sequence
  SiRNA target sequence
tacattttctactgattgtta

SEQ ID NO: 21983 - DNA, 21 bp, Artificial sequence
  SiRNA target sequence
acattttctactgattgttat

SEQ ID NO: 21984 - DNA, 21 bp, Artificial sequence
  SiRNA target sequence
cattttctactgattgttata

SEQ ID NO: 21985 - DNA, 21 bp, Artificial sequence
  SiRNA target sequence
attttctactgattgttatac

SEQ ID NO: 21986 - DNA, 21 bp, Artificial sequence
  SiRNA target sequence
ttttctactgattgttatacc

SEQ ID NO: 21987 - DNA, 21 bp, Artificial sequence
  SiRNA target sequence
tttctactgattgttatacct

SEQ ID NO: 21988 - DNA, 21 bp, Artificial sequence
  SiRNA target sequence
ttctactgattgttatacctt

SEQ ID NO: 21989 - DNA, 21 bp, Artificial sequence
  SiRNA target sequence
tctactgattgttataccttt

SEQ ID NO: 21990 - DNA, 21 bp, Artificial sequence
  SiRNA target sequence
ctactgattgttatacctttg

SEQ ID NO: 21991 - DNA, 21 bp, Artificial sequence
  SiRNA target sequence
tactgattgttatacctttgt

SEQ ID NO: 21992 - DNA, 21 bp, Artificial sequence
  SiRNA target sequence
actgattgttatacctttgtg

SEQ ID NO: 21993 - DNA, 21 bp, Artificial sequence
  SiRNA target sequence
ctgattgttatacctttgtgg

SEQ ID NO: 21994 - DNA, 21 bp, Artificial sequence
  SiRNA target sequence
tgattgttatacctttgtgga

SEQ ID NO: 21995 - DNA, 21 bp, Artificial sequence
  SiRNA target sequence
gattgttatacctttgtggaa

SEQ ID NO: 21996 - DNA, 21 bp, Artificial sequence
  SiRNA target sequence
attgttatacctttgtggaat

SEQ ID NO: 21997 - DNA, 21 bp, Artificial sequence
  SiRNA target sequence
ttgttatacctttgtggaata

SEQ ID NO: 21998 - DNA, 21 bp, Artificial sequence
  SiRNA target sequence
tgttatacctttgtggaatat

SEQ ID NO: 21999 - DNA, 21 bp, Artificial sequence
  SiRNA target sequence
gttatacctttgtggaatatg

SEQ ID NO: 22000 - DNA, 21 bp, Artificial sequence
  SiRNA target sequence
ttatacctttgtggaatatga

SEQ ID NO: 22001 - DNA, 21 bp, Artificial sequence
  SiRNA target sequence
tatacctttgtggaatatgat

SEQ ID NO: 22002 - DNA, 21 bp, Artificial sequence
  SiRNA target sequence
atacctttgtggaatatgatc

SEQ ID NO: 22003 - DNA, 21 bp, Artificial sequence
  SiRNA target sequence
tacctttgtggaatatgatcc

SEQ ID NO: 22004 - DNA, 21 bp, Artificial sequence
  SiRNA target sequence
acctttgtggaatatgatcca

SEQ ID NO: 22005 - DNA, 21 bp, Artificial sequence
  SiRNA target sequence
cctttgtggaatatgatccat

SEQ ID NO: 22006 - DNA, 21 bp, Artificial sequence
  SiRNA target sequence
ctttgtggaatatgatccatt

SEQ ID NO: 22007 - DNA, 21 bp, Artificial sequence
  SiRNA target sequence
tttgtggaatatgatccattc

SEQ ID NO: 22008 - DNA, 21 bp, Artificial sequence
  SiRNA target sequence
ttgtggaatatgatccattcg

SEQ ID NO: 22009 - DNA, 21 bp, Artificial sequence
  SiRNA target sequence
tgtggaatatgatccattcga

SEQ ID NO: 22010 - DNA, 21 bp, Artificial sequence
  SiRNA target sequence
gtggaatatgatccattcgac

SEQ ID NO: 22011 - DNA, 21 bp, Artificial sequence
  SiRNA target sequence
tggaatatgatccattcgacc

SEQ ID NO: 22012 - DNA, 21 bp, Artificial sequence
  SiRNA target sequence
ggaatatgatccattcgacca

SEQ ID NO: 22013 - DNA, 21 bp, Artificial sequence
  SiRNA target sequence
gaatatgatccattcgaccat

SEQ ID NO: 22014 - DNA, 21 bp, Artificial sequence
  SiRNA target sequence
aatatgatccattcgaccatt

SEQ ID NO: 22015 - DNA, 21 bp, Artificial sequence
  SiRNA target sequence
atatgatccattcgaccattg

SEQ ID NO: 22016 - DNA, 21 bp, Artificial sequence
  SiRNA target sequence
tatgatccattcgaccattgt

SEQ ID NO: 22017 - DNA, 21 bp, Artificial sequence
  SiRNA target sequence
atgatccattcgaccattgta

SEQ ID NO: 22018 - DNA, 21 bp, Artificial sequence
  SiRNA target sequence
tgatccattcgaccattgtaa

SEQ ID NO: 22019 - DNA, 21 bp, Artificial sequence
  SiRNA target sequence
gatccattcgaccattgtaat

SEQ ID NO: 22020 - DNA, 21 bp, Artificial sequence
  SiRNA target sequence
atccattcgaccattgtaata

SEQ ID NO: 22021 - DNA, 21 bp, Artificial sequence
  SiRNA target sequence
tccattcgaccattgtaatat

SEQ ID NO: 22022 - DNA, 21 bp, Artificial sequence
  SiRNA target sequence
ccattcgaccattgtaatatc

SEQ ID NO: 22023 - DNA, 21 bp, Artificial sequence
  SiRNA target sequence
cattcgaccattgtaatatcg

SEQ ID NO: 22024 - DNA, 21 bp, Artificial sequence
  SiRNA target sequence
attcgaccattgtaatatcgt

SEQ ID NO: 22025 - DNA, 21 bp, Artificial sequence
  SiRNA target sequence
ttcgaccattgtaatatcgtc

SEQ ID NO: 22026 - DNA, 21 bp, Artificial sequence
  SiRNA target sequence
tcgaccattgtaatatcgtca

SEQ ID NO: 22027 - DNA, 21 bp, Artificial sequence
  SiRNA target sequence
cgaccattgtaatatcgtcaa

SEQ ID NO: 22028 - DNA, 21 bp, Artificial sequence
  SiRNA target sequence
gaccattgtaatatcgtcaaa

SEQ ID NO: 22029 - DNA, 21 bp, Artificial sequence
  SiRNA target sequence
accattgtaatatcgtcaaat

SEQ ID NO: 22030 - DNA, 21 bp, Artificial sequence
  SiRNA target sequence
ccattgtaatatcgtcaaatc

SEQ ID NO: 22031 - DNA, 21 bp, Artificial sequence
  SiRNA target sequence
cattgtaatatcgtcaaatca

SEQ ID NO: 22032 - DNA, 21 bp, Artificial sequence
  SiRNA target sequence
attgtaatatcgtcaaatcaa

SEQ ID NO: 22033 - DNA, 21 bp, Artificial sequence
  SiRNA target sequence
ttgtaatatcgtcaaatcaat

SEQ ID NO: 22034 - DNA, 21 bp, Artificial sequence
  SiRNA target sequence
tgtaatatcgtcaaatcaatg

SEQ ID NO: 22035 - DNA, 21 bp, Artificial sequence
  SiRNA target sequence
gtaatatcgtcaaatcaatgt

SEQ ID NO: 22036 - DNA, 21 bp, Artificial sequence
  SiRNA target sequence
taatatcgtcaaatcaatgtc

SEQ ID NO: 22037 - DNA, 21 bp, Artificial sequence
  SiRNA target sequence
aatatcgtcaaatcaatgtct

SEQ ID NO: 22038 - DNA, 21 bp, Artificial sequence
  SiRNA target sequence
atatcgtcaaatcaatgtctt

SEQ ID NO: 22039 - DNA, 21 bp, Artificial sequence
  SiRNA target sequence
tatcgtcaaatcaatgtcttt

SEQ ID NO: 22040 - DNA, 21 bp, Artificial sequence
  SiRNA target sequence
atcgtcaaatcaatgtctttc

SEQ ID NO: 22041 - DNA, 21 bp, Artificial sequence
  SiRNA target sequence
tcgtcaaatcaatgtctttca

SEQ ID NO: 22042 - DNA, 21 bp, Artificial sequence
  SiRNA target sequence
cgtcaaatcaatgtctttcaa

SEQ ID NO: 22043 - DNA, 21 bp, Artificial sequence
  SiRNA target sequence
gtcaaatcaatgtctttcaaa

SEQ ID NO: 22044 - DNA, 21 bp, Artificial sequence
  SiRNA target sequence
tcaaatcaatgtctttcaaag

SEQ ID NO: 22045 - DNA, 21 bp, Artificial sequence
  SiRNA target sequence
caaatcaatgtctttcaaaga

SEQ ID NO: 22046 - DNA, 21 bp, Artificial sequence
  SiRNA target sequence
aaatcaatgtctttcaaagag

SEQ ID NO: 22047 - DNA, 21 bp, Artificial sequence
  SiRNA target sequence
aatcaatgtctttcaaagagt

SEQ ID NO: 22048 - DNA, 21 bp, Artificial sequence
  SiRNA target sequence
atcaatgtctttcaaagagtt

SEQ ID NO: 22049 - DNA, 21 bp, Artificial sequence
  SiRNA target sequence
tcaatgtctttcaaagagttg

SEQ ID NO: 22050 - DNA, 21 bp, Artificial sequence
  SiRNA target sequence
caatgtctttcaaagagttga

SEQ ID NO: 22051 - DNA, 21 bp, Artificial sequence
  SiRNA target sequence
aatgtctttcaaagagttgat

SEQ ID NO: 22052 - DNA, 21 bp, Artificial sequence
  SiRNA target sequence
atgtctttcaaagagttgata

SEQ ID NO: 22053 - DNA, 21 bp, Artificial sequence
  SiRNA target sequence
tgtctttcaaagagttgatag

SEQ ID NO: 22054 - DNA, 21 bp, Artificial sequence
  SiRNA target sequence
gtctttcaaagagttgataga

SEQ ID NO: 22055 - DNA, 21 bp, Artificial sequence
  SiRNA target sequence
tctttcaaagagttgatagat

SEQ ID NO: 22056 - DNA, 21 bp, Artificial sequence
  SiRNA target sequence
ctttcaaagagttgatagatg

SEQ ID NO: 22057 - DNA, 21 bp, Artificial sequence
  SiRNA target sequence
tttcaaagagttgatagatga

SEQ ID NO: 22058 - DNA, 21 bp, Artificial sequence
  SiRNA target sequence
ttcaaagagttgatagatgaa

SEQ ID NO: 22059 - DNA, 21 bp, Artificial sequence
  SiRNA target sequence
tcaaagagttgatagatgaag

SEQ ID NO: 22060 - DNA, 21 bp, Artificial sequence
  SiRNA target sequence
caaagagttgatagatgaagt

SEQ ID NO: 22061 - DNA, 21 bp, Artificial sequence
  SiRNA target sequence
aaagagttgatagatgaagtg

SEQ ID NO: 22062 - DNA, 21 bp, Artificial sequence
  SiRNA target sequence
aagagttgatagatgaagtgg

SEQ ID NO: 22063 - DNA, 21 bp, Artificial sequence
  SiRNA target sequence
agagttgatagatgaagtggt

SEQ ID NO: 22064 - DNA, 21 bp, Artificial sequence
  SiRNA target sequence
gagttgatagatgaagtggtc

SEQ ID NO: 22065 - DNA, 21 bp, Artificial sequence
  SiRNA target sequence
agttgatagatgaagtggtcg

SEQ ID NO: 22066 - DNA, 21 bp, Artificial sequence
  SiRNA target sequence
gttgatagatgaagtggtcgc

SEQ ID NO: 22067 - DNA, 21 bp, Artificial sequence
  SiRNA target sequence
ttgatagatgaagtggtcgct

SEQ ID NO: 22068 - DNA, 21 bp, Artificial sequence
  SiRNA target sequence
tgatagatgaagtggtcgcta

SEQ ID NO: 22069 - DNA, 21 bp, Artificial sequence
  SiRNA target sequence
gatagatgaagtggtcgctat

SEQ ID NO: 22070 - DNA, 21 bp, Artificial sequence
  SiRNA target sequence
atagatgaagtggtcgctatg

SEQ ID NO: 22071 - DNA, 21 bp, Artificial sequence
  SiRNA target sequence
tagatgaagtggtcgctatgt

SEQ ID NO: 22072 - DNA, 21 bp, Artificial sequence
  SiRNA target sequence
agatgaagtggtcgctatgta

SEQ ID NO: 22073 - DNA, 21 bp, Artificial sequence
  SiRNA target sequence
gatgaagtggtcgctatgtat

SEQ ID NO: 22074 - DNA, 21 bp, Artificial sequence
  SiRNA target sequence
atgaagtggtcgctatgtatt

SEQ ID NO: 22075 - DNA, 21 bp, Artificial sequence
  SiRNA target sequence
tgaagtggtcgctatgtattt

SEQ ID NO: 22076 - DNA, 21 bp, Artificial sequence
  SiRNA target sequence
gaagtggtcgctatgtatttc

SEQ ID NO: 22077 - DNA, 21 bp, Artificial sequence
  SiRNA target sequence
aagtggtcgctatgtatttcc

SEQ ID NO: 22078 - DNA, 21 bp, Artificial sequence
  SiRNA target sequence
agtggtcgctatgtatttcca

SEQ ID NO: 22079 - DNA, 21 bp, Artificial sequence
  SiRNA target sequence
gtggtcgctatgtatttccac

SEQ ID NO: 22080 - DNA, 21 bp, Artificial sequence
  SiRNA target sequence
tggtcgctatgtatttccacg

SEQ ID NO: 22081 - DNA, 21 bp, Artificial sequence
  SiRNA target sequence
ggtcgctatgtatttccacga

SEQ ID NO: 22082 - DNA, 21 bp, Artificial sequence
  SiRNA target sequence
gtcgctatgtatttccacgaa

SEQ ID NO: 22083 - DNA, 21 bp, Artificial sequence
  SiRNA target sequence
tcgctatgtatttccacgaag

SEQ ID NO: 22084 - DNA, 21 bp, Artificial sequence
  SiRNA target sequence
cgctatgtatttccacgaagg

SEQ ID NO: 22085 - DNA, 21 bp, Artificial sequence
  SiRNA target sequence
gctatgtatttccacgaagga

SEQ ID NO: 22086 - DNA, 21 bp, Artificial sequence
  SiRNA target sequence
ctatgtatttccacgaaggag

SEQ ID NO: 22087 - DNA, 21 bp, Artificial sequence
  SiRNA target sequence
tatgtatttccacgaaggaga

SEQ ID NO: 22088 - DNA, 21 bp, Artificial sequence
  SiRNA target sequence
atgtatttccacgaaggagag

SEQ ID NO: 22089 - DNA, 21 bp, Artificial sequence
  SiRNA target sequence
tgtatttccacgaaggagagt

SEQ ID NO: 22090 - DNA, 21 bp, Artificial sequence
  SiRNA target sequence
gtatttccacgaaggagagtt

SEQ ID NO: 22091 - DNA, 21 bp, Artificial sequence
  SiRNA target sequence
tatttccacgaaggagagttc

SEQ ID NO: 22092 - DNA, 21 bp, Artificial sequence
  SiRNA target sequence
atttccacgaaggagagttcg

SEQ ID NO: 22093 - DNA, 21 bp, Artificial sequence
  SiRNA target sequence
tttccacgaaggagagttcgt

SEQ ID NO: 22094 - DNA, 21 bp, Artificial sequence
  SiRNA target sequence
ttccacgaaggagagttcgta

SEQ ID NO: 22095 - DNA, 21 bp, Artificial sequence
  SiRNA target sequence
tccacgaaggagagttcgtat

SEQ ID NO: 22096 - DNA, 21 bp, Artificial sequence
  SiRNA target sequence
ccacgaaggagagttcgtatc

SEQ ID NO: 22097 - DNA, 21 bp, Artificial sequence
  SiRNA target sequence
cacgaaggagagttcgtatct

SEQ ID NO: 22098 - DNA, 21 bp, Artificial sequence
  SiRNA target sequence
acgaaggagagttcgtatctt

SEQ ID NO: 22099 - DNA, 21 bp, Artificial sequence
  SiRNA target sequence
cgaaggagagttcgtatcttc

SEQ ID NO: 22100 - DNA, 21 bp, Artificial sequence
  SiRNA target sequence
gaaggagagttcgtatcttcc

SEQ ID NO: 22101 - DNA, 21 bp, Artificial sequence
  SiRNA target sequence
aaggagagttcgtatcttccg

SEQ ID NO: 22102 - DNA, 21 bp, Artificial sequence
  SiRNA target sequence
aggagagttcgtatcttccgt

SEQ ID NO: 22103 - DNA, 21 bp, Artificial sequence
  SiRNA target sequence
ggagagttcgtatcttccgta

SEQ ID NO: 22104 - DNA, 21 bp, Artificial sequence
  SiRNA target sequence
gagagttcgtatcttccgtag

SEQ ID NO: 22105 - DNA, 21 bp, Artificial sequence
  SiRNA target sequence
agagttcgtatcttccgtaga

SEQ ID NO: 22106 - DNA, 21 bp, Artificial sequence
  SiRNA target sequence
gagttcgtatcttccgtagat

SEQ ID NO: 22107 - DNA, 21 bp, Artificial sequence
  SiRNA target sequence
agttcgtatcttccgtagata

SEQ ID NO: 22108 - DNA, 21 bp, Artificial sequence
  SiRNA target sequence
gttcgtatcttccgtagataa

SEQ ID NO: 22109 - DNA, 21 bp, Artificial sequence
  SiRNA target sequence
ttcgtatcttccgtagataaa

SEQ ID NO: 22110 - DNA, 21 bp, Artificial sequence
  SiRNA target sequence
tcgtatcttccgtagataaat

SEQ ID NO: 22111 - DNA, 21 bp, Artificial sequence
  SiRNA target sequence
cgtatcttccgtagataaatt

SEQ ID NO: 22112 - DNA, 21 bp, Artificial sequence
  SiRNA target sequence
gtatcttccgtagataaattt

SEQ ID NO: 22113 - DNA, 21 bp, Artificial sequence
  SiRNA target sequence
tatcttccgtagataaattta

SEQ ID NO: 22114 - DNA, 21 bp, Artificial sequence
  SiRNA target sequence
atcttccgtagataaatttat

SEQ ID NO: 22115 - DNA, 21 bp, Artificial sequence
  SiRNA target sequence
tcttccgtagataaatttatc

SEQ ID NO: 22116 - DNA, 21 bp, Artificial sequence
  SiRNA target sequence
cttccgtagataaatttatca

SEQ ID NO: 22117 - DNA, 21 bp, Artificial sequence
  SiRNA target sequence
ttccgtagataaatttatcat

SEQ ID NO: 22118 - DNA, 21 bp, Artificial sequence
  SiRNA target sequence
tccgtagataaatttatcatg

SEQ ID NO: 22119 - DNA, 21 bp, Artificial sequence
  SiRNA target sequence
ccgtagataaatttatcatgg

SEQ ID NO: 22120 - DNA, 21 bp, Artificial sequence
  SiRNA target sequence
cgtagataaatttatcatgga

SEQ ID NO: 22121 - DNA, 21 bp, Artificial sequence
  SiRNA target sequence
gtagataaatttatcatggaa

SEQ ID NO: 22122 - DNA, 21 bp, Artificial sequence
  SiRNA target sequence
tagataaatttatcatggaaa

SEQ ID NO: 22123 - DNA, 21 bp, Artificial sequence
  SiRNA target sequence
agataaatttatcatggaaaa

SEQ ID NO: 22124 - DNA, 21 bp, Artificial sequence
  SiRNA target sequence
gataaatttatcatggaaaat

SEQ ID NO: 22125 - DNA, 21 bp, Artificial sequence
  SiRNA target sequence
ataaatttatcatggaaaatg

SEQ ID NO: 22126 - DNA, 21 bp, Artificial sequence
  SiRNA target sequence
taaatttatcatggaaaatgt

SEQ ID NO: 22127 - DNA, 21 bp, Artificial sequence
  SiRNA target sequence
aaatttatcatggaaaatgtg

SEQ ID NO: 22128 - DNA, 21 bp, Artificial sequence
  SiRNA target sequence
aatttatcatggaaaatgtgt

SEQ ID NO: 22129 - DNA, 21 bp, Artificial sequence
  SiRNA target sequence
atttatcatggaaaatgtgtt

SEQ ID NO: 22130 - DNA, 21 bp, Artificial sequence
  SiRNA target sequence
tttatcatggaaaatgtgttt

SEQ ID NO: 22131 - DNA, 21 bp, Artificial sequence
  SiRNA target sequence
ttatcatggaaaatgtgtttg

SEQ ID NO: 22132 - DNA, 21 bp, Artificial sequence
  SiRNA target sequence
tatcatggaaaatgtgtttgc

SEQ ID NO: 22133 - DNA, 21 bp, Artificial sequence
  SiRNA target sequence
atcatggaaaatgtgtttgct

SEQ ID NO: 22134 - DNA, 21 bp, Artificial sequence
  SiRNA target sequence
tcatggaaaatgtgtttgctc

SEQ ID NO: 22135 - DNA, 21 bp, Artificial sequence
  SiRNA target sequence
catggaaaatgtgtttgctca

SEQ ID NO: 22136 - DNA, 21 bp, Artificial sequence
  SiRNA target sequence
atggaaaatgtgtttgctcag

SEQ ID NO: 22137 - DNA, 21 bp, Artificial sequence
  SiRNA target sequence
tggaaaatgtgtttgctcagg

SEQ ID NO: 22138 - DNA, 21 bp, Artificial sequence
  SiRNA target sequence
ggaaaatgtgtttgctcaggg

SEQ ID NO: 22139 - DNA, 21 bp, Artificial sequence
  SiRNA target sequence
gaaaatgtgtttgctcaggga

SEQ ID NO: 22140 - DNA, 21 bp, Artificial sequence
  SiRNA target sequence
aaaatgtgtttgctcagggag

SEQ ID NO: 22141 - DNA, 21 bp, Artificial sequence
  SiRNA target sequence
aaatgtgtttgctcagggagg

SEQ ID NO: 22142 - DNA, 21 bp, Artificial sequence
  SiRNA target sequence
aatgtgtttgctcagggagga

SEQ ID NO: 22143 - DNA, 21 bp, Artificial sequence
  SiRNA target sequence
atgtgtttgctcagggaggag

SEQ ID NO: 22144 - DNA, 21 bp, Artificial sequence
  SiRNA target sequence
tgtgtttgctcagggaggagg

SEQ ID NO: 22145 - DNA, 21 bp, Artificial sequence
  SiRNA target sequence
gtgtttgctcagggaggaggc

SEQ ID NO: 22146 - DNA, 21 bp, Artificial sequence
  SiRNA target sequence
tgtttgctcagggaggaggct

SEQ ID NO: 22147 - DNA, 21 bp, Artificial sequence
  SiRNA target sequence
gtttgctcagggaggaggctc

SEQ ID NO: 22148 - DNA, 21 bp, Artificial sequence
  SiRNA target sequence
tttgctcagggaggaggctct

SEQ ID NO: 22149 - DNA, 21 bp, Artificial sequence
  SiRNA target sequence
ttgctcagggaggaggctctt

SEQ ID NO: 22150 - DNA, 21 bp, Artificial sequence
  SiRNA target sequence
tgctcagggaggaggctcttt

SEQ ID NO: 22151 - DNA, 21 bp, Artificial sequence
  SiRNA target sequence
gctcagggaggaggctcttta

SEQ ID NO: 22152 - DNA, 21 bp, Artificial sequence
  SiRNA target sequence
ctcagggaggaggctctttat

SEQ ID NO: 22153 - DNA, 21 bp, Artificial sequence
  SiRNA target sequence
tcagggaggaggctctttatc

SEQ ID NO: 22154 - DNA, 21 bp, Artificial sequence
  SiRNA target sequence
cagggaggaggctctttatca

SEQ ID NO: 22155 - DNA, 21 bp, Artificial sequence
  SiRNA target sequence
agggaggaggctctttatcag

SEQ ID NO: 22156 - DNA, 21 bp, Artificial sequence
  SiRNA target sequence
gggaggaggctctttatcaga

SEQ ID NO: 22157 - DNA, 21 bp, Artificial sequence
  SiRNA target sequence
ggaggaggctctttatcagat

SEQ ID NO: 22158 - DNA, 21 bp, Artificial sequence
  SiRNA target sequence
gaggaggctctttatcagatg

SEQ ID NO: 22159 - DNA, 21 bp, Artificial sequence
  SiRNA target sequence
aggaggctctttatcagatga

SEQ ID NO: 22160 - DNA, 21 bp, Artificial sequence
  SiRNA target sequence
ggaggctctttatcagatgag

SEQ ID NO: 22161 - DNA, 21 bp, Artificial sequence
  SiRNA target sequence
gaggctctttatcagatgagg

SEQ ID NO: 22162 - DNA, 21 bp, Artificial sequence
  SiRNA target sequence
aggctctttatcagatgagga

SEQ ID NO: 22163 - DNA, 21 bp, Artificial sequence
  SiRNA target sequence
ggctctttatcagatgaggag

SEQ ID NO: 22164 - DNA, 21 bp, Artificial sequence
  SiRNA target sequence
gctctttatcagatgaggagg

SEQ ID NO: 22165 - DNA, 21 bp, Artificial sequence
  SiRNA target sequence
ctctttatcagatgaggagga

SEQ ID NO: 22166 - DNA, 21 bp, Artificial sequence
  SiRNA target sequence
tctttatcagatgaggaggat

SEQ ID NO: 22167 - DNA, 21 bp, Artificial sequence
  SiRNA target sequence
ctttatcagatgaggaggatg

SEQ ID NO: 22168 - DNA, 21 bp, Artificial sequence
  SiRNA target sequence
tttatcagatgaggaggatga

SEQ ID NO: 22169 - DNA, 21 bp, Artificial sequence
  SiRNA target sequence
ttatcagatgaggaggatgat

SEQ ID NO: 22170 - DNA, 21 bp, Artificial sequence
  SiRNA target sequence
tatcagatgaggaggatgatt

SEQ ID NO: 22171 - DNA, 21 bp, Artificial sequence
  SiRNA target sequence
atcagatgaggaggatgattt

SEQ ID NO: 22172 - DNA, 21 bp, Artificial sequence
  SiRNA target sequence
tcagatgaggaggatgatttc

SEQ ID NO: 22173 - DNA, 21 bp, Artificial sequence
  SiRNA target sequence
cagatgaggaggatgatttca

SEQ ID NO: 22174 - DNA, 21 bp, Artificial sequence
  SiRNA target sequence
agatgaggaggatgatttcac

SEQ ID NO: 22175 - DNA, 21 bp, Artificial sequence
  SiRNA target sequence
gatgaggaggatgatttcact

SEQ ID NO: 22176 - DNA, 21 bp, Artificial sequence
  SiRNA target sequence
atgaggaggatgatttcactg

SEQ ID NO: 22177 - DNA, 21 bp, Artificial sequence
  SiRNA target sequence
tgaggaggatgatttcactga

SEQ ID NO: 22178 - DNA, 21 bp, Artificial sequence
  SiRNA target sequence
gaggaggatgatttcactgag

SEQ ID NO: 22179 - DNA, 21 bp, Artificial sequence
  SiRNA target sequence
aggaggatgatttcactgagg

SEQ ID NO: 22180 - DNA, 21 bp, Artificial sequence
  SiRNA target sequence
ggaggatgatttcactgaggc

SEQ ID NO: 22181 - DNA, 21 bp, Artificial sequence
  SiRNA target sequence
gaggatgatttcactgaggct

SEQ ID NO: 22182 - DNA, 21 bp, Artificial sequence
  SiRNA target sequence
aggatgatttcactgaggcta

SEQ ID NO: 22183 - DNA, 21 bp, Artificial sequence
  SiRNA target sequence
ggatgatttcactgaggctag

SEQ ID NO: 22184 - DNA, 21 bp, Artificial sequence
  SiRNA target sequence
gatgatttcactgaggctagc

SEQ ID NO: 22185 - DNA, 21 bp, Artificial sequence
  SiRNA target sequence
atgatttcactgaggctagct

SEQ ID NO: 22186 - DNA, 21 bp, Artificial sequence
  SiRNA target sequence
tgatttcactgaggctagctc

SEQ ID NO: 22187 - DNA, 21 bp, Artificial sequence
  SiRNA target sequence
gatttcactgaggctagctcc

SEQ ID NO: 22188 - DNA, 21 bp, Artificial sequence
  SiRNA target sequence
atttcactgaggctagctcct

SEQ ID NO: 22189 - DNA, 21 bp, Artificial sequence
  SiRNA target sequence
tttcactgaggctagctccta

SEQ ID NO: 22190 - DNA, 21 bp, Artificial sequence
  SiRNA target sequence
ttcactgaggctagctcctat

SEQ ID NO: 22191 - DNA, 21 bp, Artificial sequence
  SiRNA target sequence
tcactgaggctagctcctatg

SEQ ID NO: 22192 - DNA, 21 bp, Artificial sequence
  SiRNA target sequence
cactgaggctagctcctatgg

SEQ ID NO: 22193 - DNA, 21 bp, Artificial sequence
  SiRNA target sequence
actgaggctagctcctatggt

SEQ ID NO: 22194 - DNA, 21 bp, Artificial sequence
  SiRNA target sequence
ctgaggctagctcctatggtg

SEQ ID NO: 22195 - DNA, 21 bp, Artificial sequence
  SiRNA target sequence
tgaggctagctcctatggtga

SEQ ID NO: 22196 - DNA, 21 bp, Artificial sequence
  SiRNA target sequence
gaggctagctcctatggtgat

SEQ ID NO: 22197 - DNA, 21 bp, Artificial sequence
  SiRNA target sequence
aggctagctcctatggtgata

SEQ ID NO: 22198 - DNA, 21 bp, Artificial sequence
  SiRNA target sequence
ggctagctcctatggtgatag

SEQ ID NO: 22199 - DNA, 21 bp, Artificial sequence
  SiRNA target sequence
gctagctcctatggtgatagt

SEQ ID NO: 22200 - DNA, 21 bp, Artificial sequence
  SiRNA target sequence
ctagctcctatggtgatagta

SEQ ID NO: 22201 - DNA, 21 bp, Artificial sequence
  SiRNA target sequence
tagctcctatggtgatagtaa

SEQ ID NO: 22202 - DNA, 21 bp, Artificial sequence
  SiRNA target sequence
agctcctatggtgatagtaat

SEQ ID NO: 22203 - DNA, 21 bp, Artificial sequence
  SiRNA target sequence
gctcctatggtgatagtaatc

SEQ ID NO: 22204 - DNA, 21 bp, Artificial sequence
  SiRNA target sequence
ctcctatggtgatagtaatct

SEQ ID NO: 22205 - DNA, 21 bp, Artificial sequence
  SiRNA target sequence
tcctatggtgatagtaatctg

SEQ ID NO: 22206 - DNA, 21 bp, Artificial sequence
  SiRNA target sequence
cctatggtgatagtaatctgg

SEQ ID NO: 22207 - DNA, 21 bp, Artificial sequence
  SiRNA target sequence
ctatggtgatagtaatctgga

SEQ ID NO: 22208 - DNA, 21 bp, Artificial sequence
  SiRNA target sequence
tatggtgatagtaatctggat

SEQ ID NO: 22209 - DNA, 21 bp, Artificial sequence
  SiRNA target sequence
atggtgatagtaatctggatg

SEQ ID NO: 22210 - DNA, 21 bp, Artificial sequence
  SiRNA target sequence
tggtgatagtaatctggatga

SEQ ID NO: 22211 - DNA, 21 bp, Artificial sequence
  SiRNA target sequence
ggtgatagtaatctggatgaa

SEQ ID NO: 22212 - DNA, 21 bp, Artificial sequence
  SiRNA target sequence
gtgatagtaatctggatgaaa

SEQ ID NO: 22213 - DNA, 21 bp, Artificial sequence
  SiRNA target sequence
tgatagtaatctggatgaaac

SEQ ID NO: 22214 - DNA, 21 bp, Artificial sequence
  SiRNA target sequence
gatagtaatctggatgaaacc

SEQ ID NO: 22215 - DNA, 21 bp, Artificial sequence
  SiRNA target sequence
atagtaatctggatgaaacct

SEQ ID NO: 22216 - DNA, 21 bp, Artificial sequence
  SiRNA target sequence
tagtaatctggatgaaacctt

SEQ ID NO: 22217 - DNA, 21 bp, Artificial sequence
  SiRNA target sequence
agtaatctggatgaaaccttg

SEQ ID NO: 22218 - DNA, 21 bp, Artificial sequence
  SiRNA target sequence
gtaatctggatgaaaccttga

SEQ ID NO: 22219 - DNA, 21 bp, Artificial sequence
  SiRNA target sequence
taatctggatgaaaccttgac

SEQ ID NO: 22220 - DNA, 21 bp, Artificial sequence
  SiRNA target sequence
aatctggatgaaaccttgact

SEQ ID NO: 22221 - DNA, 21 bp, Artificial sequence
  SiRNA target sequence
atctggatgaaaccttgactc

SEQ ID NO: 22222 - DNA, 21 bp, Artificial sequence
  SiRNA target sequence
tctggatgaaaccttgactcg

SEQ ID NO: 22223 - DNA, 21 bp, Artificial sequence
  SiRNA target sequence
ctggatgaaaccttgactcgt

SEQ ID NO: 22224 - DNA, 21 bp, Artificial sequence
  SiRNA target sequence
tggatgaaaccttgactcgtg

SEQ ID NO: 22225 - DNA, 21 bp, Artificial sequence
  SiRNA target sequence
ggatgaaaccttgactcgtga

SEQ ID NO: 22226 - DNA, 21 bp, Artificial sequence
  SiRNA target sequence
gatgaaaccttgactcgtgaa

SEQ ID NO: 22227 - DNA, 21 bp, Artificial sequence
  SiRNA target sequence
atgaaaccttgactcgtgaag

SEQ ID NO: 22228 - DNA, 21 bp, Artificial sequence
  SiRNA target sequence
tgaaaccttgactcgtgaaga

SEQ ID NO: 22229 - DNA, 21 bp, Artificial sequence
  SiRNA target sequence
gaaaccttgactcgtgaagaa

SEQ ID NO: 22230 - DNA, 21 bp, Artificial sequence
  SiRNA target sequence
aaaccttgactcgtgaagaaa

SEQ ID NO: 22231 - DNA, 21 bp, Artificial sequence
  SiRNA target sequence
aaccttgactcgtgaagaaaa

SEQ ID NO: 22232 - DNA, 21 bp, Artificial sequence
  SiRNA target sequence
accttgactcgtgaagaaaag

SEQ ID NO: 22233 - DNA, 21 bp, Artificial sequence
  SiRNA target sequence
ccttgactcgtgaagaaaaga

SEQ ID NO: 22234 - DNA, 21 bp, Artificial sequence
  SiRNA target sequence
cttgactcgtgaagaaaagaa

SEQ ID NO: 22235 - DNA, 21 bp, Artificial sequence
  SiRNA target sequence
ttgactcgtgaagaaaagaaa

SEQ ID NO: 22236 - DNA, 21 bp, Artificial sequence
  SiRNA target sequence
tgactcgtgaagaaaagaaag

SEQ ID NO: 22237 - DNA, 21 bp, Artificial sequence
  SiRNA target sequence
gactcgtgaagaaaagaaaga

SEQ ID NO: 22238 - DNA, 21 bp, Artificial sequence
  SiRNA target sequence
actcgtgaagaaaagaaagag

SEQ ID NO: 22239 - DNA, 21 bp, Artificial sequence
  SiRNA target sequence
ctcgtgaagaaaagaaagaga

SEQ ID NO: 22240 - DNA, 21 bp, Artificial sequence
  SiRNA target sequence
tcgtgaagaaaagaaagagat

SEQ ID NO: 22241 - DNA, 21 bp, Artificial sequence
  SiRNA target sequence
cgtgaagaaaagaaagagatc

SEQ ID NO: 22242 - DNA, 21 bp, Artificial sequence
  SiRNA target sequence
gtgaagaaaagaaagagatca

SEQ ID NO: 22243 - DNA, 21 bp, Artificial sequence
  SiRNA target sequence
tgaagaaaagaaagagatcat

SEQ ID NO: 22244 - DNA, 21 bp, Artificial sequence
  SiRNA target sequence
gaagaaaagaaagagatcata

SEQ ID NO: 22245 - DNA, 21 bp, Artificial sequence
  SiRNA target sequence
aagaaaagaaagagatcatag

SEQ ID NO: 22246 - DNA, 21 bp, Artificial sequence
  SiRNA target sequence
agaaaagaaagagatcataga

SEQ ID NO: 22247 - DNA, 21 bp, Artificial sequence
  SiRNA target sequence
gaaaagaaagagatcatagag

SEQ ID NO: 22248 - DNA, 21 bp, Artificial sequence
  SiRNA target sequence
aaaagaaagagatcatagagt

SEQ ID NO: 22249 - DNA, 21 bp, Artificial sequence
  SiRNA target sequence
aaagaaagagatcatagagtg

SEQ ID NO: 22250 - DNA, 21 bp, Artificial sequence
  SiRNA target sequence
aagaaagagatcatagagtgc

SEQ ID NO: 22251 - DNA, 21 bp, Artificial sequence
  SiRNA target sequence
agaaagagatcatagagtgca

SEQ ID NO: 22252 - DNA, 21 bp, Artificial sequence
  SiRNA target sequence
gaaagagatcatagagtgcat

SEQ ID NO: 22253 - DNA, 21 bp, Artificial sequence
  SiRNA target sequence
aaagagatcatagagtgcatc

SEQ ID NO: 22254 - DNA, 21 bp, Artificial sequence
  SiRNA target sequence
aagagatcatagagtgcatca

SEQ ID NO: 22255 - DNA, 21 bp, Artificial sequence
  SiRNA target sequence
agagatcatagagtgcatcaa

SEQ ID NO: 22256 - DNA, 21 bp, Artificial sequence
  SiRNA target sequence
gagatcatagagtgcatcaac

SEQ ID NO: 22257 - DNA, 21 bp, Artificial sequence
  SiRNA target sequence
agatcatagagtgcatcaacg

SEQ ID NO: 22258 - DNA, 21 bp, Artificial sequence
  SiRNA target sequence
gatcatagagtgcatcaacga

SEQ ID NO: 22259 - DNA, 21 bp, Artificial sequence
  SiRNA target sequence
atcatagagtgcatcaacgac

SEQ ID NO: 22260 - DNA, 21 bp, Artificial sequence
  SiRNA target sequence
tcatagagtgcatcaacgacc

SEQ ID NO: 22261 - DNA, 21 bp, Artificial sequence
  SiRNA target sequence
catagagtgcatcaacgacca

SEQ ID NO: 22262 - DNA, 21 bp, Artificial sequence
  SiRNA target sequence
atagagtgcatcaacgaccaa

SEQ ID NO: 22263 - DNA, 21 bp, Artificial sequence
  SiRNA target sequence
tagagtgcatcaacgaccaac

SEQ ID NO: 22264 - DNA, 21 bp, Artificial sequence
  SiRNA target sequence
agagtgcatcaacgaccaact

SEQ ID NO: 22265 - DNA, 21 bp, Artificial sequence
  SiRNA target sequence
gagtgcatcaacgaccaactt

SEQ ID NO: 22266 - DNA, 21 bp, Artificial sequence
  SiRNA target sequence
agtgcatcaacgaccaactta

SEQ ID NO: 22267 - DNA, 21 bp, Artificial sequence
  SiRNA target sequence
gtgcatcaacgaccaacttaa

SEQ ID NO: 22268 - DNA, 21 bp, Artificial sequence
  SiRNA target sequence
tgcatcaacgaccaacttaag

SEQ ID NO: 22269 - DNA, 21 bp, Artificial sequence
  SiRNA target sequence
gcatcaacgaccaacttaaga

SEQ ID NO: 22270 - DNA, 21 bp, Artificial sequence
  SiRNA target sequence
catcaacgaccaacttaagaa

SEQ ID NO: 22271 - DNA, 21 bp, Artificial sequence
  SiRNA target sequence
atcaacgaccaacttaagaat

SEQ ID NO: 22272 - DNA, 21 bp, Artificial sequence
  SiRNA target sequence
tcaacgaccaacttaagaatg

SEQ ID NO: 22273 - DNA, 21 bp, Artificial sequence
  SiRNA target sequence
caacgaccaacttaagaatga

SEQ ID NO: 22274 - DNA, 21 bp, Artificial sequence
  SiRNA target sequence
aacgaccaacttaagaatgaa

SEQ ID NO: 22275 - DNA, 21 bp, Artificial sequence
  SiRNA target sequence
acgaccaacttaagaatgaaa

SEQ ID NO: 22276 - DNA, 21 bp, Artificial sequence
  SiRNA target sequence
cgaccaacttaagaatgaaaa

SEQ ID NO: 22277 - DNA, 21 bp, Artificial sequence
  SiRNA target sequence
gaccaacttaagaatgaaaat

SEQ ID NO: 22278 - DNA, 21 bp, Artificial sequence
  SiRNA target sequence
accaacttaagaatgaaaatg

SEQ ID NO: 22279 - DNA, 21 bp, Artificial sequence
  SiRNA target sequence
ccaacttaagaatgaaaatga

SEQ ID NO: 22280 - DNA, 21 bp, Artificial sequence
  SiRNA target sequence
caacttaagaatgaaaatgat

SEQ ID NO: 22281 - DNA, 21 bp, Artificial sequence
  SiRNA target sequence
aacttaagaatgaaaatgata

SEQ ID NO: 22282 - DNA, 21 bp, Artificial sequence
  SiRNA target sequence
acttaagaatgaaaatgatac

SEQ ID NO: 22283 - DNA, 21 bp, Artificial sequence
  SiRNA target sequence
cttaagaatgaaaatgatact

SEQ ID NO: 22284 - DNA, 21 bp, Artificial sequence
  SiRNA target sequence
ttaagaatgaaaatgatacta

SEQ ID NO: 22285 - DNA, 21 bp, Artificial sequence
  SiRNA target sequence
taagaatgaaaatgatactag

SEQ ID NO: 22286 - DNA, 21 bp, Artificial sequence
  SiRNA target sequence
aagaatgaaaatgatactaga

SEQ ID NO: 22287 - DNA, 21 bp, Artificial sequence
  SiRNA target sequence
agaatgaaaatgatactagaa

SEQ ID NO: 22288 - DNA, 21 bp, Artificial sequence
  SiRNA target sequence
gaatgaaaatgatactagaac

SEQ ID NO: 22289 - DNA, 21 bp, Artificial sequence
  SiRNA target sequence
aatgaaaatgatactagaact

SEQ ID NO: 22290 - DNA, 21 bp, Artificial sequence
  SiRNA target sequence
atgaaaatgatactagaactt

SEQ ID NO: 22291 - DNA, 21 bp, Artificial sequence
  SiRNA target sequence
tgaaaatgatactagaacttc

SEQ ID NO: 22292 - DNA, 21 bp, Artificial sequence
  SiRNA target sequence
gaaaatgatactagaacttct

SEQ ID NO: 22293 - DNA, 21 bp, Artificial sequence
  SiRNA target sequence
aaaatgatactagaacttctt

SEQ ID NO: 22294 - DNA, 21 bp, Artificial sequence
  SiRNA target sequence
aaatgatactagaacttcttt

SEQ ID NO: 22295 - DNA, 21 bp, Artificial sequence
  SiRNA target sequence
aatgatactagaacttctttt

SEQ ID NO: 22296 - DNA, 21 bp, Artificial sequence
  SiRNA target sequence
atgatactagaacttcttttc

SEQ ID NO: 22297 - DNA, 21 bp, Artificial sequence
  SiRNA target sequence
tgatactagaacttcttttca

SEQ ID NO: 22298 - DNA, 21 bp, Artificial sequence
  SiRNA target sequence
gatactagaacttcttttcag

SEQ ID NO: 22299 - DNA, 21 bp, Artificial sequence
  SiRNA target sequence
atactagaacttcttttcagt

SEQ ID NO: 22300 - DNA, 21 bp, Artificial sequence
  SiRNA target sequence
tactagaacttcttttcagtt

SEQ ID NO: 22301 - DNA, 21 bp, Artificial sequence
  SiRNA target sequence
actagaacttcttttcagttg

SEQ ID NO: 22302 - DNA, 21 bp, Artificial sequence
  SiRNA target sequence
ctagaacttcttttcagttga

SEQ ID NO: 22303 - DNA, 21 bp, Artificial sequence
  SiRNA target sequence
tagaacttcttttcagttgat

SEQ ID NO: 22304 - DNA, 21 bp, Artificial sequence
  SiRNA target sequence
agaacttcttttcagttgatt

SEQ ID NO: 22305 - DNA, 21 bp, Artificial sequence
  SiRNA target sequence
gaacttcttttcagttgatta

SEQ ID NO: 22306 - DNA, 21 bp, Artificial sequence
  SiRNA target sequence
aacttcttttcagttgattag

SEQ ID NO: 22307 - DNA, 21 bp, Artificial sequence
  SiRNA target sequence
acttcttttcagttgattaga

SEQ ID NO: 22308 - DNA, 21 bp, Artificial sequence
  SiRNA target sequence
cttcttttcagttgattagag

SEQ ID NO: 22309 - DNA, 21 bp, Artificial sequence
  SiRNA target sequence
ttcttttcagttgattagaga

SEQ ID NO: 22310 - DNA, 21 bp, Artificial sequence
  SiRNA target sequence
tcttttcagttgattagagat

SEQ ID NO: 22311 - DNA, 21 bp, Artificial sequence
  SiRNA target sequence
cttttcagttgattagagatt

SEQ ID NO: 22312 - DNA, 21 bp, Artificial sequence
  SiRNA target sequence
ttttcagttgattagagatta

SEQ ID NO: 22313 - DNA, 21 bp, Artificial sequence
  SiRNA target sequence
tttcagttgattagagattat

SEQ ID NO: 22314 - DNA, 21 bp, Artificial sequence
  SiRNA target sequence
ttcagttgattagagattatt

SEQ ID NO: 22315 - DNA, 21 bp, Artificial sequence
  SiRNA target sequence
tcagttgattagagattattt

SEQ ID NO: 22316 - DNA, 21 bp, Artificial sequence
  SiRNA target sequence
cagttgattagagattatttc

SEQ ID NO: 22317 - DNA, 21 bp, Artificial sequence
  SiRNA target sequence
agttgattagagattatttcc

SEQ ID NO: 22318 - DNA, 21 bp, Artificial sequence
  SiRNA target sequence
gttgattagagattatttcca

SEQ ID NO: 22319 - DNA, 21 bp, Artificial sequence
  SiRNA target sequence
ttgattagagattatttccat

SEQ ID NO: 22320 - DNA, 21 bp, Artificial sequence
  SiRNA target sequence
tgattagagattatttccatt

SEQ ID NO: 22321 - DNA, 21 bp, Artificial sequence
  SiRNA target sequence
gattagagattatttccattg

SEQ ID NO: 22322 - DNA, 21 bp, Artificial sequence
  SiRNA target sequence
attagagattatttccattgt

SEQ ID NO: 22323 - DNA, 21 bp, Artificial sequence
  SiRNA target sequence
ttagagattatttccattgtg

SEQ ID NO: 22324 - DNA, 21 bp, Artificial sequence
  SiRNA target sequence
tagagattatttccattgtgc

SEQ ID NO: 22325 - DNA, 21 bp, Artificial sequence
  SiRNA target sequence
agagattatttccattgtgct

SEQ ID NO: 22326 - DNA, 21 bp, Artificial sequence
  SiRNA target sequence
gagattatttccattgtgcta

SEQ ID NO: 22327 - DNA, 21 bp, Artificial sequence
  SiRNA target sequence
agattatttccattgtgctaa

SEQ ID NO: 22328 - DNA, 21 bp, Artificial sequence
  SiRNA target sequence
gattatttccattgtgctaag

SEQ ID NO: 22329 - DNA, 21 bp, Artificial sequence
  SiRNA target sequence
attatttccattgtgctaagg

SEQ ID NO: 22330 - DNA, 21 bp, Artificial sequence
  SiRNA target sequence
ttatttccattgtgctaagga

SEQ ID NO: 22331 - DNA, 21 bp, Artificial sequence
  SiRNA target sequence
tatttccattgtgctaaggat

SEQ ID NO: 22332 - DNA, 21 bp, Artificial sequence
  SiRNA target sequence
atttccattgtgctaaggatt

SEQ ID NO: 22333 - DNA, 21 bp, Artificial sequence
  SiRNA target sequence
tttccattgtgctaaggattc

SEQ ID NO: 22334 - DNA, 21 bp, Artificial sequence
  SiRNA target sequence
ttccattgtgctaaggattcg

SEQ ID NO: 22335 - DNA, 21 bp, Artificial sequence
  SiRNA target sequence
tccattgtgctaaggattcgc

SEQ ID NO: 22336 - DNA, 21 bp, Artificial sequence
  SiRNA target sequence
ccattgtgctaaggattcgct

SEQ ID NO: 22337 - DNA, 21 bp, Artificial sequence
  SiRNA target sequence
cattgtgctaaggattcgcta

SEQ ID NO: 22338 - DNA, 21 bp, Artificial sequence
  SiRNA target sequence
attgtgctaaggattcgctac

SEQ ID NO: 22339 - DNA, 21 bp, Artificial sequence
  SiRNA target sequence
ttgtgctaaggattcgctaca

SEQ ID NO: 22340 - DNA, 21 bp, Artificial sequence
  SiRNA target sequence
tgtgctaaggattcgctacaa

SEQ ID NO: 22341 - DNA, 21 bp, Artificial sequence
  SiRNA target sequence
gtgctaaggattcgctacaag

SEQ ID NO: 22342 - DNA, 21 bp, Artificial sequence
  SiRNA target sequence
tgctaaggattcgctacaaga

SEQ ID NO: 22343 - DNA, 21 bp, Artificial sequence
  SiRNA target sequence
gctaaggattcgctacaagag

SEQ ID NO: 22344 - DNA, 21 bp, Artificial sequence
  SiRNA target sequence
ctaaggattcgctacaagaga

SEQ ID NO: 22345 - DNA, 21 bp, Artificial sequence
  SiRNA target sequence
taaggattcgctacaagagaa

SEQ ID NO: 22346 - DNA, 21 bp, Artificial sequence
  SiRNA target sequence
aaggattcgctacaagagaaa

SEQ ID NO: 22347 - DNA, 21 bp, Artificial sequence
  SiRNA target sequence
aggattcgctacaagagaaat

SEQ ID NO: 22348 - DNA, 21 bp, Artificial sequence
  SiRNA target sequence
ggattcgctacaagagaaatt

SEQ ID NO: 22349 - DNA, 21 bp, Artificial sequence
  SiRNA target sequence
gattcgctacaagagaaattt

SEQ ID NO: 22350 - DNA, 21 bp, Artificial sequence
  SiRNA target sequence
attcgctacaagagaaatttt

SEQ ID NO: 22351 - DNA, 21 bp, Artificial sequence
  SiRNA target sequence
ttcgctacaagagaaattttc

SEQ ID NO: 22352 - DNA, 21 bp, Artificial sequence
  SiRNA target sequence
tcgctacaagagaaattttca

SEQ ID NO: 22353 - DNA, 21 bp, Artificial sequence
  SiRNA target sequence
cgctacaagagaaattttcag

SEQ ID NO: 22354 - DNA, 21 bp, Artificial sequence
  SiRNA target sequence
gctacaagagaaattttcagc

SEQ ID NO: 22355 - DNA, 21 bp, Artificial sequence
  SiRNA target sequence
ctacaagagaaattttcagcc

SEQ ID NO: 22356 - DNA, 21 bp, Artificial sequence
  SiRNA target sequence
tacaagagaaattttcagcct

SEQ ID NO: 22357 - DNA, 21 bp, Artificial sequence
  SiRNA target sequence
acaagagaaattttcagccta

SEQ ID NO: 22358 - DNA, 21 bp, Artificial sequence
  SiRNA target sequence
caagagaaattttcagcctat

SEQ ID NO: 22359 - DNA, 21 bp, Artificial sequence
  SiRNA target sequence
aagagaaattttcagcctatc

SEQ ID NO: 22360 - DNA, 21 bp, Artificial sequence
  SiRNA target sequence
agagaaattttcagcctatcg

SEQ ID NO: 22361 - DNA, 21 bp, Artificial sequence
  SiRNA target sequence
gagaaattttcagcctatcgc

SEQ ID NO: 22362 - DNA, 21 bp, Artificial sequence
  SiRNA target sequence
agaaattttcagcctatcgcc

SEQ ID NO: 22363 - DNA, 21 bp, Artificial sequence
  SiRNA target sequence
gaaattttcagcctatcgccg

SEQ ID NO: 22364 - DNA, 21 bp, Artificial sequence
  SiRNA target sequence
aaattttcagcctatcgccga

SEQ ID NO: 22365 - DNA, 21 bp, Artificial sequence
  SiRNA target sequence
aattttcagcctatcgccgaa

SEQ ID NO: 22366 - DNA, 21 bp, Artificial sequence
  SiRNA target sequence
attttcagcctatcgccgaaa

SEQ ID NO: 22367 - DNA, 21 bp, Artificial sequence
  SiRNA target sequence
ttttcagcctatcgccgaaag

SEQ ID NO: 22368 - DNA, 21 bp, Artificial sequence
  SiRNA target sequence
tttcagcctatcgccgaaagt

SEQ ID NO: 22369 - DNA, 21 bp, Artificial sequence
  SiRNA target sequence
ttcagcctatcgccgaaagta

SEQ ID NO: 22370 - DNA, 21 bp, Artificial sequence
  SiRNA target sequence
tcagcctatcgccgaaagtac

SEQ ID NO: 22371 - DNA, 21 bp, Artificial sequence
  SiRNA target sequence
cagcctatcgccgaaagtact

SEQ ID NO: 22372 - DNA, 21 bp, Artificial sequence
  SiRNA target sequence
agcctatcgccgaaagtactc

SEQ ID NO: 22373 - DNA, 21 bp, Artificial sequence
  SiRNA target sequence
gcctatcgccgaaagtactct

SEQ ID NO: 22374 - DNA, 21 bp, Artificial sequence
  SiRNA target sequence
cctatcgccgaaagtactctt

SEQ ID NO: 22375 - DNA, 21 bp, Artificial sequence
  SiRNA target sequence
ctatcgccgaaagtactcttt

SEQ ID NO: 22376 - DNA, 21 bp, Artificial sequence
  SiRNA target sequence
tatcgccgaaagtactctttc

SEQ ID NO: 22377 - DNA, 21 bp, Artificial sequence
  SiRNA target sequence
atcgccgaaagtactctttcg

SEQ ID NO: 22378 - DNA, 21 bp, Artificial sequence
  SiRNA target sequence
tcgccgaaagtactctttcga

SEQ ID NO: 22379 - DNA, 21 bp, Artificial sequence
  SiRNA target sequence
cgccgaaagtactctttcgac

SEQ ID NO: 22380 - DNA, 21 bp, Artificial sequence
  SiRNA target sequence
gccgaaagtactctttcgacg

SEQ ID NO: 22381 - DNA, 21 bp, Artificial sequence
  SiRNA target sequence
ccgaaagtactctttcgacga

SEQ ID NO: 22382 - DNA, 21 bp, Artificial sequence
  SiRNA target sequence
cgaaagtactctttcgacgaa

SEQ ID NO: 22383 - DNA, 21 bp, Artificial sequence
  SiRNA target sequence
gaaagtactctttcgacgaat

SEQ ID NO: 22384 - DNA, 21 bp, Artificial sequence
  SiRNA target sequence
aaagtactctttcgacgaatg

SEQ ID NO: 22385 - DNA, 21 bp, Artificial sequence
  SiRNA target sequence
aagtactctttcgacgaatgg

SEQ ID NO: 22386 - DNA, 21 bp, Artificial sequence
  SiRNA target sequence
agtactctttcgacgaatggt

SEQ ID NO: 22387 - DNA, 21 bp, Artificial sequence
  SiRNA target sequence
gtactctttcgacgaatggtt

SEQ ID NO: 22388 - DNA, 21 bp, Artificial sequence
  SiRNA target sequence
tactctttcgacgaatggttt

SEQ ID NO: 22389 - DNA, 21 bp, Artificial sequence
  SiRNA target sequence
actctttcgacgaatggttta

SEQ ID NO: 22390 - DNA, 21 bp, Artificial sequence
  SiRNA target sequence
ctctttcgacgaatggtttag

SEQ ID NO: 22391 - DNA, 21 bp, Artificial sequence
  SiRNA target sequence
tctttcgacgaatggtttagt

SEQ ID NO: 22392 - DNA, 21 bp, Artificial sequence
  SiRNA target sequence
ctttcgacgaatggtttagtt

SEQ ID NO: 22393 - DNA, 21 bp, Artificial sequence
  SiRNA target sequence
tttcgacgaatggtttagttt

SEQ ID NO: 22394 - DNA, 21 bp, Artificial sequence
  SiRNA target sequence
ttcgacgaatggtttagtttc

SEQ ID NO: 22395 - DNA, 21 bp, Artificial sequence
  SiRNA target sequence
tcgacgaatggtttagtttct

SEQ ID NO: 22396 - DNA, 21 bp, Artificial sequence
  SiRNA target sequence
cgacgaatggtttagtttctc

SEQ ID NO: 22397 - DNA, 21 bp, Artificial sequence
  SiRNA target sequence
gacgaatggtttagtttctca

SEQ ID NO: 22398 - DNA, 21 bp, Artificial sequence
  SiRNA target sequence
acgaatggtttagtttctcaa

SEQ ID NO: 22399 - DNA, 21 bp, Artificial sequence
  SiRNA target sequence
cgaatggtttagtttctcaaa

SEQ ID NO: 22400 - DNA, 21 bp, Artificial sequence
  SiRNA target sequence
gaatggtttagtttctcaaag

SEQ ID NO: 22401 - DNA, 21 bp, Artificial sequence
  SiRNA target sequence
aatggtttagtttctcaaagg

SEQ ID NO: 22402 - DNA, 21 bp, Artificial sequence
  SiRNA target sequence
atggtttagtttctcaaaggc

SEQ ID NO: 22403 - DNA, 21 bp, Artificial sequence
  SiRNA target sequence
tggtttagtttctcaaaggca

SEQ ID NO: 22404 - DNA, 21 bp, Artificial sequence
  SiRNA target sequence
ggtttagtttctcaaaggcat

SEQ ID NO: 22405 - DNA, 21 bp, Artificial sequence
  SiRNA target sequence
gtttagtttctcaaaggcatc

SEQ ID NO: 22406 - DNA, 21 bp, Artificial sequence
  SiRNA target sequence
tttagtttctcaaaggcatct

SEQ ID NO: 22407 - DNA, 21 bp, Artificial sequence
  SiRNA target sequence
ttagtttctcaaaggcatcta

SEQ ID NO: 22408 - DNA, 21 bp, Artificial sequence
  SiRNA target sequence
tagtttctcaaaggcatctaa

SEQ ID NO: 22409 - DNA, 21 bp, Artificial sequence
  SiRNA target sequence
agtttctcaaaggcatctaaa

SEQ ID NO: 22410 - DNA, 21 bp, Artificial sequence
  SiRNA target sequence
gtttctcaaaggcatctaaag

SEQ ID NO: 22411 - DNA, 21 bp, Artificial sequence
  SiRNA target sequence
tttctcaaaggcatctaaagt

SEQ ID NO: 22412 - DNA, 21 bp, Artificial sequence
  SiRNA target sequence
ttctcaaaggcatctaaagta

SEQ ID NO: 22413 - DNA, 21 bp, Artificial sequence
  SiRNA target sequence
tctcaaaggcatctaaagtag

SEQ ID NO: 22414 - DNA, 21 bp, Artificial sequence
  SiRNA target sequence
ctcaaaggcatctaaagtagt

SEQ ID NO: 22415 - DNA, 21 bp, Artificial sequence
  SiRNA target sequence
tcaaaggcatctaaagtagtg

SEQ ID NO: 22416 - DNA, 21 bp, Artificial sequence
  SiRNA target sequence
caaaggcatctaaagtagtgt

SEQ ID NO: 22417 - DNA, 21 bp, Artificial sequence
  SiRNA target sequence
aaaggcatctaaagtagtgtt

SEQ ID NO: 22418 - DNA, 21 bp, Artificial sequence
  SiRNA target sequence
aaggcatctaaagtagtgttg

SEQ ID NO: 22419 - DNA, 21 bp, Artificial sequence
  SiRNA target sequence
aggcatctaaagtagtgttgg

SEQ ID NO: 22420 - DNA, 21 bp, Artificial sequence
  SiRNA target sequence
ggcatctaaagtagtgttggg

SEQ ID NO: 22421 - DNA, 21 bp, Artificial sequence
  SiRNA target sequence
gcatctaaagtagtgttggga

SEQ ID NO: 22422 - DNA, 21 bp, Artificial sequence
  SiRNA target sequence
catctaaagtagtgttgggaa

SEQ ID NO: 22423 - DNA, 21 bp, Artificial sequence
  SiRNA target sequence
atctaaagtagtgttgggaat

SEQ ID NO: 22424 - DNA, 21 bp, Artificial sequence
  SiRNA target sequence
tctaaagtagtgttgggaata

SEQ ID NO: 22425 - DNA, 21 bp, Artificial sequence
  SiRNA target sequence
ctaaagtagtgttgggaatac

SEQ ID NO: 22426 - DNA, 21 bp, Artificial sequence
  SiRNA target sequence
taaagtagtgttgggaatact

SEQ ID NO: 22427 - DNA, 21 bp, Artificial sequence
  SiRNA target sequence
aaagtagtgttgggaatactc

SEQ ID NO: 22428 - DNA, 21 bp, Artificial sequence
  SiRNA target sequence
aagtagtgttgggaatactct

SEQ ID NO: 22429 - DNA, 21 bp, Artificial sequence
  SiRNA target sequence
agtagtgttgggaatactctc

SEQ ID NO: 22430 - DNA, 21 bp, Artificial sequence
  SiRNA target sequence
gtagtgttgggaatactctct

SEQ ID NO: 22431 - DNA, 21 bp, Artificial sequence
  SiRNA target sequence
tagtgttgggaatactctctt

SEQ ID NO: 22432 - DNA, 21 bp, Artificial sequence
  SiRNA target sequence
agtgttgggaatactctcttt

SEQ ID NO: 22433 - DNA, 21 bp, Artificial sequence
  SiRNA target sequence
gtgttgggaatactctctttg

SEQ ID NO: 22434 - DNA, 21 bp, Artificial sequence
  SiRNA target sequence
tgttgggaatactctctttgg

SEQ ID NO: 22435 - DNA, 21 bp, Artificial sequence
  SiRNA target sequence
gttgggaatactctctttggt

SEQ ID NO: 22436 - DNA, 21 bp, Artificial sequence
  SiRNA target sequence
ttgggaatactctctttggta

SEQ ID NO: 22437 - DNA, 21 bp, Artificial sequence
  SiRNA target sequence
tgggaatactctctttggtac

SEQ ID NO: 22438 - DNA, 21 bp, Artificial sequence
  SiRNA target sequence
gggaatactctctttggtact

SEQ ID NO: 22439 - DNA, 21 bp, Artificial sequence
  SiRNA target sequence
ggaatactctctttggtactg

SEQ ID NO: 22440 - DNA, 21 bp, Artificial sequence
  SiRNA target sequence
gaatactctctttggtactgg

SEQ ID NO: 22441 - DNA, 21 bp, Artificial sequence
  SiRNA target sequence
aatactctctttggtactggt

SEQ ID NO: 22442 - DNA, 21 bp, Artificial sequence
  SiRNA target sequence
atactctctttggtactggtt

SEQ ID NO: 22443 - DNA, 21 bp, Artificial sequence
  SiRNA target sequence
tactctctttggtactggttg

SEQ ID NO: 22444 - DNA, 21 bp, Artificial sequence
  SiRNA target sequence
actctctttggtactggttgg

SEQ ID NO: 22445 - DNA, 21 bp, Artificial sequence
  SiRNA target sequence
ctctctttggtactggttgga

SEQ ID NO: 22446 - DNA, 21 bp, Artificial sequence
  SiRNA target sequence
tctctttggtactggttggat

SEQ ID NO: 22447 - DNA, 21 bp, Artificial sequence
  SiRNA target sequence
ctctttggtactggttggata

SEQ ID NO: 22448 - DNA, 21 bp, Artificial sequence
  SiRNA target sequence
tctttggtactggttggatat

SEQ ID NO: 22449 - DNA, 21 bp, Artificial sequence
  SiRNA target sequence
ctttggtactggttggatatg

SEQ ID NO: 22450 - DNA, 21 bp, Artificial sequence
  SiRNA target sequence
tttggtactggttggatatgg

SEQ ID NO: 22451 - DNA, 21 bp, Artificial sequence
  SiRNA target sequence
ttggtactggttggatatggt

SEQ ID NO: 22452 - DNA, 21 bp, Artificial sequence
  SiRNA target sequence
tggtactggttggatatggta

SEQ ID NO: 22453 - DNA, 21 bp, Artificial sequence
  SiRNA target sequence
ggtactggttggatatggtat

SEQ ID NO: 22454 - DNA, 21 bp, Artificial sequence
  SiRNA target sequence
gtactggttggatatggtata

SEQ ID NO: 22455 - DNA, 21 bp, Artificial sequence
  SiRNA target sequence
tactggttggatatggtatat

SEQ ID NO: 22456 - DNA, 21 bp, Artificial sequence
  SiRNA target sequence
actggttggatatggtatata

SEQ ID NO: 22457 - DNA, 21 bp, Artificial sequence
  SiRNA target sequence
ctggttggatatggtatatat

SEQ ID NO: 22458 - DNA, 21 bp, Artificial sequence
  SiRNA target sequence
tggttggatatggtatatatt

SEQ ID NO: 22459 - DNA, 21 bp, Artificial sequence
  SiRNA target sequence
ggttggatatggtatatattc

SEQ ID NO: 22460 - DNA, 21 bp, Artificial sequence
  SiRNA target sequence
gttggatatggtatatattca

SEQ ID NO: 22461 - DNA, 21 bp, Artificial sequence
  SiRNA target sequence
ttggatatggtatatattcat

SEQ ID NO: 22462 - DNA, 21 bp, Artificial sequence
  SiRNA target sequence
tggatatggtatatattcata

SEQ ID NO: 22463 - DNA, 21 bp, Artificial sequence
  SiRNA target sequence
ggatatggtatatattcatat

SEQ ID NO: 22464 - DNA, 21 bp, Artificial sequence
  SiRNA target sequence
gatatggtatatattcatatg

SEQ ID NO: 22465 - DNA, 21 bp, Artificial sequence
  SiRNA target sequence
atatggtatatattcatatgt

SEQ ID NO: 22466 - DNA, 21 bp, Artificial sequence
  SiRNA target sequence
tatggtatatattcatatgtt

SEQ ID NO: 22467 - DNA, 21 bp, Artificial sequence
  SiRNA target sequence
atggtatatattcatatgtta

SEQ ID NO: 22468 - DNA, 21 bp, Artificial sequence
  SiRNA target sequence
tggtatatattcatatgttaa

SEQ ID NO: 22469 - DNA, 21 bp, Artificial sequence
  SiRNA target sequence
ggtatatattcatatgttaaa

SEQ ID NO: 22470 - DNA, 21 bp, Artificial sequence
  SiRNA target sequence
gtatatattcatatgttaaag

SEQ ID NO: 22471 - DNA, 21 bp, Artificial sequence
  SiRNA target sequence
tatatattcatatgttaaagg

SEQ ID NO: 22472 - DNA, 21 bp, Artificial sequence
  SiRNA target sequence
atatattcatatgttaaagga

SEQ ID NO: 22473 - DNA, 21 bp, Artificial sequence
  SiRNA target sequence
tatattcatatgttaaaggaa

SEQ ID NO: 22474 - DNA, 21 bp, Artificial sequence
  SiRNA target sequence
atattcatatgttaaaggaac

SEQ ID NO: 22475 - DNA, 21 bp, Artificial sequence
  SiRNA target sequence
tattcatatgttaaaggaact

SEQ ID NO: 22476 - DNA, 21 bp, Artificial sequence
  SiRNA target sequence
attcatatgttaaaggaactc

SEQ ID NO: 22477 - DNA, 21 bp, Artificial sequence
  SiRNA target sequence
ttcatatgttaaaggaactcc

SEQ ID NO: 22478 - DNA, 21 bp, Artificial sequence
  SiRNA target sequence
tcatatgttaaaggaactcct

SEQ ID NO: 22479 - DNA, 21 bp, Artificial sequence
  SiRNA target sequence
catatgttaaaggaactcctg

SEQ ID NO: 22480 - DNA, 21 bp, Artificial sequence
  SiRNA target sequence
atatgttaaaggaactcctgc

SEQ ID NO: 22481 - DNA, 21 bp, Artificial sequence
  SiRNA target sequence
tatgttaaaggaactcctgcg

SEQ ID NO: 22482 - DNA, 21 bp, Artificial sequence
  SiRNA target sequence
atgttaaaggaactcctgcga

SEQ ID NO: 22483 - DNA, 21 bp, Artificial sequence
  SiRNA target sequence
tgttaaaggaactcctgcgaa

SEQ ID NO: 22484 - DNA, 21 bp, Artificial sequence
  SiRNA target sequence
gttaaaggaactcctgcgaaa

SEQ ID NO: 22485 - DNA, 21 bp, Artificial sequence
  SiRNA target sequence
ttaaaggaactcctgcgaaag

SEQ ID NO: 22486 - DNA, 21 bp, Artificial sequence
  SiRNA target sequence
taaaggaactcctgcgaaaga

SEQ ID NO: 22487 - DNA, 21 bp, Artificial sequence
  SiRNA target sequence
aaaggaactcctgcgaaagac

SEQ ID NO: 22488 - DNA, 21 bp, Artificial sequence
  SiRNA target sequence
aaggaactcctgcgaaagact

SEQ ID NO: 22489 - DNA, 21 bp, Artificial sequence
  SiRNA target sequence
aggaactcctgcgaaagactc

SEQ ID NO: 22490 - DNA, 21 bp, Artificial sequence
  SiRNA target sequence
ggaactcctgcgaaagactca

SEQ ID NO: 22491 - DNA, 21 bp, Artificial sequence
  SiRNA target sequence
gaactcctgcgaaagactcag

SEQ ID NO: 22492 - DNA, 21 bp, Artificial sequence
  SiRNA target sequence
aactcctgcgaaagactcagc

SEQ ID NO: 22493 - DNA, 21 bp, Artificial sequence
  SiRNA target sequence
actcctgcgaaagactcagcg

SEQ ID NO: 22494 - DNA, 21 bp, Artificial sequence
  SiRNA target sequence
ctcctgcgaaagactcagcgg

SEQ ID NO: 22495 - DNA, 21 bp, Artificial sequence
  SiRNA target sequence
tcctgcgaaagactcagcgga

SEQ ID NO: 22496 - DNA, 21 bp, Artificial sequence
  SiRNA target sequence
cctgcgaaagactcagcggaa

SEQ ID NO: 22497 - DNA, 21 bp, Artificial sequence
  SiRNA target sequence
ctgcgaaagactcagcggaat

SEQ ID NO: 22498 - DNA, 21 bp, Artificial sequence
  SiRNA target sequence
tgcgaaagactcagcggaatc

SEQ ID NO: 22499 - DNA, 21 bp, Artificial sequence
  SiRNA target sequence
gcgaaagactcagcggaatct

SEQ ID NO: 22500 - DNA, 21 bp, Artificial sequence
  SiRNA target sequence
cgaaagactcagcggaatctt

SEQ ID NO: 22501 - DNA, 21 bp, Artificial sequence
  SiRNA target sequence
gaaagactcagcggaatctta

SEQ ID NO: 22502 - DNA, 21 bp, Artificial sequence
  SiRNA target sequence
aaagactcagcggaatcttac

SEQ ID NO: 22503 - DNA, 21 bp, Artificial sequence
  SiRNA target sequence
aagactcagcggaatcttacg

SEQ ID NO: 22504 - DNA, 21 bp, Artificial sequence
  SiRNA target sequence
agactcagcggaatcttacga

SEQ ID NO: 22505 - DNA, 21 bp, Artificial sequence
  SiRNA target sequence
gactcagcggaatcttacgaa

SEQ ID NO: 22506 - DNA, 21 bp, Artificial sequence
  SiRNA target sequence
actcagcggaatcttacgaac

SEQ ID NO: 22507 - DNA, 21 bp, Artificial sequence
  SiRNA target sequence
ctcagcggaatcttacgaacc

SEQ ID NO: 22508 - DNA, 21 bp, Artificial sequence
  SiRNA target sequence
tcagcggaatcttacgaacca

SEQ ID NO: 22509 - DNA, 21 bp, Artificial sequence
  SiRNA target sequence
cagcggaatcttacgaaccaa

SEQ ID NO: 22510 - DNA, 21 bp, Artificial sequence
  SiRNA target sequence
agcggaatcttacgaaccaaa

SEQ ID NO: 22511 - DNA, 21 bp, Artificial sequence
  SiRNA target sequence
gcggaatcttacgaaccaaaa

SEQ ID NO: 22512 - DNA, 21 bp, Artificial sequence
  SiRNA target sequence
cggaatcttacgaaccaaaag

SEQ ID NO: 22513 - DNA, 21 bp, Artificial sequence
  SiRNA target sequence
ggaatcttacgaaccaaaagt

SEQ ID NO: 22514 - DNA, 21 bp, Artificial sequence
  SiRNA target sequence
gaatcttacgaaccaaaagtg

SEQ ID NO: 22515 - DNA, 21 bp, Artificial sequence
  SiRNA target sequence
aatcttacgaaccaaaagtgg

SEQ ID NO: 22516 - DNA, 21 bp, Artificial sequence
  SiRNA target sequence
atcttacgaaccaaaagtggc

SEQ ID NO: 22517 - DNA, 21 bp, Artificial sequence
  SiRNA target sequence
tcttacgaaccaaaagtggcg

SEQ ID NO: 22518 - DNA, 21 bp, Artificial sequence
  SiRNA target sequence
cttacgaaccaaaagtggcga

SEQ ID NO: 22519 - DNA, 21 bp, Artificial sequence
  SiRNA target sequence
ttacgaaccaaaagtggcgag

SEQ ID NO: 22520 - DNA, 21 bp, Artificial sequence
  SiRNA target sequence
tacgaaccaaaagtggcgagt

SEQ ID NO: 22521 - DNA, 21 bp, Artificial sequence
  SiRNA target sequence
acgaaccaaaagtggcgagta

SEQ ID NO: 22522 - DNA, 21 bp, Artificial sequence
  SiRNA target sequence
cgaaccaaaagtggcgagtaa

SEQ ID NO: 22523 - DNA, 21 bp, Artificial sequence
  SiRNA target sequence
gaaccaaaagtggcgagtaag

SEQ ID NO: 22524 - DNA, 21 bp, Artificial sequence
  SiRNA target sequence
aaccaaaagtggcgagtaagg

SEQ ID NO: 22525 - DNA, 21 bp, Artificial sequence
  SiRNA target sequence
accaaaagtggcgagtaaggt

SEQ ID NO: 22526 - DNA, 21 bp, Artificial sequence
  SiRNA target sequence
ccaaaagtggcgagtaaggtt

SEQ ID NO: 22527 - DNA, 21 bp, Artificial sequence
  SiRNA target sequence
caaaagtggcgagtaaggtta

SEQ ID NO: 22528 - DNA, 21 bp, Artificial sequence
  SiRNA target sequence
aaaagtggcgagtaaggttaa

SEQ ID NO: 22529 - DNA, 21 bp, Artificial sequence
  SiRNA target sequence
aaagtggcgagtaaggttaag

SEQ ID NO: 22530 - DNA, 21 bp, Artificial sequence
  SiRNA target sequence
aagtggcgagtaaggttaagg

SEQ ID NO: 22531 - DNA, 21 bp, Artificial sequence
  SiRNA target sequence
agtggcgagtaaggttaaggt

SEQ ID NO: 22532 - DNA, 21 bp, Artificial sequence
  SiRNA target sequence
gtggcgagtaaggttaaggtt

SEQ ID NO: 22533 - DNA, 21 bp, Artificial sequence
  SiRNA target sequence
tggcgagtaaggttaaggttg

SEQ ID NO: 22534 - DNA, 21 bp, Artificial sequence
  SiRNA target sequence
ggcgagtaaggttaaggttga

SEQ ID NO: 22535 - DNA, 21 bp, Artificial sequence
  SiRNA target sequence
gcgagtaaggttaaggttgag

SEQ ID NO: 22536 - DNA, 21 bp, Artificial sequence
  SiRNA target sequence
cgagtaaggttaaggttgagg

SEQ ID NO: 22537 - DNA, 21 bp, Artificial sequence
  SiRNA target sequence
gagtaaggttaaggttgaggg

SEQ ID NO: 22538 - DNA, 21 bp, Artificial sequence
  SiRNA target sequence
agtaaggttaaggttgaggga

SEQ ID NO: 22539 - DNA, 21 bp, Artificial sequence
  SiRNA target sequence
gtaaggttaaggttgagggaa

SEQ ID NO: 22540 - DNA, 21 bp, Artificial sequence
  SiRNA target sequence
taaggttaaggttgagggaaa

SEQ ID NO: 22541 - DNA, 21 bp, Artificial sequence
  SiRNA target sequence
aaggttaaggttgagggaaat

SEQ ID NO: 22542 - DNA, 21 bp, Artificial sequence
  SiRNA target sequence
aggttaaggttgagggaaata

SEQ ID NO: 22543 - DNA, 21 bp, Artificial sequence
  SiRNA target sequence
ggttaaggttgagggaaataa

SEQ ID NO: 22544 - DNA, 21 bp, Artificial sequence
  SiRNA target sequence
gttaaggttgagggaaataac

SEQ ID NO: 22545 - DNA, 21 bp, Artificial sequence
  SiRNA target sequence
ttaaggttgagggaaataaca

SEQ ID NO: 22546 - DNA, 21 bp, Artificial sequence
  SiRNA target sequence
taaggttgagggaaataacag

SEQ ID NO: 22547 - DNA, 21 bp, Artificial sequence
  SiRNA target sequence
aaggttgagggaaataacagt

SEQ ID NO: 22548 - DNA, 21 bp, Artificial sequence
  SiRNA target sequence
aggttgagggaaataacagtg

SEQ ID NO: 22549 - DNA, 21 bp, Artificial sequence
  SiRNA target sequence
ggttgagggaaataacagtgt

SEQ ID NO: 22550 - DNA, 21 bp, Artificial sequence
  SiRNA target sequence
gttgagggaaataacagtgtt

SEQ ID NO: 22551 - DNA, 21 bp, Artificial sequence
  SiRNA target sequence
ttgagggaaataacagtgttc

SEQ ID NO: 22552 - DNA, 21 bp, Artificial sequence
  SiRNA target sequence
tgagggaaataacagtgttcc

SEQ ID NO: 22553 - DNA, 21 bp, Artificial sequence
  SiRNA target sequence
gagggaaataacagtgttcct

SEQ ID NO: 22554 - DNA, 21 bp, Artificial sequence
  SiRNA target sequence
agggaaataacagtgttcctg

SEQ ID NO: 22555 - DNA, 21 bp, Artificial sequence
  SiRNA target sequence
gggaaataacagtgttcctga

SEQ ID NO: 22556 - DNA, 21 bp, Artificial sequence
  SiRNA target sequence
ggaaataacagtgttcctgag

SEQ ID NO: 22557 - DNA, 21 bp, Artificial sequence
  SiRNA target sequence
gaaataacagtgttcctgagg

SEQ ID NO: 22558 - DNA, 21 bp, Artificial sequence
  SiRNA target sequence
aaataacagtgttcctgaggc

SEQ ID NO: 22559 - DNA, 21 bp, Artificial sequence
  SiRNA target sequence
aataacagtgttcctgaggcg

SEQ ID NO: 22560 - DNA, 21 bp, Artificial sequence
  SiRNA target sequence
ataacagtgttcctgaggcgt

SEQ ID NO: 22561 - DNA, 21 bp, Artificial sequence
  SiRNA target sequence
taacagtgttcctgaggcgta

SEQ ID NO: 22562 - DNA, 21 bp, Artificial sequence
  SiRNA target sequence
aacagtgttcctgaggcgtac

SEQ ID NO: 22563 - DNA, 21 bp, Artificial sequence
  SiRNA target sequence
acagtgttcctgaggcgtacg

SEQ ID NO: 22564 - DNA, 21 bp, Artificial sequence
  SiRNA target sequence
cagtgttcctgaggcgtacga

SEQ ID NO: 22565 - DNA, 21 bp, Artificial sequence
  SiRNA target sequence
agtgttcctgaggcgtacgaa

SEQ ID NO: 22566 - DNA, 21 bp, Artificial sequence
  SiRNA target sequence
gtgttcctgaggcgtacgaac

SEQ ID NO: 22567 - DNA, 21 bp, Artificial sequence
  SiRNA target sequence
tgttcctgaggcgtacgaacc

SEQ ID NO: 22568 - DNA, 21 bp, Artificial sequence
  SiRNA target sequence
gttcctgaggcgtacgaacca

SEQ ID NO: 22569 - DNA, 21 bp, Artificial sequence
  SiRNA target sequence
ttcctgaggcgtacgaaccaa

SEQ ID NO: 22570 - DNA, 21 bp, Artificial sequence
  SiRNA target sequence
tcctgaggcgtacgaaccaaa

SEQ ID NO: 22571 - DNA, 21 bp, Artificial sequence
  SiRNA target sequence
cctgaggcgtacgaaccaaaa

SEQ ID NO: 22572 - DNA, 21 bp, Artificial sequence
  SiRNA target sequence
ctgaggcgtacgaaccaaaag

SEQ ID NO: 22573 - DNA, 21 bp, Artificial sequence
  SiRNA target sequence
tgaggcgtacgaaccaaaagt

SEQ ID NO: 22574 - DNA, 21 bp, Artificial sequence
  SiRNA target sequence
gaggcgtacgaaccaaaagtt

SEQ ID NO: 22575 - DNA, 21 bp, Artificial sequence
  SiRNA target sequence
aggcgtacgaaccaaaagtta

SEQ ID NO: 22576 - DNA, 21 bp, Artificial sequence
  SiRNA target sequence
ggcgtacgaaccaaaagttag

SEQ ID NO: 22577 - DNA, 21 bp, Artificial sequence
  SiRNA target sequence
gcgtacgaaccaaaagttagt

SEQ ID NO: 22578 - DNA, 21 bp, Artificial sequence
  SiRNA target sequence
cgtacgaaccaaaagttagta

SEQ ID NO: 22579 - DNA, 21 bp, Artificial sequence
  SiRNA target sequence
gtacgaaccaaaagttagtag

SEQ ID NO: 22580 - DNA, 21 bp, Artificial sequence
  SiRNA target sequence
tacgaaccaaaagttagtaga

SEQ ID NO: 22581 - DNA, 21 bp, Artificial sequence
  SiRNA target sequence
acgaaccaaaagttagtagaa

SEQ ID NO: 22582 - DNA, 21 bp, Artificial sequence
  SiRNA target sequence
cgaaccaaaagttagtagaaa

SEQ ID NO: 22583 - DNA, 21 bp, Artificial sequence
  SiRNA target sequence
gaaccaaaagttagtagaaaa

SEQ ID NO: 22584 - DNA, 21 bp, Artificial sequence
  SiRNA target sequence
aaccaaaagttagtagaaaag

SEQ ID NO: 22585 - DNA, 21 bp, Artificial sequence
  SiRNA target sequence
accaaaagttagtagaaaagt

SEQ ID NO: 22586 - DNA, 21 bp, Artificial sequence
  SiRNA target sequence
ccaaaagttagtagaaaagtc

SEQ ID NO: 22587 - DNA, 21 bp, Artificial sequence
  SiRNA target sequence
caaaagttagtagaaaagtca

SEQ ID NO: 22588 - DNA, 21 bp, Artificial sequence
  SiRNA target sequence
aaaagttagtagaaaagtcaa

SEQ ID NO: 22589 - DNA, 21 bp, Artificial sequence
  SiRNA target sequence
aaagttagtagaaaagtcaag

SEQ ID NO: 22590 - DNA, 21 bp, Artificial sequence
  SiRNA target sequence
aagttagtagaaaagtcaagg

SEQ ID NO: 22591 - DNA, 21 bp, Artificial sequence
  SiRNA target sequence
agttagtagaaaagtcaaggt

SEQ ID NO: 22592 - DNA, 21 bp, Artificial sequence
  SiRNA target sequence
gttagtagaaaagtcaaggtt

SEQ ID NO: 22593 - DNA, 21 bp, Artificial sequence
  SiRNA target sequence
ttagtagaaaagtcaaggttg

SEQ ID NO: 22594 - DNA, 21 bp, Artificial sequence
  SiRNA target sequence
tagtagaaaagtcaaggttga

SEQ ID NO: 22595 - DNA, 21 bp, Artificial sequence
  SiRNA target sequence
agtagaaaagtcaaggttgaa

SEQ ID NO: 22596 - DNA, 21 bp, Artificial sequence
  SiRNA target sequence
gtagaaaagtcaaggttgaag

SEQ ID NO: 22597 - DNA, 21 bp, Artificial sequence
  SiRNA target sequence
tagaaaagtcaaggttgaagg

SEQ ID NO: 22598 - DNA, 21 bp, Artificial sequence
  SiRNA target sequence
agaaaagtcaaggttgaagga

SEQ ID NO: 22599 - DNA, 21 bp, Artificial sequence
  SiRNA target sequence
gaaaagtcaaggttgaaggat

SEQ ID NO: 22600 - DNA, 21 bp, Artificial sequence
  SiRNA target sequence
aaaagtcaaggttgaaggata

SEQ ID NO: 22601 - DNA, 21 bp, Artificial sequence
  SiRNA target sequence
aaagtcaaggttgaaggatac

SEQ ID NO: 22602 - DNA, 21 bp, Artificial sequence
  SiRNA target sequence
aagtcaaggttgaaggataca

SEQ ID NO: 22603 - DNA, 21 bp, Artificial sequence
  SiRNA target sequence
agtcaaggttgaaggatacaa

SEQ ID NO: 22604 - DNA, 21 bp, Artificial sequence
  SiRNA target sequence
gtcaaggttgaaggatacaat

SEQ ID NO: 22605 - DNA, 21 bp, Artificial sequence
  SiRNA target sequence
tcaaggttgaaggatacaatg

SEQ ID NO: 22606 - DNA, 21 bp, Artificial sequence
  SiRNA target sequence
caaggttgaaggatacaatgc

SEQ ID NO: 22607 - DNA, 21 bp, Artificial sequence
  SiRNA target sequence
aaggttgaaggatacaatgcg

SEQ ID NO: 22608 - DNA, 21 bp, Artificial sequence
  SiRNA target sequence
aggttgaaggatacaatgcga

SEQ ID NO: 22609 - DNA, 21 bp, Artificial sequence
  SiRNA target sequence
ggttgaaggatacaatgcgag

SEQ ID NO: 22610 - DNA, 21 bp, Artificial sequence
  SiRNA target sequence
gttgaaggatacaatgcgaga

SEQ ID NO: 22611 - DNA, 21 bp, Artificial sequence
  SiRNA target sequence
ttgaaggatacaatgcgagag

SEQ ID NO: 22612 - DNA, 21 bp, Artificial sequence
  SiRNA target sequence
tgaaggatacaatgcgagaga

SEQ ID NO: 22613 - DNA, 21 bp, Artificial sequence
  SiRNA target sequence
gaaggatacaatgcgagagag

SEQ ID NO: 22614 - DNA, 21 bp, Artificial sequence
  SiRNA target sequence
aaggatacaatgcgagagaga

SEQ ID NO: 22615 - DNA, 21 bp, Artificial sequence
  SiRNA target sequence
aggatacaatgcgagagagat

SEQ ID NO: 22616 - DNA, 21 bp, Artificial sequence
  SiRNA target sequence
ggatacaatgcgagagagatt

SEQ ID NO: 22617 - DNA, 21 bp, Artificial sequence
  SiRNA target sequence
gatacaatgcgagagagatta

SEQ ID NO: 22618 - DNA, 21 bp, Artificial sequence
  SiRNA target sequence
atacaatgcgagagagattaa

SEQ ID NO: 22619 - DNA, 21 bp, Artificial sequence
  SiRNA target sequence
tacaatgcgagagagattaaa

SEQ ID NO: 22620 - DNA, 21 bp, Artificial sequence
  SiRNA target sequence
acaatgcgagagagattaaac

SEQ ID NO: 22621 - DNA, 21 bp, Artificial sequence
  SiRNA target sequence
caatgcgagagagattaaacg

SEQ ID NO: 22622 - DNA, 21 bp, Artificial sequence
  SiRNA target sequence
aatgcgagagagattaaacgt

SEQ ID NO: 22623 - DNA, 21 bp, Artificial sequence
  SiRNA target sequence
atgcgagagagattaaacgta

SEQ ID NO: 22624 - DNA, 21 bp, Artificial sequence
  SiRNA target sequence
tgcgagagagattaaacgtaa

SEQ ID NO: 22625 - DNA, 21 bp, Artificial sequence
  SiRNA target sequence
gcgagagagattaaacgtaaa

SEQ ID NO: 22626 - DNA, 21 bp, Artificial sequence
  SiRNA target sequence
cgagagagattaaacgtaaag

SEQ ID NO: 22627 - DNA, 21 bp, Artificial sequence
  SiRNA target sequence
gagagagattaaacgtaaagt

SEQ ID NO: 22628 - DNA, 21 bp, Artificial sequence
  SiRNA target sequence
agagagattaaacgtaaagtg

SEQ ID NO: 22629 - DNA, 21 bp, Artificial sequence
  SiRNA target sequence
gagagattaaacgtaaagtgg

SEQ ID NO: 22630 - DNA, 21 bp, Artificial sequence
  SiRNA target sequence
agagattaaacgtaaagtgga

SEQ ID NO: 22631 - DNA, 21 bp, Artificial sequence
  SiRNA target sequence
gagattaaacgtaaagtggaa

SEQ ID NO: 22632 - DNA, 21 bp, Artificial sequence
  SiRNA target sequence
agattaaacgtaaagtggaag

SEQ ID NO: 22633 - DNA, 21 bp, Artificial sequence
  SiRNA target sequence
gattaaacgtaaagtggaagc

SEQ ID NO: 22634 - DNA, 21 bp, Artificial sequence
  SiRNA target sequence
attaaacgtaaagtggaagct

SEQ ID NO: 22635 - DNA, 21 bp, Artificial sequence
  SiRNA target sequence
ttaaacgtaaagtggaagctt

SEQ ID NO: 22636 - DNA, 21 bp, Artificial sequence
  SiRNA target sequence
taaacgtaaagtggaagctta

SEQ ID NO: 22637 - DNA, 21 bp, Artificial sequence
  SiRNA target sequence
aaacgtaaagtggaagcttat

SEQ ID NO: 22638 - DNA, 21 bp, Artificial sequence
  SiRNA target sequence
aacgtaaagtggaagcttatg

SEQ ID NO: 22639 - DNA, 21 bp, Artificial sequence
  SiRNA target sequence
acgtaaagtggaagcttatgc

SEQ ID NO: 22640 - DNA, 21 bp, Artificial sequence
  SiRNA target sequence
cgtaaagtggaagcttatgct

SEQ ID NO: 22641 - DNA, 21 bp, Artificial sequence
  SiRNA target sequence
gtaaagtggaagcttatgctc

SEQ ID NO: 22642 - DNA, 21 bp, Artificial sequence
  SiRNA target sequence
taaagtggaagcttatgctcc

SEQ ID NO: 22643 - DNA, 21 bp, Artificial sequence
  SiRNA target sequence
aaagtggaagcttatgctccc

SEQ ID NO: 22644 - DNA, 21 bp, Artificial sequence
  SiRNA target sequence
aagtggaagcttatgctccca

SEQ ID NO: 22645 - DNA, 21 bp, Artificial sequence
  SiRNA target sequence
agtggaagcttatgctcccaa

SEQ ID NO: 22646 - DNA, 21 bp, Artificial sequence
  SiRNA target sequence
gtggaagcttatgctcccaaa

SEQ ID NO: 22647 - DNA, 21 bp, Artificial sequence
  SiRNA target sequence
tggaagcttatgctcccaaag

SEQ ID NO: 22648 - DNA, 21 bp, Artificial sequence
  SiRNA target sequence
ggaagcttatgctcccaaagt

SEQ ID NO: 22649 - DNA, 21 bp, Artificial sequence
  SiRNA target sequence
gaagcttatgctcccaaagtt

SEQ ID NO: 22650 - DNA, 21 bp, Artificial sequence
  SiRNA target sequence
aagcttatgctcccaaagtta

SEQ ID NO: 22651 - DNA, 21 bp, Artificial sequence
  SiRNA target sequence
agcttatgctcccaaagttag

SEQ ID NO: 22652 - DNA, 21 bp, Artificial sequence
  SiRNA target sequence
gcttatgctcccaaagttagt

SEQ ID NO: 22653 - DNA, 21 bp, Artificial sequence
  SiRNA target sequence
cttatgctcccaaagttagtc

SEQ ID NO: 22654 - DNA, 21 bp, Artificial sequence
  SiRNA target sequence
ttatgctcccaaagttagtcg

SEQ ID NO: 22655 - DNA, 21 bp, Artificial sequence
  SiRNA target sequence
tatgctcccaaagttagtcga

SEQ ID NO: 22656 - DNA, 21 bp, Artificial sequence
  SiRNA target sequence
atgctcccaaagttagtcgag

SEQ ID NO: 22657 - DNA, 21 bp, Artificial sequence
  SiRNA target sequence
tgctcccaaagttagtcgagc

SEQ ID NO: 22658 - DNA, 21 bp, Artificial sequence
  SiRNA target sequence
gctcccaaagttagtcgagct

SEQ ID NO: 22659 - DNA, 21 bp, Artificial sequence
  SiRNA target sequence
ctcccaaagttagtcgagctg

SEQ ID NO: 22660 - DNA, 21 bp, Artificial sequence
  SiRNA target sequence
tcccaaagttagtcgagctgt

SEQ ID NO: 22661 - DNA, 21 bp, Artificial sequence
  SiRNA target sequence
cccaaagttagtcgagctgtg

SEQ ID NO: 22662 - DNA, 21 bp, Artificial sequence
  SiRNA target sequence
ccaaagttagtcgagctgtgc

SEQ ID NO: 22663 - DNA, 21 bp, Artificial sequence
  SiRNA target sequence
caaagttagtcgagctgtgcg

SEQ ID NO: 22664 - DNA, 21 bp, Artificial sequence
  SiRNA target sequence
aaagttagtcgagctgtgcgc

SEQ ID NO: 22665 - DNA, 21 bp, Artificial sequence
  SiRNA target sequence
aagttagtcgagctgtgcgcg

SEQ ID NO: 22666 - DNA, 21 bp, Artificial sequence
  SiRNA target sequence
agttagtcgagctgtgcgcgt

SEQ ID NO: 22667 - DNA, 21 bp, Artificial sequence
  SiRNA target sequence
gttagtcgagctgtgcgcgtc

SEQ ID NO: 22668 - DNA, 21 bp, Artificial sequence
  SiRNA target sequence
ttagtcgagctgtgcgcgtcg

SEQ ID NO: 22669 - DNA, 21 bp, Artificial sequence
  SiRNA target sequence
tagtcgagctgtgcgcgtcga

SEQ ID NO: 22670 - DNA, 21 bp, Artificial sequence
  SiRNA target sequence
agtcgagctgtgcgcgtcgaa

SEQ ID NO: 22671 - DNA, 21 bp, Artificial sequence
  SiRNA target sequence
gtcgagctgtgcgcgtcgaat

SEQ ID NO: 22672 - DNA, 21 bp, Artificial sequence
  SiRNA target sequence
tcgagctgtgcgcgtcgaatc

SEQ ID NO: 22673 - DNA, 21 bp, Artificial sequence
  SiRNA target sequence
cgagctgtgcgcgtcgaatct

SEQ ID NO: 22674 - DNA, 21 bp, Artificial sequence
  SiRNA target sequence
gagctgtgcgcgtcgaatcta

SEQ ID NO: 22675 - DNA, 21 bp, Artificial sequence
  SiRNA target sequence
agctgtgcgcgtcgaatctag

SEQ ID NO: 22676 - DNA, 21 bp, Artificial sequence
  SiRNA target sequence
gctgtgcgcgtcgaatctagt

SEQ ID NO: 22677 - DNA, 21 bp, Artificial sequence
  SiRNA target sequence
ctgtgcgcgtcgaatctagtg

SEQ ID NO: 22678 - DNA, 21 bp, Artificial sequence
  SiRNA target sequence
tgtgcgcgtcgaatctagtga

SEQ ID NO: 22679 - DNA, 21 bp, Artificial sequence
  SiRNA target sequence
gtgcgcgtcgaatctagtgag

SEQ ID NO: 22680 - DNA, 21 bp, Artificial sequence
  SiRNA target sequence
tgcgcgtcgaatctagtgagg

SEQ ID NO: 22681 - DNA, 21 bp, Artificial sequence
  SiRNA target sequence
gcgcgtcgaatctagtgaggt

SEQ ID NO: 22682 - DNA, 21 bp, Artificial sequence
  SiRNA target sequence
cgcgtcgaatctagtgaggtt

SEQ ID NO: 22683 - DNA, 21 bp, Artificial sequence
  SiRNA target sequence
gcgtcgaatctagtgaggttg

SEQ ID NO: 22684 - DNA, 21 bp, Artificial sequence
  SiRNA target sequence
cgtcgaatctagtgaggttgt

SEQ ID NO: 22685 - DNA, 21 bp, Artificial sequence
  SiRNA target sequence
gtcgaatctagtgaggttgta

SEQ ID NO: 22686 - DNA, 21 bp, Artificial sequence
  SiRNA target sequence
tcgaatctagtgaggttgtaa

SEQ ID NO: 22687 - DNA, 21 bp, Artificial sequence
  SiRNA target sequence
cgaatctagtgaggttgtaat

SEQ ID NO: 22688 - DNA, 21 bp, Artificial sequence
  SiRNA target sequence
gaatctagtgaggttgtaata

SEQ ID NO: 22689 - DNA, 21 bp, Artificial sequence
  SiRNA target sequence
aatctagtgaggttgtaatac

SEQ ID NO: 22690 - DNA, 21 bp, Artificial sequence
  SiRNA target sequence
atctagtgaggttgtaataca

SEQ ID NO: 22691 - DNA, 21 bp, Artificial sequence
  SiRNA target sequence
tctagtgaggttgtaatacat

SEQ ID NO: 22692 - DNA, 21 bp, Artificial sequence
  SiRNA target sequence
ctagtgaggttgtaatacatc

SEQ ID NO: 22693 - DNA, 21 bp, Artificial sequence
  SiRNA target sequence
tagtgaggttgtaatacatcc

SEQ ID NO: 22694 - DNA, 21 bp, Artificial sequence
  SiRNA target sequence
agtgaggttgtaatacatcct

SEQ ID NO: 22695 - DNA, 21 bp, Artificial sequence
  SiRNA target sequence
gtgaggttgtaatacatccta

SEQ ID NO: 22696 - DNA, 21 bp, Artificial sequence
  SiRNA target sequence
tgaggttgtaatacatcctaa

SEQ ID NO: 22697 - DNA, 21 bp, Artificial sequence
  SiRNA target sequence
gaggttgtaatacatcctaat

SEQ ID NO: 22698 - DNA, 21 bp, Artificial sequence
  SiRNA target sequence
aggttgtaatacatcctaatt

SEQ ID NO: 22699 - DNA, 21 bp, Artificial sequence
  SiRNA target sequence
ggttgtaatacatcctaattc

SEQ ID NO: 22700 - DNA, 21 bp, Artificial sequence
  SiRNA target sequence
gttgtaatacatcctaattct

SEQ ID NO: 22701 - DNA, 21 bp, Artificial sequence
  SiRNA target sequence
ttgtaatacatcctaattctc

SEQ ID NO: 22702 - DNA, 21 bp, Artificial sequence
  SiRNA target sequence
tgtaatacatcctaattctct

SEQ ID NO: 22703 - DNA, 21 bp, Artificial sequence
  SiRNA target sequence
gtaatacatcctaattctctg

SEQ ID NO: 22704 - DNA, 21 bp, Artificial sequence
  SiRNA target sequence
taatacatcctaattctctga

SEQ ID NO: 22705 - DNA, 21 bp, Artificial sequence
  SiRNA target sequence
aatacatcctaattctctgat

SEQ ID NO: 22706 - DNA, 21 bp, Artificial sequence
  SiRNA target sequence
atacatcctaattctctgatt

SEQ ID NO: 22707 - DNA, 21 bp, Artificial sequence
  SiRNA target sequence
tacatcctaattctctgattg

SEQ ID NO: 22708 - DNA, 21 bp, Artificial sequence
  SiRNA target sequence
acatcctaattctctgattga

SEQ ID NO: 22709 - DNA, 21 bp, Artificial sequence
  SiRNA target sequence
catcctaattctctgattgag

SEQ ID NO: 22710 - DNA, 21 bp, Artificial sequence
  SiRNA target sequence
atcctaattctctgattgaga

SEQ ID NO: 22711 - DNA, 21 bp, Artificial sequence
  SiRNA target sequence
tcctaattctctgattgagaa

SEQ ID NO: 22712 - DNA, 21 bp, Artificial sequence
  SiRNA target sequence
cctaattctctgattgagaag

SEQ ID NO: 22713 - DNA, 21 bp, Artificial sequence
  SiRNA target sequence
ctaattctctgattgagaagg

SEQ ID NO: 22714 - DNA, 21 bp, Artificial sequence
  SiRNA target sequence
taattctctgattgagaaggg

SEQ ID NO: 22715 - DNA, 21 bp, Artificial sequence
  SiRNA target sequence
aattctctgattgagaagggt

SEQ ID NO: 22716 - DNA, 21 bp, Artificial sequence
  SiRNA target sequence
attctctgattgagaagggtg

SEQ ID NO: 22717 - DNA, 21 bp, Artificial sequence
  SiRNA target sequence
ttctctgattgagaagggtga

SEQ ID NO: 22718 - DNA, 21 bp, Artificial sequence
  SiRNA target sequence
tctctgattgagaagggtgat

SEQ ID NO: 22719 - DNA, 21 bp, Artificial sequence
  SiRNA target sequence
ctctgattgagaagggtgatg

SEQ ID NO: 22720 - DNA, 21 bp, Artificial sequence
  SiRNA target sequence
tctgattgagaagggtgatga

SEQ ID NO: 22721 - DNA, 21 bp, Artificial sequence
  SiRNA target sequence
ctgattgagaagggtgatgat

SEQ ID NO: 22722 - DNA, 21 bp, Artificial sequence
  SiRNA target sequence
tgattgagaagggtgatgata

SEQ ID NO: 22723 - DNA, 21 bp, Artificial sequence
  SiRNA target sequence
gattgagaagggtgatgatat

SEQ ID NO: 22724 - DNA, 21 bp, Artificial sequence
  SiRNA target sequence
attgagaagggtgatgatatt

SEQ ID NO: 22725 - DNA, 21 bp, Artificial sequence
  SiRNA target sequence
ttgagaagggtgatgatattg

SEQ ID NO: 22726 - DNA, 21 bp, Artificial sequence
  SiRNA target sequence
tgagaagggtgatgatattgt

SEQ ID NO: 22727 - DNA, 21 bp, Artificial sequence
  SiRNA target sequence
gagaagggtgatgatattgtg

SEQ ID NO: 22728 - DNA, 21 bp, Artificial sequence
  SiRNA target sequence
agaagggtgatgatattgtgc

SEQ ID NO: 22729 - DNA, 21 bp, Artificial sequence
  SiRNA target sequence
gaagggtgatgatattgtgca

SEQ ID NO: 22730 - DNA, 21 bp, Artificial sequence
  SiRNA target sequence
aagggtgatgatattgtgcaa

SEQ ID NO: 22731 - DNA, 21 bp, Artificial sequence
  SiRNA target sequence
agggtgatgatattgtgcaat

SEQ ID NO: 22732 - DNA, 21 bp, Artificial sequence
  SiRNA target sequence
gggtgatgatattgtgcaatc

SEQ ID NO: 22733 - DNA, 21 bp, Artificial sequence
  SiRNA target sequence
ggtgatgatattgtgcaatct

SEQ ID NO: 22734 - DNA, 21 bp, Artificial sequence
  SiRNA target sequence
gtgatgatattgtgcaatctg

SEQ ID NO: 22735 - DNA, 21 bp, Artificial sequence
  SiRNA target sequence
tgatgatattgtgcaatctga

SEQ ID NO: 22736 - DNA, 21 bp, Artificial sequence
  SiRNA target sequence
gatgatattgtgcaatctgaa

SEQ ID NO: 22737 - DNA, 21 bp, Artificial sequence
  SiRNA target sequence
atgatattgtgcaatctgaag

SEQ ID NO: 22738 - DNA, 21 bp, Artificial sequence
  SiRNA target sequence
tgatattgtgcaatctgaagc

SEQ ID NO: 22739 - DNA, 21 bp, Artificial sequence
  SiRNA target sequence
gatattgtgcaatctgaagca

SEQ ID NO: 22740 - DNA, 21 bp, Artificial sequence
  SiRNA target sequence
atattgtgcaatctgaagcat

SEQ ID NO: 22741 - DNA, 21 bp, Artificial sequence
  SiRNA target sequence
tattgtgcaatctgaagcatg

SEQ ID NO: 22742 - DNA, 21 bp, Artificial sequence
  SiRNA target sequence
attgtgcaatctgaagcatgt

SEQ ID NO: 22743 - DNA, 21 bp, Artificial sequence
  SiRNA target sequence
ttgtgcaatctgaagcatgta

SEQ ID NO: 22744 - DNA, 21 bp, Artificial sequence
  SiRNA target sequence
tgtgcaatctgaagcatgtag

SEQ ID NO: 22745 - DNA, 21 bp, Artificial sequence
  SiRNA target sequence
gtgcaatctgaagcatgtagt

SEQ ID NO: 22746 - DNA, 21 bp, Artificial sequence
  SiRNA target sequence
tgcaatctgaagcatgtagtg

SEQ ID NO: 22747 - DNA, 21 bp, Artificial sequence
  SiRNA target sequence
gcaatctgaagcatgtagtga

SEQ ID NO: 22748 - DNA, 21 bp, Artificial sequence
  SiRNA target sequence
caatctgaagcatgtagtgat

SEQ ID NO: 22749 - DNA, 21 bp, Artificial sequence
  SiRNA target sequence
aatctgaagcatgtagtgata

SEQ ID NO: 22750 - DNA, 21 bp, Artificial sequence
  SiRNA target sequence
atctgaagcatgtagtgatat

SEQ ID NO: 22751 - DNA, 21 bp, Artificial sequence
  SiRNA target sequence
tctgaagcatgtagtgatata

SEQ ID NO: 22752 - DNA, 21 bp, Artificial sequence
  SiRNA target sequence
ctgaagcatgtagtgatataa

SEQ ID NO: 22753 - DNA, 21 bp, Artificial sequence
  SiRNA target sequence
tgaagcatgtagtgatataaa

SEQ ID NO: 22754 - DNA, 21 bp, Artificial sequence
  SiRNA target sequence
gaagcatgtagtgatataaat

SEQ ID NO: 22755 - DNA, 21 bp, Artificial sequence
  SiRNA target sequence
aagcatgtagtgatataaatg

SEQ ID NO: 22756 - DNA, 21 bp, Artificial sequence
  SiRNA target sequence
agcatgtagtgatataaatgc

SEQ ID NO: 22757 - DNA, 21 bp, Artificial sequence
  SiRNA target sequence
gcatgtagtgatataaatgct

SEQ ID NO: 22758 - DNA, 21 bp, Artificial sequence
  SiRNA target sequence
catgtagtgatataaatgctt

SEQ ID NO: 22759 - DNA, 21 bp, Artificial sequence
  SiRNA target sequence
atgtagtgatataaatgcttc

SEQ ID NO: 22760 - DNA, 21 bp, Artificial sequence
  SiRNA target sequence
tgtagtgatataaatgcttcg

SEQ ID NO: 22761 - DNA, 21 bp, Artificial sequence
  SiRNA target sequence
gtagtgatataaatgcttcgg

SEQ ID NO: 22762 - DNA, 21 bp, Artificial sequence
  SiRNA target sequence
tagtgatataaatgcttcgga

SEQ ID NO: 22763 - DNA, 21 bp, Artificial sequence
  SiRNA target sequence
agtgatataaatgcttcggaa

SEQ ID NO: 22764 - DNA, 21 bp, Artificial sequence
  SiRNA target sequence
gtgatataaatgcttcggaac

SEQ ID NO: 22765 - DNA, 21 bp, Artificial sequence
  SiRNA target sequence
tgatataaatgcttcggaaca

SEQ ID NO: 22766 - DNA, 21 bp, Artificial sequence
  SiRNA target sequence
gatataaatgcttcggaacaa

SEQ ID NO: 22767 - DNA, 21 bp, Artificial sequence
  SiRNA target sequence
atataaatgcttcggaacaac

SEQ ID NO: 22768 - DNA, 21 bp, Artificial sequence
  SiRNA target sequence
tataaatgcttcggaacaact

SEQ ID NO: 22769 - DNA, 21 bp, Artificial sequence
  SiRNA target sequence
ataaatgcttcggaacaactc

SEQ ID NO: 22770 - DNA, 21 bp, Artificial sequence
  SiRNA target sequence
taaatgcttcggaacaactca

SEQ ID NO: 22771 - DNA, 21 bp, Artificial sequence
  SiRNA target sequence
aaatgcttcggaacaactcac

SEQ ID NO: 22772 - DNA, 21 bp, Artificial sequence
  SiRNA target sequence
aatgcttcggaacaactcact

SEQ ID NO: 22773 - DNA, 21 bp, Artificial sequence
  SiRNA target sequence
atgcttcggaacaactcactg

SEQ ID NO: 22774 - DNA, 21 bp, Artificial sequence
  SiRNA target sequence
tgcttcggaacaactcactgc

SEQ ID NO: 22775 - DNA, 21 bp, Artificial sequence
  SiRNA target sequence
gcttcggaacaactcactgct

SEQ ID NO: 22776 - DNA, 21 bp, Artificial sequence
  SiRNA target sequence
cttcggaacaactcactgctg

SEQ ID NO: 22777 - DNA, 21 bp, Artificial sequence
  SiRNA target sequence
ttcggaacaactcactgctgt

SEQ ID NO: 22778 - DNA, 21 bp, Artificial sequence
  SiRNA target sequence
tcggaacaactcactgctgtt

SEQ ID NO: 22779 - DNA, 21 bp, Artificial sequence
  SiRNA target sequence
cggaacaactcactgctgtta

SEQ ID NO: 22780 - DNA, 21 bp, Artificial sequence
  SiRNA target sequence
ggaacaactcactgctgttac

SEQ ID NO: 22781 - DNA, 21 bp, Artificial sequence
  SiRNA target sequence
gaacaactcactgctgttacg

SEQ ID NO: 22782 - DNA, 21 bp, Artificial sequence
  SiRNA target sequence
aacaactcactgctgttacga

SEQ ID NO: 22783 - DNA, 21 bp, Artificial sequence
  SiRNA target sequence
acaactcactgctgttacgac

SEQ ID NO: 22784 - DNA, 21 bp, Artificial sequence
  SiRNA target sequence
caactcactgctgttacgaca

SEQ ID NO: 22785 - DNA, 21 bp, Artificial sequence
  SiRNA target sequence
aactcactgctgttacgacaa

SEQ ID NO: 22786 - DNA, 21 bp, Artificial sequence
  SiRNA target sequence
actcactgctgttacgacaaa

SEQ ID NO: 22787 - DNA, 21 bp, Artificial sequence
  SiRNA target sequence
ctcactgctgttacgacaaat

SEQ ID NO: 22788 - DNA, 21 bp, Artificial sequence
  SiRNA target sequence
tcactgctgttacgacaaata

SEQ ID NO: 22789 - DNA, 21 bp, Artificial sequence
  SiRNA target sequence
cactgctgttacgacaaataa

SEQ ID NO: 22790 - DNA, 21 bp, Artificial sequence
  SiRNA target sequence
actgctgttacgacaaataac

SEQ ID NO: 22791 - DNA, 21 bp, Artificial sequence
  SiRNA target sequence
ctgctgttacgacaaataaca

SEQ ID NO: 22792 - DNA, 21 bp, Artificial sequence
  SiRNA target sequence
tgctgttacgacaaataacac

SEQ ID NO: 22793 - DNA, 21 bp, Artificial sequence
  SiRNA target sequence
gctgttacgacaaataacacc

SEQ ID NO: 22794 - DNA, 21 bp, Artificial sequence
  SiRNA target sequence
ctgttacgacaaataacacct

SEQ ID NO: 22795 - DNA, 21 bp, Artificial sequence
  SiRNA target sequence
tgttacgacaaataacaccta

SEQ ID NO: 22796 - DNA, 21 bp, Artificial sequence
  SiRNA target sequence
gttacgacaaataacacctat

SEQ ID NO: 22797 - DNA, 21 bp, Artificial sequence
  SiRNA target sequence
ttacgacaaataacacctatg

SEQ ID NO: 22798 - DNA, 21 bp, Artificial sequence
  SiRNA target sequence
tacgacaaataacacctatgt

SEQ ID NO: 22799 - DNA, 21 bp, Artificial sequence
  SiRNA target sequence
acgacaaataacacctatgta

SEQ ID NO: 22800 - DNA, 21 bp, Artificial sequence
  SiRNA target sequence
cgacaaataacacctatgtaa

SEQ ID NO: 22801 - DNA, 21 bp, Artificial sequence
  SiRNA target sequence
gacaaataacacctatgtaat

SEQ ID NO: 22802 - DNA, 21 bp, Artificial sequence
  SiRNA target sequence
acaaataacacctatgtaatg

SEQ ID NO: 22803 - DNA, 21 bp, Artificial sequence
  SiRNA target sequence
caaataacacctatgtaatga

SEQ ID NO: 22804 - DNA, 21 bp, Artificial sequence
  SiRNA target sequence
aaataacacctatgtaatgac

SEQ ID NO: 22805 - DNA, 21 bp, Artificial sequence
  SiRNA target sequence
aataacacctatgtaatgacc

SEQ ID NO: 22806 - DNA, 21 bp, Artificial sequence
  SiRNA target sequence
ataacacctatgtaatgacca

SEQ ID NO: 22807 - DNA, 21 bp, Artificial sequence
  SiRNA target sequence
taacacctatgtaatgaccat

SEQ ID NO: 22808 - DNA, 21 bp, Artificial sequence
  SiRNA target sequence
aacacctatgtaatgaccatt

SEQ ID NO: 22809 - DNA, 21 bp, Artificial sequence
  SiRNA target sequence
acacctatgtaatgaccattt

SEQ ID NO: 22810 - DNA, 21 bp, Artificial sequence
  SiRNA target sequence
cacctatgtaatgaccatttt

SEQ ID NO: 22811 - DNA, 21 bp, Artificial sequence
  SiRNA target sequence
acctatgtaatgaccatttta

SEQ ID NO: 22812 - DNA, 21 bp, Artificial sequence
  SiRNA target sequence
cctatgtaatgaccattttat

SEQ ID NO: 22813 - DNA, 21 bp, Artificial sequence
  SiRNA target sequence
ctatgtaatgaccattttatc

SEQ ID NO: 22814 - DNA, 21 bp, Artificial sequence
  SiRNA target sequence
tatgtaatgaccattttatct

SEQ ID NO: 22815 - DNA, 21 bp, Artificial sequence
  SiRNA target sequence
atgtaatgaccattttatcta

SEQ ID NO: 22816 - DNA, 21 bp, Artificial sequence
  SiRNA target sequence
tgtaatgaccattttatctaa

SEQ ID NO: 22817 - DNA, 21 bp, Artificial sequence
  SiRNA target sequence
gtaatgaccattttatctaaa

SEQ ID NO: 22818 - DNA, 21 bp, Artificial sequence
  SiRNA target sequence
taatgaccattttatctaaag

SEQ ID NO: 22819 - DNA, 21 bp, Artificial sequence
  SiRNA target sequence
aatgaccattttatctaaaga

SEQ ID NO: 22820 - DNA, 21 bp, Artificial sequence
  SiRNA target sequence
atgaccattttatctaaagaa

SEQ ID NO: 22821 - DNA, 21 bp, Artificial sequence
  SiRNA target sequence
tgaccattttatctaaagaat

SEQ ID NO: 22822 - DNA, 21 bp, Artificial sequence
  SiRNA target sequence
gaccattttatctaaagaatc

SEQ ID NO: 22823 - DNA, 21 bp, Artificial sequence
  SiRNA target sequence
accattttatctaaagaatct

SEQ ID NO: 22824 - DNA, 21 bp, Artificial sequence
  SiRNA target sequence
ccattttatctaaagaatctg

SEQ ID NO: 22825 - DNA, 21 bp, Artificial sequence
  SiRNA target sequence
cattttatctaaagaatctgt

SEQ ID NO: 22826 - DNA, 21 bp, Artificial sequence
  SiRNA target sequence
attttatctaaagaatctgtt

SEQ ID NO: 22827 - DNA, 21 bp, Artificial sequence
  SiRNA target sequence
ttttatctaaagaatctgtta

SEQ ID NO: 22828 - DNA, 21 bp, Artificial sequence
  SiRNA target sequence
tttatctaaagaatctgttat

SEQ ID NO: 22829 - DNA, 21 bp, Artificial sequence
  SiRNA target sequence
ttatctaaagaatctgttatt

SEQ ID NO: 22830 - DNA, 21 bp, Artificial sequence
  SiRNA target sequence
tatctaaagaatctgttatta

SEQ ID NO: 22831 - DNA, 21 bp, Artificial sequence
  SiRNA target sequence
atctaaagaatctgttattag

SEQ ID NO: 22832 - DNA, 21 bp, Artificial sequence
  SiRNA target sequence
tctaaagaatctgttattaga

SEQ ID NO: 22833 - DNA, 21 bp, Artificial sequence
  SiRNA target sequence
ctaaagaatctgttattagag

SEQ ID NO: 22834 - DNA, 21 bp, Artificial sequence
  SiRNA target sequence
taaagaatctgttattagagt

SEQ ID NO: 22835 - DNA, 21 bp, Artificial sequence
  SiRNA target sequence
aaagaatctgttattagagtg

SEQ ID NO: 22836 - DNA, 21 bp, Artificial sequence
  SiRNA target sequence
aagaatctgttattagagtgg

SEQ ID NO: 22837 - DNA, 21 bp, Artificial sequence
  SiRNA target sequence
agaatctgttattagagtggg

SEQ ID NO: 22838 - DNA, 21 bp, Artificial sequence
  SiRNA target sequence
gaatctgttattagagtgggg

SEQ ID NO: 22839 - DNA, 21 bp, Artificial sequence
  SiRNA target sequence
aatctgttattagagtggggc

SEQ ID NO: 22840 - DNA, 21 bp, Artificial sequence
  SiRNA target sequence
atctgttattagagtggggca

SEQ ID NO: 22841 - DNA, 21 bp, Artificial sequence
  SiRNA target sequence
tctgttattagagtggggcac

SEQ ID NO: 22842 - DNA, 21 bp, Artificial sequence
  SiRNA target sequence
ctgttattagagtggggcact

SEQ ID NO: 22843 - DNA, 21 bp, Artificial sequence
  SiRNA target sequence
tgttattagagtggggcactg

SEQ ID NO: 22844 - DNA, 21 bp, Artificial sequence
  SiRNA target sequence
gttattagagtggggcactgt

SEQ ID NO: 22845 - DNA, 21 bp, Artificial sequence
  SiRNA target sequence
ttattagagtggggcactgta

SEQ ID NO: 22846 - DNA, 21 bp, Artificial sequence
  SiRNA target sequence
tattagagtggggcactgtat

SEQ ID NO: 22847 - DNA, 21 bp, Artificial sequence
  SiRNA target sequence
attagagtggggcactgtatt

SEQ ID NO: 22848 - DNA, 21 bp, Artificial sequence
  SiRNA target sequence
ttagagtggggcactgtattt

SEQ ID NO: 22849 - DNA, 21 bp, Artificial sequence
  SiRNA target sequence
tagagtggggcactgtatttt

SEQ ID NO: 22850 - DNA, 21 bp, Artificial sequence
  SiRNA target sequence
agagtggggcactgtattttt

SEQ ID NO: 22851 - DNA, 21 bp, Artificial sequence
  SiRNA target sequence
gagtggggcactgtatttttc

SEQ ID NO: 22852 - DNA, 21 bp, Artificial sequence
  SiRNA target sequence
agtggggcactgtatttttct

SEQ ID NO: 22853 - DNA, 21 bp, Artificial sequence
  SiRNA target sequence
gtggggcactgtatttttctg

SEQ ID NO: 22854 - DNA, 21 bp, Artificial sequence
  SiRNA target sequence
tggggcactgtatttttctga

SEQ ID NO: 22855 - DNA, 21 bp, Artificial sequence
  SiRNA target sequence
ggggcactgtatttttctgaa

SEQ ID NO: 22856 - DNA, 21 bp, Artificial sequence
  SiRNA target sequence
gggcactgtatttttctgaaa

SEQ ID NO: 22857 - DNA, 21 bp, Artificial sequence
  SiRNA target sequence
ggcactgtatttttctgaaag

SEQ ID NO: 22858 - DNA, 21 bp, Artificial sequence
  SiRNA target sequence
gcactgtatttttctgaaagg

SEQ ID NO: 22859 - DNA, 21 bp, Artificial sequence
  SiRNA target sequence
cactgtatttttctgaaagga

SEQ ID NO: 22860 - DNA, 21 bp, Artificial sequence
  SiRNA target sequence
actgtatttttctgaaaggaa

SEQ ID NO: 22861 - DNA, 21 bp, Artificial sequence
  SiRNA target sequence
ctgtatttttctgaaaggaaa

SEQ ID NO: 22862 - DNA, 21 bp, Artificial sequence
  SiRNA target sequence
tgtatttttctgaaaggaaaa

SEQ ID NO: 22863 - DNA, 21 bp, Artificial sequence
  SiRNA target sequence
gtatttttctgaaaggaaaaa

SEQ ID NO: 22864 - DNA, 21 bp, Artificial sequence
  SiRNA target sequence
tatttttctgaaaggaaaaat

SEQ ID NO: 22865 - DNA, 21 bp, Artificial sequence
  SiRNA target sequence
atttttctgaaaggaaaaatt

SEQ ID NO: 22866 - DNA, 21 bp, Artificial sequence
  SiRNA target sequence
tttttctgaaaggaaaaattg

SEQ ID NO: 22867 - DNA, 21 bp, Artificial sequence
  SiRNA target sequence
ttttctgaaaggaaaaattgc

SEQ ID NO: 22868 - DNA, 21 bp, Artificial sequence
  SiRNA target sequence
tttctgaaaggaaaaattgca

SEQ ID NO: 22869 - DNA, 21 bp, Artificial sequence
  SiRNA target sequence
ttctgaaaggaaaaattgcag

SEQ ID NO: 22870 - DNA, 21 bp, Artificial sequence
  SiRNA target sequence
tctgaaaggaaaaattgcagt

SEQ ID NO: 22871 - DNA, 21 bp, Artificial sequence
  SiRNA target sequence
ctgaaaggaaaaattgcagta

SEQ ID NO: 22872 - DNA, 21 bp, Artificial sequence
  SiRNA target sequence
tgaaaggaaaaattgcagtag

SEQ ID NO: 22873 - DNA, 21 bp, Artificial sequence
  SiRNA target sequence
gaaaggaaaaattgcagtagc

SEQ ID NO: 22874 - DNA, 21 bp, Artificial sequence
  SiRNA target sequence
aaaggaaaaattgcagtagct

SEQ ID NO: 22875 - DNA, 21 bp, Artificial sequence
  SiRNA target sequence
aaggaaaaattgcagtagctc

SEQ ID NO: 22876 - DNA, 21 bp, Artificial sequence
  SiRNA target sequence
aggaaaaattgcagtagctcc

SEQ ID NO: 22877 - DNA, 21 bp, Artificial sequence
  SiRNA target sequence
ggaaaaattgcagtagctcct

SEQ ID NO: 22878 - DNA, 21 bp, Artificial sequence
  SiRNA target sequence
gaaaaattgcagtagctcctg

SEQ ID NO: 22879 - DNA, 21 bp, Artificial sequence
  SiRNA target sequence
aaaaattgcagtagctcctgg

SEQ ID NO: 22880 - DNA, 21 bp, Artificial sequence
  SiRNA target sequence
aaaattgcagtagctcctggt

SEQ ID NO: 22881 - DNA, 21 bp, Artificial sequence
  SiRNA target sequence
aaattgcagtagctcctggtc

SEQ ID NO: 22882 - DNA, 21 bp, Artificial sequence
  SiRNA target sequence
aattgcagtagctcctggtca

SEQ ID NO: 22883 - DNA, 21 bp, Artificial sequence
  SiRNA target sequence
attgcagtagctcctggtcat

SEQ ID NO: 22884 - DNA, 21 bp, Artificial sequence
  SiRNA target sequence
ttgcagtagctcctggtcatt

SEQ ID NO: 22885 - DNA, 21 bp, Artificial sequence
  SiRNA target sequence
tgcagtagctcctggtcatta

SEQ ID NO: 22886 - DNA, 21 bp, Artificial sequence
  SiRNA target sequence
gcagtagctcctggtcattat

SEQ ID NO: 22887 - DNA, 21 bp, Artificial sequence
  SiRNA target sequence
cagtagctcctggtcattatt

SEQ ID NO: 22888 - DNA, 21 bp, Artificial sequence
  SiRNA target sequence
agtagctcctggtcattattt

SEQ ID NO: 22889 - DNA, 21 bp, Artificial sequence
  SiRNA target sequence
gtagctcctggtcattattta

SEQ ID NO: 22890 - DNA, 21 bp, Artificial sequence
  SiRNA target sequence
tagctcctggtcattatttac

SEQ ID NO: 22891 - DNA, 21 bp, Artificial sequence
  SiRNA target sequence
agctcctggtcattatttacg

SEQ ID NO: 22892 - DNA, 21 bp, Artificial sequence
  SiRNA target sequence
gctcctggtcattatttacgt

SEQ ID NO: 22893 - DNA, 21 bp, Artificial sequence
  SiRNA target sequence
ctcctggtcattatttacgta

SEQ ID NO: 22894 - DNA, 21 bp, Artificial sequence
  SiRNA target sequence
tcctggtcattatttacgtat

SEQ ID NO: 22895 - DNA, 21 bp, Artificial sequence
  SiRNA target sequence
cctggtcattatttacgtata

SEQ ID NO: 22896 - DNA, 21 bp, Artificial sequence
  SiRNA target sequence
ctggtcattatttacgtatac

SEQ ID NO: 22897 - DNA, 21 bp, Artificial sequence
  SiRNA target sequence
tggtcattatttacgtatact

SEQ ID NO: 22898 - DNA, 21 bp, Artificial sequence
  SiRNA target sequence
ggtcattatttacgtatactt

SEQ ID NO: 22899 - DNA, 21 bp, Artificial sequence
  SiRNA target sequence
gtcattatttacgtatacttc

SEQ ID NO: 22900 - DNA, 21 bp, Artificial sequence
  SiRNA target sequence
tcattatttacgtatacttca

SEQ ID NO: 22901 - DNA, 21 bp, Artificial sequence
  SiRNA target sequence
cattatttacgtatacttcag

SEQ ID NO: 22902 - DNA, 21 bp, Artificial sequence
  SiRNA target sequence
attatttacgtatacttcagc

SEQ ID NO: 22903 - DNA, 21 bp, Artificial sequence
  SiRNA target sequence
ttatttacgtatacttcagcg

SEQ ID NO: 22904 - DNA, 21 bp, Artificial sequence
  SiRNA target sequence
tatttacgtatacttcagcgc

SEQ ID NO: 22905 - DNA, 21 bp, Artificial sequence
  SiRNA target sequence
atttacgtatacttcagcgcg

SEQ ID NO: 22906 - DNA, 21 bp, Artificial sequence
  SiRNA target sequence
tttacgtatacttcagcgcgc

SEQ ID NO: 22907 - DNA, 21 bp, Artificial sequence
  SiRNA target sequence
ttacgtatacttcagcgcgca

SEQ ID NO: 22908 - DNA, 21 bp, Artificial sequence
  SiRNA target sequence
tacgtatacttcagcgcgcat

SEQ ID NO: 22909 - DNA, 21 bp, Artificial sequence
  SiRNA target sequence
acgtatacttcagcgcgcata

SEQ ID NO: 22910 - DNA, 21 bp, Artificial sequence
  SiRNA target sequence
cgtatacttcagcgcgcatat

SEQ ID NO: 22911 - DNA, 21 bp, Artificial sequence
  SiRNA target sequence
gtatacttcagcgcgcatatg

SEQ ID NO: 22912 - DNA, 21 bp, Artificial sequence
  SiRNA target sequence
tatacttcagcgcgcatatga

SEQ ID NO: 22913 - DNA, 21 bp, Artificial sequence
  SiRNA target sequence
atacttcagcgcgcatatgag

SEQ ID NO: 22914 - DNA, 21 bp, Artificial sequence
  SiRNA target sequence
tacttcagcgcgcatatgagt

SEQ ID NO: 22915 - DNA, 21 bp, Artificial sequence
  SiRNA target sequence
acttcagcgcgcatatgagtt

SEQ ID NO: 22916 - DNA, 21 bp, Artificial sequence
  SiRNA target sequence
cttcagcgcgcatatgagtta

SEQ ID NO: 22917 - DNA, 21 bp, Artificial sequence
  SiRNA target sequence
ttcagcgcgcatatgagttag

SEQ ID NO: 22918 - DNA, 21 bp, Artificial sequence
  SiRNA target sequence
tcagcgcgcatatgagttaga

SEQ ID NO: 22919 - DNA, 21 bp, Artificial sequence
  SiRNA target sequence
cagcgcgcatatgagttagat

SEQ ID NO: 22920 - DNA, 21 bp, Artificial sequence
  SiRNA target sequence
agcgcgcatatgagttagatg

SEQ ID NO: 22921 - DNA, 21 bp, Artificial sequence
  SiRNA target sequence
gcgcgcatatgagttagatga

SEQ ID NO: 22922 - DNA, 21 bp, Artificial sequence
  SiRNA target sequence
cgcgcatatgagttagatgac

SEQ ID NO: 22923 - DNA, 21 bp, Artificial sequence
  SiRNA target sequence
gcgcatatgagttagatgacg

SEQ ID NO: 22924 - DNA, 21 bp, Artificial sequence
  SiRNA target sequence
cgcatatgagttagatgacgg

SEQ ID NO: 22925 - DNA, 21 bp, Artificial sequence
  SiRNA target sequence
gcatatgagttagatgacggt

SEQ ID NO: 22926 - DNA, 21 bp, Artificial sequence
  SiRNA target sequence
catatgagttagatgacggtg

SEQ ID NO: 22927 - DNA, 21 bp, Artificial sequence
  SiRNA target sequence
atatgagttagatgacggtgc

SEQ ID NO: 22928 - DNA, 21 bp, Artificial sequence
  SiRNA target sequence
tatgagttagatgacggtgct

SEQ ID NO: 22929 - DNA, 21 bp, Artificial sequence
  SiRNA target sequence
atgagttagatgacggtgcta

SEQ ID NO: 22930 - DNA, 21 bp, Artificial sequence
  SiRNA target sequence
tgagttagatgacggtgctat

SEQ ID NO: 22931 - DNA, 21 bp, Artificial sequence
  SiRNA target sequence
gagttagatgacggtgctatt

SEQ ID NO: 22932 - DNA, 21 bp, Artificial sequence
  SiRNA target sequence
agttagatgacggtgctattt

SEQ ID NO: 22933 - DNA, 21 bp, Artificial sequence
  SiRNA target sequence
gttagatgacggtgctatttt

SEQ ID NO: 22934 - DNA, 21 bp, Artificial sequence
  SiRNA target sequence
ttagatgacggtgctatttta

SEQ ID NO: 22935 - DNA, 21 bp, Artificial sequence
  SiRNA target sequence
tagatgacggtgctattttac

SEQ ID NO: 22936 - DNA, 21 bp, Artificial sequence
  SiRNA target sequence
agatgacggtgctattttaca

SEQ ID NO: 22937 - DNA, 21 bp, Artificial sequence
  SiRNA target sequence
gatgacggtgctattttacag

SEQ ID NO: 22938 - DNA, 21 bp, Artificial sequence
  SiRNA target sequence
atgacggtgctattttacagt

SEQ ID NO: 22939 - DNA, 21 bp, Artificial sequence
  SiRNA target sequence
tgacggtgctattttacagtt

SEQ ID NO: 22940 - DNA, 21 bp, Artificial sequence
  SiRNA target sequence
gacggtgctattttacagttt

SEQ ID NO: 22941 - DNA, 21 bp, Artificial sequence
  SiRNA target sequence
acggtgctattttacagttta

SEQ ID NO: 22942 - DNA, 21 bp, Artificial sequence
  SiRNA target sequence
cggtgctattttacagtttaa

SEQ ID NO: 22943 - DNA, 21 bp, Artificial sequence
  SiRNA target sequence
ggtgctattttacagtttaat

SEQ ID NO: 22944 - DNA, 21 bp, Artificial sequence
  SiRNA target sequence
gtgctattttacagtttaatc

SEQ ID NO: 22945 - DNA, 21 bp, Artificial sequence
  SiRNA target sequence
tgctattttacagtttaatca

SEQ ID NO: 22946 - DNA, 21 bp, Artificial sequence
  SiRNA target sequence
gctattttacagtttaatcat

SEQ ID NO: 22947 - DNA, 21 bp, Artificial sequence
  SiRNA target sequence
ctattttacagtttaatcatc

SEQ ID NO: 22948 - DNA, 21 bp, Artificial sequence
  SiRNA target sequence
tattttacagtttaatcatcc

SEQ ID NO: 22949 - DNA, 21 bp, Artificial sequence
  SiRNA target sequence
attttacagtttaatcatcct

SEQ ID NO: 22950 - DNA, 21 bp, Artificial sequence
  SiRNA target sequence
ttttacagtttaatcatcctt

SEQ ID NO: 22951 - DNA, 21 bp, Artificial sequence
  SiRNA target sequence
tttacagtttaatcatcctta

SEQ ID NO: 22952 - DNA, 21 bp, Artificial sequence
  SiRNA target sequence
ttacagtttaatcatccttac

SEQ ID NO: 22953 - DNA, 21 bp, Artificial sequence
  SiRNA target sequence
tacagtttaatcatccttacg

SEQ ID NO: 22954 - DNA, 21 bp, Artificial sequence
  SiRNA target sequence
acagtttaatcatccttacgg

SEQ ID NO: 22955 - DNA, 21 bp, Artificial sequence
  SiRNA target sequence
cagtttaatcatccttacggg

SEQ ID NO: 22956 - DNA, 21 bp, Artificial sequence
  SiRNA target sequence
agtttaatcatccttacggga

SEQ ID NO: 22957 - DNA, 21 bp, Artificial sequence
  SiRNA target sequence
gtttaatcatccttacgggaa

SEQ ID NO: 22958 - DNA, 21 bp, Artificial sequence
  SiRNA target sequence
tttaatcatccttacgggaag

SEQ ID NO: 22959 - DNA, 21 bp, Artificial sequence
  SiRNA target sequence
ttaatcatccttacgggaaga

SEQ ID NO: 22960 - DNA, 21 bp, Artificial sequence
  SiRNA target sequence
taatcatccttacgggaagag

SEQ ID NO: 22961 - DNA, 21 bp, Artificial sequence
  SiRNA target sequence
aatcatccttacgggaagagg

SEQ ID NO: 22962 - DNA, 21 bp, Artificial sequence
  SiRNA target sequence
atcatccttacgggaagagga

SEQ ID NO: 22963 - DNA, 21 bp, Artificial sequence
  SiRNA target sequence
tcatccttacgggaagaggaa

SEQ ID NO: 22964 - DNA, 21 bp, Artificial sequence
  SiRNA target sequence
catccttacgggaagaggaac

SEQ ID NO: 22965 - DNA, 21 bp, Artificial sequence
  SiRNA target sequence
atccttacgggaagaggaact

SEQ ID NO: 22966 - DNA, 21 bp, Artificial sequence
  SiRNA target sequence
tccttacgggaagaggaactt

SEQ ID NO: 22967 - DNA, 21 bp, Artificial sequence
  SiRNA target sequence
ccttacgggaagaggaacttc

SEQ ID NO: 22968 - DNA, 21 bp, Artificial sequence
  SiRNA target sequence
cttacgggaagaggaacttct

SEQ ID NO: 22969 - DNA, 21 bp, Artificial sequence
  SiRNA target sequence
ttacgggaagaggaacttctt

SEQ ID NO: 22970 - DNA, 21 bp, Artificial sequence
  SiRNA target sequence
tacgggaagaggaacttcttt

SEQ ID NO: 22971 - DNA, 21 bp, Artificial sequence
  SiRNA target sequence
acgggaagaggaacttcttta

SEQ ID NO: 22972 - DNA, 21 bp, Artificial sequence
  SiRNA target sequence
cgggaagaggaacttctttac

SEQ ID NO: 22973 - DNA, 21 bp, Artificial sequence
  SiRNA target sequence
gggaagaggaacttctttacg

SEQ ID NO: 22974 - DNA, 21 bp, Artificial sequence
  SiRNA target sequence
ggaagaggaacttctttacgt

SEQ ID NO: 22975 - DNA, 21 bp, Artificial sequence
  SiRNA target sequence
gaagaggaacttctttacgtt

SEQ ID NO: 22976 - DNA, 21 bp, Artificial sequence
  SiRNA target sequence
aagaggaacttctttacgttt

SEQ ID NO: 22977 - DNA, 21 bp, Artificial sequence
  SiRNA target sequence
agaggaacttctttacgtttg

SEQ ID NO: 22978 - DNA, 21 bp, Artificial sequence
  SiRNA target sequence
gaggaacttctttacgtttgt

SEQ ID NO: 22979 - DNA, 21 bp, Artificial sequence
  SiRNA target sequence
aggaacttctttacgtttgtt

SEQ ID NO: 22980 - DNA, 21 bp, Artificial sequence
  SiRNA target sequence
ggaacttctttacgtttgttg

SEQ ID NO: 22981 - DNA, 21 bp, Artificial sequence
  SiRNA target sequence
gaacttctttacgtttgttgg

SEQ ID NO: 22982 - DNA, 21 bp, Artificial sequence
  SiRNA target sequence
aacttctttacgtttgttggt

SEQ ID NO: 22983 - DNA, 21 bp, Artificial sequence
  SiRNA target sequence
acttctttacgtttgttggtg

SEQ ID NO: 22984 - DNA, 21 bp, Artificial sequence
  SiRNA target sequence
cttctttacgtttgttggtga

SEQ ID NO: 22985 - DNA, 21 bp, Artificial sequence
  SiRNA target sequence
ttctttacgtttgttggtgac

SEQ ID NO: 22986 - DNA, 21 bp, Artificial sequence
  SiRNA target sequence
tctttacgtttgttggtgaca

SEQ ID NO: 22987 - DNA, 21 bp, Artificial sequence
  SiRNA target sequence
ctttacgtttgttggtgacat

SEQ ID NO: 22988 - DNA, 21 bp, Artificial sequence
  SiRNA target sequence
tttacgtttgttggtgacatc

SEQ ID NO: 22989 - DNA, 21 bp, Artificial sequence
  SiRNA target sequence
ttacgtttgttggtgacatcc

SEQ ID NO: 22990 - DNA, 21 bp, Artificial sequence
  SiRNA target sequence
tacgtttgttggtgacatcca

SEQ ID NO: 22991 - DNA, 21 bp, Artificial sequence
  SiRNA target sequence
acgtttgttggtgacatccaa

SEQ ID NO: 22992 - DNA, 21 bp, Artificial sequence
  SiRNA target sequence
cgtttgttggtgacatccaat

SEQ ID NO: 22993 - DNA, 21 bp, Artificial sequence
  SiRNA target sequence
gtttgttggtgacatccaatt

SEQ ID NO: 22994 - DNA, 21 bp, Artificial sequence
  SiRNA target sequence
tttgttggtgacatccaattc

SEQ ID NO: 22995 - DNA, 21 bp, Artificial sequence
  SiRNA target sequence
ttgttggtgacatccaattct

SEQ ID NO: 22996 - DNA, 21 bp, Artificial sequence
  SiRNA target sequence
tgttggtgacatccaattctc

SEQ ID NO: 22997 - DNA, 21 bp, Artificial sequence
  SiRNA target sequence
gttggtgacatccaattctcg

SEQ ID NO: 22998 - DNA, 21 bp, Artificial sequence
  SiRNA target sequence
ttggtgacatccaattctcgt

SEQ ID NO: 22999 - DNA, 21 bp, Artificial sequence
  SiRNA target sequence
tggtgacatccaattctcgtt

SEQ ID NO: 23000 - DNA, 21 bp, Artificial sequence
  SiRNA target sequence
ggtgacatccaattctcgttg

SEQ ID NO: 23001 - DNA, 21 bp, Artificial sequence
  SiRNA target sequence
gtgacatccaattctcgttgt

SEQ ID NO: 23002 - DNA, 21 bp, Artificial sequence
  SiRNA target sequence
tgacatccaattctcgttgta

SEQ ID NO: 23003 - DNA, 21 bp, Artificial sequence
  SiRNA target sequence
gacatccaattctcgttgtat

SEQ ID NO: 23004 - DNA, 21 bp, Artificial sequence
  SiRNA target sequence
acatccaattctcgttgtata

SEQ ID NO: 23005 - DNA, 21 bp, Artificial sequence
  SiRNA target sequence
catccaattctcgttgtataa

SEQ ID NO: 23006 - DNA, 21 bp, Artificial sequence
  SiRNA target sequence
atccaattctcgttgtataaa

SEQ ID NO: 23007 - DNA, 21 bp, Artificial sequence
  SiRNA target sequence
tccaattctcgttgtataaaa

SEQ ID NO: 23008 - DNA, 21 bp, Artificial sequence
  SiRNA target sequence
ccaattctcgttgtataaaac

SEQ ID NO: 23009 - DNA, 21 bp, Artificial sequence
  SiRNA target sequence
caattctcgttgtataaaacg

SEQ ID NO: 23010 - DNA, 21 bp, Artificial sequence
  SiRNA target sequence
aattctcgttgtataaaacga

SEQ ID NO: 23011 - DNA, 21 bp, Artificial sequence
  SiRNA target sequence
attctcgttgtataaaacgaa

SEQ ID NO: 23012 - DNA, 21 bp, Artificial sequence
  SiRNA target sequence
ttctcgttgtataaaacgaaa

SEQ ID NO: 23013 - DNA, 21 bp, Artificial sequence
  SiRNA target sequence
tctcgttgtataaaacgaaaa

SEQ ID NO: 23014 - DNA, 21 bp, Artificial sequence
  SiRNA target sequence
ctcgttgtataaaacgaaaaa

SEQ ID NO: 23015 - DNA, 21 bp, Artificial sequence
  SiRNA target sequence
tcgttgtataaaacgaaaaat

SEQ ID NO: 23016 - DNA, 21 bp, Artificial sequence
  SiRNA target sequence
cgttgtataaaacgaaaaata

SEQ ID NO: 23017 - DNA, 21 bp, Artificial sequence
  SiRNA target sequence
gttgtataaaacgaaaaatat

SEQ ID NO: 23018 - DNA, 21 bp, Artificial sequence
  SiRNA target sequence
ttgtataaaacgaaaaatata

SEQ ID NO: 23019 - DNA, 21 bp, Artificial sequence
  SiRNA target sequence
tgtataaaacgaaaaatatat

SEQ ID NO: 23020 - DNA, 21 bp, Artificial sequence
  SiRNA target sequence
gtataaaacgaaaaatatatc

SEQ ID NO: 23021 - DNA, 21 bp, Artificial sequence
  SiRNA target sequence
tataaaacgaaaaatatatct

SEQ ID NO: 23022 - DNA, 21 bp, Artificial sequence
  SiRNA target sequence
ataaaacgaaaaatatatcta

SEQ ID NO: 23023 - DNA, 21 bp, Artificial sequence
  SiRNA target sequence
taaaacgaaaaatatatctaa

SEQ ID NO: 23024 - DNA, 21 bp, Artificial sequence
  SiRNA target sequence
aaaacgaaaaatatatctaaa

SEQ ID NO: 23025 - DNA, 21 bp, Artificial sequence
  SiRNA target sequence
aaacgaaaaatatatctaaaa

SEQ ID NO: 23026 - DNA, 21 bp, Artificial sequence
  SiRNA target sequence
aacgaaaaatatatctaaaac

SEQ ID NO: 23027 - DNA, 21 bp, Artificial sequence
  SiRNA target sequence
acgaaaaatatatctaaaaca

SEQ ID NO: 23028 - DNA, 21 bp, Artificial sequence
  SiRNA target sequence
cgaaaaatatatctaaaacaa

SEQ ID NO: 23029 - DNA, 21 bp, Artificial sequence
  SiRNA target sequence
gaaaaatatatctaaaacaaa

SEQ ID NO: 23030 - DNA, 21 bp, Artificial sequence
  SiRNA target sequence
aaaaatatatctaaaacaaat

SEQ ID NO: 23031 - DNA, 21 bp, Artificial sequence
  SiRNA target sequence
aaaatatatctaaaacaaatg

SEQ ID NO: 23032 - DNA, 21 bp, Artificial sequence
  SiRNA target sequence
aaatatatctaaaacaaatga

SEQ ID NO: 23033 - DNA, 21 bp, Artificial sequence
  SiRNA target sequence
aatatatctaaaacaaatgat

SEQ ID NO: 23034 - DNA, 21 bp, Artificial sequence
  SiRNA target sequence
atatatctaaaacaaatgatc

SEQ ID NO: 23035 - DNA, 21 bp, Artificial sequence
  SiRNA target sequence
tatatctaaaacaaatgatct

SEQ ID NO: 23036 - DNA, 21 bp, Artificial sequence
  SiRNA target sequence
atatctaaaacaaatgatctg

SEQ ID NO: 23037 - DNA, 21 bp, Artificial sequence
  SiRNA target sequence
tatctaaaacaaatgatctgg

SEQ ID NO: 23038 - DNA, 21 bp, Artificial sequence
  SiRNA target sequence
atctaaaacaaatgatctgga

SEQ ID NO: 23039 - DNA, 21 bp, Artificial sequence
  SiRNA target sequence
tctaaaacaaatgatctggat

SEQ ID NO: 23040 - DNA, 21 bp, Artificial sequence
  SiRNA target sequence
ctaaaacaaatgatctggatt

SEQ ID NO: 23041 - DNA, 21 bp, Artificial sequence
  SiRNA target sequence
taaaacaaatgatctggattc

SEQ ID NO: 23042 - DNA, 21 bp, Artificial sequence
  SiRNA target sequence
aaaacaaatgatctggattct

SEQ ID NO: 23043 - DNA, 21 bp, Artificial sequence
  SiRNA target sequence
aaacaaatgatctggattctc

SEQ ID NO: 23044 - DNA, 21 bp, Artificial sequence
  SiRNA target sequence
aacaaatgatctggattctcg

SEQ ID NO: 23045 - DNA, 21 bp, Artificial sequence
  SiRNA target sequence
acaaatgatctggattctcgt

SEQ ID NO: 23046 - DNA, 21 bp, Artificial sequence
  SiRNA target sequence
caaatgatctggattctcgtg

SEQ ID NO: 23047 - DNA, 21 bp, Artificial sequence
  SiRNA target sequence
aaatgatctggattctcgtga

SEQ ID NO: 23048 - DNA, 21 bp, Artificial sequence
  SiRNA target sequence
aatgatctggattctcgtgac

SEQ ID NO: 23049 - DNA, 21 bp, Artificial sequence
  SiRNA target sequence
atgatctggattctcgtgact

SEQ ID NO: 23050 - DNA, 21 bp, Artificial sequence
  SiRNA target sequence
tgatctggattctcgtgactt

SEQ ID NO: 23051 - DNA, 21 bp, Artificial sequence
  SiRNA target sequence
gatctggattctcgtgacttg

SEQ ID NO: 23052 - DNA, 21 bp, Artificial sequence
  SiRNA target sequence
atctggattctcgtgacttga

SEQ ID NO: 23053 - DNA, 21 bp, Artificial sequence
  SiRNA target sequence
tctggattctcgtgacttgat

SEQ ID NO: 23054 - DNA, 21 bp, Artificial sequence
  SiRNA target sequence
ctggattctcgtgacttgatg

SEQ ID NO: 23055 - DNA, 21 bp, Artificial sequence
  SiRNA target sequence
tggattctcgtgacttgatgc

SEQ ID NO: 23056 - DNA, 21 bp, Artificial sequence
  SiRNA target sequence
ggattctcgtgacttgatgca

SEQ ID NO: 23057 - DNA, 21 bp, Artificial sequence
  SiRNA target sequence
gattctcgtgacttgatgcac

SEQ ID NO: 23058 - DNA, 21 bp, Artificial sequence
  SiRNA target sequence
attctcgtgacttgatgcact

SEQ ID NO: 23059 - DNA, 21 bp, Artificial sequence
  SiRNA target sequence
ttctcgtgacttgatgcactt

SEQ ID NO: 23060 - DNA, 21 bp, Artificial sequence
  SiRNA target sequence
tctcgtgacttgatgcacttt

SEQ ID NO: 23061 - DNA, 21 bp, Artificial sequence
  SiRNA target sequence
ctcgtgacttgatgcactttg

SEQ ID NO: 23062 - DNA, 21 bp, Artificial sequence
  SiRNA target sequence
tcgtgacttgatgcactttgt

SEQ ID NO: 23063 - DNA, 21 bp, Artificial sequence
  SiRNA target sequence
cgtgacttgatgcactttgtt

SEQ ID NO: 23064 - DNA, 21 bp, Artificial sequence
  SiRNA target sequence
gtgacttgatgcactttgttg

SEQ ID NO: 23065 - DNA, 21 bp, Artificial sequence
  SiRNA target sequence
tgacttgatgcactttgttgt

SEQ ID NO: 23066 - DNA, 21 bp, Artificial sequence
  SiRNA target sequence
gacttgatgcactttgttgtt

SEQ ID NO: 23067 - DNA, 21 bp, Artificial sequence
  SiRNA target sequence
acttgatgcactttgttgttg

SEQ ID NO: 23068 - DNA, 21 bp, Artificial sequence
  SiRNA target sequence
cttgatgcactttgttgttga

SEQ ID NO: 23069 - DNA, 21 bp, Artificial sequence
  SiRNA target sequence
ttgatgcactttgttgttgat

SEQ ID NO: 23070 - DNA, 21 bp, Artificial sequence
  SiRNA target sequence
tgatgcactttgttgttgata

SEQ ID NO: 23071 - DNA, 21 bp, Artificial sequence
  SiRNA target sequence
gatgcactttgttgttgataa

SEQ ID NO: 23072 - DNA, 21 bp, Artificial sequence
  SiRNA target sequence
atgcactttgttgttgataag

SEQ ID NO: 23073 - DNA, 21 bp, Artificial sequence
  SiRNA target sequence
tgcactttgttgttgataagt

SEQ ID NO: 23074 - DNA, 21 bp, Artificial sequence
  SiRNA target sequence
gcactttgttgttgataagtc

SEQ ID NO: 23075 - DNA, 21 bp, Artificial sequence
  SiRNA target sequence
cactttgttgttgataagtca

SEQ ID NO: 23076 - DNA, 21 bp, Artificial sequence
  SiRNA target sequence
actttgttgttgataagtcag

SEQ ID NO: 23077 - DNA, 21 bp, Artificial sequence
  SiRNA target sequence
ctttgttgttgataagtcagt

SEQ ID NO: 23078 - DNA, 21 bp, Artificial sequence
  SiRNA target sequence
tttgttgttgataagtcagta

SEQ ID NO: 23079 - DNA, 21 bp, Artificial sequence
  SiRNA target sequence
ttgttgttgataagtcagtag

SEQ ID NO: 23080 - DNA, 21 bp, Artificial sequence
  SiRNA target sequence
tgttgttgataagtcagtagt

SEQ ID NO: 23081 - DNA, 21 bp, Artificial sequence
  SiRNA target sequence
gttgttgataagtcagtagtt

SEQ ID NO: 23082 - DNA, 21 bp, Artificial sequence
  SiRNA target sequence
ttgttgataagtcagtagttc

SEQ ID NO: 23083 - DNA, 21 bp, Artificial sequence
  SiRNA target sequence
tgttgataagtcagtagttca

SEQ ID NO: 23084 - DNA, 21 bp, Artificial sequence
  SiRNA target sequence
gttgataagtcagtagttcac

SEQ ID NO: 23085 - DNA, 21 bp, Artificial sequence
  SiRNA target sequence
ttgataagtcagtagttcaca

SEQ ID NO: 23086 - DNA, 21 bp, Artificial sequence
  SiRNA target sequence
tgataagtcagtagttcacag

SEQ ID NO: 23087 - DNA, 21 bp, Artificial sequence
  SiRNA target sequence
gataagtcagtagttcacagg

SEQ ID NO: 23088 - DNA, 21 bp, Artificial sequence
  SiRNA target sequence
ataagtcagtagttcacaggg

SEQ ID NO: 23089 - DNA, 21 bp, Artificial sequence
  SiRNA target sequence
taagtcagtagttcacaggga

SEQ ID NO: 23090 - DNA, 21 bp, Artificial sequence
  SiRNA target sequence
aagtcagtagttcacagggat

SEQ ID NO: 23091 - DNA, 21 bp, Artificial sequence
  SiRNA target sequence
agtcagtagttcacagggata

SEQ ID NO: 23092 - DNA, 21 bp, Artificial sequence
  SiRNA target sequence
gtcagtagttcacagggatat

SEQ ID NO: 23093 - DNA, 21 bp, Artificial sequence
  SiRNA target sequence
tcagtagttcacagggatatt

SEQ ID NO: 23094 - DNA, 21 bp, Artificial sequence
  SiRNA target sequence
cagtagttcacagggatattt

SEQ ID NO: 23095 - DNA, 21 bp, Artificial sequence
  SiRNA target sequence
agtagttcacagggatatttc

SEQ ID NO: 23096 - DNA, 21 bp, Artificial sequence
  SiRNA target sequence
gtagttcacagggatatttct

SEQ ID NO: 23097 - DNA, 21 bp, Artificial sequence
  SiRNA target sequence
tagttcacagggatatttctt

SEQ ID NO: 23098 - DNA, 21 bp, Artificial sequence
  SiRNA target sequence
agttcacagggatatttcttc

SEQ ID NO: 23099 - DNA, 21 bp, Artificial sequence
  SiRNA target sequence
gttcacagggatatttcttca

SEQ ID NO: 23100 - DNA, 21 bp, Artificial sequence
  SiRNA target sequence
ttcacagggatatttcttcat

SEQ ID NO: 23101 - DNA, 21 bp, Artificial sequence
  SiRNA target sequence
tcacagggatatttcttcata

SEQ ID NO: 23102 - DNA, 21 bp, Artificial sequence
  SiRNA target sequence
cacagggatatttcttcatat

SEQ ID NO: 23103 - DNA, 21 bp, Artificial sequence
  SiRNA target sequence
acagggatatttcttcatatt

SEQ ID NO: 23104 - DNA, 21 bp, Artificial sequence
  SiRNA target sequence
cagggatatttcttcatattt

SEQ ID NO: 23105 - DNA, 21 bp, Artificial sequence
  SiRNA target sequence
agggatatttcttcatatttc

SEQ ID NO: 23106 - DNA, 21 bp, Artificial sequence
  SiRNA target sequence
gggatatttcttcatatttct

SEQ ID NO: 23107 - DNA, 21 bp, Artificial sequence
  SiRNA target sequence
ggatatttcttcatatttctg

SEQ ID NO: 23108 - DNA, 21 bp, Artificial sequence
  SiRNA target sequence
gatatttcttcatatttctgt

SEQ ID NO: 23109 - DNA, 21 bp, Artificial sequence
  SiRNA target sequence
atatttcttcatatttctgtg

SEQ ID NO: 23110 - DNA, 21 bp, Artificial sequence
  SiRNA target sequence
tatttcttcatatttctgtga

SEQ ID NO: 23111 - DNA, 21 bp, Artificial sequence
  SiRNA target sequence
atttcttcatatttctgtgaa

SEQ ID NO: 23112 - DNA, 21 bp, Artificial sequence
  SiRNA target sequence
tttcttcatatttctgtgaac

SEQ ID NO: 23113 - DNA, 21 bp, Artificial sequence
  SiRNA target sequence
ttcttcatatttctgtgaacg

SEQ ID NO: 23114 - DNA, 21 bp, Artificial sequence
  SiRNA target sequence
tcttcatatttctgtgaacgt

SEQ ID NO: 23115 - DNA, 21 bp, Artificial sequence
  SiRNA target sequence
cttcatatttctgtgaacgtt

SEQ ID NO: 23116 - DNA, 21 bp, Artificial sequence
  SiRNA target sequence
ttcatatttctgtgaacgttt

SEQ ID NO: 23117 - DNA, 21 bp, Artificial sequence
  SiRNA target sequence
tcatatttctgtgaacgttta

SEQ ID NO: 23118 - DNA, 21 bp, Artificial sequence
  SiRNA target sequence
catatttctgtgaacgtttag

SEQ ID NO: 23119 - DNA, 21 bp, Artificial sequence
  SiRNA target sequence
atatttctgtgaacgtttaga

SEQ ID NO: 23120 - DNA, 21 bp, Artificial sequence
  SiRNA target sequence
tatttctgtgaacgtttagag

SEQ ID NO: 23121 - DNA, 21 bp, Artificial sequence
  SiRNA target sequence
atttctgtgaacgtttagagt

SEQ ID NO: 23122 - DNA, 21 bp, Artificial sequence
  SiRNA target sequence
tttctgtgaacgtttagagtt

SEQ ID NO: 23123 - DNA, 21 bp, Artificial sequence
  SiRNA target sequence
ttctgtgaacgtttagagttg

SEQ ID NO: 23124 - DNA, 21 bp, Artificial sequence
  SiRNA target sequence
tctgtgaacgtttagagttgc

SEQ ID NO: 23125 - DNA, 21 bp, Artificial sequence
  SiRNA target sequence
ctgtgaacgtttagagttgca

SEQ ID NO: 23126 - DNA, 21 bp, Artificial sequence
  SiRNA target sequence
tgtgaacgtttagagttgcaa

SEQ ID NO: 23127 - DNA, 21 bp, Artificial sequence
  SiRNA target sequence
gtgaacgtttagagttgcaat

SEQ ID NO: 23128 - DNA, 21 bp, Artificial sequence
  SiRNA target sequence
tgaacgtttagagttgcaatc

SEQ ID NO: 23129 - DNA, 21 bp, Artificial sequence
  SiRNA target sequence
gaacgtttagagttgcaatcc

SEQ ID NO: 23130 - DNA, 21 bp, Artificial sequence
  SiRNA target sequence
aacgtttagagttgcaatccg

SEQ ID NO: 23131 - DNA, 21 bp, Artificial sequence
  SiRNA target sequence
acgtttagagttgcaatccgt

SEQ ID NO: 23132 - DNA, 21 bp, Artificial sequence
  SiRNA target sequence
cgtttagagttgcaatccgtg

SEQ ID NO: 23133 - DNA, 21 bp, Artificial sequence
  SiRNA target sequence
gtttagagttgcaatccgtgg

SEQ ID NO: 23134 - DNA, 21 bp, Artificial sequence
  SiRNA target sequence
tttagagttgcaatccgtggg

SEQ ID NO: 23135 - DNA, 21 bp, Artificial sequence
  SiRNA target sequence
ttagagttgcaatccgtgggt

SEQ ID NO: 23136 - DNA, 21 bp, Artificial sequence
  SiRNA target sequence
tagagttgcaatccgtgggtt

SEQ ID NO: 23137 - DNA, 21 bp, Artificial sequence
  SiRNA target sequence
agagttgcaatccgtgggttc

SEQ ID NO: 23138 - DNA, 21 bp, Artificial sequence
  SiRNA target sequence
gagttgcaatccgtgggttca

SEQ ID NO: 23139 - DNA, 21 bp, Artificial sequence
  SiRNA target sequence
agttgcaatccgtgggttcaa

SEQ ID NO: 23140 - DNA, 21 bp, Artificial sequence
  SiRNA target sequence
gttgcaatccgtgggttcaac

SEQ ID NO: 23141 - DNA, 21 bp, Artificial sequence
  SiRNA target sequence
ttgcaatccgtgggttcaact

SEQ ID NO: 23142 - DNA, 21 bp, Artificial sequence
  SiRNA target sequence
tgcaatccgtgggttcaactc

SEQ ID NO: 23143 - DNA, 21 bp, Artificial sequence
  SiRNA target sequence
gcaatccgtgggttcaactcg

SEQ ID NO: 23144 - DNA, 21 bp, Artificial sequence
  SiRNA target sequence
caatccgtgggttcaactcga

SEQ ID NO: 23145 - DNA, 21 bp, Artificial sequence
  SiRNA target sequence
aatccgtgggttcaactcgaa

SEQ ID NO: 23146 - DNA, 21 bp, Artificial sequence
  SiRNA target sequence
atccgtgggttcaactcgaat

SEQ ID NO: 23147 - DNA, 21 bp, Artificial sequence
  SiRNA target sequence
tccgtgggttcaactcgaatc

SEQ ID NO: 23148 - DNA, 21 bp, Artificial sequence
  SiRNA target sequence
ccgtgggttcaactcgaatcc

SEQ ID NO: 23149 - DNA, 21 bp, Artificial sequence
  SiRNA target sequence
cgtgggttcaactcgaatcca

SEQ ID NO: 23150 - DNA, 21 bp, Artificial sequence
  SiRNA target sequence
gtgggttcaactcgaatccag

SEQ ID NO: 23151 - DNA, 21 bp, Artificial sequence
  SiRNA target sequence
tgggttcaactcgaatccagt

SEQ ID NO: 23152 - DNA, 21 bp, Artificial sequence
  SiRNA target sequence
gggttcaactcgaatccagtt

SEQ ID NO: 23153 - DNA, 21 bp, Artificial sequence
  SiRNA target sequence
ggttcaactcgaatccagtta

SEQ ID NO: 23154 - DNA, 21 bp, Artificial sequence
  SiRNA target sequence
gttcaactcgaatccagttac

SEQ ID NO: 23155 - DNA, 21 bp, Artificial sequence
  SiRNA target sequence
ttcaactcgaatccagttacc

SEQ ID NO: 23156 - DNA, 21 bp, Artificial sequence
  SiRNA target sequence
tcaactcgaatccagttacct

SEQ ID NO: 23157 - DNA, 21 bp, Artificial sequence
  SiRNA target sequence
caactcgaatccagttacctg

SEQ ID NO: 23158 - DNA, 21 bp, Artificial sequence
  SiRNA target sequence
aactcgaatccagttacctgt

SEQ ID NO: 23159 - DNA, 21 bp, Artificial sequence
  SiRNA target sequence
actcgaatccagttacctgtt

SEQ ID NO: 23160 - DNA, 21 bp, Artificial sequence
  SiRNA target sequence
ctcgaatccagttacctgtta

SEQ ID NO: 23161 - DNA, 21 bp, Artificial sequence
  SiRNA target sequence
tcgaatccagttacctgttat

SEQ ID NO: 23162 - DNA, 21 bp, Artificial sequence
  SiRNA target sequence
cgaatccagttacctgttatg

SEQ ID NO: 23163 - DNA, 21 bp, Artificial sequence
  SiRNA target sequence
gaatccagttacctgttatgc

SEQ ID NO: 23164 - DNA, 21 bp, Artificial sequence
  SiRNA target sequence
aatccagttacctgttatgcg

SEQ ID NO: 23165 - DNA, 21 bp, Artificial sequence
  SiRNA target sequence
atccagttacctgttatgcga

SEQ ID NO: 23166 - DNA, 21 bp, Artificial sequence
  SiRNA target sequence
tccagttacctgttatgcgat

SEQ ID NO: 23167 - DNA, 21 bp, Artificial sequence
  SiRNA target sequence
ccagttacctgttatgcgatg

SEQ ID NO: 23168 - DNA, 21 bp, Artificial sequence
  SiRNA target sequence
cagttacctgttatgcgatgg

SEQ ID NO: 23169 - DNA, 21 bp, Artificial sequence
  SiRNA target sequence
agttacctgttatgcgatggg

SEQ ID NO: 23170 - DNA, 21 bp, Artificial sequence
  SiRNA target sequence
gttacctgttatgcgatgggt

SEQ ID NO: 23171 - DNA, 21 bp, Artificial sequence
  SiRNA target sequence
ttacctgttatgcgatgggta

SEQ ID NO: 23172 - DNA, 21 bp, Artificial sequence
  SiRNA target sequence
tacctgttatgcgatgggtaa

SEQ ID NO: 23173 - DNA, 21 bp, Artificial sequence
  SiRNA target sequence
acctgttatgcgatgggtaag

SEQ ID NO: 23174 - DNA, 21 bp, Artificial sequence
  SiRNA target sequence
cctgttatgcgatgggtaaga

SEQ ID NO: 23175 - DNA, 21 bp, Artificial sequence
  SiRNA target sequence
ctgttatgcgatgggtaagag

SEQ ID NO: 23176 - DNA, 21 bp, Artificial sequence
  SiRNA target sequence
tgttatgcgatgggtaagaga

SEQ ID NO: 23177 - DNA, 21 bp, Artificial sequence
  SiRNA target sequence
gttatgcgatgggtaagagat

SEQ ID NO: 23178 - DNA, 21 bp, Artificial sequence
  SiRNA target sequence
ttatgcgatgggtaagagatg

SEQ ID NO: 23179 - DNA, 21 bp, Artificial sequence
  SiRNA target sequence
tatgcgatgggtaagagatgt

SEQ ID NO: 23180 - DNA, 21 bp, Artificial sequence
  SiRNA target sequence
atgcgatgggtaagagatgtt

SEQ ID NO: 23181 - DNA, 21 bp, Artificial sequence
  SiRNA target sequence
tgcgatgggtaagagatgttg

SEQ ID NO: 23182 - DNA, 21 bp, Artificial sequence
  SiRNA target sequence
gcgatgggtaagagatgttgg

SEQ ID NO: 23183 - DNA, 21 bp, Artificial sequence
  SiRNA target sequence
cgatgggtaagagatgttgga

SEQ ID NO: 23184 - DNA, 21 bp, Artificial sequence
  SiRNA target sequence
gatgggtaagagatgttggat

SEQ ID NO: 23185 - DNA, 21 bp, Artificial sequence
  SiRNA target sequence
atgggtaagagatgttggata

SEQ ID NO: 23186 - DNA, 21 bp, Artificial sequence
  SiRNA target sequence
tgggtaagagatgttggatat

SEQ ID NO: 23187 - DNA, 21 bp, Artificial sequence
  SiRNA target sequence
gggtaagagatgttggatata

SEQ ID NO: 23188 - DNA, 21 bp, Artificial sequence
  SiRNA target sequence
ggtaagagatgttggatatat

SEQ ID NO: 23189 - DNA, 21 bp, Artificial sequence
  SiRNA target sequence
gtaagagatgttggatatatt

SEQ ID NO: 23190 - DNA, 21 bp, Artificial sequence
  SiRNA target sequence
taagagatgttggatatattt

SEQ ID NO: 23191 - DNA, 21 bp, Artificial sequence
  SiRNA target sequence
aagagatgttggatatatttt

SEQ ID NO: 23192 - DNA, 21 bp, Artificial sequence
  SiRNA target sequence
agagatgttggatatattttc

SEQ ID NO: 23193 - DNA, 21 bp, Artificial sequence
  SiRNA target sequence
gagatgttggatatattttcg

SEQ ID NO: 23194 - DNA, 21 bp, Artificial sequence
  SiRNA target sequence
agatgttggatatattttcgt

SEQ ID NO: 23195 - DNA, 21 bp, Artificial sequence
  SiRNA target sequence
gatgttggatatattttcgtt

SEQ ID NO: 23196 - DNA, 21 bp, Artificial sequence
  SiRNA target sequence
atgttggatatattttcgtta

SEQ ID NO: 23197 - DNA, 21 bp, Artificial sequence
  SiRNA target sequence
tgttggatatattttcgttaa

SEQ ID NO: 23198 - DNA, 21 bp, Artificial sequence
  SiRNA target sequence
gttggatatattttcgttaag

SEQ ID NO: 23199 - DNA, 21 bp, Artificial sequence
  SiRNA target sequence
ttggatatattttcgttaagt

SEQ ID NO: 23200 - DNA, 21 bp, Artificial sequence
  SiRNA target sequence
tggatatattttcgttaagtc

SEQ ID NO: 23201 - DNA, 21 bp, Artificial sequence
  SiRNA target sequence
ggatatattttcgttaagtcg

SEQ ID NO: 23202 - DNA, 21 bp, Artificial sequence
  SiRNA target sequence
gatatattttcgttaagtcgg

SEQ ID NO: 23203 - DNA, 21 bp, Artificial sequence
  SiRNA target sequence
atatattttcgttaagtcggg

SEQ ID NO: 23204 - DNA, 21 bp, Artificial sequence
  SiRNA target sequence
tatattttcgttaagtcggga

SEQ ID NO: 23205 - DNA, 21 bp, Artificial sequence
  SiRNA target sequence
atattttcgttaagtcgggac

SEQ ID NO: 23206 - DNA, 21 bp, Artificial sequence
  SiRNA target sequence
tattttcgttaagtcgggaca

SEQ ID NO: 23207 - DNA, 21 bp, Artificial sequence
  SiRNA target sequence
attttcgttaagtcgggacag

SEQ ID NO: 23208 - DNA, 21 bp, Artificial sequence
  SiRNA target sequence
ttttcgttaagtcgggacagg

SEQ ID NO: 23209 - DNA, 21 bp, Artificial sequence
  SiRNA target sequence
tttcgttaagtcgggacaggg

SEQ ID NO: 23210 - DNA, 21 bp, Artificial sequence
  SiRNA target sequence
ttcgttaagtcgggacagggt

SEQ ID NO: 23211 - DNA, 21 bp, Artificial sequence
  SiRNA target sequence
tcgttaagtcgggacagggta

SEQ ID NO: 23212 - DNA, 21 bp, Artificial sequence
  SiRNA target sequence
cgttaagtcgggacagggtac

SEQ ID NO: 23213 - DNA, 21 bp, Artificial sequence
  SiRNA target sequence
gttaagtcgggacagggtact

SEQ ID NO: 23214 - DNA, 21 bp, Artificial sequence
  SiRNA target sequence
ttaagtcgggacagggtacta

SEQ ID NO: 23215 - DNA, 21 bp, Artificial sequence
  SiRNA target sequence
taagtcgggacagggtactag

SEQ ID NO: 23216 - DNA, 21 bp, Artificial sequence
  SiRNA target sequence
aagtcgggacagggtactagt

SEQ ID NO: 23217 - DNA, 21 bp, Artificial sequence
  SiRNA target sequence
agtcgggacagggtactagtt

SEQ ID NO: 23218 - DNA, 21 bp, Artificial sequence
  SiRNA target sequence
gtcgggacagggtactagttg

SEQ ID NO: 23219 - DNA, 21 bp, Artificial sequence
  SiRNA target sequence
tcgggacagggtactagttgt

SEQ ID NO: 23220 - DNA, 21 bp, Artificial sequence
  SiRNA target sequence
cgggacagggtactagttgta

SEQ ID NO: 23221 - DNA, 21 bp, Artificial sequence
  SiRNA target sequence
gggacagggtactagttgtat

SEQ ID NO: 23222 - DNA, 21 bp, Artificial sequence
  SiRNA target sequence
ggacagggtactagttgtata

SEQ ID NO: 23223 - DNA, 21 bp, Artificial sequence
  SiRNA target sequence
gacagggtactagttgtataa

SEQ ID NO: 23224 - DNA, 21 bp, Artificial sequence
  SiRNA target sequence
acagggtactagttgtataaa

SEQ ID NO: 23225 - DNA, 21 bp, Artificial sequence
  SiRNA target sequence
cagggtactagttgtataaag

SEQ ID NO: 23226 - DNA, 21 bp, Artificial sequence
  SiRNA target sequence
agggtactagttgtataaaga

SEQ ID NO: 23227 - DNA, 21 bp, Artificial sequence
  SiRNA target sequence
gggtactagttgtataaagaa

SEQ ID NO: 23228 - DNA, 21 bp, Artificial sequence
  SiRNA target sequence
ggtactagttgtataaagaac

SEQ ID NO: 23229 - DNA, 21 bp, Artificial sequence
  SiRNA target sequence
gtactagttgtataaagaacg

SEQ ID NO: 23230 - DNA, 21 bp, Artificial sequence
  SiRNA target sequence
tactagttgtataaagaacgt

SEQ ID NO: 23231 - DNA, 21 bp, Artificial sequence
  SiRNA target sequence
actagttgtataaagaacgtt

SEQ ID NO: 23232 - DNA, 21 bp, Artificial sequence
  SiRNA target sequence
ctagttgtataaagaacgttt

SEQ ID NO: 23233 - DNA, 21 bp, Artificial sequence
  SiRNA target sequence
tagttgtataaagaacgtttc

SEQ ID NO: 23234 - DNA, 21 bp, Artificial sequence
  SiRNA target sequence
agttgtataaagaacgtttct

SEQ ID NO: 23235 - DNA, 21 bp, Artificial sequence
  SiRNA target sequence
gttgtataaagaacgtttcta

SEQ ID NO: 23236 - DNA, 21 bp, Artificial sequence
  SiRNA target sequence
ttgtataaagaacgtttctaa

SEQ ID NO: 23237 - DNA, 21 bp, Artificial sequence
  SiRNA target sequence
tgtataaagaacgtttctaac

SEQ ID NO: 23238 - DNA, 21 bp, Artificial sequence
  SiRNA target sequence
gtataaagaacgtttctaacg

SEQ ID NO: 23239 - DNA, 21 bp, Artificial sequence
  SiRNA target sequence
tataaagaacgtttctaacgt

SEQ ID NO: 23240 - DNA, 21 bp, Artificial sequence
  SiRNA target sequence
ataaagaacgtttctaacgtt

SEQ ID NO: 23241 - DNA, 21 bp, Artificial sequence
  SiRNA target sequence
taaagaacgtttctaacgtta

SEQ ID NO: 23242 - DNA, 21 bp, Artificial sequence
  SiRNA target sequence
aaagaacgtttctaacgttag

SEQ ID NO: 23243 - DNA, 21 bp, Artificial sequence
  SiRNA target sequence
aagaacgtttctaacgttagc

SEQ ID NO: 23244 - DNA, 21 bp, Artificial sequence
  SiRNA target sequence
agaacgtttctaacgttagct

SEQ ID NO: 23245 - DNA, 21 bp, Artificial sequence
  SiRNA target sequence
gaacgtttctaacgttagcta

SEQ ID NO: 23246 - DNA, 21 bp, Artificial sequence
  SiRNA target sequence
aacgtttctaacgttagctat

SEQ ID NO: 23247 - DNA, 21 bp, Artificial sequence
  SiRNA target sequence
acgtttctaacgttagctata

SEQ ID NO: 23248 - DNA, 21 bp, Artificial sequence
  SiRNA target sequence
cgtttctaacgttagctatat

SEQ ID NO: 23249 - DNA, 21 bp, Artificial sequence
  SiRNA target sequence
gtttctaacgttagctatatg

SEQ ID NO: 23250 - DNA, 21 bp, Artificial sequence
  SiRNA target sequence
tttctaacgttagctatatga

SEQ ID NO: 23251 - DNA, 21 bp, Artificial sequence
  SiRNA target sequence
ttctaacgttagctatatgac

SEQ ID NO: 23252 - DNA, 21 bp, Artificial sequence
  SiRNA target sequence
tctaacgttagctatatgact

SEQ ID NO: 23253 - DNA, 21 bp, Artificial sequence
  SiRNA target sequence
ctaacgttagctatatgactg

SEQ ID NO: 23254 - DNA, 21 bp, Artificial sequence
  SiRNA target sequence
taacgttagctatatgactga

SEQ ID NO: 23255 - DNA, 21 bp, Artificial sequence
  SiRNA target sequence
aacgttagctatatgactgat

SEQ ID NO: 23256 - DNA, 21 bp, Artificial sequence
  SiRNA target sequence
acgttagctatatgactgata

SEQ ID NO: 23257 - DNA, 21 bp, Artificial sequence
  SiRNA target sequence
cgttagctatatgactgatac

SEQ ID NO: 23258 - DNA, 21 bp, Artificial sequence
  SiRNA target sequence
gttagctatatgactgatacc

SEQ ID NO: 23259 - DNA, 21 bp, Artificial sequence
  SiRNA target sequence
ttagctatatgactgataccg

SEQ ID NO: 23260 - DNA, 21 bp, Artificial sequence
  SiRNA target sequence
tagctatatgactgataccga

SEQ ID NO: 23261 - DNA, 21 bp, Artificial sequence
  SiRNA target sequence
agctatatgactgataccgat

SEQ ID NO: 23262 - DNA, 21 bp, Artificial sequence
  SiRNA target sequence
gctatatgactgataccgatc

SEQ ID NO: 23263 - DNA, 21 bp, Artificial sequence
  SiRNA target sequence
ctatatgactgataccgatcc

SEQ ID NO: 23264 - DNA, 21 bp, Artificial sequence
  SiRNA target sequence
tatatgactgataccgatcct

SEQ ID NO: 23265 - DNA, 21 bp, Artificial sequence
  SiRNA target sequence
atatgactgataccgatcctg

SEQ ID NO: 23266 - DNA, 21 bp, Artificial sequence
  SiRNA target sequence
tatgactgataccgatcctga

SEQ ID NO: 23267 - DNA, 21 bp, Artificial sequence
  SiRNA target sequence
atgactgataccgatcctgat

SEQ ID NO: 23268 - DNA, 21 bp, Artificial sequence
  SiRNA target sequence
tgactgataccgatcctgatg

SEQ ID NO: 23269 - DNA, 21 bp, Artificial sequence
  SiRNA target sequence
gactgataccgatcctgatgc

SEQ ID NO: 23270 - DNA, 21 bp, Artificial sequence
  SiRNA target sequence
actgataccgatcctgatgcg

SEQ ID NO: 23271 - DNA, 21 bp, Artificial sequence
  SiRNA target sequence
ctgataccgatcctgatgcgc

SEQ ID NO: 23272 - DNA, 21 bp, Artificial sequence
  SiRNA target sequence
tgataccgatcctgatgcgcg

SEQ ID NO: 23273 - DNA, 21 bp, Artificial sequence
  SiRNA target sequence
gataccgatcctgatgcgcga

SEQ ID NO: 23274 - DNA, 21 bp, Artificial sequence
  SiRNA target sequence
ataccgatcctgatgcgcgag

SEQ ID NO: 23275 - DNA, 21 bp, Artificial sequence
  SiRNA target sequence
taccgatcctgatgcgcgaga

SEQ ID NO: 23276 - DNA, 21 bp, Artificial sequence
  SiRNA target sequence
accgatcctgatgcgcgagaa

SEQ ID NO: 23277 - DNA, 21 bp, Artificial sequence
  SiRNA target sequence
ccgatcctgatgcgcgagaaa

SEQ ID NO: 23278 - DNA, 21 bp, Artificial sequence
  SiRNA target sequence
cgatcctgatgcgcgagaaat

SEQ ID NO: 23279 - DNA, 21 bp, Artificial sequence
  SiRNA target sequence
gatcctgatgcgcgagaaatt

SEQ ID NO: 23280 - DNA, 21 bp, Artificial sequence
  SiRNA target sequence
atcctgatgcgcgagaaattc

SEQ ID NO: 23281 - DNA, 21 bp, Artificial sequence
  SiRNA target sequence
tcctgatgcgcgagaaattcg

SEQ ID NO: 23282 - DNA, 21 bp, Artificial sequence
  SiRNA target sequence
cctgatgcgcgagaaattcga

SEQ ID NO: 23283 - DNA, 21 bp, Artificial sequence
  SiRNA target sequence
ctgatgcgcgagaaattcgat

SEQ ID NO: 23284 - DNA, 21 bp, Artificial sequence
  SiRNA target sequence
tgatgcgcgagaaattcgatt

SEQ ID NO: 23285 - DNA, 21 bp, Artificial sequence
  SiRNA target sequence
gatgcgcgagaaattcgattg

SEQ ID NO: 23286 - DNA, 21 bp, Artificial sequence
  SiRNA target sequence
atgcgcgagaaattcgattga

SEQ ID NO: 23287 - DNA, 21 bp, Artificial sequence
  SiRNA target sequence
tgcgcgagaaattcgattgag

SEQ ID NO: 23288 - DNA, 21 bp, Artificial sequence
  SiRNA target sequence
gcgcgagaaattcgattgagg

SEQ ID NO: 23289 - DNA, 21 bp, Artificial sequence
  SiRNA target sequence
cgcgagaaattcgattgaggg

SEQ ID NO: 23290 - DNA, 21 bp, Artificial sequence
  SiRNA target sequence
gcgagaaattcgattgaggga

SEQ ID NO: 23291 - DNA, 21 bp, Artificial sequence
  SiRNA target sequence
cgagaaattcgattgagggaa

SEQ ID NO: 23292 - DNA, 21 bp, Artificial sequence
  SiRNA target sequence
gagaaattcgattgagggaag

SEQ ID NO: 23293 - DNA, 21 bp, Artificial sequence
  SiRNA target sequence
agaaattcgattgagggaagc

SEQ ID NO: 23294 - DNA, 21 bp, Artificial sequence
  SiRNA target sequence
gaaattcgattgagggaagcg

SEQ ID NO: 23295 - DNA, 21 bp, Artificial sequence
  SiRNA target sequence
aaattcgattgagggaagcgt

SEQ ID NO: 23296 - DNA, 21 bp, Artificial sequence
  SiRNA target sequence
aattcgattgagggaagcgtg

SEQ ID NO: 23297 - DNA, 21 bp, Artificial sequence
  SiRNA target sequence
attcgattgagggaagcgtgg

SEQ ID NO: 23298 - DNA, 21 bp, Artificial sequence
  SiRNA target sequence
ttcgattgagggaagcgtggg

SEQ ID NO: 23299 - DNA, 21 bp, Artificial sequence
  SiRNA target sequence
tcgattgagggaagcgtggga

SEQ ID NO: 23300 - DNA, 21 bp, Artificial sequence
  SiRNA target sequence
cgattgagggaagcgtgggag

SEQ ID NO: 23301 - DNA, 21 bp, Artificial sequence
  SiRNA target sequence
gattgagggaagcgtgggagt

SEQ ID NO: 23302 - DNA, 21 bp, Artificial sequence
  SiRNA target sequence
attgagggaagcgtgggagta

SEQ ID NO: 23303 - DNA, 21 bp, Artificial sequence
  SiRNA target sequence
ttgagggaagcgtgggagtat

SEQ ID NO: 23304 - DNA, 21 bp, Artificial sequence
  SiRNA target sequence
tgagggaagcgtgggagtatt

SEQ ID NO: 23305 - DNA, 21 bp, Artificial sequence
  SiRNA target sequence
gagggaagcgtgggagtattc

SEQ ID NO: 23306 - DNA, 21 bp, Artificial sequence
  SiRNA target sequence
agggaagcgtgggagtattca

SEQ ID NO: 23307 - DNA, 21 bp, Artificial sequence
  SiRNA target sequence
gggaagcgtgggagtattcat

SEQ ID NO: 23308 - DNA, 21 bp, Artificial sequence
  SiRNA target sequence
ggaagcgtgggagtattcatt

SEQ ID NO: 23309 - DNA, 21 bp, Artificial sequence
  SiRNA target sequence
gaagcgtgggagtattcatta

SEQ ID NO: 23310 - DNA, 21 bp, Artificial sequence
  SiRNA target sequence
aagcgtgggagtattcattag

SEQ ID NO: 23311 - DNA, 21 bp, Artificial sequence
  SiRNA target sequence
agcgtgggagtattcattaga

SEQ ID NO: 23312 - DNA, 21 bp, Artificial sequence
  SiRNA target sequence
gcgtgggagtattcattagaa

SEQ ID NO: 23313 - DNA, 21 bp, Artificial sequence
  SiRNA target sequence
cgtgggagtattcattagaaa

SEQ ID NO: 23314 - DNA, 21 bp, Artificial sequence
  SiRNA target sequence
gtgggagtattcattagaaac

SEQ ID NO: 23315 - DNA, 21 bp, Artificial sequence
  SiRNA target sequence
tgggagtattcattagaaacg

SEQ ID NO: 23316 - DNA, 21 bp, Artificial sequence
  SiRNA target sequence
gggagtattcattagaaacga

SEQ ID NO: 23317 - DNA, 21 bp, Artificial sequence
  SiRNA target sequence
ggagtattcattagaaacgat

SEQ ID NO: 23318 - DNA, 21 bp, Artificial sequence
  SiRNA target sequence
gagtattcattagaaacgata

SEQ ID NO: 23319 - DNA, 21 bp, Artificial sequence
  SiRNA target sequence
agtattcattagaaacgatat

SEQ ID NO: 23320 - DNA, 21 bp, Artificial sequence
  SiRNA target sequence
gtattcattagaaacgatatc

SEQ ID NO: 23321 - DNA, 21 bp, Artificial sequence
  SiRNA target sequence
tattcattagaaacgatatct

SEQ ID NO: 23322 - DNA, 21 bp, Artificial sequence
  SiRNA target sequence
attcattagaaacgatatctg

SEQ ID NO: 23323 - DNA, 21 bp, Artificial sequence
  SiRNA target sequence
ttcattagaaacgatatctgg

SEQ ID NO: 23324 - DNA, 21 bp, Artificial sequence
  SiRNA target sequence
tcattagaaacgatatctggg

SEQ ID NO: 23325 - DNA, 21 bp, Artificial sequence
  SiRNA target sequence
cattagaaacgatatctgggg

SEQ ID NO: 23326 - DNA, 21 bp, Artificial sequence
  SiRNA target sequence
attagaaacgatatctgggga

SEQ ID NO: 23327 - DNA, 21 bp, Artificial sequence
  SiRNA target sequence
ttagaaacgatatctggggat

SEQ ID NO: 23328 - DNA, 21 bp, Artificial sequence
  SiRNA target sequence
tagaaacgatatctggggatg

SEQ ID NO: 23329 - DNA, 21 bp, Artificial sequence
  SiRNA target sequence
agaaacgatatctggggatgg

SEQ ID NO: 23330 - DNA, 21 bp, Artificial sequence
  SiRNA target sequence
gaaacgatatctggggatggg

SEQ ID NO: 23331 - DNA, 21 bp, Artificial sequence
  SiRNA target sequence
aaacgatatctggggatgggg

SEQ ID NO: 23332 - DNA, 21 bp, Artificial sequence
  SiRNA target sequence
aacgatatctggggatggggg

SEQ ID NO: 23333 - DNA, 21 bp, Artificial sequence
  SiRNA target sequence
acgatatctggggatggggga

SEQ ID NO: 23334 - DNA, 21 bp, Artificial sequence
  SiRNA target sequence
cgatatctggggatgggggag

SEQ ID NO: 23335 - DNA, 21 bp, Artificial sequence
  SiRNA target sequence
gatatctggggatgggggagc

SEQ ID NO: 23336 - DNA, 21 bp, Artificial sequence
  SiRNA target sequence
atatctggggatgggggagct

SEQ ID NO: 23337 - DNA, 21 bp, Artificial sequence
  SiRNA target sequence
tatctggggatgggggagctc

SEQ ID NO: 23338 - DNA, 21 bp, Artificial sequence
  SiRNA target sequence
atctggggatgggggagctcc

SEQ ID NO: 23339 - DNA, 21 bp, Artificial sequence
  SiRNA target sequence
tctggggatgggggagctcct

SEQ ID NO: 23340 - DNA, 21 bp, Artificial sequence
  SiRNA target sequence
ctggggatgggggagctcctc

SEQ ID NO: 23341 - DNA, 21 bp, Artificial sequence
  SiRNA target sequence
tggggatgggggagctcctct

SEQ ID NO: 23342 - DNA, 21 bp, Artificial sequence
  SiRNA target sequence
ggggatgggggagctcctctt

SEQ ID NO: 23343 - DNA, 21 bp, Artificial sequence
  SiRNA target sequence
gggatgggggagctcctcttt

SEQ ID NO: 23344 - DNA, 21 bp, Artificial sequence
  SiRNA target sequence
ggatgggggagctcctctttt

SEQ ID NO: 23345 - DNA, 21 bp, Artificial sequence
  SiRNA target sequence
gatgggggagctcctcttttc

SEQ ID NO: 23346 - DNA, 21 bp, Artificial sequence
  SiRNA target sequence
atgggggagctcctcttttcg

SEQ ID NO: 23347 - DNA, 21 bp, Artificial sequence
  SiRNA target sequence
tgggggagctcctcttttcgt

SEQ ID NO: 23348 - DNA, 21 bp, Artificial sequence
  SiRNA target sequence
gggggagctcctcttttcgta

SEQ ID NO: 23349 - DNA, 21 bp, Artificial sequence
  SiRNA target sequence
ggggagctcctcttttcgtaa

SEQ ID NO: 23350 - DNA, 21 bp, Artificial sequence
  SiRNA target sequence
gggagctcctcttttcgtaac

SEQ ID NO: 23351 - DNA, 21 bp, Artificial sequence
  SiRNA target sequence
ggagctcctcttttcgtaact

SEQ ID NO: 23352 - DNA, 21 bp, Artificial sequence
  SiRNA target sequence
gagctcctcttttcgtaacta

SEQ ID NO: 23353 - DNA, 21 bp, Artificial sequence
  SiRNA target sequence
agctcctcttttcgtaactaa

SEQ ID NO: 23354 - DNA, 21 bp, Artificial sequence
  SiRNA target sequence
gctcctcttttcgtaactaat

SEQ ID NO: 23355 - DNA, 21 bp, Artificial sequence
  SiRNA target sequence
ctcctcttttcgtaactaata

SEQ ID NO: 23356 - DNA, 21 bp, Artificial sequence
  SiRNA target sequence
tcctcttttcgtaactaatag

SEQ ID NO: 23357 - DNA, 21 bp, Artificial sequence
  SiRNA target sequence
cctcttttcgtaactaatagt

SEQ ID NO: 23358 - DNA, 21 bp, Artificial sequence
  SiRNA target sequence
ctcttttcgtaactaatagta

SEQ ID NO: 23359 - DNA, 21 bp, Artificial sequence
  SiRNA target sequence
tcttttcgtaactaatagtaa

SEQ ID NO: 23360 - DNA, 21 bp, Artificial sequence
  SiRNA target sequence
cttttcgtaactaatagtaaa

SEQ ID NO: 23361 - DNA, 21 bp, Artificial sequence
  SiRNA target sequence
ttttcgtaactaatagtaaaa

SEQ ID NO: 23362 - DNA, 21 bp, Artificial sequence
  SiRNA target sequence
tttcgtaactaatagtaaaat

SEQ ID NO: 23363 - DNA, 21 bp, Artificial sequence
  SiRNA target sequence
ttcgtaactaatagtaaaata

SEQ ID NO: 23364 - DNA, 21 bp, Artificial sequence
  SiRNA target sequence
tcgtaactaatagtaaaatag

SEQ ID NO: 23365 - DNA, 21 bp, Artificial sequence
  SiRNA target sequence
cgtaactaatagtaaaatagg

SEQ ID NO: 23366 - DNA, 21 bp, Artificial sequence
  SiRNA target sequence
gtaactaatagtaaaatagga

SEQ ID NO: 23367 - DNA, 21 bp, Artificial sequence
  SiRNA target sequence
taactaatagtaaaataggac

SEQ ID NO: 23368 - DNA, 21 bp, Artificial sequence
  SiRNA target sequence
aactaatagtaaaataggacc

SEQ ID NO: 23369 - DNA, 21 bp, Artificial sequence
  SiRNA target sequence
actaatagtaaaataggacct

SEQ ID NO: 23370 - DNA, 21 bp, Artificial sequence
  SiRNA target sequence
ctaatagtaaaataggacctg

SEQ ID NO: 23371 - DNA, 21 bp, Artificial sequence
  SiRNA target sequence
taatagtaaaataggacctgg

SEQ ID NO: 23372 - DNA, 21 bp, Artificial sequence
  SiRNA target sequence
aatagtaaaataggacctggt

SEQ ID NO: 23373 - DNA, 21 bp, Artificial sequence
  SiRNA target sequence
atagtaaaataggacctggta

SEQ ID NO: 23374 - DNA, 21 bp, Artificial sequence
  SiRNA target sequence
tagtaaaataggacctggtaa

SEQ ID NO: 23375 - DNA, 21 bp, Artificial sequence
  SiRNA target sequence
agtaaaataggacctggtaag

SEQ ID NO: 23376 - DNA, 21 bp, Artificial sequence
  SiRNA target sequence
gtaaaataggacctggtaaga

SEQ ID NO: 23377 - DNA, 21 bp, Artificial sequence
  SiRNA target sequence
taaaataggacctggtaagat

SEQ ID NO: 23378 - DNA, 21 bp, Artificial sequence
  SiRNA target sequence
aaaataggacctggtaagatc

SEQ ID NO: 23379 - DNA, 21 bp, Artificial sequence
  SiRNA target sequence
aaataggacctggtaagatca

SEQ ID NO: 23380 - DNA, 21 bp, Artificial sequence
  SiRNA target sequence
aataggacctggtaagatcat

SEQ ID NO: 23381 - DNA, 21 bp, Artificial sequence
  SiRNA target sequence
ataggacctggtaagatcata

SEQ ID NO: 23382 - DNA, 21 bp, Artificial sequence
  SiRNA target sequence
taggacctggtaagatcatag

SEQ ID NO: 23383 - DNA, 21 bp, Artificial sequence
  SiRNA target sequence
aggacctggtaagatcatagg

SEQ ID NO: 23384 - DNA, 21 bp, Artificial sequence
  SiRNA target sequence
ggacctggtaagatcatagga

SEQ ID NO: 23385 - DNA, 21 bp, Artificial sequence
  SiRNA target sequence
gacctggtaagatcataggaa

SEQ ID NO: 23386 - DNA, 21 bp, Artificial sequence
  SiRNA target sequence
acctggtaagatcataggaat

SEQ ID NO: 23387 - DNA, 21 bp, Artificial sequence
  SiRNA target sequence
cctggtaagatcataggaatt

SEQ ID NO: 23388 - DNA, 21 bp, Artificial sequence
  SiRNA target sequence
ctggtaagatcataggaattc

SEQ ID NO: 23389 - DNA, 21 bp, Artificial sequence
  SiRNA target sequence
tggtaagatcataggaattca

SEQ ID NO: 23390 - DNA, 21 bp, Artificial sequence
  SiRNA target sequence
ggtaagatcataggaattcat

SEQ ID NO: 23391 - DNA, 21 bp, Artificial sequence
  SiRNA target sequence
gtaagatcataggaattcata

SEQ ID NO: 23392 - DNA, 21 bp, Artificial sequence
  SiRNA target sequence
taagatcataggaattcatac

SEQ ID NO: 23393 - DNA, 21 bp, Artificial sequence
  SiRNA target sequence
aagatcataggaattcataca

SEQ ID NO: 23394 - DNA, 21 bp, Artificial sequence
  SiRNA target sequence
agatcataggaattcatacag

SEQ ID NO: 23395 - DNA, 21 bp, Artificial sequence
  SiRNA target sequence
gatcataggaattcatacagc

SEQ ID NO: 23396 - DNA, 21 bp, Artificial sequence
  SiRNA target sequence
atcataggaattcatacagct

SEQ ID NO: 23397 - DNA, 21 bp, Artificial sequence
  SiRNA target sequence
tcataggaattcatacagctg

SEQ ID NO: 23398 - DNA, 21 bp, Artificial sequence
  SiRNA target sequence
cataggaattcatacagctgg

SEQ ID NO: 23399 - DNA, 21 bp, Artificial sequence
  SiRNA target sequence
ataggaattcatacagctgga

SEQ ID NO: 23400 - DNA, 21 bp, Artificial sequence
  SiRNA target sequence
taggaattcatacagctggag

SEQ ID NO: 23401 - DNA, 21 bp, Artificial sequence
  SiRNA target sequence
aggaattcatacagctggagg

SEQ ID NO: 23402 - DNA, 21 bp, Artificial sequence
  SiRNA target sequence
ggaattcatacagctggaggt

SEQ ID NO: 23403 - DNA, 21 bp, Artificial sequence
  SiRNA target sequence
gaattcatacagctggaggtc

SEQ ID NO: 23404 - DNA, 21 bp, Artificial sequence
  SiRNA target sequence
aattcatacagctggaggtca

SEQ ID NO: 23405 - DNA, 21 bp, Artificial sequence
  SiRNA target sequence
attcatacagctggaggtcac

SEQ ID NO: 23406 - DNA, 21 bp, Artificial sequence
  SiRNA target sequence
ttcatacagctggaggtcacc

SEQ ID NO: 23407 - DNA, 21 bp, Artificial sequence
  SiRNA target sequence
tcatacagctggaggtcaccg

SEQ ID NO: 23408 - DNA, 21 bp, Artificial sequence
  SiRNA target sequence
catacagctggaggtcaccgt

SEQ ID NO: 23409 - DNA, 21 bp, Artificial sequence
  SiRNA target sequence
atacagctggaggtcaccgtt

SEQ ID NO: 23410 - DNA, 21 bp, Artificial sequence
  SiRNA target sequence
tacagctggaggtcaccgttt

SEQ ID NO: 23411 - DNA, 21 bp, Artificial sequence
  SiRNA target sequence
acagctggaggtcaccgtttt

SEQ ID NO: 23412 - DNA, 21 bp, Artificial sequence
  SiRNA target sequence
cagctggaggtcaccgttttg

SEQ ID NO: 23413 - DNA, 21 bp, Artificial sequence
  SiRNA target sequence
agctggaggtcaccgttttgg

SEQ ID NO: 23414 - DNA, 21 bp, Artificial sequence
  SiRNA target sequence
gctggaggtcaccgttttgga

SEQ ID NO: 23415 - DNA, 21 bp, Artificial sequence
  SiRNA target sequence
ctggaggtcaccgttttggag

SEQ ID NO: 23416 - DNA, 21 bp, Artificial sequence
  SiRNA target sequence
tggaggtcaccgttttggagt

SEQ ID NO: 23417 - DNA, 21 bp, Artificial sequence
  SiRNA target sequence
ggaggtcaccgttttggagtt

SEQ ID NO: 23418 - DNA, 21 bp, Artificial sequence
  SiRNA target sequence
gaggtcaccgttttggagttg

SEQ ID NO: 23419 - DNA, 21 bp, Artificial sequence
  SiRNA target sequence
aggtcaccgttttggagttgg

SEQ ID NO: 23420 - DNA, 21 bp, Artificial sequence
  SiRNA target sequence
ggtcaccgttttggagttggc

SEQ ID NO: 23421 - DNA, 21 bp, Artificial sequence
  SiRNA target sequence
gtcaccgttttggagttggca

SEQ ID NO: 23422 - DNA, 21 bp, Artificial sequence
  SiRNA target sequence
tcaccgttttggagttggcag

SEQ ID NO: 23423 - DNA, 21 bp, Artificial sequence
  SiRNA target sequence
caccgttttggagttggcagt

SEQ ID NO: 23424 - DNA, 21 bp, Artificial sequence
  SiRNA target sequence
accgttttggagttggcagtt

SEQ ID NO: 23425 - DNA, 21 bp, Artificial sequence
  SiRNA target sequence
ccgttttggagttggcagttg

SEQ ID NO: 23426 - DNA, 21 bp, Artificial sequence
  SiRNA target sequence
cgttttggagttggcagttgc

SEQ ID NO: 23427 - DNA, 21 bp, Artificial sequence
  SiRNA target sequence
gttttggagttggcagttgct

SEQ ID NO: 23428 - DNA, 21 bp, Artificial sequence
  SiRNA target sequence
ttttggagttggcagttgctt

SEQ ID NO: 23429 - DNA, 21 bp, Artificial sequence
  SiRNA target sequence
tttggagttggcagttgcttt

SEQ ID NO: 23430 - DNA, 21 bp, Artificial sequence
  SiRNA target sequence
ttggagttggcagttgctttg

SEQ ID NO: 23431 - DNA, 21 bp, Artificial sequence
  SiRNA target sequence
tggagttggcagttgctttgc

SEQ ID NO: 23432 - DNA, 21 bp, Artificial sequence
  SiRNA target sequence
ggagttggcagttgctttgcc

SEQ ID NO: 23433 - DNA, 21 bp, Artificial sequence
  SiRNA target sequence
gagttggcagttgctttgcca

SEQ ID NO: 23434 - DNA, 21 bp, Artificial sequence
  SiRNA target sequence
agttggcagttgctttgccac

SEQ ID NO: 23435 - DNA, 21 bp, Artificial sequence
  SiRNA target sequence
gttggcagttgctttgccact

SEQ ID NO: 23436 - DNA, 21 bp, Artificial sequence
  SiRNA target sequence
ttggcagttgctttgccactc

SEQ ID NO: 23437 - DNA, 21 bp, Artificial sequence
  SiRNA target sequence
tggcagttgctttgccactcc

SEQ ID NO: 23438 - DNA, 21 bp, Artificial sequence
  SiRNA target sequence
ggcagttgctttgccactccg

SEQ ID NO: 23439 - DNA, 21 bp, Artificial sequence
  SiRNA target sequence
gcagttgctttgccactccgt

SEQ ID NO: 23440 - DNA, 21 bp, Artificial sequence
  SiRNA target sequence
cagttgctttgccactccgtt

SEQ ID NO: 23441 - DNA, 21 bp, Artificial sequence
  SiRNA target sequence
agttgctttgccactccgttt

SEQ ID NO: 23442 - DNA, 21 bp, Artificial sequence
  SiRNA target sequence
gttgctttgccactccgtttt

SEQ ID NO: 23443 - DNA, 21 bp, Artificial sequence
  SiRNA target sequence
ttgctttgccactccgtttta

SEQ ID NO: 23444 - DNA, 21 bp, Artificial sequence
  SiRNA target sequence
tgctttgccactccgttttat

SEQ ID NO: 23445 - DNA, 21 bp, Artificial sequence
  SiRNA target sequence
gctttgccactccgttttata

SEQ ID NO: 23446 - DNA, 21 bp, Artificial sequence
  SiRNA target sequence
ctttgccactccgttttatat

SEQ ID NO: 23447 - DNA, 21 bp, Artificial sequence
  SiRNA target sequence
tttgccactccgttttatata

SEQ ID NO: 23448 - DNA, 21 bp, Artificial sequence
  SiRNA target sequence
ttgccactccgttttatatag

SEQ ID NO: 23449 - DNA, 21 bp, Artificial sequence
  SiRNA target sequence
tgccactccgttttatataga

SEQ ID NO: 23450 - DNA, 21 bp, Artificial sequence
  SiRNA target sequence
gccactccgttttatatagag

SEQ ID NO: 23451 - DNA, 21 bp, Artificial sequence
  SiRNA target sequence
ccactccgttttatatagagg

SEQ ID NO: 23452 - DNA, 21 bp, Artificial sequence
  SiRNA target sequence
cactccgttttatatagagga

SEQ ID NO: 23453 - DNA, 21 bp, Artificial sequence
  SiRNA target sequence
actccgttttatatagaggat

SEQ ID NO: 23454 - DNA, 21 bp, Artificial sequence
  SiRNA target sequence
ctccgttttatatagaggatg

SEQ ID NO: 23455 - DNA, 21 bp, Artificial sequence
  SiRNA target sequence
tccgttttatatagaggatgt

SEQ ID NO: 23456 - DNA, 21 bp, Artificial sequence
  SiRNA target sequence
ccgttttatatagaggatgtg

SEQ ID NO: 23457 - DNA, 21 bp, Artificial sequence
  SiRNA target sequence
cgttttatatagaggatgtga

SEQ ID NO: 23458 - DNA, 21 bp, Artificial sequence
  SiRNA target sequence
gttttatatagaggatgtgaa

SEQ ID NO: 23459 - DNA, 21 bp, Artificial sequence
  SiRNA target sequence
ttttatatagaggatgtgaaa

SEQ ID NO: 23460 - DNA, 21 bp, Artificial sequence
  SiRNA target sequence
tttatatagaggatgtgaaag

SEQ ID NO: 23461 - DNA, 21 bp, Artificial sequence
  SiRNA target sequence
ttatatagaggatgtgaaaga

SEQ ID NO: 23462 - DNA, 21 bp, Artificial sequence
  SiRNA target sequence
tatatagaggatgtgaaagag

SEQ ID NO: 23463 - DNA, 21 bp, Artificial sequence
  SiRNA target sequence
atatagaggatgtgaaagaga

SEQ ID NO: 23464 - DNA, 21 bp, Artificial sequence
  SiRNA target sequence
tatagaggatgtgaaagagat

SEQ ID NO: 23465 - DNA, 21 bp, Artificial sequence
  SiRNA target sequence
atagaggatgtgaaagagatc

SEQ ID NO: 23466 - DNA, 21 bp, Artificial sequence
  SiRNA target sequence
tagaggatgtgaaagagatct

SEQ ID NO: 23467 - DNA, 21 bp, Artificial sequence
  SiRNA target sequence
agaggatgtgaaagagatctt

SEQ ID NO: 23468 - DNA, 21 bp, Artificial sequence
  SiRNA target sequence
gaggatgtgaaagagatcttg

SEQ ID NO: 23469 - DNA, 21 bp, Artificial sequence
  SiRNA target sequence
aggatgtgaaagagatcttgt

SEQ ID NO: 23470 - DNA, 21 bp, Artificial sequence
  SiRNA target sequence
ggatgtgaaagagatcttgtc

SEQ ID NO: 23471 - DNA, 21 bp, Artificial sequence
  SiRNA target sequence
gatgtgaaagagatcttgtct

SEQ ID NO: 23472 - DNA, 21 bp, Artificial sequence
  SiRNA target sequence
atgtgaaagagatcttgtctc

SEQ ID NO: 23473 - DNA, 21 bp, Artificial sequence
  SiRNA target sequence
tgtgaaagagatcttgtctcg

SEQ ID NO: 23474 - DNA, 21 bp, Artificial sequence
  SiRNA target sequence
gtgaaagagatcttgtctcga

SEQ ID NO: 23475 - DNA, 21 bp, Artificial sequence
  SiRNA target sequence
tgaaagagatcttgtctcgat

SEQ ID NO: 23476 - DNA, 21 bp, Artificial sequence
  SiRNA target sequence
gaaagagatcttgtctcgata

SEQ ID NO: 23477 - DNA, 21 bp, Artificial sequence
  SiRNA target sequence
aaagagatcttgtctcgatat

SEQ ID NO: 23478 - DNA, 21 bp, Artificial sequence
  SiRNA target sequence
aagagatcttgtctcgatatg

SEQ ID NO: 23479 - DNA, 21 bp, Artificial sequence
  SiRNA target sequence
agagatcttgtctcgatatga

SEQ ID NO: 23480 - DNA, 21 bp, Artificial sequence
  SiRNA target sequence
gagatcttgtctcgatatgac

SEQ ID NO: 23481 - DNA, 21 bp, Artificial sequence
  SiRNA target sequence
agatcttgtctcgatatgact

SEQ ID NO: 23482 - DNA, 21 bp, Artificial sequence
  SiRNA target sequence
gatcttgtctcgatatgacta

SEQ ID NO: 23483 - DNA, 21 bp, Artificial sequence
  SiRNA target sequence
atcttgtctcgatatgactat

SEQ ID NO: 23484 - DNA, 21 bp, Artificial sequence
  SiRNA target sequence
tcttgtctcgatatgactata

SEQ ID NO: 23485 - DNA, 21 bp, Artificial sequence
  SiRNA target sequence
cttgtctcgatatgactataa

SEQ ID NO: 23486 - DNA, 21 bp, Artificial sequence
  SiRNA target sequence
ttgtctcgatatgactataaa

SEQ ID NO: 23487 - DNA, 21 bp, Artificial sequence
  SiRNA target sequence
tgtctcgatatgactataaag

SEQ ID NO: 23488 - DNA, 21 bp, Artificial sequence
  SiRNA target sequence
gtctcgatatgactataaagc

SEQ ID NO: 23489 - DNA, 21 bp, Artificial sequence
  SiRNA target sequence
tctcgatatgactataaagcg

SEQ ID NO: 23490 - DNA, 21 bp, Artificial sequence
  SiRNA target sequence
ctcgatatgactataaagcgc

SEQ ID NO: 23491 - DNA, 21 bp, Artificial sequence
  SiRNA target sequence
tcgatatgactataaagcgca

SEQ ID NO: 23492 - DNA, 21 bp, Artificial sequence
  SiRNA target sequence
cgatatgactataaagcgcaa

SEQ ID NO: 23493 - DNA, 21 bp, Artificial sequence
  SiRNA target sequence
gatatgactataaagcgcaat

SEQ ID NO: 23494 - DNA, 21 bp, Artificial sequence
  SiRNA target sequence
atatgactataaagcgcaatc

SEQ ID NO: 23495 - DNA, 21 bp, Artificial sequence
  SiRNA target sequence
tatgactataaagcgcaatct

SEQ ID NO: 23496 - DNA, 21 bp, Artificial sequence
  SiRNA target sequence
atgactataaagcgcaatctt

SEQ ID NO: 23497 - DNA, 21 bp, Artificial sequence
  SiRNA target sequence
tgactataaagcgcaatcttg

SEQ ID NO: 23498 - DNA, 21 bp, Artificial sequence
  SiRNA target sequence
gactataaagcgcaatcttgt

SEQ ID NO: 23499 - DNA, 21 bp, Artificial sequence
  SiRNA target sequence
actataaagcgcaatcttgtg

SEQ ID NO: 23500 - DNA, 21 bp, Artificial sequence
  SiRNA target sequence
ctataaagcgcaatcttgtgc

SEQ ID NO: 23501 - DNA, 21 bp, Artificial sequence
  SiRNA target sequence
tataaagcgcaatcttgtgct

SEQ ID NO: 23502 - DNA, 21 bp, Artificial sequence
  SiRNA target sequence
ataaagcgcaatcttgtgctt

SEQ ID NO: 23503 - DNA, 21 bp, Artificial sequence
  SiRNA target sequence
taaagcgcaatcttgtgcttt

SEQ ID NO: 23504 - DNA, 21 bp, Artificial sequence
  SiRNA target sequence
aaagcgcaatcttgtgctttt

SEQ ID NO: 23505 - DNA, 21 bp, Artificial sequence
  SiRNA target sequence
aagcgcaatcttgtgcttttg

SEQ ID NO: 23506 - DNA, 21 bp, Artificial sequence
  SiRNA target sequence
agcgcaatcttgtgcttttga

SEQ ID NO: 23507 - DNA, 21 bp, Artificial sequence
  SiRNA target sequence
gcgcaatcttgtgcttttgag

SEQ ID NO: 23508 - DNA, 21 bp, Artificial sequence
  SiRNA target sequence
cgcaatcttgtgcttttgagt

SEQ ID NO: 23509 - DNA, 21 bp, Artificial sequence
  SiRNA target sequence
gcaatcttgtgcttttgagtt

SEQ ID NO: 23510 - DNA, 21 bp, Artificial sequence
  SiRNA target sequence
caatcttgtgcttttgagtta

SEQ ID NO: 23511 - DNA, 21 bp, Artificial sequence
  SiRNA target sequence
aatcttgtgcttttgagttag

SEQ ID NO: 23512 - DNA, 21 bp, Artificial sequence
  SiRNA target sequence
atcttgtgcttttgagttagt

SEQ ID NO: 23513 - DNA, 21 bp, Artificial sequence
  SiRNA target sequence
tcttgtgcttttgagttagtg

SEQ ID NO: 23514 - DNA, 21 bp, Artificial sequence
  SiRNA target sequence
cttgtgcttttgagttagtgt

SEQ ID NO: 23515 - DNA, 21 bp, Artificial sequence
  SiRNA target sequence
ttgtgcttttgagttagtgtt

SEQ ID NO: 23516 - DNA, 21 bp, Artificial sequence
  SiRNA target sequence
tgtgcttttgagttagtgttg

SEQ ID NO: 23517 - DNA, 21 bp, Artificial sequence
  SiRNA target sequence
gtgcttttgagttagtgttgc

SEQ ID NO: 23518 - DNA, 21 bp, Artificial sequence
  SiRNA target sequence
tgcttttgagttagtgttgcg

SEQ ID NO: 23519 - DNA, 21 bp, Artificial sequence
  SiRNA target sequence
gcttttgagttagtgttgcga

SEQ ID NO: 23520 - DNA, 21 bp, Artificial sequence
  SiRNA target sequence
cttttgagttagtgttgcgac

SEQ ID NO: 23521 - DNA, 21 bp, Artificial sequence
  SiRNA target sequence
ttttgagttagtgttgcgaca

SEQ ID NO: 23522 - DNA, 21 bp, Artificial sequence
  SiRNA target sequence
tttgagttagtgttgcgacag

SEQ ID NO: 23523 - DNA, 21 bp, Artificial sequence
  SiRNA target sequence
ttgagttagtgttgcgacagg

SEQ ID NO: 23524 - DNA, 21 bp, Artificial sequence
  SiRNA target sequence
tgagttagtgttgcgacagga

SEQ ID NO: 23525 - DNA, 21 bp, Artificial sequence
  SiRNA target sequence
gagttagtgttgcgacaggat

SEQ ID NO: 23526 - DNA, 21 bp, Artificial sequence
  SiRNA target sequence
agttagtgttgcgacaggatc

SEQ ID NO: 23527 - DNA, 21 bp, Artificial sequence
  SiRNA target sequence
gttagtgttgcgacaggatct

SEQ ID NO: 23528 - DNA, 21 bp, Artificial sequence
  SiRNA target sequence
ttagtgttgcgacaggatctc

SEQ ID NO: 23529 - DNA, 21 bp, Artificial sequence
  SiRNA target sequence
tagtgttgcgacaggatctcg

SEQ ID NO: 23530 - DNA, 21 bp, Artificial sequence
  SiRNA target sequence
agtgttgcgacaggatctcga

SEQ ID NO: 23531 - DNA, 21 bp, Artificial sequence
  SiRNA target sequence
gtgttgcgacaggatctcgaa

SEQ ID NO: 23532 - DNA, 21 bp, Artificial sequence
  SiRNA target sequence
tgttgcgacaggatctcgaac

SEQ ID NO: 23533 - DNA, 21 bp, Artificial sequence
  SiRNA target sequence
gttgcgacaggatctcgaacc

SEQ ID NO: 23534 - DNA, 21 bp, Artificial sequence
  SiRNA target sequence
ttgcgacaggatctcgaacca

SEQ ID NO: 23535 - DNA, 21 bp, Artificial sequence
  SiRNA target sequence
tgcgacaggatctcgaaccat

SEQ ID NO: 23536 - DNA, 21 bp, Artificial sequence
  SiRNA target sequence
gcgacaggatctcgaaccatg

SEQ ID NO: 23537 - DNA, 21 bp, Artificial sequence
  SiRNA target sequence
cgacaggatctcgaaccatgt

SEQ ID NO: 23538 - DNA, 21 bp, Artificial sequence
  SiRNA target sequence
gacaggatctcgaaccatgtg

SEQ ID NO: 23539 - DNA, 21 bp, Artificial sequence
  SiRNA target sequence
acaggatctcgaaccatgtgc

SEQ ID NO: 23540 - DNA, 21 bp, Artificial sequence
  SiRNA target sequence
caggatctcgaaccatgtgct

SEQ ID NO: 23541 - DNA, 21 bp, Artificial sequence
  SiRNA target sequence
aggatctcgaaccatgtgctt

SEQ ID NO: 23542 - DNA, 21 bp, Artificial sequence
  SiRNA target sequence
ggatctcgaaccatgtgcttt

SEQ ID NO: 23543 - DNA, 21 bp, Artificial sequence
  SiRNA target sequence
gatctcgaaccatgtgcttta

SEQ ID NO: 23544 - DNA, 21 bp, Artificial sequence
  SiRNA target sequence
atctcgaaccatgtgctttac

SEQ ID NO: 23545 - DNA, 21 bp, Artificial sequence
  SiRNA target sequence
tctcgaaccatgtgctttacc

SEQ ID NO: 23546 - DNA, 21 bp, Artificial sequence
  SiRNA target sequence
ctcgaaccatgtgctttacct

SEQ ID NO: 23547 - DNA, 21 bp, Artificial sequence
  SiRNA target sequence
tcgaaccatgtgctttaccta

SEQ ID NO: 23548 - DNA, 21 bp, Artificial sequence
  SiRNA target sequence
cgaaccatgtgctttacctaa

SEQ ID NO: 23549 - DNA, 21 bp, Artificial sequence
  SiRNA target sequence
gaaccatgtgctttacctaac

SEQ ID NO: 23550 - DNA, 21 bp, Artificial sequence
  SiRNA target sequence
aaccatgtgctttacctaacc

SEQ ID NO: 23551 - DNA, 21 bp, Artificial sequence
  SiRNA target sequence
accatgtgctttacctaacca

SEQ ID NO: 23552 - DNA, 21 bp, Artificial sequence
  SiRNA target sequence
ccatgtgctttacctaaccat

SEQ ID NO: 23553 - DNA, 21 bp, Artificial sequence
  SiRNA target sequence
catgtgctttacctaaccatt

SEQ ID NO: 23554 - DNA, 21 bp, Artificial sequence
  SiRNA target sequence
atgtgctttacctaaccattt

SEQ ID NO: 23555 - DNA, 21 bp, Artificial sequence
  SiRNA target sequence
tgtgctttacctaaccattta

SEQ ID NO: 23556 - DNA, 21 bp, Artificial sequence
  SiRNA target sequence
gtgctttacctaaccatttag

SEQ ID NO: 23557 - DNA, 21 bp, Artificial sequence
  SiRNA target sequence
tgctttacctaaccatttaga

SEQ ID NO: 23558 - DNA, 21 bp, Artificial sequence
  SiRNA target sequence
gctttacctaaccatttagat

SEQ ID NO: 23559 - DNA, 21 bp, Artificial sequence
  SiRNA target sequence
ctttacctaaccatttagatg

SEQ ID NO: 23560 - DNA, 21 bp, Artificial sequence
  SiRNA target sequence
tttacctaaccatttagatga

SEQ ID NO: 23561 - DNA, 21 bp, Artificial sequence
  SiRNA target sequence
ttacctaaccatttagatgaa

SEQ ID NO: 23562 - DNA, 21 bp, Artificial sequence
  SiRNA target sequence
tacctaaccatttagatgaat

SEQ ID NO: 23563 - DNA, 21 bp, Artificial sequence
  SiRNA target sequence
acctaaccatttagatgaatg

SEQ ID NO: 23564 - DNA, 21 bp, Artificial sequence
  SiRNA target sequence
cctaaccatttagatgaatgt

SEQ ID NO: 23565 - DNA, 21 bp, Artificial sequence
  SiRNA target sequence
ctaaccatttagatgaatgtg

SEQ ID NO: 23566 - DNA, 21 bp, Artificial sequence
  SiRNA target sequence
taaccatttagatgaatgtga

SEQ ID NO: 23567 - DNA, 21 bp, Artificial sequence
  SiRNA target sequence
aaccatttagatgaatgtgag

SEQ ID NO: 23568 - DNA, 21 bp, Artificial sequence
  SiRNA target sequence
accatttagatgaatgtgagt

SEQ ID NO: 23569 - DNA, 21 bp, Artificial sequence
  SiRNA target sequence
ccatttagatgaatgtgagtt

SEQ ID NO: 23570 - DNA, 21 bp, Artificial sequence
  SiRNA target sequence
catttagatgaatgtgagttc

SEQ ID NO: 23571 - DNA, 21 bp, Artificial sequence
  SiRNA target sequence
atttagatgaatgtgagttca

SEQ ID NO: 23572 - DNA, 21 bp, Artificial sequence
  SiRNA target sequence
tttagatgaatgtgagttcat

SEQ ID NO: 23573 - DNA, 21 bp, Artificial sequence
  SiRNA target sequence
ttagatgaatgtgagttcatc

SEQ ID NO: 23574 - DNA, 21 bp, Artificial sequence
  SiRNA target sequence
tagatgaatgtgagttcatct

SEQ ID NO: 23575 - DNA, 21 bp, Artificial sequence
  SiRNA target sequence
agatgaatgtgagttcatctt

SEQ ID NO: 23576 - DNA, 21 bp, Artificial sequence
  SiRNA target sequence
gatgaatgtgagttcatctta

SEQ ID NO: 23577 - DNA, 21 bp, Artificial sequence
  SiRNA target sequence
atgaatgtgagttcatcttaa

SEQ ID NO: 23578 - DNA, 21 bp, Artificial sequence
  SiRNA target sequence
tgaatgtgagttcatcttaat

SEQ ID NO: 23579 - DNA, 21 bp, Artificial sequence
  SiRNA target sequence
gaatgtgagttcatcttaatg

SEQ ID NO: 23580 - DNA, 21 bp, Artificial sequence
  SiRNA target sequence
aatgtgagttcatcttaatgg

SEQ ID NO: 23581 - DNA, 21 bp, Artificial sequence
  SiRNA target sequence
atgtgagttcatcttaatggg

SEQ ID NO: 23582 - DNA, 21 bp, Artificial sequence
  SiRNA target sequence
tgtgagttcatcttaatgggg

SEQ ID NO: 23583 - DNA, 21 bp, Artificial sequence
  SiRNA target sequence
gtgagttcatcttaatgggga

SEQ ID NO: 23584 - DNA, 21 bp, Artificial sequence
  SiRNA target sequence
tgagttcatcttaatggggaa

SEQ ID NO: 23585 - DNA, 21 bp, Artificial sequence
  SiRNA target sequence
gagttcatcttaatggggaag

SEQ ID NO: 23586 - DNA, 21 bp, Artificial sequence
  SiRNA target sequence
agttcatcttaatggggaagg

SEQ ID NO: 23587 - DNA, 21 bp, Artificial sequence
  SiRNA target sequence
gttcatcttaatggggaaggt

SEQ ID NO: 23588 - DNA, 21 bp, Artificial sequence
  SiRNA target sequence
ttcatcttaatggggaaggtt

SEQ ID NO: 23589 - DNA, 21 bp, Artificial sequence
  SiRNA target sequence
tcatcttaatggggaaggtta

SEQ ID NO: 23590 - DNA, 21 bp, Artificial sequence
  SiRNA target sequence
catcttaatggggaaggttaa

SEQ ID NO: 23591 - DNA, 21 bp, Artificial sequence
  SiRNA target sequence
atcttaatggggaaggttaag

SEQ ID NO: 23592 - DNA, 21 bp, Artificial sequence
  SiRNA target sequence
tcttaatggggaaggttaagg

SEQ ID NO: 23593 - DNA, 21 bp, Artificial sequence
  SiRNA target sequence
cttaatggggaaggttaagga

SEQ ID NO: 23594 - DNA, 21 bp, Artificial sequence
  SiRNA target sequence
ttaatggggaaggttaaggat

SEQ ID NO: 23595 - DNA, 21 bp, Artificial sequence
  SiRNA target sequence
taatggggaaggttaaggatc

SEQ ID NO: 23596 - DNA, 21 bp, Artificial sequence
  SiRNA target sequence
aatggggaaggttaaggatcc

SEQ ID NO: 23597 - DNA, 21 bp, Artificial sequence
  SiRNA target sequence
atggggaaggttaaggatccc

SEQ ID NO: 23598 - DNA, 21 bp, Artificial sequence
  SiRNA target sequence
tggggaaggttaaggatcccc

SEQ ID NO: 23599 - DNA, 21 bp, Artificial sequence
  SiRNA target sequence
ggggaaggttaaggatccccc

SEQ ID NO: 23600 - DNA, 21 bp, Artificial sequence
  SiRNA target sequence
gggaaggttaaggatccccca

SEQ ID NO: 23601 - DNA, 21 bp, Artificial sequence
  SiRNA target sequence
ggaaggttaaggatcccccag

SEQ ID NO: 23602 - DNA, 21 bp, Artificial sequence
  SiRNA target sequence
gaaggttaaggatcccccagt

SEQ ID NO: 23603 - DNA, 21 bp, Artificial sequence
  SiRNA target sequence
aaggttaaggatcccccagtt

SEQ ID NO: 23604 - DNA, 21 bp, Artificial sequence
  SiRNA target sequence
aggttaaggatcccccagttc

SEQ ID NO: 23605 - DNA, 21 bp, Artificial sequence
  SiRNA target sequence
ggttaaggatcccccagttca

SEQ ID NO: 23606 - DNA, 21 bp, Artificial sequence
  SiRNA target sequence
gttaaggatcccccagttcaa

SEQ ID NO: 23607 - DNA, 21 bp, Artificial sequence
  SiRNA target sequence
ttaaggatcccccagttcaac

SEQ ID NO: 23608 - DNA, 21 bp, Artificial sequence
  SiRNA target sequence
taaggatcccccagttcaacc

SEQ ID NO: 23609 - DNA, 21 bp, Artificial sequence
  SiRNA target sequence
aaggatcccccagttcaacca

SEQ ID NO: 23610 - DNA, 21 bp, Artificial sequence
  SiRNA target sequence
aggatcccccagttcaaccat

SEQ ID NO: 23611 - DNA, 21 bp, Artificial sequence
  SiRNA target sequence
ggatcccccagttcaaccatc

SEQ ID NO: 23612 - DNA, 21 bp, Artificial sequence
  SiRNA target sequence
gatcccccagttcaaccatct

SEQ ID NO: 23613 - DNA, 21 bp, Artificial sequence
  SiRNA target sequence
atcccccagttcaaccatcta

SEQ ID NO: 23614 - DNA, 21 bp, Artificial sequence
  SiRNA target sequence
tcccccagttcaaccatctag

SEQ ID NO: 23615 - DNA, 21 bp, Artificial sequence
  SiRNA target sequence
cccccagttcaaccatctaga

SEQ ID NO: 23616 - DNA, 21 bp, Artificial sequence
  SiRNA target sequence
ccccagttcaaccatctagaa

SEQ ID NO: 23617 - DNA, 21 bp, Artificial sequence
  SiRNA target sequence
cccagttcaaccatctagaag

SEQ ID NO: 23618 - DNA, 21 bp, Artificial sequence
  SiRNA target sequence
ccagttcaaccatctagaagt

SEQ ID NO: 23619 - DNA, 21 bp, Artificial sequence
  SiRNA target sequence
cagttcaaccatctagaagta

SEQ ID NO: 23620 - DNA, 21 bp, Artificial sequence
  SiRNA target sequence
agttcaaccatctagaagtaa

SEQ ID NO: 23621 - DNA, 21 bp, Artificial sequence
  SiRNA target sequence
gttcaaccatctagaagtaaa

SEQ ID NO: 23622 - DNA, 21 bp, Artificial sequence
  SiRNA target sequence
ttcaaccatctagaagtaaaa

SEQ ID NO: 23623 - DNA, 21 bp, Artificial sequence
  SiRNA target sequence
tcaaccatctagaagtaaaat

SEQ ID NO: 23624 - DNA, 21 bp, Artificial sequence
  SiRNA target sequence
caaccatctagaagtaaaatt

SEQ ID NO: 23625 - DNA, 21 bp, Artificial sequence
  SiRNA target sequence
aaccatctagaagtaaaattt

SEQ ID NO: 23626 - DNA, 21 bp, Artificial sequence
  SiRNA target sequence
accatctagaagtaaaatttc

SEQ ID NO: 23627 - DNA, 21 bp, Artificial sequence
  SiRNA target sequence
ccatctagaagtaaaatttct

SEQ ID NO: 23628 - DNA, 21 bp, Artificial sequence
  SiRNA target sequence
catctagaagtaaaatttctc

SEQ ID NO: 23629 - DNA, 21 bp, Artificial sequence
  SiRNA target sequence
atctagaagtaaaatttctcc

SEQ ID NO: 23630 - DNA, 21 bp, Artificial sequence
  SiRNA target sequence
tctagaagtaaaatttctcca

SEQ ID NO: 23631 - DNA, 21 bp, Artificial sequence
  SiRNA target sequence
ctagaagtaaaatttctccat

SEQ ID NO: 23632 - DNA, 21 bp, Artificial sequence
  SiRNA target sequence
tagaagtaaaatttctccatc

SEQ ID NO: 23633 - DNA, 21 bp, Artificial sequence
  SiRNA target sequence
agaagtaaaatttctccatct

SEQ ID NO: 23634 - DNA, 21 bp, Artificial sequence
  SiRNA target sequence
gaagtaaaatttctccatctc

SEQ ID NO: 23635 - DNA, 21 bp, Artificial sequence
  SiRNA target sequence
aagtaaaatttctccatctcc

SEQ ID NO: 23636 - DNA, 21 bp, Artificial sequence
  SiRNA target sequence
agtaaaatttctccatctccc

SEQ ID NO: 23637 - DNA, 21 bp, Artificial sequence
  SiRNA target sequence
gtaaaatttctccatctccct

SEQ ID NO: 23638 - DNA, 21 bp, Artificial sequence
  SiRNA target sequence
taaaatttctccatctccctt

SEQ ID NO: 23639 - DNA, 21 bp, Artificial sequence
  SiRNA target sequence
aaaatttctccatctccctta

SEQ ID NO: 23640 - DNA, 21 bp, Artificial sequence
  SiRNA target sequence
aaatttctccatctcccttat

SEQ ID NO: 23641 - DNA, 21 bp, Artificial sequence
  SiRNA target sequence
aatttctccatctcccttata

SEQ ID NO: 23642 - DNA, 21 bp, Artificial sequence
  SiRNA target sequence
atttctccatctcccttatac

SEQ ID NO: 23643 - DNA, 21 bp, Artificial sequence
  SiRNA target sequence
tttctccatctcccttatacg

SEQ ID NO: 23644 - DNA, 21 bp, Artificial sequence
  SiRNA target sequence
ttctccatctcccttatacgg

SEQ ID NO: 23645 - DNA, 21 bp, Artificial sequence
  SiRNA target sequence
tctccatctcccttatacgga

SEQ ID NO: 23646 - DNA, 21 bp, Artificial sequence
  SiRNA target sequence
ctccatctcccttatacggac

SEQ ID NO: 23647 - DNA, 21 bp, Artificial sequence
  SiRNA target sequence
tccatctcccttatacggaca

SEQ ID NO: 23648 - DNA, 21 bp, Artificial sequence
  SiRNA target sequence
ccatctcccttatacggacac

SEQ ID NO: 23649 - DNA, 21 bp, Artificial sequence
  SiRNA target sequence
catctcccttatacggacaca

SEQ ID NO: 23650 - DNA, 21 bp, Artificial sequence
  SiRNA target sequence
atctcccttatacggacacat

SEQ ID NO: 23651 - DNA, 21 bp, Artificial sequence
  SiRNA target sequence
tctcccttatacggacacata

SEQ ID NO: 23652 - DNA, 21 bp, Artificial sequence
  SiRNA target sequence
ctcccttatacggacacataa

SEQ ID NO: 23653 - DNA, 21 bp, Artificial sequence
  SiRNA target sequence
tcccttatacggacacataac

SEQ ID NO: 23654 - DNA, 21 bp, Artificial sequence
  SiRNA target sequence
cccttatacggacacataact

SEQ ID NO: 23655 - DNA, 21 bp, Artificial sequence
  SiRNA target sequence
ccttatacggacacataactg

SEQ ID NO: 23656 - DNA, 21 bp, Artificial sequence
  SiRNA target sequence
cttatacggacacataactga

SEQ ID NO: 23657 - DNA, 21 bp, Artificial sequence
  SiRNA target sequence
ttatacggacacataactgaa

SEQ ID NO: 23658 - DNA, 21 bp, Artificial sequence
  SiRNA target sequence
tatacggacacataactgaac

SEQ ID NO: 23659 - DNA, 21 bp, Artificial sequence
  SiRNA target sequence
atacggacacataactgaacc

SEQ ID NO: 23660 - DNA, 21 bp, Artificial sequence
  SiRNA target sequence
tacggacacataactgaaccc

SEQ ID NO: 23661 - DNA, 21 bp, Artificial sequence
  SiRNA target sequence
acggacacataactgaaccct

SEQ ID NO: 23662 - DNA, 21 bp, Artificial sequence
  SiRNA target sequence
cggacacataactgaaccctc

SEQ ID NO: 23663 - DNA, 21 bp, Artificial sequence
  SiRNA target sequence
ggacacataactgaaccctct

SEQ ID NO: 23664 - DNA, 21 bp, Artificial sequence
  SiRNA target sequence
gacacataactgaaccctcta

SEQ ID NO: 23665 - DNA, 21 bp, Artificial sequence
  SiRNA target sequence
acacataactgaaccctctag

SEQ ID NO: 23666 - DNA, 21 bp, Artificial sequence
  SiRNA target sequence
cacataactgaaccctctagt

SEQ ID NO: 23667 - DNA, 21 bp, Artificial sequence
  SiRNA target sequence
acataactgaaccctctagtg

SEQ ID NO: 23668 - DNA, 21 bp, Artificial sequence
  SiRNA target sequence
cataactgaaccctctagtgc

SEQ ID NO: 23669 - DNA, 21 bp, Artificial sequence
  SiRNA target sequence
ataactgaaccctctagtgcc

SEQ ID NO: 23670 - DNA, 21 bp, Artificial sequence
  SiRNA target sequence
taactgaaccctctagtgccc

SEQ ID NO: 23671 - DNA, 21 bp, Artificial sequence
  SiRNA target sequence
aactgaaccctctagtgcccc

SEQ ID NO: 23672 - DNA, 21 bp, Artificial sequence
  SiRNA target sequence
actgaaccctctagtgcccct

SEQ ID NO: 23673 - DNA, 21 bp, Artificial sequence
  SiRNA target sequence
ctgaaccctctagtgccccta

SEQ ID NO: 23674 - DNA, 21 bp, Artificial sequence
  SiRNA target sequence
tgaaccctctagtgcccctac

SEQ ID NO: 23675 - DNA, 21 bp, Artificial sequence
  SiRNA target sequence
gaaccctctagtgcccctact

SEQ ID NO: 23676 - DNA, 21 bp, Artificial sequence
  SiRNA target sequence
aaccctctagtgcccctactt

SEQ ID NO: 23677 - DNA, 21 bp, Artificial sequence
  SiRNA target sequence
accctctagtgcccctacttg

SEQ ID NO: 23678 - DNA, 21 bp, Artificial sequence
  SiRNA target sequence
ccctctagtgcccctacttgg

SEQ ID NO: 23679 - DNA, 21 bp, Artificial sequence
  SiRNA target sequence
cctctagtgcccctacttggt

SEQ ID NO: 23680 - DNA, 21 bp, Artificial sequence
  SiRNA target sequence
ctctagtgcccctacttggtt

SEQ ID NO: 23681 - DNA, 21 bp, Artificial sequence
  SiRNA target sequence
tctagtgcccctacttggtta

SEQ ID NO: 23682 - DNA, 21 bp, Artificial sequence
  SiRNA target sequence
ctagtgcccctacttggttat

SEQ ID NO: 23683 - DNA, 21 bp, Artificial sequence
  SiRNA target sequence
tagtgcccctacttggttata

SEQ ID NO: 23684 - DNA, 21 bp, Artificial sequence
  SiRNA target sequence
agtgcccctacttggttatat

SEQ ID NO: 23685 - DNA, 21 bp, Artificial sequence
  SiRNA target sequence
gtgcccctacttggttatatc

SEQ ID NO: 23686 - DNA, 21 bp, Artificial sequence
  SiRNA target sequence
tgcccctacttggttatatcc

SEQ ID NO: 23687 - DNA, 21 bp, Artificial sequence
  SiRNA target sequence
gcccctacttggttatatcct

SEQ ID NO: 23688 - DNA, 21 bp, Artificial sequence
  SiRNA target sequence
cccctacttggttatatccta

SEQ ID NO: 23689 - DNA, 21 bp, Artificial sequence
  SiRNA target sequence
ccctacttggttatatcctag

SEQ ID NO: 23690 - DNA, 21 bp, Artificial sequence
  SiRNA target sequence
cctacttggttatatcctaga

SEQ ID NO: 23691 - DNA, 21 bp, Artificial sequence
  SiRNA target sequence
ctacttggttatatcctagag

SEQ ID NO: 23692 - DNA, 21 bp, Artificial sequence
  SiRNA target sequence
tacttggttatatcctagaga

SEQ ID NO: 23693 - DNA, 21 bp, Artificial sequence
  SiRNA target sequence
acttggttatatcctagagag

SEQ ID NO: 23694 - DNA, 21 bp, Artificial sequence
  SiRNA target sequence
cttggttatatcctagagagc

SEQ ID NO: 23695 - DNA, 21 bp, Artificial sequence
  SiRNA target sequence
ttggttatatcctagagagct

SEQ ID NO: 23696 - DNA, 21 bp, Artificial sequence
  SiRNA target sequence
tggttatatcctagagagctt

SEQ ID NO: 23697 - DNA, 21 bp, Artificial sequence
  SiRNA target sequence
ggttatatcctagagagcttg

SEQ ID NO: 23698 - DNA, 21 bp, Artificial sequence
  SiRNA target sequence
gttatatcctagagagcttga

SEQ ID NO: 23699 - DNA, 21 bp, Artificial sequence
  SiRNA target sequence
ttatatcctagagagcttgat

SEQ ID NO: 23700 - DNA, 21 bp, Artificial sequence
  SiRNA target sequence
tatatcctagagagcttgatg

SEQ ID NO: 23701 - DNA, 21 bp, Artificial sequence
  SiRNA target sequence
atatcctagagagcttgatgg

SEQ ID NO: 23702 - DNA, 21 bp, Artificial sequence
  SiRNA target sequence
tatcctagagagcttgatgga

SEQ ID NO: 23703 - DNA, 21 bp, Artificial sequence
  SiRNA target sequence
atcctagagagcttgatggac

SEQ ID NO: 23704 - DNA, 21 bp, Artificial sequence
  SiRNA target sequence
tcctagagagcttgatggaca

SEQ ID NO: 23705 - DNA, 21 bp, Artificial sequence
  SiRNA target sequence
cctagagagcttgatggacag

SEQ ID NO: 23706 - DNA, 21 bp, Artificial sequence
  SiRNA target sequence
ctagagagcttgatggacaga

SEQ ID NO: 23707 - DNA, 21 bp, Artificial sequence
  SiRNA target sequence
tagagagcttgatggacagat

SEQ ID NO: 23708 - DNA, 21 bp, Artificial sequence
  SiRNA target sequence
agagagcttgatggacagatt

SEQ ID NO: 23709 - DNA, 21 bp, Artificial sequence
  SiRNA target sequence
gagagcttgatggacagattt

SEQ ID NO: 23710 - DNA, 21 bp, Artificial sequence
  SiRNA target sequence
agagcttgatggacagatttt

SEQ ID NO: 23711 - DNA, 21 bp, Artificial sequence
  SiRNA target sequence
gagcttgatggacagattttt

SEQ ID NO: 23712 - DNA, 21 bp, Artificial sequence
  SiRNA target sequence
agcttgatggacagatttttg

SEQ ID NO: 23713 - DNA, 21 bp, Artificial sequence
  SiRNA target sequence
gcttgatggacagatttttga

SEQ ID NO: 23714 - DNA, 21 bp, Artificial sequence
  SiRNA target sequence
cttgatggacagatttttgac

SEQ ID NO: 23715 - DNA, 21 bp, Artificial sequence
  SiRNA target sequence
ttgatggacagatttttgacc

SEQ ID NO: 23716 - DNA, 21 bp, Artificial sequence
  SiRNA target sequence
tgatggacagatttttgaccc

SEQ ID NO: 23717 - DNA, 21 bp, Artificial sequence
  SiRNA target sequence
gatggacagatttttgaccct

SEQ ID NO: 23718 - DNA, 21 bp, Artificial sequence
  SiRNA target sequence
atggacagatttttgaccctc

SEQ ID NO: 23719 - DNA, 21 bp, Artificial sequence
  SiRNA target sequence
tggacagatttttgaccctct

SEQ ID NO: 23720 - DNA, 21 bp, Artificial sequence
  SiRNA target sequence
ggacagatttttgaccctcta

SEQ ID NO: 23721 - DNA, 21 bp, Artificial sequence
  SiRNA target sequence
gacagatttttgaccctctaa

SEQ ID NO: 23722 - DNA, 21 bp, Artificial sequence
  SiRNA target sequence
acagatttttgaccctctaaa

SEQ ID NO: 23723 - DNA, 21 bp, Artificial sequence
  SiRNA target sequence
cagatttttgaccctctaaaa

SEQ ID NO: 23724 - DNA, 21 bp, Artificial sequence
  SiRNA target sequence
agatttttgaccctctaaaat

SEQ ID NO: 23725 - DNA, 21 bp, Artificial sequence
  SiRNA target sequence
gatttttgaccctctaaaata

SEQ ID NO: 23726 - DNA, 21 bp, Artificial sequence
  SiRNA target sequence
atttttgaccctctaaaatat

SEQ ID NO: 23727 - DNA, 21 bp, Artificial sequence
  SiRNA target sequence
tttttgaccctctaaaatata

SEQ ID NO: 23728 - DNA, 21 bp, Artificial sequence
  SiRNA target sequence
ttttgaccctctaaaatatag

SEQ ID NO: 23729 - DNA, 21 bp, Artificial sequence
  SiRNA target sequence
tttgaccctctaaaatatagg

SEQ ID NO: 23730 - DNA, 21 bp, Artificial sequence
  SiRNA target sequence
ttgaccctctaaaatatagga

SEQ ID NO: 23731 - DNA, 21 bp, Artificial sequence
  SiRNA target sequence
tgaccctctaaaatataggac

SEQ ID NO: 23732 - DNA, 21 bp, Artificial sequence
  SiRNA target sequence
gaccctctaaaatataggact

SEQ ID NO: 23733 - DNA, 21 bp, Artificial sequence
  SiRNA target sequence
accctctaaaatataggactg

SEQ ID NO: 23734 - DNA, 21 bp, Artificial sequence
  SiRNA target sequence
ccctctaaaatataggactgc

SEQ ID NO: 23735 - DNA, 21 bp, Artificial sequence
  SiRNA target sequence
cctctaaaatataggactgct

SEQ ID NO: 23736 - DNA, 21 bp, Artificial sequence
  SiRNA target sequence
ctctaaaatataggactgcta

SEQ ID NO: 23737 - DNA, 21 bp, Artificial sequence
  SiRNA target sequence
tctaaaatataggactgctag

SEQ ID NO: 23738 - DNA, 21 bp, Artificial sequence
  SiRNA target sequence
ctaaaatataggactgctaga

SEQ ID NO: 23739 - DNA, 21 bp, Artificial sequence
  SiRNA target sequence
taaaatataggactgctagac

SEQ ID NO: 23740 - DNA, 21 bp, Artificial sequence
  SiRNA target sequence
aaaatataggactgctagact

SEQ ID NO: 23741 - DNA, 21 bp, Artificial sequence
  SiRNA target sequence
aaatataggactgctagactc

SEQ ID NO: 23742 - DNA, 21 bp, Artificial sequence
  SiRNA target sequence
aatataggactgctagactcg

SEQ ID NO: 23743 - DNA, 21 bp, Artificial sequence
  SiRNA target sequence
atataggactgctagactcgg

SEQ ID NO: 23744 - DNA, 21 bp, Artificial sequence
  SiRNA target sequence
tataggactgctagactcgga

SEQ ID NO: 23745 - DNA, 21 bp, Artificial sequence
  SiRNA target sequence
ataggactgctagactcggaa

SEQ ID NO: 23746 - DNA, 21 bp, Artificial sequence
  SiRNA target sequence
taggactgctagactcggaaa

SEQ ID NO: 23747 - DNA, 21 bp, Artificial sequence
  SiRNA target sequence
aggactgctagactcggaaaa

SEQ ID NO: 23748 - DNA, 21 bp, Artificial sequence
  SiRNA target sequence
ggactgctagactcggaaaag

SEQ ID NO: 23749 - DNA, 21 bp, Artificial sequence
  SiRNA target sequence
gactgctagactcggaaaaga

SEQ ID NO: 23750 - DNA, 21 bp, Artificial sequence
  SiRNA target sequence
actgctagactcggaaaagat

SEQ ID NO: 23751 - DNA, 21 bp, Artificial sequence
  SiRNA target sequence
ctgctagactcggaaaagata

SEQ ID NO: 23752 - DNA, 21 bp, Artificial sequence
  SiRNA target sequence
tgctagactcggaaaagatag

SEQ ID NO: 23753 - DNA, 21 bp, Artificial sequence
  SiRNA target sequence
gctagactcggaaaagatagt

SEQ ID NO: 23754 - DNA, 21 bp, Artificial sequence
  SiRNA target sequence
ctagactcggaaaagatagtg

SEQ ID NO: 23755 - DNA, 21 bp, Artificial sequence
  SiRNA target sequence
tagactcggaaaagatagtgt

SEQ ID NO: 23756 - DNA, 21 bp, Artificial sequence
  SiRNA target sequence
agactcggaaaagatagtgtt

SEQ ID NO: 23757 - DNA, 21 bp, Artificial sequence
  SiRNA target sequence
gactcggaaaagatagtgttc

SEQ ID NO: 23758 - DNA, 21 bp, Artificial sequence
  SiRNA target sequence
actcggaaaagatagtgttcc

SEQ ID NO: 23759 - DNA, 21 bp, Artificial sequence
  SiRNA target sequence
ctcggaaaagatagtgttcct

SEQ ID NO: 23760 - DNA, 21 bp, Artificial sequence
  SiRNA target sequence
tcggaaaagatagtgttccta

SEQ ID NO: 23761 - DNA, 21 bp, Artificial sequence
  SiRNA target sequence
cggaaaagatagtgttcctat

SEQ ID NO: 23762 - DNA, 21 bp, Artificial sequence
  SiRNA target sequence
ggaaaagatagtgttcctatt

SEQ ID NO: 23763 - DNA, 21 bp, Artificial sequence
  SiRNA target sequence
gaaaagatagtgttcctatta

SEQ ID NO: 23764 - DNA, 21 bp, Artificial sequence
  SiRNA target sequence
aaaagatagtgttcctattag

SEQ ID NO: 23765 - DNA, 21 bp, Artificial sequence
  SiRNA target sequence
aaagatagtgttcctattagg

SEQ ID NO: 23766 - DNA, 21 bp, Artificial sequence
  SiRNA target sequence
aagatagtgttcctattagga

SEQ ID NO: 23767 - DNA, 21 bp, Artificial sequence
  SiRNA target sequence
agatagtgttcctattaggag

SEQ ID NO: 23768 - DNA, 21 bp, Artificial sequence
  SiRNA target sequence
gatagtgttcctattaggagt

SEQ ID NO: 23769 - DNA, 21 bp, Artificial sequence
  SiRNA target sequence
atagtgttcctattaggagta

SEQ ID NO: 23770 - DNA, 21 bp, Artificial sequence
  SiRNA target sequence
tagtgttcctattaggagtaa

SEQ ID NO: 23771 - DNA, 21 bp, Artificial sequence
  SiRNA target sequence
agtgttcctattaggagtaag

SEQ ID NO: 23772 - DNA, 21 bp, Artificial sequence
  SiRNA target sequence
gtgttcctattaggagtaagt

SEQ ID NO: 23773 - DNA, 21 bp, Artificial sequence
  SiRNA target sequence
tgttcctattaggagtaagtt

SEQ ID NO: 23774 - DNA, 21 bp, Artificial sequence
  SiRNA target sequence
gttcctattaggagtaagtta

SEQ ID NO: 23775 - DNA, 21 bp, Artificial sequence
  SiRNA target sequence
ttcctattaggagtaagttaa

SEQ ID NO: 23776 - DNA, 21 bp, Artificial sequence
  SiRNA target sequence
tcctattaggagtaagttaat

SEQ ID NO: 23777 - DNA, 21 bp, Artificial sequence
  SiRNA target sequence
cctattaggagtaagttaatt

SEQ ID NO: 23778 - DNA, 21 bp, Artificial sequence
  SiRNA target sequence
ctattaggagtaagttaatta

SEQ ID NO: 23779 - DNA, 21 bp, Artificial sequence
  SiRNA target sequence
tattaggagtaagttaattaa

SEQ ID NO: 23780 - DNA, 21 bp, Artificial sequence
  SiRNA target sequence
attaggagtaagttaattaat

SEQ ID NO: 23781 - DNA, 21 bp, Artificial sequence
  SiRNA target sequence
ttaggagtaagttaattaatc

SEQ ID NO: 23782 - DNA, 21 bp, Artificial sequence
  SiRNA target sequence
taggagtaagttaattaatct

SEQ ID NO: 23783 - DNA, 21 bp, Artificial sequence
  SiRNA target sequence
aggagtaagttaattaatctg

SEQ ID NO: 23784 - DNA, 21 bp, Artificial sequence
  SiRNA target sequence
ggagtaagttaattaatctgg

SEQ ID NO: 23785 - DNA, 21 bp, Artificial sequence
  SiRNA target sequence
gagtaagttaattaatctggc

SEQ ID NO: 23786 - DNA, 21 bp, Artificial sequence
  SiRNA target sequence
agtaagttaattaatctggct

SEQ ID NO: 23787 - DNA, 21 bp, Artificial sequence
  SiRNA target sequence
gtaagttaattaatctggcta

SEQ ID NO: 23788 - DNA, 21 bp, Artificial sequence
  SiRNA target sequence
taagttaattaatctggctaa

SEQ ID NO: 23789 - DNA, 21 bp, Artificial sequence
  SiRNA target sequence
aagttaattaatctggctaaa

SEQ ID NO: 23790 - DNA, 21 bp, Artificial sequence
  SiRNA target sequence
agttaattaatctggctaaaa

SEQ ID NO: 23791 - DNA, 21 bp, Artificial sequence
  SiRNA target sequence
gttaattaatctggctaaaat

SEQ ID NO: 23792 - DNA, 21 bp, Artificial sequence
  SiRNA target sequence
ttaattaatctggctaaaatg

SEQ ID NO: 23793 - DNA, 21 bp, Artificial sequence
  SiRNA target sequence
taattaatctggctaaaatgg

SEQ ID NO: 23794 - DNA, 21 bp, Artificial sequence
  SiRNA target sequence
aattaatctggctaaaatggc

SEQ ID NO: 23795 - DNA, 21 bp, Artificial sequence
  SiRNA target sequence
attaatctggctaaaatggct

SEQ ID NO: 23796 - DNA, 21 bp, Artificial sequence
  SiRNA target sequence
ttaatctggctaaaatggctc

SEQ ID NO: 23797 - DNA, 21 bp, Artificial sequence
  SiRNA target sequence
taatctggctaaaatggctct

SEQ ID NO: 23798 - DNA, 21 bp, Artificial sequence
  SiRNA target sequence
aatctggctaaaatggctctc

SEQ ID NO: 23799 - DNA, 21 bp, Artificial sequence
  SiRNA target sequence
atctggctaaaatggctctca

SEQ ID NO: 23800 - DNA, 21 bp, Artificial sequence
  SiRNA target sequence
tctggctaaaatggctctcat

SEQ ID NO: 23801 - DNA, 21 bp, Artificial sequence
  SiRNA target sequence
ctggctaaaatggctctcata

SEQ ID NO: 23802 - DNA, 21 bp, Artificial sequence
  SiRNA target sequence
tggctaaaatggctctcatag

SEQ ID NO: 23803 - DNA, 21 bp, Artificial sequence
  SiRNA target sequence
ggctaaaatggctctcataga

SEQ ID NO: 23804 - DNA, 21 bp, Artificial sequence
  SiRNA target sequence
gctaaaatggctctcatagac

SEQ ID NO: 23805 - DNA, 21 bp, Artificial sequence
  SiRNA target sequence
ctaaaatggctctcatagacg

SEQ ID NO: 23806 - DNA, 21 bp, Artificial sequence
  SiRNA target sequence
taaaatggctctcatagacga

SEQ ID NO: 23807 - DNA, 21 bp, Artificial sequence
  SiRNA target sequence
aaaatggctctcatagacgat

SEQ ID NO: 23808 - DNA, 21 bp, Artificial sequence
  SiRNA target sequence
aaatggctctcatagacgata

SEQ ID NO: 23809 - DNA, 21 bp, Artificial sequence
  SiRNA target sequence
aatggctctcatagacgatat

SEQ ID NO: 23810 - DNA, 21 bp, Artificial sequence
  SiRNA target sequence
atggctctcatagacgatata

SEQ ID NO: 23811 - DNA, 21 bp, Artificial sequence
  SiRNA target sequence
tggctctcatagacgatatat

SEQ ID NO: 23812 - DNA, 21 bp, Artificial sequence
  SiRNA target sequence
ggctctcatagacgatatata

SEQ ID NO: 23813 - DNA, 21 bp, Artificial sequence
  SiRNA target sequence
gctctcatagacgatatatat

SEQ ID NO: 23814 - DNA, 21 bp, Artificial sequence
  SiRNA target sequence
ctctcatagacgatatatatt

SEQ ID NO: 23815 - DNA, 21 bp, Artificial sequence
  SiRNA target sequence
tctcatagacgatatatattc

SEQ ID NO: 23816 - DNA, 21 bp, Artificial sequence
  SiRNA target sequence
ctcatagacgatatatattct

SEQ ID NO: 23817 - DNA, 21 bp, Artificial sequence
  SiRNA target sequence
tcatagacgatatatattctg

SEQ ID NO: 23818 - DNA, 21 bp, Artificial sequence
  SiRNA target sequence
catagacgatatatattctgt

SEQ ID NO: 23819 - DNA, 21 bp, Artificial sequence
  SiRNA target sequence
atagacgatatatattctgtg

SEQ ID NO: 23820 - DNA, 21 bp, Artificial sequence
  SiRNA target sequence
tagacgatatatattctgtgt

SEQ ID NO: 23821 - DNA, 21 bp, Artificial sequence
  SiRNA target sequence
agacgatatatattctgtgta

SEQ ID NO: 23822 - DNA, 21 bp, Artificial sequence
  SiRNA target sequence
gacgatatatattctgtgtac

SEQ ID NO: 23823 - DNA, 21 bp, Artificial sequence
  SiRNA target sequence
acgatatatattctgtgtact

SEQ ID NO: 23824 - DNA, 21 bp, Artificial sequence
  SiRNA target sequence
cgatatatattctgtgtactt

SEQ ID NO: 23825 - DNA, 21 bp, Artificial sequence
  SiRNA target sequence
gatatatattctgtgtactta

SEQ ID NO: 23826 - DNA, 21 bp, Artificial sequence
  SiRNA target sequence
atatatattctgtgtacttac

SEQ ID NO: 23827 - DNA, 21 bp, Artificial sequence
  SiRNA target sequence
tatatattctgtgtacttaca

SEQ ID NO: 23828 - DNA, 21 bp, Artificial sequence
  SiRNA target sequence
atatattctgtgtacttacaa

SEQ ID NO: 23829 - DNA, 21 bp, Artificial sequence
  SiRNA target sequence
tatattctgtgtacttacaaa

SEQ ID NO: 23830 - DNA, 21 bp, Artificial sequence
  SiRNA target sequence
atattctgtgtacttacaaaa

SEQ ID NO: 23831 - DNA, 21 bp, Artificial sequence
  SiRNA target sequence
tattctgtgtacttacaaaag

SEQ ID NO: 23832 - DNA, 21 bp, Artificial sequence
  SiRNA target sequence
attctgtgtacttacaaaaga

SEQ ID NO: 23833 - DNA, 21 bp, Artificial sequence
  SiRNA target sequence
ttctgtgtacttacaaaagaa

SEQ ID NO: 23834 - DNA, 21 bp, Artificial sequence
  SiRNA target sequence
tctgtgtacttacaaaagaaa

SEQ ID NO: 23835 - DNA, 21 bp, Artificial sequence
  SiRNA target sequence
ctgtgtacttacaaaagaaag

SEQ ID NO: 23836 - DNA, 21 bp, Artificial sequence
  SiRNA target sequence
tgtgtacttacaaaagaaaga

SEQ ID NO: 23837 - DNA, 21 bp, Artificial sequence
  SiRNA target sequence
gtgtacttacaaaagaaagat

SEQ ID NO: 23838 - DNA, 21 bp, Artificial sequence
  SiRNA target sequence
tgtacttacaaaagaaagatc

SEQ ID NO: 23839 - DNA, 21 bp, Artificial sequence
  SiRNA target sequence
gtacttacaaaagaaagatct

SEQ ID NO: 23840 - DNA, 21 bp, Artificial sequence
  SiRNA target sequence
tacttacaaaagaaagatctc

SEQ ID NO: 23841 - DNA, 21 bp, Artificial sequence
  SiRNA target sequence
acttacaaaagaaagatctct

SEQ ID NO: 23842 - DNA, 21 bp, Artificial sequence
  SiRNA target sequence
cttacaaaagaaagatctctt

SEQ ID NO: 23843 - DNA, 21 bp, Artificial sequence
  SiRNA target sequence
ttacaaaagaaagatctcttg

SEQ ID NO: 23844 - DNA, 21 bp, Artificial sequence
  SiRNA target sequence
tacaaaagaaagatctcttgg

SEQ ID NO: 23845 - DNA, 21 bp, Artificial sequence
  SiRNA target sequence
acaaaagaaagatctcttgga

SEQ ID NO: 23846 - DNA, 21 bp, Artificial sequence
  SiRNA target sequence
caaaagaaagatctcttggat

SEQ ID NO: 23847 - DNA, 21 bp, Artificial sequence
  SiRNA target sequence
aaaagaaagatctcttggatg

SEQ ID NO: 23848 - DNA, 21 bp, Artificial sequence
  SiRNA target sequence
aaagaaagatctcttggatgg

SEQ ID NO: 23849 - DNA, 21 bp, Artificial sequence
  SiRNA target sequence
aagaaagatctcttggatggg

SEQ ID NO: 23850 - DNA, 21 bp, Artificial sequence
  SiRNA target sequence
agaaagatctcttggatgggc

SEQ ID NO: 23851 - DNA, 21 bp, Artificial sequence
  SiRNA target sequence
gaaagatctcttggatgggcg

SEQ ID NO: 23852 - DNA, 21 bp, Artificial sequence
  SiRNA target sequence
aaagatctcttggatgggcga

SEQ ID NO: 23853 - DNA, 21 bp, Artificial sequence
  SiRNA target sequence
aagatctcttggatgggcgat

SEQ ID NO: 23854 - DNA, 21 bp, Artificial sequence
  SiRNA target sequence
agatctcttggatgggcgatt

SEQ ID NO: 23855 - DNA, 21 bp, Artificial sequence
  SiRNA target sequence
gatctcttggatgggcgattt

SEQ ID NO: 23856 - DNA, 21 bp, Artificial sequence
  SiRNA target sequence
atctcttggatgggcgatttc

SEQ ID NO: 23857 - DNA, 21 bp, Artificial sequence
  SiRNA target sequence
tctcttggatgggcgatttcc

SEQ ID NO: 23858 - DNA, 21 bp, Artificial sequence
  SiRNA target sequence
ctcttggatgggcgatttcca

SEQ ID NO: 23859 - DNA, 21 bp, Artificial sequence
  SiRNA target sequence
tcttggatgggcgatttccat

SEQ ID NO: 23860 - DNA, 21 bp, Artificial sequence
  SiRNA target sequence
cttggatgggcgatttccatc

SEQ ID NO: 23861 - DNA, 21 bp, Artificial sequence
  SiRNA target sequence
ttggatgggcgatttccatca

SEQ ID NO: 23862 - DNA, 21 bp, Artificial sequence
  SiRNA target sequence
tggatgggcgatttccatcat

SEQ ID NO: 23863 - DNA, 21 bp, Artificial sequence
  SiRNA target sequence
ggatgggcgatttccatcatc

SEQ ID NO: 23864 - DNA, 21 bp, Artificial sequence
  SiRNA target sequence
gatgggcgatttccatcatca

SEQ ID NO: 23865 - DNA, 21 bp, Artificial sequence
  SiRNA target sequence
atgggcgatttccatcatcat

SEQ ID NO: 23866 - DNA, 21 bp, Artificial sequence
  SiRNA target sequence
tgggcgatttccatcatcatt

SEQ ID NO: 23867 - DNA, 21 bp, Artificial sequence
  SiRNA target sequence
gggcgatttccatcatcatta

SEQ ID NO: 23868 - DNA, 21 bp, Artificial sequence
  SiRNA target sequence
ggcgatttccatcatcattaa

SEQ ID NO: 23869 - DNA, 21 bp, Artificial sequence
  SiRNA target sequence
gcgatttccatcatcattaac

SEQ ID NO: 23870 - DNA, 21 bp, Artificial sequence
  SiRNA target sequence
cgatttccatcatcattaacc

SEQ ID NO: 23871 - DNA, 21 bp, Artificial sequence
  SiRNA target sequence
gatttccatcatcattaacct

SEQ ID NO: 23872 - DNA, 21 bp, Artificial sequence
  SiRNA target sequence
atttccatcatcattaacctt

SEQ ID NO: 23873 - DNA, 21 bp, Artificial sequence
  SiRNA target sequence
tttccatcatcattaaccttt

SEQ ID NO: 23874 - DNA, 21 bp, Artificial sequence
  SiRNA target sequence
ttccatcatcattaacctttg

SEQ ID NO: 23875 - DNA, 21 bp, Artificial sequence
  SiRNA target sequence
tccatcatcattaacctttga

SEQ ID NO: 23876 - DNA, 21 bp, Artificial sequence
  SiRNA target sequence
ccatcatcattaacctttgat

SEQ ID NO: 23877 - DNA, 21 bp, Artificial sequence
  SiRNA target sequence
catcatcattaacctttgatc

SEQ ID NO: 23878 - DNA, 21 bp, Artificial sequence
  SiRNA target sequence
atcatcattaacctttgatca

SEQ ID NO: 23879 - DNA, 21 bp, Artificial sequence
  SiRNA target sequence
tcatcattaacctttgatcag

SEQ ID NO: 23880 - DNA, 21 bp, Artificial sequence
  SiRNA target sequence
catcattaacctttgatcagg

SEQ ID NO: 23881 - DNA, 21 bp, Artificial sequence
  SiRNA target sequence
atcattaacctttgatcaggc

SEQ ID NO: 23882 - DNA, 21 bp, Artificial sequence
  SiRNA target sequence
tcattaacctttgatcaggca

SEQ ID NO: 23883 - DNA, 21 bp, Artificial sequence
  SiRNA target sequence
cattaacctttgatcaggcag

SEQ ID NO: 23884 - DNA, 21 bp, Artificial sequence
  SiRNA target sequence
attaacctttgatcaggcagt

SEQ ID NO: 23885 - DNA, 21 bp, Artificial sequence
  SiRNA target sequence
ttaacctttgatcaggcagtg

SEQ ID NO: 23886 - DNA, 21 bp, Artificial sequence
  SiRNA target sequence
taacctttgatcaggcagtgt

SEQ ID NO: 23887 - DNA, 21 bp, Artificial sequence
  SiRNA target sequence
aacctttgatcaggcagtgtt

SEQ ID NO: 23888 - DNA, 21 bp, Artificial sequence
  SiRNA target sequence
acctttgatcaggcagtgttg

SEQ ID NO: 23889 - DNA, 21 bp, Artificial sequence
  SiRNA target sequence
cctttgatcaggcagtgttgg

SEQ ID NO: 23890 - DNA, 21 bp, Artificial sequence
  SiRNA target sequence
ctttgatcaggcagtgttggg

SEQ ID NO: 23891 - DNA, 21 bp, Artificial sequence
  SiRNA target sequence
tttgatcaggcagtgttggga

SEQ ID NO: 23892 - DNA, 21 bp, Artificial sequence
  SiRNA target sequence
ttgatcaggcagtgttgggaa

SEQ ID NO: 23893 - DNA, 21 bp, Artificial sequence
  SiRNA target sequence
tgatcaggcagtgttgggaat

SEQ ID NO: 23894 - DNA, 21 bp, Artificial sequence
  SiRNA target sequence
gatcaggcagtgttgggaata

SEQ ID NO: 23895 - DNA, 21 bp, Artificial sequence
  SiRNA target sequence
atcaggcagtgttgggaatac

SEQ ID NO: 23896 - DNA, 21 bp, Artificial sequence
  SiRNA target sequence
tcaggcagtgttgggaatacc

SEQ ID NO: 23897 - DNA, 21 bp, Artificial sequence
  SiRNA target sequence
caggcagtgttgggaataccc

SEQ ID NO: 23898 - DNA, 21 bp, Artificial sequence
  SiRNA target sequence
aggcagtgttgggaatacccg

SEQ ID NO: 23899 - DNA, 21 bp, Artificial sequence
  SiRNA target sequence
ggcagtgttgggaatacccgg

SEQ ID NO: 23900 - DNA, 21 bp, Artificial sequence
  SiRNA target sequence
gcagtgttgggaatacccggg

SEQ ID NO: 23901 - DNA, 21 bp, Artificial sequence
  SiRNA target sequence
cagtgttgggaatacccgggg

SEQ ID NO: 23902 - DNA, 21 bp, Artificial sequence
  SiRNA target sequence
agtgttgggaatacccgggga

SEQ ID NO: 23903 - DNA, 21 bp, Artificial sequence
  SiRNA target sequence
gtgttgggaatacccggggag

SEQ ID NO: 23904 - DNA, 21 bp, Artificial sequence
  SiRNA target sequence
tgttgggaatacccggggagg

SEQ ID NO: 23905 - DNA, 21 bp, Artificial sequence
  SiRNA target sequence
gttgggaatacccggggagga

SEQ ID NO: 23906 - DNA, 21 bp, Artificial sequence
  SiRNA target sequence
ttgggaatacccggggaggat

SEQ ID NO: 23907 - DNA, 21 bp, Artificial sequence
  SiRNA target sequence
tgggaatacccggggaggatt

SEQ ID NO: 23908 - DNA, 21 bp, Artificial sequence
  SiRNA target sequence
gggaatacccggggaggatta

SEQ ID NO: 23909 - DNA, 21 bp, Artificial sequence
  SiRNA target sequence
ggaatacccggggaggattat

SEQ ID NO: 23910 - DNA, 21 bp, Artificial sequence
  SiRNA target sequence
gaatacccggggaggattatg

SEQ ID NO: 23911 - DNA, 21 bp, Artificial sequence
  SiRNA target sequence
aatacccggggaggattatgt

SEQ ID NO: 23912 - DNA, 21 bp, Artificial sequence
  SiRNA target sequence
atacccggggaggattatgtc

SEQ ID NO: 23913 - DNA, 21 bp, Artificial sequence
  SiRNA target sequence
tacccggggaggattatgtca

SEQ ID NO: 23914 - DNA, 21 bp, Artificial sequence
  SiRNA target sequence
acccggggaggattatgtcaa

SEQ ID NO: 23915 - DNA, 21 bp, Artificial sequence
  SiRNA target sequence
cccggggaggattatgtcaac

SEQ ID NO: 23916 - DNA, 21 bp, Artificial sequence
  SiRNA target sequence
ccggggaggattatgtcaact

SEQ ID NO: 23917 - DNA, 21 bp, Artificial sequence
  SiRNA target sequence
cggggaggattatgtcaactc

SEQ ID NO: 23918 - DNA, 21 bp, Artificial sequence
  SiRNA target sequence
ggggaggattatgtcaactca

SEQ ID NO: 23919 - DNA, 21 bp, Artificial sequence
  SiRNA target sequence
gggaggattatgtcaactcaa

SEQ ID NO: 23920 - DNA, 21 bp, Artificial sequence
  SiRNA target sequence
ggaggattatgtcaactcaat

SEQ ID NO: 23921 - DNA, 21 bp, Artificial sequence
  SiRNA target sequence
gaggattatgtcaactcaata

SEQ ID NO: 23922 - DNA, 21 bp, Artificial sequence
  SiRNA target sequence
aggattatgtcaactcaataa

SEQ ID NO: 23923 - DNA, 21 bp, Artificial sequence
  SiRNA target sequence
ggattatgtcaactcaataaa

SEQ ID NO: 23924 - DNA, 21 bp, Artificial sequence
  SiRNA target sequence
gattatgtcaactcaataaaa

SEQ ID NO: 23925 - DNA, 21 bp, Artificial sequence
  SiRNA target sequence
attatgtcaactcaataaaac

SEQ ID NO: 23926 - DNA, 21 bp, Artificial sequence
  SiRNA target sequence
ttatgtcaactcaataaaacg

SEQ ID NO: 23927 - DNA, 21 bp, Artificial sequence
  SiRNA target sequence
tatgtcaactcaataaaacgc

SEQ ID NO: 23928 - DNA, 21 bp, Artificial sequence
  SiRNA target sequence
atgtcaactcaataaaacgcg

SEQ ID NO: 23929 - DNA, 21 bp, Artificial sequence
  SiRNA target sequence
tgtcaactcaataaaacgcga

SEQ ID NO: 23930 - DNA, 21 bp, Artificial sequence
  SiRNA target sequence
gtcaactcaataaaacgcgat

SEQ ID NO: 23931 - DNA, 21 bp, Artificial sequence
  SiRNA target sequence
tcaactcaataaaacgcgata

SEQ ID NO: 23932 - DNA, 21 bp, Artificial sequence
  SiRNA target sequence
caactcaataaaacgcgatac

SEQ ID NO: 23933 - DNA, 21 bp, Artificial sequence
  SiRNA target sequence
aactcaataaaacgcgatacc

SEQ ID NO: 23934 - DNA, 21 bp, Artificial sequence
  SiRNA target sequence
actcaataaaacgcgatacct

SEQ ID NO: 23935 - DNA, 21 bp, Artificial sequence
  SiRNA target sequence
ctcaataaaacgcgatacctc

SEQ ID NO: 23936 - DNA, 21 bp, Artificial sequence
  SiRNA target sequence
tcaataaaacgcgatacctct

SEQ ID NO: 23937 - DNA, 21 bp, Artificial sequence
  SiRNA target sequence
caataaaacgcgatacctctt

SEQ ID NO: 23938 - DNA, 21 bp, Artificial sequence
  SiRNA target sequence
aataaaacgcgatacctcttg

SEQ ID NO: 23939 - DNA, 21 bp, Artificial sequence
  SiRNA target sequence
ataaaacgcgatacctcttgc

SEQ ID NO: 23940 - DNA, 21 bp, Artificial sequence
  SiRNA target sequence
taaaacgcgatacctcttgcg

SEQ ID NO: 23941 - DNA, 21 bp, Artificial sequence
  SiRNA target sequence
aaaacgcgatacctcttgcgg

SEQ ID NO: 23942 - DNA, 21 bp, Artificial sequence
  SiRNA target sequence
aaacgcgatacctcttgcgga

SEQ ID NO: 23943 - DNA, 21 bp, Artificial sequence
  SiRNA target sequence
aacgcgatacctcttgcggat

SEQ ID NO: 23944 - DNA, 21 bp, Artificial sequence
  SiRNA target sequence
acgcgatacctcttgcggata

SEQ ID NO: 23945 - DNA, 21 bp, Artificial sequence
  SiRNA target sequence
cgcgatacctcttgcggatat

SEQ ID NO: 23946 - DNA, 21 bp, Artificial sequence
  SiRNA target sequence
gcgatacctcttgcggatatc

SEQ ID NO: 23947 - DNA, 21 bp, Artificial sequence
  SiRNA target sequence
cgatacctcttgcggatatcc

SEQ ID NO: 23948 - DNA, 21 bp, Artificial sequence
  SiRNA target sequence
gatacctcttgcggatatcct

SEQ ID NO: 23949 - DNA, 21 bp, Artificial sequence
  SiRNA target sequence
atacctcttgcggatatcctt

SEQ ID NO: 23950 - DNA, 21 bp, Artificial sequence
  SiRNA target sequence
tacctcttgcggatatccttt

SEQ ID NO: 23951 - DNA, 21 bp, Artificial sequence
  SiRNA target sequence
acctcttgcggatatcctttc

SEQ ID NO: 23952 - DNA, 21 bp, Artificial sequence
  SiRNA target sequence
cctcttgcggatatcctttcg

SEQ ID NO: 23953 - DNA, 21 bp, Artificial sequence
  SiRNA target sequence
ctcttgcggatatcctttcgt

SEQ ID NO: 23954 - DNA, 21 bp, Artificial sequence
  SiRNA target sequence
tcttgcggatatcctttcgtt

SEQ ID NO: 23955 - DNA, 21 bp, Artificial sequence
  SiRNA target sequence
cttgcggatatcctttcgtta

SEQ ID NO: 23956 - DNA, 21 bp, Artificial sequence
  SiRNA target sequence
ttgcggatatcctttcgttaa

SEQ ID NO: 23957 - DNA, 21 bp, Artificial sequence
  SiRNA target sequence
tgcggatatcctttcgttaaa

SEQ ID NO: 23958 - DNA, 21 bp, Artificial sequence
  SiRNA target sequence
gcggatatcctttcgttaaag

SEQ ID NO: 23959 - DNA, 21 bp, Artificial sequence
  SiRNA target sequence
cggatatcctttcgttaaaga

SEQ ID NO: 23960 - DNA, 21 bp, Artificial sequence
  SiRNA target sequence
ggatatcctttcgttaaagaa

SEQ ID NO: 23961 - DNA, 21 bp, Artificial sequence
  SiRNA target sequence
gatatcctttcgttaaagaag

SEQ ID NO: 23962 - DNA, 21 bp, Artificial sequence
  SiRNA target sequence
atatcctttcgttaaagaagg

SEQ ID NO: 23963 - DNA, 21 bp, Artificial sequence
  SiRNA target sequence
tatcctttcgttaaagaagga

SEQ ID NO: 23964 - DNA, 21 bp, Artificial sequence
  SiRNA target sequence
atcctttcgttaaagaaggat

SEQ ID NO: 23965 - DNA, 21 bp, Artificial sequence
  SiRNA target sequence
tcctttcgttaaagaaggatg

SEQ ID NO: 23966 - DNA, 21 bp, Artificial sequence
  SiRNA target sequence
cctttcgttaaagaaggatgg

SEQ ID NO: 23967 - DNA, 21 bp, Artificial sequence
  SiRNA target sequence
ctttcgttaaagaaggatgga

SEQ ID NO: 23968 - DNA, 21 bp, Artificial sequence
  SiRNA target sequence
tttcgttaaagaaggatggac

SEQ ID NO: 23969 - DNA, 21 bp, Artificial sequence
  SiRNA target sequence
ttcgttaaagaaggatggacg

SEQ ID NO: 23970 - DNA, 21 bp, Artificial sequence
  SiRNA target sequence
tcgttaaagaaggatggacgc

SEQ ID NO: 23971 - DNA, 21 bp, Artificial sequence
  SiRNA target sequence
cgttaaagaaggatggacgcg

SEQ ID NO: 23972 - DNA, 21 bp, Artificial sequence
  SiRNA target sequence
gttaaagaaggatggacgcga

SEQ ID NO: 23973 - DNA, 21 bp, Artificial sequence
  SiRNA target sequence
ttaaagaaggatggacgcgag

SEQ ID NO: 23974 - DNA, 21 bp, Artificial sequence
  SiRNA target sequence
taaagaaggatggacgcgagc

SEQ ID NO: 23975 - DNA, 21 bp, Artificial sequence
  SiRNA target sequence
aaagaaggatggacgcgagct

SEQ ID NO: 23976 - DNA, 21 bp, Artificial sequence
  SiRNA target sequence
aagaaggatggacgcgagcta

SEQ ID NO: 23977 - DNA, 21 bp, Artificial sequence
  SiRNA target sequence
agaaggatggacgcgagctaa

SEQ ID NO: 23978 - DNA, 21 bp, Artificial sequence
  SiRNA target sequence
gaaggatggacgcgagctaaa

SEQ ID NO: 23979 - DNA, 21 bp, Artificial sequence
  SiRNA target sequence
aaggatggacgcgagctaaaa

SEQ ID NO: 23980 - DNA, 21 bp, Artificial sequence
  SiRNA target sequence
aggatggacgcgagctaaaat

SEQ ID NO: 23981 - DNA, 21 bp, Artificial sequence
  SiRNA target sequence
ggatggacgcgagctaaaatc

SEQ ID NO: 23982 - DNA, 21 bp, Artificial sequence
  SiRNA target sequence
gatggacgcgagctaaaatct

SEQ ID NO: 23983 - DNA, 21 bp, Artificial sequence
  SiRNA target sequence
atggacgcgagctaaaatctt

SEQ ID NO: 23984 - DNA, 21 bp, Artificial sequence
  SiRNA target sequence
tggacgcgagctaaaatcttt

SEQ ID NO: 23985 - DNA, 21 bp, Artificial sequence
  SiRNA target sequence
ggacgcgagctaaaatctttg

SEQ ID NO: 23986 - DNA, 21 bp, Artificial sequence
  SiRNA target sequence
gacgcgagctaaaatctttgg

SEQ ID NO: 23987 - DNA, 21 bp, Artificial sequence
  SiRNA target sequence
acgcgagctaaaatctttggt

SEQ ID NO: 23988 - DNA, 21 bp, Artificial sequence
  SiRNA target sequence
cgcgagctaaaatctttggta

SEQ ID NO: 23989 - DNA, 21 bp, Artificial sequence
  SiRNA target sequence
gcgagctaaaatctttggtaa

SEQ ID NO: 23990 - DNA, 21 bp, Artificial sequence
  SiRNA target sequence
cgagctaaaatctttggtaat

SEQ ID NO: 23991 - DNA, 21 bp, Artificial sequence
  SiRNA target sequence
gagctaaaatctttggtaatg

SEQ ID NO: 23992 - DNA, 21 bp, Artificial sequence
  SiRNA target sequence
agctaaaatctttggtaatgg

SEQ ID NO: 23993 - DNA, 21 bp, Artificial sequence
  SiRNA target sequence
gctaaaatctttggtaatggc

SEQ ID NO: 23994 - DNA, 21 bp, Artificial sequence
  SiRNA target sequence
ctaaaatctttggtaatggcg

SEQ ID NO: 23995 - DNA, 21 bp, Artificial sequence
  SiRNA target sequence
taaaatctttggtaatggcga

SEQ ID NO: 23996 - DNA, 21 bp, Artificial sequence
  SiRNA target sequence
aaaatctttggtaatggcgat

SEQ ID NO: 23997 - DNA, 21 bp, Artificial sequence
  SiRNA target sequence
aaatctttggtaatggcgatg

SEQ ID NO: 23998 - DNA, 21 bp, Artificial sequence
  SiRNA target sequence
aatctttggtaatggcgatga

SEQ ID NO: 23999 - DNA, 21 bp, Artificial sequence
  SiRNA target sequence
atctttggtaatggcgatgag

SEQ ID NO: 24000 - DNA, 21 bp, Artificial sequence
  SiRNA target sequence
tctttggtaatggcgatgagt

SEQ ID NO: 24001 - DNA, 21 bp, Artificial sequence
  SiRNA target sequence
ctttggtaatggcgatgagta

SEQ ID NO: 24002 - DNA, 21 bp, Artificial sequence
  SiRNA target sequence
tttggtaatggcgatgagtat

SEQ ID NO: 24003 - DNA, 21 bp, Artificial sequence
  SiRNA target sequence
ttggtaatggcgatgagtatg

SEQ ID NO: 24004 - DNA, 21 bp, Artificial sequence
  SiRNA target sequence
tggtaatggcgatgagtatga

SEQ ID NO: 24005 - DNA, 21 bp, Artificial sequence
  SiRNA target sequence
ggtaatggcgatgagtatgac

SEQ ID NO: 24006 - DNA, 21 bp, Artificial sequence
  SiRNA target sequence
gtaatggcgatgagtatgaca

SEQ ID NO: 24007 - DNA, 21 bp, Artificial sequence
  SiRNA target sequence
taatggcgatgagtatgacat

SEQ ID NO: 24008 - DNA, 21 bp, Artificial sequence
  SiRNA target sequence
aatggcgatgagtatgacatg

SEQ ID NO: 24009 - DNA, 21 bp, Artificial sequence
  SiRNA target sequence
atggcgatgagtatgacatgt

SEQ ID NO: 24010 - DNA, 21 bp, Artificial sequence
  SiRNA target sequence
tggcgatgagtatgacatgtc

SEQ ID NO: 24011 - DNA, 21 bp, Artificial sequence
  SiRNA target sequence
ggcgatgagtatgacatgtcc

SEQ ID NO: 24012 - DNA, 21 bp, Artificial sequence
  SiRNA target sequence
gcgatgagtatgacatgtcca

SEQ ID NO: 24013 - DNA, 21 bp, Artificial sequence
  SiRNA target sequence
cgatgagtatgacatgtccac

SEQ ID NO: 24014 - DNA, 21 bp, Artificial sequence
  SiRNA target sequence
gatgagtatgacatgtccact

SEQ ID NO: 24015 - DNA, 21 bp, Artificial sequence
  SiRNA target sequence
atgagtatgacatgtccactt

SEQ ID NO: 24016 - DNA, 21 bp, Artificial sequence
  SiRNA target sequence
tgagtatgacatgtccacttc

SEQ ID NO: 24017 - DNA, 21 bp, Artificial sequence
  SiRNA target sequence
gagtatgacatgtccacttcg

SEQ ID NO: 24018 - DNA, 21 bp, Artificial sequence
  SiRNA target sequence
agtatgacatgtccacttcgg

SEQ ID NO: 24019 - DNA, 21 bp, Artificial sequence
  SiRNA target sequence
gtatgacatgtccacttcggg

SEQ ID NO: 24020 - DNA, 21 bp, Artificial sequence
  SiRNA target sequence
tatgacatgtccacttcgggc

SEQ ID NO: 24021 - DNA, 21 bp, Artificial sequence
  SiRNA target sequence
atgacatgtccacttcgggcg

SEQ ID NO: 24022 - DNA, 21 bp, Artificial sequence
  SiRNA target sequence
tgacatgtccacttcgggcgt

SEQ ID NO: 24023 - DNA, 21 bp, Artificial sequence
  SiRNA target sequence
gacatgtccacttcgggcgtt

SEQ ID NO: 24024 - DNA, 21 bp, Artificial sequence
  SiRNA target sequence
acatgtccacttcgggcgttc

SEQ ID NO: 24025 - DNA, 21 bp, Artificial sequence
  SiRNA target sequence
catgtccacttcgggcgttca

SEQ ID NO: 24026 - DNA, 21 bp, Artificial sequence
  SiRNA target sequence
atgtccacttcgggcgttcaa

SEQ ID NO: 24027 - DNA, 21 bp, Artificial sequence
  SiRNA target sequence
tgtccacttcgggcgttcaaa

SEQ ID NO: 24028 - DNA, 21 bp, Artificial sequence
  SiRNA target sequence
gtccacttcgggcgttcaaat

SEQ ID NO: 24029 - DNA, 21 bp, Artificial sequence
  SiRNA target sequence
tccacttcgggcgttcaaatg

SEQ ID NO: 24030 - DNA, 21 bp, Artificial sequence
  SiRNA target sequence
ccacttcgggcgttcaaatgc

SEQ ID NO: 24031 - DNA, 21 bp, Artificial sequence
  SiRNA target sequence
cacttcgggcgttcaaatgct

SEQ ID NO: 24032 - DNA, 21 bp, Artificial sequence
  SiRNA target sequence
acttcgggcgttcaaatgcta

SEQ ID NO: 24033 - DNA, 21 bp, Artificial sequence
  SiRNA target sequence
cttcgggcgttcaaatgctaa

SEQ ID NO: 24034 - DNA, 21 bp, Artificial sequence
  SiRNA target sequence
ttcgggcgttcaaatgctaag

SEQ ID NO: 24035 - DNA, 21 bp, Artificial sequence
  SiRNA target sequence
tcgggcgttcaaatgctaagg

SEQ ID NO: 24036 - DNA, 21 bp, Artificial sequence
  SiRNA target sequence
cgggcgttcaaatgctaaggg

SEQ ID NO: 24037 - DNA, 21 bp, Artificial sequence
  SiRNA target sequence
gggcgttcaaatgctaaggga

SEQ ID NO: 24038 - DNA, 21 bp, Artificial sequence
  SiRNA target sequence
ggcgttcaaatgctaagggaa

SEQ ID NO: 24039 - DNA, 21 bp, Artificial sequence
  SiRNA target sequence
gcgttcaaatgctaagggaaa

SEQ ID NO: 24040 - DNA, 21 bp, Artificial sequence
  SiRNA target sequence
cgttcaaatgctaagggaaaa

SEQ ID NO: 24041 - DNA, 21 bp, Artificial sequence
  SiRNA target sequence
gttcaaatgctaagggaaaaa

SEQ ID NO: 24042 - DNA, 21 bp, Artificial sequence
  SiRNA target sequence
ttcaaatgctaagggaaaaag

SEQ ID NO: 24043 - DNA, 21 bp, Artificial sequence
  SiRNA target sequence
tcaaatgctaagggaaaaagt

SEQ ID NO: 24044 - DNA, 21 bp, Artificial sequence
  SiRNA target sequence
caaatgctaagggaaaaagta

SEQ ID NO: 24045 - DNA, 21 bp, Artificial sequence
  SiRNA target sequence
aaatgctaagggaaaaagtac

SEQ ID NO: 24046 - DNA, 21 bp, Artificial sequence
  SiRNA target sequence
aatgctaagggaaaaagtaca

SEQ ID NO: 24047 - DNA, 21 bp, Artificial sequence
  SiRNA target sequence
atgctaagggaaaaagtacaa

SEQ ID NO: 24048 - DNA, 21 bp, Artificial sequence
  SiRNA target sequence
tgctaagggaaaaagtacaag

SEQ ID NO: 24049 - DNA, 21 bp, Artificial sequence
  SiRNA target sequence
gctaagggaaaaagtacaaga

SEQ ID NO: 24050 - DNA, 21 bp, Artificial sequence
  SiRNA target sequence
ctaagggaaaaagtacaagaa

SEQ ID NO: 24051 - DNA, 21 bp, Artificial sequence
  SiRNA target sequence
taagggaaaaagtacaagaat

SEQ ID NO: 24052 - DNA, 21 bp, Artificial sequence
  SiRNA target sequence
aagggaaaaagtacaagaatg

SEQ ID NO: 24053 - DNA, 21 bp, Artificial sequence
  SiRNA target sequence
agggaaaaagtacaagaatgc

SEQ ID NO: 24054 - DNA, 21 bp, Artificial sequence
  SiRNA target sequence
gggaaaaagtacaagaatgca

SEQ ID NO: 24055 - DNA, 21 bp, Artificial sequence
  SiRNA target sequence
ggaaaaagtacaagaatgcat

SEQ ID NO: 24056 - DNA, 21 bp, Artificial sequence
  SiRNA target sequence
gaaaaagtacaagaatgcata

SEQ ID NO: 24057 - DNA, 21 bp, Artificial sequence
  SiRNA target sequence
aaaaagtacaagaatgcatag

SEQ ID NO: 24058 - DNA, 21 bp, Artificial sequence
  SiRNA target sequence
aaaagtacaagaatgcataga

SEQ ID NO: 24059 - DNA, 21 bp, Artificial sequence
  SiRNA target sequence
aaagtacaagaatgcatagag

SEQ ID NO: 24060 - DNA, 21 bp, Artificial sequence
  SiRNA target sequence
aagtacaagaatgcatagagg

SEQ ID NO: 24061 - DNA, 21 bp, Artificial sequence
  SiRNA target sequence
agtacaagaatgcatagaggc

SEQ ID NO: 24062 - DNA, 21 bp, Artificial sequence
  SiRNA target sequence
gtacaagaatgcatagaggcg

SEQ ID NO: 24063 - DNA, 21 bp, Artificial sequence
  SiRNA target sequence
tacaagaatgcatagaggcgg

SEQ ID NO: 24064 - DNA, 21 bp, Artificial sequence
  SiRNA target sequence
acaagaatgcatagaggcggc

SEQ ID NO: 24065 - DNA, 21 bp, Artificial sequence
  SiRNA target sequence
caagaatgcatagaggcggca

SEQ ID NO: 24066 - DNA, 21 bp, Artificial sequence
  SiRNA target sequence
aagaatgcatagaggcggcaa

SEQ ID NO: 24067 - DNA, 21 bp, Artificial sequence
  SiRNA target sequence
agaatgcatagaggcggcaag

SEQ ID NO: 24068 - DNA, 21 bp, Artificial sequence
  SiRNA target sequence
gaatgcatagaggcggcaaga

SEQ ID NO: 24069 - DNA, 21 bp, Artificial sequence
  SiRNA target sequence
aatgcatagaggcggcaagac

SEQ ID NO: 24070 - DNA, 21 bp, Artificial sequence
  SiRNA target sequence
atgcatagaggcggcaagaca

SEQ ID NO: 24071 - DNA, 21 bp, Artificial sequence
  SiRNA target sequence
tgcatagaggcggcaagacag

SEQ ID NO: 24072 - DNA, 21 bp, Artificial sequence
  SiRNA target sequence
gcatagaggcggcaagacagg

SEQ ID NO: 24073 - DNA, 21 bp, Artificial sequence
  SiRNA target sequence
catagaggcggcaagacaggg

SEQ ID NO: 24074 - DNA, 21 bp, Artificial sequence
  SiRNA target sequence
atagaggcggcaagacagggg

SEQ ID NO: 24075 - DNA, 21 bp, Artificial sequence
  SiRNA target sequence
tagaggcggcaagacagggga

SEQ ID NO: 24076 - DNA, 21 bp, Artificial sequence
  SiRNA target sequence
agaggcggcaagacaggggaa

SEQ ID NO: 24077 - DNA, 21 bp, Artificial sequence
  SiRNA target sequence
gaggcggcaagacaggggaag

SEQ ID NO: 24078 - DNA, 21 bp, Artificial sequence
  SiRNA target sequence
aggcggcaagacaggggaaga

SEQ ID NO: 24079 - DNA, 21 bp, Artificial sequence
  SiRNA target sequence
ggcggcaagacaggggaagat

SEQ ID NO: 24080 - DNA, 21 bp, Artificial sequence
  SiRNA target sequence
gcggcaagacaggggaagata

SEQ ID NO: 24081 - DNA, 21 bp, Artificial sequence
  SiRNA target sequence
cggcaagacaggggaagatat

SEQ ID NO: 24082 - DNA, 21 bp, Artificial sequence
  SiRNA target sequence
ggcaagacaggggaagatatt

SEQ ID NO: 24083 - DNA, 21 bp, Artificial sequence
  SiRNA target sequence
gcaagacaggggaagatattg

SEQ ID NO: 24084 - DNA, 21 bp, Artificial sequence
  SiRNA target sequence
caagacaggggaagatattgg

SEQ ID NO: 24085 - DNA, 21 bp, Artificial sequence
  SiRNA target sequence
aagacaggggaagatattgga

SEQ ID NO: 24086 - DNA, 21 bp, Artificial sequence
  SiRNA target sequence
agacaggggaagatattggac

SEQ ID NO: 24087 - DNA, 21 bp, Artificial sequence
  SiRNA target sequence
gacaggggaagatattggacc

SEQ ID NO: 24088 - DNA, 21 bp, Artificial sequence
  SiRNA target sequence
acaggggaagatattggacca

SEQ ID NO: 24089 - DNA, 21 bp, Artificial sequence
  SiRNA target sequence
caggggaagatattggaccat

SEQ ID NO: 24090 - DNA, 21 bp, Artificial sequence
  SiRNA target sequence
aggggaagatattggaccatt

SEQ ID NO: 24091 - DNA, 21 bp, Artificial sequence
  SiRNA target sequence
ggggaagatattggaccatta

SEQ ID NO: 24092 - DNA, 21 bp, Artificial sequence
  SiRNA target sequence
gggaagatattggaccattat

SEQ ID NO: 24093 - DNA, 21 bp, Artificial sequence
  SiRNA target sequence
ggaagatattggaccattatt

SEQ ID NO: 24094 - DNA, 21 bp, Artificial sequence
  SiRNA target sequence
gaagatattggaccattattt

SEQ ID NO: 24095 - DNA, 21 bp, Artificial sequence
  SiRNA target sequence
aagatattggaccattatttc

SEQ ID NO: 24096 - DNA, 21 bp, Artificial sequence
  SiRNA target sequence
agatattggaccattatttca

SEQ ID NO: 24097 - DNA, 21 bp, Artificial sequence
  SiRNA target sequence
gatattggaccattatttcat

SEQ ID NO: 24098 - DNA, 21 bp, Artificial sequence
  SiRNA target sequence
atattggaccattatttcatt

SEQ ID NO: 24099 - DNA, 21 bp, Artificial sequence
  SiRNA target sequence
tattggaccattatttcattg

SEQ ID NO: 24100 - DNA, 21 bp, Artificial sequence
  SiRNA target sequence
attggaccattatttcattga

SEQ ID NO: 24101 - DNA, 21 bp, Artificial sequence
  SiRNA target sequence
ttggaccattatttcattgat

SEQ ID NO: 24102 - DNA, 21 bp, Artificial sequence
  SiRNA target sequence
tggaccattatttcattgata

SEQ ID NO: 24103 - DNA, 21 bp, Artificial sequence
  SiRNA target sequence
ggaccattatttcattgatac

SEQ ID NO: 24104 - DNA, 21 bp, Artificial sequence
  SiRNA target sequence
gaccattatttcattgataca

SEQ ID NO: 24105 - DNA, 21 bp, Artificial sequence
  SiRNA target sequence
accattatttcattgatacat

SEQ ID NO: 24106 - DNA, 21 bp, Artificial sequence
  SiRNA target sequence
ccattatttcattgatacatt

SEQ ID NO: 24107 - DNA, 21 bp, Artificial sequence
  SiRNA target sequence
cattatttcattgatacatta

SEQ ID NO: 24108 - DNA, 21 bp, Artificial sequence
  SiRNA target sequence
attatttcattgatacattaa

SEQ ID NO: 24109 - DNA, 21 bp, Artificial sequence
  SiRNA target sequence
ttatttcattgatacattaaa

SEQ ID NO: 24110 - DNA, 21 bp, Artificial sequence
  SiRNA target sequence
tatttcattgatacattaaaa

SEQ ID NO: 24111 - DNA, 21 bp, Artificial sequence
  SiRNA target sequence
atttcattgatacattaaaag

SEQ ID NO: 24112 - DNA, 21 bp, Artificial sequence
  SiRNA target sequence
tttcattgatacattaaaaga

SEQ ID NO: 24113 - DNA, 21 bp, Artificial sequence
  SiRNA target sequence
ttcattgatacattaaaagat

SEQ ID NO: 24114 - DNA, 21 bp, Artificial sequence
  SiRNA target sequence
tcattgatacattaaaagatg

SEQ ID NO: 24115 - DNA, 21 bp, Artificial sequence
  SiRNA target sequence
cattgatacattaaaagatga

SEQ ID NO: 24116 - DNA, 21 bp, Artificial sequence
  SiRNA target sequence
attgatacattaaaagatgaa

SEQ ID NO: 24117 - DNA, 21 bp, Artificial sequence
  SiRNA target sequence
ttgatacattaaaagatgaaa

SEQ ID NO: 24118 - DNA, 21 bp, Artificial sequence
  SiRNA target sequence
tgatacattaaaagatgaaag

SEQ ID NO: 24119 - DNA, 21 bp, Artificial sequence
  SiRNA target sequence
gatacattaaaagatgaaagg

SEQ ID NO: 24120 - DNA, 21 bp, Artificial sequence
  SiRNA target sequence
atacattaaaagatgaaagga

SEQ ID NO: 24121 - DNA, 21 bp, Artificial sequence
  SiRNA target sequence
tacattaaaagatgaaaggaa

SEQ ID NO: 24122 - DNA, 21 bp, Artificial sequence
  SiRNA target sequence
acattaaaagatgaaaggaag

SEQ ID NO: 24123 - DNA, 21 bp, Artificial sequence
  SiRNA target sequence
cattaaaagatgaaaggaagc

SEQ ID NO: 24124 - DNA, 21 bp, Artificial sequence
  SiRNA target sequence
attaaaagatgaaaggaagcc

SEQ ID NO: 24125 - DNA, 21 bp, Artificial sequence
  SiRNA target sequence
ttaaaagatgaaaggaagcct

SEQ ID NO: 24126 - DNA, 21 bp, Artificial sequence
  SiRNA target sequence
taaaagatgaaaggaagccta

SEQ ID NO: 24127 - DNA, 21 bp, Artificial sequence
  SiRNA target sequence
aaaagatgaaaggaagcctaa

SEQ ID NO: 24128 - DNA, 21 bp, Artificial sequence
  SiRNA target sequence
aaagatgaaaggaagcctaaa

SEQ ID NO: 24129 - DNA, 21 bp, Artificial sequence
  SiRNA target sequence
aagatgaaaggaagcctaaac

SEQ ID NO: 24130 - DNA, 21 bp, Artificial sequence
  SiRNA target sequence
agatgaaaggaagcctaaaca

SEQ ID NO: 24131 - DNA, 21 bp, Artificial sequence
  SiRNA target sequence
gatgaaaggaagcctaaacat

SEQ ID NO: 24132 - DNA, 21 bp, Artificial sequence
  SiRNA target sequence
atgaaaggaagcctaaacata

SEQ ID NO: 24133 - DNA, 21 bp, Artificial sequence
  SiRNA target sequence
tgaaaggaagcctaaacataa

SEQ ID NO: 24134 - DNA, 21 bp, Artificial sequence
  SiRNA target sequence
gaaaggaagcctaaacataag

SEQ ID NO: 24135 - DNA, 21 bp, Artificial sequence
  SiRNA target sequence
aaaggaagcctaaacataagg

SEQ ID NO: 24136 - DNA, 21 bp, Artificial sequence
  SiRNA target sequence
aaggaagcctaaacataaggc

SEQ ID NO: 24137 - DNA, 21 bp, Artificial sequence
  SiRNA target sequence
aggaagcctaaacataaggct

SEQ ID NO: 24138 - DNA, 21 bp, Artificial sequence
  SiRNA target sequence
ggaagcctaaacataaggctc

SEQ ID NO: 24139 - DNA, 21 bp, Artificial sequence
  SiRNA target sequence
gaagcctaaacataaggctca

SEQ ID NO: 24140 - DNA, 21 bp, Artificial sequence
  SiRNA target sequence
aagcctaaacataaggctcat

SEQ ID NO: 24141 - DNA, 21 bp, Artificial sequence
  SiRNA target sequence
agcctaaacataaggctcata

SEQ ID NO: 24142 - DNA, 21 bp, Artificial sequence
  SiRNA target sequence
gcctaaacataaggctcataa

SEQ ID NO: 24143 - DNA, 21 bp, Artificial sequence
  SiRNA target sequence
cctaaacataaggctcataag

SEQ ID NO: 24144 - DNA, 21 bp, Artificial sequence
  SiRNA target sequence
ctaaacataaggctcataagt

SEQ ID NO: 24145 - DNA, 21 bp, Artificial sequence
  SiRNA target sequence
taaacataaggctcataagtc

SEQ ID NO: 24146 - DNA, 21 bp, Artificial sequence
  SiRNA target sequence
aaacataaggctcataagtct

SEQ ID NO: 24147 - DNA, 21 bp, Artificial sequence
  SiRNA target sequence
aacataaggctcataagtctc

SEQ ID NO: 24148 - DNA, 21 bp, Artificial sequence
  SiRNA target sequence
acataaggctcataagtctcg

SEQ ID NO: 24149 - DNA, 21 bp, Artificial sequence
  SiRNA target sequence
cataaggctcataagtctcga

SEQ ID NO: 24150 - DNA, 21 bp, Artificial sequence
  SiRNA target sequence
ataaggctcataagtctcgaa

SEQ ID NO: 24151 - DNA, 21 bp, Artificial sequence
  SiRNA target sequence
taaggctcataagtctcgaat

SEQ ID NO: 24152 - DNA, 21 bp, Artificial sequence
  SiRNA target sequence
aaggctcataagtctcgaatg

SEQ ID NO: 24153 - DNA, 21 bp, Artificial sequence
  SiRNA target sequence
aggctcataagtctcgaatgt

SEQ ID NO: 24154 - DNA, 21 bp, Artificial sequence
  SiRNA target sequence
ggctcataagtctcgaatgtt

SEQ ID NO: 24155 - DNA, 21 bp, Artificial sequence
  SiRNA target sequence
gctcataagtctcgaatgttt

SEQ ID NO: 24156 - DNA, 21 bp, Artificial sequence
  SiRNA target sequence
ctcataagtctcgaatgtttt

SEQ ID NO: 24157 - DNA, 21 bp, Artificial sequence
  SiRNA target sequence
tcataagtctcgaatgttttc

SEQ ID NO: 24158 - DNA, 21 bp, Artificial sequence
  SiRNA target sequence
cataagtctcgaatgttttct

SEQ ID NO: 24159 - DNA, 21 bp, Artificial sequence
  SiRNA target sequence
ataagtctcgaatgttttcta

SEQ ID NO: 24160 - DNA, 21 bp, Artificial sequence
  SiRNA target sequence
taagtctcgaatgttttctaa

SEQ ID NO: 24161 - DNA, 21 bp, Artificial sequence
  SiRNA target sequence
aagtctcgaatgttttctaat

SEQ ID NO: 24162 - DNA, 21 bp, Artificial sequence
  SiRNA target sequence
agtctcgaatgttttctaatg

SEQ ID NO: 24163 - DNA, 21 bp, Artificial sequence
  SiRNA target sequence
gtctcgaatgttttctaatgg

SEQ ID NO: 24164 - DNA, 21 bp, Artificial sequence
  SiRNA target sequence
tctcgaatgttttctaatgga

SEQ ID NO: 24165 - DNA, 21 bp, Artificial sequence
  SiRNA target sequence
ctcgaatgttttctaatggac

SEQ ID NO: 24166 - DNA, 21 bp, Artificial sequence
  SiRNA target sequence
tcgaatgttttctaatggacc

SEQ ID NO: 24167 - DNA, 21 bp, Artificial sequence
  SiRNA target sequence
cgaatgttttctaatggaccg

SEQ ID NO: 24168 - DNA, 21 bp, Artificial sequence
  SiRNA target sequence
gaatgttttctaatggaccga

SEQ ID NO: 24169 - DNA, 21 bp, Artificial sequence
  SiRNA target sequence
aatgttttctaatggaccgat

SEQ ID NO: 24170 - DNA, 21 bp, Artificial sequence
  SiRNA target sequence
atgttttctaatggaccgata

SEQ ID NO: 24171 - DNA, 21 bp, Artificial sequence
  SiRNA target sequence
tgttttctaatggaccgatag

SEQ ID NO: 24172 - DNA, 21 bp, Artificial sequence
  SiRNA target sequence
gttttctaatggaccgataga

SEQ ID NO: 24173 - DNA, 21 bp, Artificial sequence
  SiRNA target sequence
ttttctaatggaccgatagat

SEQ ID NO: 24174 - DNA, 21 bp, Artificial sequence
  SiRNA target sequence
tttctaatggaccgatagatt

SEQ ID NO: 24175 - DNA, 21 bp, Artificial sequence
  SiRNA target sequence
ttctaatggaccgatagatta

SEQ ID NO: 24176 - DNA, 21 bp, Artificial sequence
  SiRNA target sequence
tctaatggaccgatagattac

SEQ ID NO: 24177 - DNA, 21 bp, Artificial sequence
  SiRNA target sequence
ctaatggaccgatagattacc

SEQ ID NO: 24178 - DNA, 21 bp, Artificial sequence
  SiRNA target sequence
taatggaccgatagattacct

SEQ ID NO: 24179 - DNA, 21 bp, Artificial sequence
  SiRNA target sequence
aatggaccgatagattacctt

SEQ ID NO: 24180 - DNA, 21 bp, Artificial sequence
  SiRNA target sequence
atggaccgatagattaccttg

SEQ ID NO: 24181 - DNA, 21 bp, Artificial sequence
  SiRNA target sequence
tggaccgatagattaccttgt

SEQ ID NO: 24182 - DNA, 21 bp, Artificial sequence
  SiRNA target sequence
ggaccgatagattaccttgtc

SEQ ID NO: 24183 - DNA, 21 bp, Artificial sequence
  SiRNA target sequence
gaccgatagattaccttgtct

SEQ ID NO: 24184 - DNA, 21 bp, Artificial sequence
  SiRNA target sequence
accgatagattaccttgtctg

SEQ ID NO: 24185 - DNA, 21 bp, Artificial sequence
  SiRNA target sequence
ccgatagattaccttgtctgg

SEQ ID NO: 24186 - DNA, 21 bp, Artificial sequence
  SiRNA target sequence
cgatagattaccttgtctgga

SEQ ID NO: 24187 - DNA, 21 bp, Artificial sequence
  SiRNA target sequence
gatagattaccttgtctggag

SEQ ID NO: 24188 - DNA, 21 bp, Artificial sequence
  SiRNA target sequence
atagattaccttgtctggagc

SEQ ID NO: 24189 - DNA, 21 bp, Artificial sequence
  SiRNA target sequence
tagattaccttgtctggagca

SEQ ID NO: 24190 - DNA, 21 bp, Artificial sequence
  SiRNA target sequence
agattaccttgtctggagcaa

SEQ ID NO: 24191 - DNA, 21 bp, Artificial sequence
  SiRNA target sequence
gattaccttgtctggagcaag

SEQ ID NO: 24192 - DNA, 21 bp, Artificial sequence
  SiRNA target sequence
attaccttgtctggagcaaga

SEQ ID NO: 24193 - DNA, 21 bp, Artificial sequence
  SiRNA target sequence
ttaccttgtctggagcaagat

SEQ ID NO: 24194 - DNA, 21 bp, Artificial sequence
  SiRNA target sequence
taccttgtctggagcaagatg

SEQ ID NO: 24195 - DNA, 21 bp, Artificial sequence
  SiRNA target sequence
accttgtctggagcaagatgt

SEQ ID NO: 24196 - DNA, 21 bp, Artificial sequence
  SiRNA target sequence
ccttgtctggagcaagatgta

SEQ ID NO: 24197 - DNA, 21 bp, Artificial sequence
  SiRNA target sequence
cttgtctggagcaagatgtat

SEQ ID NO: 24198 - DNA, 21 bp, Artificial sequence
  SiRNA target sequence
ttgtctggagcaagatgtatt

SEQ ID NO: 24199 - DNA, 21 bp, Artificial sequence
  SiRNA target sequence
tgtctggagcaagatgtattt

SEQ ID NO: 24200 - DNA, 21 bp, Artificial sequence
  SiRNA target sequence
gtctggagcaagatgtatttt

SEQ ID NO: 24201 - DNA, 21 bp, Artificial sequence
  SiRNA target sequence
tctggagcaagatgtatttta

SEQ ID NO: 24202 - DNA, 21 bp, Artificial sequence
  SiRNA target sequence
ctggagcaagatgtattttaa

SEQ ID NO: 24203 - DNA, 21 bp, Artificial sequence
  SiRNA target sequence
tggagcaagatgtattttaat

SEQ ID NO: 24204 - DNA, 21 bp, Artificial sequence
  SiRNA target sequence
ggagcaagatgtattttaatc

SEQ ID NO: 24205 - DNA, 21 bp, Artificial sequence
  SiRNA target sequence
gagcaagatgtattttaatcc

SEQ ID NO: 24206 - DNA, 21 bp, Artificial sequence
  SiRNA target sequence
agcaagatgtattttaatcca

SEQ ID NO: 24207 - DNA, 21 bp, Artificial sequence
  SiRNA target sequence
gcaagatgtattttaatccaa

SEQ ID NO: 24208 - DNA, 21 bp, Artificial sequence
  SiRNA target sequence
caagatgtattttaatccaat

SEQ ID NO: 24209 - DNA, 21 bp, Artificial sequence
  SiRNA target sequence
aagatgtattttaatccaata

SEQ ID NO: 24210 - DNA, 21 bp, Artificial sequence
  SiRNA target sequence
agatgtattttaatccaatag

SEQ ID NO: 24211 - DNA, 21 bp, Artificial sequence
  SiRNA target sequence
gatgtattttaatccaatagt

SEQ ID NO: 24212 - DNA, 21 bp, Artificial sequence
  SiRNA target sequence
atgtattttaatccaatagta

SEQ ID NO: 24213 - DNA, 21 bp, Artificial sequence
  SiRNA target sequence
tgtattttaatccaatagtag

SEQ ID NO: 24214 - DNA, 21 bp, Artificial sequence
  SiRNA target sequence
gtattttaatccaatagtagc

SEQ ID NO: 24215 - DNA, 21 bp, Artificial sequence
  SiRNA target sequence
tattttaatccaatagtagcg

SEQ ID NO: 24216 - DNA, 21 bp, Artificial sequence
  SiRNA target sequence
attttaatccaatagtagcgg

SEQ ID NO: 24217 - DNA, 21 bp, Artificial sequence
  SiRNA target sequence
ttttaatccaatagtagcggt

SEQ ID NO: 24218 - DNA, 21 bp, Artificial sequence
  SiRNA target sequence
tttaatccaatagtagcggtg

SEQ ID NO: 24219 - DNA, 21 bp, Artificial sequence
  SiRNA target sequence
ttaatccaatagtagcggtgt

SEQ ID NO: 24220 - DNA, 21 bp, Artificial sequence
  SiRNA target sequence
taatccaatagtagcggtgtt

SEQ ID NO: 24221 - DNA, 21 bp, Artificial sequence
  SiRNA target sequence
aatccaatagtagcggtgtta

SEQ ID NO: 24222 - DNA, 21 bp, Artificial sequence
  SiRNA target sequence
atccaatagtagcggtgttat

SEQ ID NO: 24223 - DNA, 21 bp, Artificial sequence
  SiRNA target sequence
tccaatagtagcggtgttatc

SEQ ID NO: 24224 - DNA, 21 bp, Artificial sequence
  SiRNA target sequence
ccaatagtagcggtgttatct

SEQ ID NO: 24225 - DNA, 21 bp, Artificial sequence
  SiRNA target sequence
caatagtagcggtgttatctg

SEQ ID NO: 24226 - DNA, 21 bp, Artificial sequence
  SiRNA target sequence
aatagtagcggtgttatctga

SEQ ID NO: 24227 - DNA, 21 bp, Artificial sequence
  SiRNA target sequence
atagtagcggtgttatctgag

SEQ ID NO: 24228 - DNA, 21 bp, Artificial sequence
  SiRNA target sequence
tagtagcggtgttatctgagc

SEQ ID NO: 24229 - DNA, 21 bp, Artificial sequence
  SiRNA target sequence
agtagcggtgttatctgagct

SEQ ID NO: 24230 - DNA, 21 bp, Artificial sequence
  SiRNA target sequence
gtagcggtgttatctgagctc

SEQ ID NO: 24231 - DNA, 21 bp, Artificial sequence
  SiRNA target sequence
tagcggtgttatctgagctca

SEQ ID NO: 24232 - DNA, 21 bp, Artificial sequence
  SiRNA target sequence
agcggtgttatctgagctcaa

SEQ ID NO: 24233 - DNA, 21 bp, Artificial sequence
  SiRNA target sequence
gcggtgttatctgagctcaaa

SEQ ID NO: 24234 - DNA, 21 bp, Artificial sequence
  SiRNA target sequence
cggtgttatctgagctcaaaa

SEQ ID NO: 24235 - DNA, 21 bp, Artificial sequence
  SiRNA target sequence
ggtgttatctgagctcaaaaa

SEQ ID NO: 24236 - DNA, 21 bp, Artificial sequence
  SiRNA target sequence
gtgttatctgagctcaaaaat

SEQ ID NO: 24237 - DNA, 21 bp, Artificial sequence
  SiRNA target sequence
tgttatctgagctcaaaaatg

SEQ ID NO: 24238 - DNA, 21 bp, Artificial sequence
  SiRNA target sequence
gttatctgagctcaaaaatgt

SEQ ID NO: 24239 - DNA, 21 bp, Artificial sequence
  SiRNA target sequence
ttatctgagctcaaaaatgtg

SEQ ID NO: 24240 - DNA, 21 bp, Artificial sequence
  SiRNA target sequence
tatctgagctcaaaaatgtgg

SEQ ID NO: 24241 - DNA, 21 bp, Artificial sequence
  SiRNA target sequence
atctgagctcaaaaatgtgga

SEQ ID NO: 24242 - DNA, 21 bp, Artificial sequence
  SiRNA target sequence
tctgagctcaaaaatgtggat

SEQ ID NO: 24243 - DNA, 21 bp, Artificial sequence
  SiRNA target sequence
ctgagctcaaaaatgtggatc

SEQ ID NO: 24244 - DNA, 21 bp, Artificial sequence
  SiRNA target sequence
tgagctcaaaaatgtggatca

SEQ ID NO: 24245 - DNA, 21 bp, Artificial sequence
  SiRNA target sequence
gagctcaaaaatgtggatcat

SEQ ID NO: 24246 - DNA, 21 bp, Artificial sequence
  SiRNA target sequence
agctcaaaaatgtggatcata

SEQ ID NO: 24247 - DNA, 21 bp, Artificial sequence
  SiRNA target sequence
gctcaaaaatgtggatcatat

SEQ ID NO: 24248 - DNA, 21 bp, Artificial sequence
  SiRNA target sequence
ctcaaaaatgtggatcatatt

SEQ ID NO: 24249 - DNA, 21 bp, Artificial sequence
  SiRNA target sequence
tcaaaaatgtggatcatattt

SEQ ID NO: 24250 - DNA, 21 bp, Artificial sequence
  SiRNA target sequence
caaaaatgtggatcatatttc

SEQ ID NO: 24251 - DNA, 21 bp, Artificial sequence
  SiRNA target sequence
aaaaatgtggatcatatttcc

SEQ ID NO: 24252 - DNA, 21 bp, Artificial sequence
  SiRNA target sequence
aaaatgtggatcatatttccg

SEQ ID NO: 24253 - DNA, 21 bp, Artificial sequence
  SiRNA target sequence
aaatgtggatcatatttccgt

SEQ ID NO: 24254 - DNA, 21 bp, Artificial sequence
  SiRNA target sequence
aatgtggatcatatttccgta

SEQ ID NO: 24255 - DNA, 21 bp, Artificial sequence
  SiRNA target sequence
atgtggatcatatttccgtag

SEQ ID NO: 24256 - DNA, 21 bp, Artificial sequence
  SiRNA target sequence
tgtggatcatatttccgtagg

SEQ ID NO: 24257 - DNA, 21 bp, Artificial sequence
  SiRNA target sequence
gtggatcatatttccgtaggg

SEQ ID NO: 24258 - DNA, 21 bp, Artificial sequence
  SiRNA target sequence
tggatcatatttccgtagggt

SEQ ID NO: 24259 - DNA, 21 bp, Artificial sequence
  SiRNA target sequence
ggatcatatttccgtagggtc

SEQ ID NO: 24260 - DNA, 21 bp, Artificial sequence
  SiRNA target sequence
gatcatatttccgtagggtcc

SEQ ID NO: 24261 - DNA, 21 bp, Artificial sequence
  SiRNA target sequence
atcatatttccgtagggtcca

SEQ ID NO: 24262 - DNA, 21 bp, Artificial sequence
  SiRNA target sequence
tcatatttccgtagggtccaa

SEQ ID NO: 24263 - DNA, 21 bp, Artificial sequence
  SiRNA target sequence
catatttccgtagggtccaat

SEQ ID NO: 24264 - DNA, 21 bp, Artificial sequence
  SiRNA target sequence
atatttccgtagggtccaatg

SEQ ID NO: 24265 - DNA, 21 bp, Artificial sequence
  SiRNA target sequence
tatttccgtagggtccaatgt

SEQ ID NO: 24266 - DNA, 21 bp, Artificial sequence
  SiRNA target sequence
atttccgtagggtccaatgtg

SEQ ID NO: 24267 - DNA, 21 bp, Artificial sequence
  SiRNA target sequence
tttccgtagggtccaatgtgt

SEQ ID NO: 24268 - DNA, 21 bp, Artificial sequence
  SiRNA target sequence
ttccgtagggtccaatgtgta

SEQ ID NO: 24269 - DNA, 21 bp, Artificial sequence
  SiRNA target sequence
tccgtagggtccaatgtgtat

SEQ ID NO: 24270 - DNA, 21 bp, Artificial sequence
  SiRNA target sequence
ccgtagggtccaatgtgtatt

SEQ ID NO: 24271 - DNA, 21 bp, Artificial sequence
  SiRNA target sequence
cgtagggtccaatgtgtattc

SEQ ID NO: 24272 - DNA, 21 bp, Artificial sequence
  SiRNA target sequence
gtagggtccaatgtgtattct

SEQ ID NO: 24273 - DNA, 21 bp, Artificial sequence
  SiRNA target sequence
tagggtccaatgtgtattcta

SEQ ID NO: 24274 - DNA, 21 bp, Artificial sequence
  SiRNA target sequence
agggtccaatgtgtattctac

SEQ ID NO: 24275 - DNA, 21 bp, Artificial sequence
  SiRNA target sequence
gggtccaatgtgtattctacg

SEQ ID NO: 24276 - DNA, 21 bp, Artificial sequence
  SiRNA target sequence
ggtccaatgtgtattctacgg

SEQ ID NO: 24277 - DNA, 21 bp, Artificial sequence
  SiRNA target sequence
gtccaatgtgtattctacgga

SEQ ID NO: 24278 - DNA, 21 bp, Artificial sequence
  SiRNA target sequence
tccaatgtgtattctacggac

SEQ ID NO: 24279 - DNA, 21 bp, Artificial sequence
  SiRNA target sequence
ccaatgtgtattctacggact

SEQ ID NO: 24280 - DNA, 21 bp, Artificial sequence
  SiRNA target sequence
caatgtgtattctacggactg

SEQ ID NO: 24281 - DNA, 21 bp, Artificial sequence
  SiRNA target sequence
aatgtgtattctacggactgg

SEQ ID NO: 24282 - DNA, 21 bp, Artificial sequence
  SiRNA target sequence
atgtgtattctacggactggg

SEQ ID NO: 24283 - DNA, 21 bp, Artificial sequence
  SiRNA target sequence
tgtgtattctacggactggga

SEQ ID NO: 24284 - DNA, 21 bp, Artificial sequence
  SiRNA target sequence
gtgtattctacggactgggat

SEQ ID NO: 24285 - DNA, 21 bp, Artificial sequence
  SiRNA target sequence
tgtattctacggactgggatg

SEQ ID NO: 24286 - DNA, 21 bp, Artificial sequence
  SiRNA target sequence
gtattctacggactgggatgt

SEQ ID NO: 24287 - DNA, 21 bp, Artificial sequence
  SiRNA target sequence
tattctacggactgggatgtt

SEQ ID NO: 24288 - DNA, 21 bp, Artificial sequence
  SiRNA target sequence
attctacggactgggatgtta

SEQ ID NO: 24289 - DNA, 21 bp, Artificial sequence
  SiRNA target sequence
ttctacggactgggatgttat

SEQ ID NO: 24290 - DNA, 21 bp, Artificial sequence
  SiRNA target sequence
tctacggactgggatgttatc

SEQ ID NO: 24291 - DNA, 21 bp, Artificial sequence
  SiRNA target sequence
ctacggactgggatgttatcg

SEQ ID NO: 24292 - DNA, 21 bp, Artificial sequence
  SiRNA target sequence
tacggactgggatgttatcgc

SEQ ID NO: 24293 - DNA, 21 bp, Artificial sequence
  SiRNA target sequence
acggactgggatgttatcgca

SEQ ID NO: 24294 - DNA, 21 bp, Artificial sequence
  SiRNA target sequence
cggactgggatgttatcgcaa

SEQ ID NO: 24295 - DNA, 21 bp, Artificial sequence
  SiRNA target sequence
ggactgggatgttatcgcaag

SEQ ID NO: 24296 - DNA, 21 bp, Artificial sequence
  SiRNA target sequence
gactgggatgttatcgcaaga

SEQ ID NO: 24297 - DNA, 21 bp, Artificial sequence
  SiRNA target sequence
actgggatgttatcgcaagat

SEQ ID NO: 24298 - DNA, 21 bp, Artificial sequence
  SiRNA target sequence
ctgggatgttatcgcaagata

SEQ ID NO: 24299 - DNA, 21 bp, Artificial sequence
  SiRNA target sequence
tgggatgttatcgcaagatac

SEQ ID NO: 24300 - DNA, 21 bp, Artificial sequence
  SiRNA target sequence
gggatgttatcgcaagatact

SEQ ID NO: 24301 - DNA, 21 bp, Artificial sequence
  SiRNA target sequence
ggatgttatcgcaagatactt

SEQ ID NO: 24302 - DNA, 21 bp, Artificial sequence
  SiRNA target sequence
gatgttatcgcaagatacttg

SEQ ID NO: 24303 - DNA, 21 bp, Artificial sequence
  SiRNA target sequence
atgttatcgcaagatacttga

SEQ ID NO: 24304 - DNA, 21 bp, Artificial sequence
  SiRNA target sequence
tgttatcgcaagatacttgaa

SEQ ID NO: 24305 - DNA, 21 bp, Artificial sequence
  SiRNA target sequence
gttatcgcaagatacttgaag

SEQ ID NO: 24306 - DNA, 21 bp, Artificial sequence
  SiRNA target sequence
ttatcgcaagatacttgaagt

SEQ ID NO: 24307 - DNA, 21 bp, Artificial sequence
  SiRNA target sequence
tatcgcaagatacttgaagtc

SEQ ID NO: 24308 - DNA, 21 bp, Artificial sequence
  SiRNA target sequence
atcgcaagatacttgaagtca

SEQ ID NO: 24309 - DNA, 21 bp, Artificial sequence
  SiRNA target sequence
tcgcaagatacttgaagtcaa

SEQ ID NO: 24310 - DNA, 21 bp, Artificial sequence
  SiRNA target sequence
cgcaagatacttgaagtcaaa

SEQ ID NO: 24311 - DNA, 21 bp, Artificial sequence
  SiRNA target sequence
gcaagatacttgaagtcaaaa

SEQ ID NO: 24312 - DNA, 21 bp, Artificial sequence
  SiRNA target sequence
caagatacttgaagtcaaaat

SEQ ID NO: 24313 - DNA, 21 bp, Artificial sequence
  SiRNA target sequence
aagatacttgaagtcaaaatc

SEQ ID NO: 24314 - DNA, 21 bp, Artificial sequence
  SiRNA target sequence
agatacttgaagtcaaaatct

SEQ ID NO: 24315 - DNA, 21 bp, Artificial sequence
  SiRNA target sequence
gatacttgaagtcaaaatctc

SEQ ID NO: 24316 - DNA, 21 bp, Artificial sequence
  SiRNA target sequence
atacttgaagtcaaaatctca

SEQ ID NO: 24317 - DNA, 21 bp, Artificial sequence
  SiRNA target sequence
tacttgaagtcaaaatctcac

SEQ ID NO: 24318 - DNA, 21 bp, Artificial sequence
  SiRNA target sequence
acttgaagtcaaaatctcacc

SEQ ID NO: 24319 - DNA, 21 bp, Artificial sequence
  SiRNA target sequence
cttgaagtcaaaatctcacca

SEQ ID NO: 24320 - DNA, 21 bp, Artificial sequence
  SiRNA target sequence
ttgaagtcaaaatctcaccat

SEQ ID NO: 24321 - DNA, 21 bp, Artificial sequence
  SiRNA target sequence
tgaagtcaaaatctcaccata

SEQ ID NO: 24322 - DNA, 21 bp, Artificial sequence
  SiRNA target sequence
gaagtcaaaatctcaccatat

SEQ ID NO: 24323 - DNA, 21 bp, Artificial sequence
  SiRNA target sequence
aagtcaaaatctcaccatatg

SEQ ID NO: 24324 - DNA, 21 bp, Artificial sequence
  SiRNA target sequence
agtcaaaatctcaccatatgg

SEQ ID NO: 24325 - DNA, 21 bp, Artificial sequence
  SiRNA target sequence
gtcaaaatctcaccatatggt

SEQ ID NO: 24326 - DNA, 21 bp, Artificial sequence
  SiRNA target sequence
tcaaaatctcaccatatggtg

SEQ ID NO: 24327 - DNA, 21 bp, Artificial sequence
  SiRNA target sequence
caaaatctcaccatatggtgg

SEQ ID NO: 24328 - DNA, 21 bp, Artificial sequence
  SiRNA target sequence
aaaatctcaccatatggtggc

SEQ ID NO: 24329 - DNA, 21 bp, Artificial sequence
  SiRNA target sequence
aaatctcaccatatggtggca

SEQ ID NO: 24330 - DNA, 21 bp, Artificial sequence
  SiRNA target sequence
aatctcaccatatggtggcag

SEQ ID NO: 24331 - DNA, 21 bp, Artificial sequence
  SiRNA target sequence
atctcaccatatggtggcagg

SEQ ID NO: 24332 - DNA, 21 bp, Artificial sequence
  SiRNA target sequence
tctcaccatatggtggcagga

SEQ ID NO: 24333 - DNA, 21 bp, Artificial sequence
  SiRNA target sequence
ctcaccatatggtggcaggag

SEQ ID NO: 24334 - DNA, 21 bp, Artificial sequence
  SiRNA target sequence
tcaccatatggtggcaggaga

SEQ ID NO: 24335 - DNA, 21 bp, Artificial sequence
  SiRNA target sequence
caccatatggtggcaggagac

SEQ ID NO: 24336 - DNA, 21 bp, Artificial sequence
  SiRNA target sequence
accatatggtggcaggagact

SEQ ID NO: 24337 - DNA, 21 bp, Artificial sequence
  SiRNA target sequence
ccatatggtggcaggagactt

SEQ ID NO: 24338 - DNA, 21 bp, Artificial sequence
  SiRNA target sequence
catatggtggcaggagacttt

SEQ ID NO: 24339 - DNA, 21 bp, Artificial sequence
  SiRNA target sequence
atatggtggcaggagactttg

SEQ ID NO: 24340 - DNA, 21 bp, Artificial sequence
  SiRNA target sequence
tatggtggcaggagactttga

SEQ ID NO: 24341 - DNA, 21 bp, Artificial sequence
  SiRNA target sequence
atggtggcaggagactttgaa

SEQ ID NO: 24342 - DNA, 21 bp, Artificial sequence
  SiRNA target sequence
tggtggcaggagactttgaag

SEQ ID NO: 24343 - DNA, 21 bp, Artificial sequence
  SiRNA target sequence
ggtggcaggagactttgaagg

SEQ ID NO: 24344 - DNA, 21 bp, Artificial sequence
  SiRNA target sequence
gtggcaggagactttgaaggc

SEQ ID NO: 24345 - DNA, 21 bp, Artificial sequence
  SiRNA target sequence
tggcaggagactttgaaggct

SEQ ID NO: 24346 - DNA, 21 bp, Artificial sequence
  SiRNA target sequence
ggcaggagactttgaaggctt

SEQ ID NO: 24347 - DNA, 21 bp, Artificial sequence
  SiRNA target sequence
gcaggagactttgaaggcttc

SEQ ID NO: 24348 - DNA, 21 bp, Artificial sequence
  SiRNA target sequence
caggagactttgaaggcttcg

SEQ ID NO: 24349 - DNA, 21 bp, Artificial sequence
  SiRNA target sequence
aggagactttgaaggcttcga

SEQ ID NO: 24350 - DNA, 21 bp, Artificial sequence
  SiRNA target sequence
ggagactttgaaggcttcgat

SEQ ID NO: 24351 - DNA, 21 bp, Artificial sequence
  SiRNA target sequence
gagactttgaaggcttcgatg

SEQ ID NO: 24352 - DNA, 21 bp, Artificial sequence
  SiRNA target sequence
agactttgaaggcttcgatgc

SEQ ID NO: 24353 - DNA, 21 bp, Artificial sequence
  SiRNA target sequence
gactttgaaggcttcgatgct

SEQ ID NO: 24354 - DNA, 21 bp, Artificial sequence
  SiRNA target sequence
actttgaaggcttcgatgctt

SEQ ID NO: 24355 - DNA, 21 bp, Artificial sequence
  SiRNA target sequence
ctttgaaggcttcgatgcttc

SEQ ID NO: 24356 - DNA, 21 bp, Artificial sequence
  SiRNA target sequence
tttgaaggcttcgatgcttcg

SEQ ID NO: 24357 - DNA, 21 bp, Artificial sequence
  SiRNA target sequence
ttgaaggcttcgatgcttcgg

SEQ ID NO: 24358 - DNA, 21 bp, Artificial sequence
  SiRNA target sequence
tgaaggcttcgatgcttcgga

SEQ ID NO: 24359 - DNA, 21 bp, Artificial sequence
  SiRNA target sequence
gaaggcttcgatgcttcggaa

SEQ ID NO: 24360 - DNA, 21 bp, Artificial sequence
  SiRNA target sequence
aaggcttcgatgcttcggaac

SEQ ID NO: 24361 - DNA, 21 bp, Artificial sequence
  SiRNA target sequence
aggcttcgatgcttcggaaca

SEQ ID NO: 24362 - DNA, 21 bp, Artificial sequence
  SiRNA target sequence
ggcttcgatgcttcggaacag

SEQ ID NO: 24363 - DNA, 21 bp, Artificial sequence
  SiRNA target sequence
gcttcgatgcttcggaacagt

SEQ ID NO: 24364 - DNA, 21 bp, Artificial sequence
  SiRNA target sequence
cttcgatgcttcggaacagtc

SEQ ID NO: 24365 - DNA, 21 bp, Artificial sequence
  SiRNA target sequence
ttcgatgcttcggaacagtcc

SEQ ID NO: 24366 - DNA, 21 bp, Artificial sequence
  SiRNA target sequence
tcgatgcttcggaacagtccg

SEQ ID NO: 24367 - DNA, 21 bp, Artificial sequence
  SiRNA target sequence
cgatgcttcggaacagtccga

SEQ ID NO: 24368 - DNA, 21 bp, Artificial sequence
  SiRNA target sequence
gatgcttcggaacagtccgac

SEQ ID NO: 24369 - DNA, 21 bp, Artificial sequence
  SiRNA target sequence
atgcttcggaacagtccgaca

SEQ ID NO: 24370 - DNA, 21 bp, Artificial sequence
  SiRNA target sequence
tgcttcggaacagtccgacat

SEQ ID NO: 24371 - DNA, 21 bp, Artificial sequence
  SiRNA target sequence
gcttcggaacagtccgacata

SEQ ID NO: 24372 - DNA, 21 bp, Artificial sequence
  SiRNA target sequence
cttcggaacagtccgacatat

SEQ ID NO: 24373 - DNA, 21 bp, Artificial sequence
  SiRNA target sequence
ttcggaacagtccgacatatt

SEQ ID NO: 24374 - DNA, 21 bp, Artificial sequence
  SiRNA target sequence
tcggaacagtccgacatattg

SEQ ID NO: 24375 - DNA, 21 bp, Artificial sequence
  SiRNA target sequence
cggaacagtccgacatattgt

SEQ ID NO: 24376 - DNA, 21 bp, Artificial sequence
  SiRNA target sequence
ggaacagtccgacatattgta

SEQ ID NO: 24377 - DNA, 21 bp, Artificial sequence
  SiRNA target sequence
gaacagtccgacatattgtac

SEQ ID NO: 24378 - DNA, 21 bp, Artificial sequence
  SiRNA target sequence
aacagtccgacatattgtacg

SEQ ID NO: 24379 - DNA, 21 bp, Artificial sequence
  SiRNA target sequence
acagtccgacatattgtacgc

SEQ ID NO: 24380 - DNA, 21 bp, Artificial sequence
  SiRNA target sequence
cagtccgacatattgtacgct

SEQ ID NO: 24381 - DNA, 21 bp, Artificial sequence
  SiRNA target sequence
agtccgacatattgtacgctg

SEQ ID NO: 24382 - DNA, 21 bp, Artificial sequence
  SiRNA target sequence
gtccgacatattgtacgctgc

SEQ ID NO: 24383 - DNA, 21 bp, Artificial sequence
  SiRNA target sequence
tccgacatattgtacgctgcg

SEQ ID NO: 24384 - DNA, 21 bp, Artificial sequence
  SiRNA target sequence
ccgacatattgtacgctgcgg

SEQ ID NO: 24385 - DNA, 21 bp, Artificial sequence
  SiRNA target sequence
cgacatattgtacgctgcggg

SEQ ID NO: 24386 - DNA, 21 bp, Artificial sequence
  SiRNA target sequence
gacatattgtacgctgcggga

SEQ ID NO: 24387 - DNA, 21 bp, Artificial sequence
  SiRNA target sequence
acatattgtacgctgcgggag

SEQ ID NO: 24388 - DNA, 21 bp, Artificial sequence
  SiRNA target sequence
catattgtacgctgcgggaga

SEQ ID NO: 24389 - DNA, 21 bp, Artificial sequence
  SiRNA target sequence
atattgtacgctgcgggagaa

SEQ ID NO: 24390 - DNA, 21 bp, Artificial sequence
  SiRNA target sequence
tattgtacgctgcgggagaag

SEQ ID NO: 24391 - DNA, 21 bp, Artificial sequence
  SiRNA target sequence
attgtacgctgcgggagaagt

SEQ ID NO: 24392 - DNA, 21 bp, Artificial sequence
  SiRNA target sequence
ttgtacgctgcgggagaagtt

SEQ ID NO: 24393 - DNA, 21 bp, Artificial sequence
  SiRNA target sequence
tgtacgctgcgggagaagttt

SEQ ID NO: 24394 - DNA, 21 bp, Artificial sequence
  SiRNA target sequence
gtacgctgcgggagaagtttt

SEQ ID NO: 24395 - DNA, 21 bp, Artificial sequence
  SiRNA target sequence
tacgctgcgggagaagtttta

SEQ ID NO: 24396 - DNA, 21 bp, Artificial sequence
  SiRNA target sequence
acgctgcgggagaagttttac

SEQ ID NO: 24397 - DNA, 21 bp, Artificial sequence
  SiRNA target sequence
cgctgcgggagaagttttaca

SEQ ID NO: 24398 - DNA, 21 bp, Artificial sequence
  SiRNA target sequence
gctgcgggagaagttttacaa

SEQ ID NO: 24399 - DNA, 21 bp, Artificial sequence
  SiRNA target sequence
ctgcgggagaagttttacaag

SEQ ID NO: 24400 - DNA, 21 bp, Artificial sequence
  SiRNA target sequence
tgcgggagaagttttacaaga

SEQ ID NO: 24401 - DNA, 21 bp, Artificial sequence
  SiRNA target sequence
gcgggagaagttttacaagag

SEQ ID NO: 24402 - DNA, 21 bp, Artificial sequence
  SiRNA target sequence
cgggagaagttttacaagagt

SEQ ID NO: 24403 - DNA, 21 bp, Artificial sequence
  SiRNA target sequence
gggagaagttttacaagagtt

SEQ ID NO: 24404 - DNA, 21 bp, Artificial sequence
  SiRNA target sequence
ggagaagttttacaagagttg

SEQ ID NO: 24405 - DNA, 21 bp, Artificial sequence
  SiRNA target sequence
gagaagttttacaagagttga

SEQ ID NO: 24406 - DNA, 21 bp, Artificial sequence
  SiRNA target sequence
agaagttttacaagagttgag

SEQ ID NO: 24407 - DNA, 21 bp, Artificial sequence
  SiRNA target sequence
gaagttttacaagagttgagt

SEQ ID NO: 24408 - DNA, 21 bp, Artificial sequence
  SiRNA target sequence
aagttttacaagagttgagta

SEQ ID NO: 24409 - DNA, 21 bp, Artificial sequence
  SiRNA target sequence
agttttacaagagttgagtaa

SEQ ID NO: 24410 - DNA, 21 bp, Artificial sequence
  SiRNA target sequence
gttttacaagagttgagtaag

SEQ ID NO: 24411 - DNA, 21 bp, Artificial sequence
  SiRNA target sequence
ttttacaagagttgagtaaga

SEQ ID NO: 24412 - DNA, 21 bp, Artificial sequence
  SiRNA target sequence
tttacaagagttgagtaagaa

SEQ ID NO: 24413 - DNA, 21 bp, Artificial sequence
  SiRNA target sequence
ttacaagagttgagtaagaaa

SEQ ID NO: 24414 - DNA, 21 bp, Artificial sequence
  SiRNA target sequence
tacaagagttgagtaagaaaa

SEQ ID NO: 24415 - DNA, 21 bp, Artificial sequence
  SiRNA target sequence
acaagagttgagtaagaaaat

SEQ ID NO: 24416 - DNA, 21 bp, Artificial sequence
  SiRNA target sequence
caagagttgagtaagaaaatt

SEQ ID NO: 24417 - DNA, 21 bp, Artificial sequence
  SiRNA target sequence
aagagttgagtaagaaaattt

SEQ ID NO: 24418 - DNA, 21 bp, Artificial sequence
  SiRNA target sequence
agagttgagtaagaaaatttt

SEQ ID NO: 24419 - DNA, 21 bp, Artificial sequence
  SiRNA target sequence
gagttgagtaagaaaattttt

SEQ ID NO: 24420 - DNA, 21 bp, Artificial sequence
  SiRNA target sequence
agttgagtaagaaaattttta

SEQ ID NO: 24421 - DNA, 21 bp, Artificial sequence
  SiRNA target sequence
gttgagtaagaaaatttttaa

SEQ ID NO: 24422 - DNA, 21 bp, Artificial sequence
  SiRNA target sequence
ttgagtaagaaaatttttaac

SEQ ID NO: 24423 - DNA, 21 bp, Artificial sequence
  SiRNA target sequence
tgagtaagaaaatttttaact

SEQ ID NO: 24424 - DNA, 21 bp, Artificial sequence
  SiRNA target sequence
gagtaagaaaatttttaactc

SEQ ID NO: 24425 - DNA, 21 bp, Artificial sequence
  SiRNA target sequence
agtaagaaaatttttaactca

SEQ ID NO: 24426 - DNA, 21 bp, Artificial sequence
  SiRNA target sequence
gtaagaaaatttttaactcaa

SEQ ID NO: 24427 - DNA, 21 bp, Artificial sequence
  SiRNA target sequence
taagaaaatttttaactcaac

SEQ ID NO: 24428 - DNA, 21 bp, Artificial sequence
  SiRNA target sequence
aagaaaatttttaactcaacc

SEQ ID NO: 24429 - DNA, 21 bp, Artificial sequence
  SiRNA target sequence
agaaaatttttaactcaaccg

SEQ ID NO: 24430 - DNA, 21 bp, Artificial sequence
  SiRNA target sequence
gaaaatttttaactcaaccga

SEQ ID NO: 24431 - DNA, 21 bp, Artificial sequence
  SiRNA target sequence
aaaatttttaactcaaccgag

SEQ ID NO: 24432 - DNA, 21 bp, Artificial sequence
  SiRNA target sequence
aaatttttaactcaaccgagg

SEQ ID NO: 24433 - DNA, 21 bp, Artificial sequence
  SiRNA target sequence
aatttttaactcaaccgagga

SEQ ID NO: 24434 - DNA, 21 bp, Artificial sequence
  SiRNA target sequence
atttttaactcaaccgaggat

SEQ ID NO: 24435 - DNA, 21 bp, Artificial sequence
  SiRNA target sequence
tttttaactcaaccgaggatg

SEQ ID NO: 24436 - DNA, 21 bp, Artificial sequence
  SiRNA target sequence
ttttaactcaaccgaggatga

SEQ ID NO: 24437 - DNA, 21 bp, Artificial sequence
  SiRNA target sequence
tttaactcaaccgaggatgag

SEQ ID NO: 24438 - DNA, 21 bp, Artificial sequence
  SiRNA target sequence
ttaactcaaccgaggatgaga

SEQ ID NO: 24439 - DNA, 21 bp, Artificial sequence
  SiRNA target sequence
taactcaaccgaggatgagat

SEQ ID NO: 24440 - DNA, 21 bp, Artificial sequence
  SiRNA target sequence
aactcaaccgaggatgagatt

SEQ ID NO: 24441 - DNA, 21 bp, Artificial sequence
  SiRNA target sequence
actcaaccgaggatgagattt

SEQ ID NO: 24442 - DNA, 21 bp, Artificial sequence
  SiRNA target sequence
ctcaaccgaggatgagatttt

SEQ ID NO: 24443 - DNA, 21 bp, Artificial sequence
  SiRNA target sequence
tcaaccgaggatgagattttg

SEQ ID NO: 24444 - DNA, 21 bp, Artificial sequence
  SiRNA target sequence
caaccgaggatgagattttgc

SEQ ID NO: 24445 - DNA, 21 bp, Artificial sequence
  SiRNA target sequence
aaccgaggatgagattttgca

SEQ ID NO: 24446 - DNA, 21 bp, Artificial sequence
  SiRNA target sequence
accgaggatgagattttgcag

SEQ ID NO: 24447 - DNA, 21 bp, Artificial sequence
  SiRNA target sequence
ccgaggatgagattttgcagc

SEQ ID NO: 24448 - DNA, 21 bp, Artificial sequence
  SiRNA target sequence
cgaggatgagattttgcagca

SEQ ID NO: 24449 - DNA, 21 bp, Artificial sequence
  SiRNA target sequence
gaggatgagattttgcagcag

SEQ ID NO: 24450 - DNA, 21 bp, Artificial sequence
  SiRNA target sequence
aggatgagattttgcagcaga

SEQ ID NO: 24451 - DNA, 21 bp, Artificial sequence
  SiRNA target sequence
ggatgagattttgcagcagaa

SEQ ID NO: 24452 - DNA, 21 bp, Artificial sequence
  SiRNA target sequence
gatgagattttgcagcagaag

SEQ ID NO: 24453 - DNA, 21 bp, Artificial sequence
  SiRNA target sequence
atgagattttgcagcagaagg

SEQ ID NO: 24454 - DNA, 21 bp, Artificial sequence
  SiRNA target sequence
tgagattttgcagcagaaggc

SEQ ID NO: 24455 - DNA, 21 bp, Artificial sequence
  SiRNA target sequence
gagattttgcagcagaaggct

SEQ ID NO: 24456 - DNA, 21 bp, Artificial sequence
  SiRNA target sequence
agattttgcagcagaaggcta

SEQ ID NO: 24457 - DNA, 21 bp, Artificial sequence
  SiRNA target sequence
gattttgcagcagaaggctat

SEQ ID NO: 24458 - DNA, 21 bp, Artificial sequence
  SiRNA target sequence
attttgcagcagaaggctatc

SEQ ID NO: 24459 - DNA, 21 bp, Artificial sequence
  SiRNA target sequence
ttttgcagcagaaggctatcc

SEQ ID NO: 24460 - DNA, 21 bp, Artificial sequence
  SiRNA target sequence
tttgcagcagaaggctatcct

SEQ ID NO: 24461 - DNA, 21 bp, Artificial sequence
  SiRNA target sequence
ttgcagcagaaggctatcctt

SEQ ID NO: 24462 - DNA, 21 bp, Artificial sequence
  SiRNA target sequence
tgcagcagaaggctatccttc

SEQ ID NO: 24463 - DNA, 21 bp, Artificial sequence
  SiRNA target sequence
gcagcagaaggctatccttca

SEQ ID NO: 24464 - DNA, 21 bp, Artificial sequence
  SiRNA target sequence
cagcagaaggctatccttcat

SEQ ID NO: 24465 - DNA, 21 bp, Artificial sequence
  SiRNA target sequence
agcagaaggctatccttcatt

SEQ ID NO: 24466 - DNA, 21 bp, Artificial sequence
  SiRNA target sequence
gcagaaggctatccttcattc

SEQ ID NO: 24467 - DNA, 21 bp, Artificial sequence
  SiRNA target sequence
cagaaggctatccttcattcg

SEQ ID NO: 24468 - DNA, 21 bp, Artificial sequence
  SiRNA target sequence
agaaggctatccttcattcgt

SEQ ID NO: 24469 - DNA, 21 bp, Artificial sequence
  SiRNA target sequence
gaaggctatccttcattcgtt

SEQ ID NO: 24470 - DNA, 21 bp, Artificial sequence
  SiRNA target sequence
aaggctatccttcattcgttg

SEQ ID NO: 24471 - DNA, 21 bp, Artificial sequence
  SiRNA target sequence
aggctatccttcattcgttgg

SEQ ID NO: 24472 - DNA, 21 bp, Artificial sequence
  SiRNA target sequence
ggctatccttcattcgttggt

SEQ ID NO: 24473 - DNA, 21 bp, Artificial sequence
  SiRNA target sequence
gctatccttcattcgttggtt

SEQ ID NO: 24474 - DNA, 21 bp, Artificial sequence
  SiRNA target sequence
ctatccttcattcgttggtta

SEQ ID NO: 24475 - DNA, 21 bp, Artificial sequence
  SiRNA target sequence
tatccttcattcgttggttaa

SEQ ID NO: 24476 - DNA, 21 bp, Artificial sequence
  SiRNA target sequence
atccttcattcgttggttaat

SEQ ID NO: 24477 - DNA, 21 bp, Artificial sequence
  SiRNA target sequence
tccttcattcgttggttaatt

SEQ ID NO: 24478 - DNA, 21 bp, Artificial sequence
  SiRNA target sequence
ccttcattcgttggttaattc

SEQ ID NO: 24479 - DNA, 21 bp, Artificial sequence
  SiRNA target sequence
cttcattcgttggttaattct

SEQ ID NO: 24480 - DNA, 21 bp, Artificial sequence
  SiRNA target sequence
ttcattcgttggttaattctc

SEQ ID NO: 24481 - DNA, 21 bp, Artificial sequence
  SiRNA target sequence
tcattcgttggttaattctct

SEQ ID NO: 24482 - DNA, 21 bp, Artificial sequence
  SiRNA target sequence
cattcgttggttaattctctt

SEQ ID NO: 24483 - DNA, 21 bp, Artificial sequence
  SiRNA target sequence
attcgttggttaattctcttc

SEQ ID NO: 24484 - DNA, 21 bp, Artificial sequence
  SiRNA target sequence
ttcgttggttaattctcttca

SEQ ID NO: 24485 - DNA, 21 bp, Artificial sequence
  SiRNA target sequence
tcgttggttaattctcttcat

SEQ ID NO: 24486 - DNA, 21 bp, Artificial sequence
  SiRNA target sequence
cgttggttaattctcttcata

SEQ ID NO: 24487 - DNA, 21 bp, Artificial sequence
  SiRNA target sequence
gttggttaattctcttcatat

SEQ ID NO: 24488 - DNA, 21 bp, Artificial sequence
  SiRNA target sequence
ttggttaattctcttcatatc

SEQ ID NO: 24489 - DNA, 21 bp, Artificial sequence
  SiRNA target sequence
tggttaattctcttcatatca

SEQ ID NO: 24490 - DNA, 21 bp, Artificial sequence
  SiRNA target sequence
ggttaattctcttcatatcaa

SEQ ID NO: 24491 - DNA, 21 bp, Artificial sequence
  SiRNA target sequence
gttaattctcttcatatcaat

SEQ ID NO: 24492 - DNA, 21 bp, Artificial sequence
  SiRNA target sequence
ttaattctcttcatatcaatg

SEQ ID NO: 24493 - DNA, 21 bp, Artificial sequence
  SiRNA target sequence
taattctcttcatatcaatga

SEQ ID NO: 24494 - DNA, 21 bp, Artificial sequence
  SiRNA target sequence
aattctcttcatatcaatgaa

SEQ ID NO: 24495 - DNA, 21 bp, Artificial sequence
  SiRNA target sequence
attctcttcatatcaatgaaa

SEQ ID NO: 24496 - DNA, 21 bp, Artificial sequence
  SiRNA target sequence
ttctcttcatatcaatgaaaa

SEQ ID NO: 24497 - DNA, 21 bp, Artificial sequence
  SiRNA target sequence
tctcttcatatcaatgaaaat

SEQ ID NO: 24498 - DNA, 21 bp, Artificial sequence
  SiRNA target sequence
ctcttcatatcaatgaaaatg

SEQ ID NO: 24499 - DNA, 21 bp, Artificial sequence
  SiRNA target sequence
tcttcatatcaatgaaaatgg

SEQ ID NO: 24500 - DNA, 21 bp, Artificial sequence
  SiRNA target sequence
cttcatatcaatgaaaatgga

SEQ ID NO: 24501 - DNA, 21 bp, Artificial sequence
  SiRNA target sequence
ttcatatcaatgaaaatggaa

SEQ ID NO: 24502 - DNA, 21 bp, Artificial sequence
  SiRNA target sequence
tcatatcaatgaaaatggaat

SEQ ID NO: 24503 - DNA, 21 bp, Artificial sequence
  SiRNA target sequence
catatcaatgaaaatggaatt

SEQ ID NO: 24504 - DNA, 21 bp, Artificial sequence
  SiRNA target sequence
atatcaatgaaaatggaattg

SEQ ID NO: 24505 - DNA, 21 bp, Artificial sequence
  SiRNA target sequence
tatcaatgaaaatggaattgt

SEQ ID NO: 24506 - DNA, 21 bp, Artificial sequence
  SiRNA target sequence
atcaatgaaaatggaattgtc

SEQ ID NO: 24507 - DNA, 21 bp, Artificial sequence
  SiRNA target sequence
tcaatgaaaatggaattgtcc

SEQ ID NO: 24508 - DNA, 21 bp, Artificial sequence
  SiRNA target sequence
caatgaaaatggaattgtcct

SEQ ID NO: 24509 - DNA, 21 bp, Artificial sequence
  SiRNA target sequence
aatgaaaatggaattgtcctt

SEQ ID NO: 24510 - DNA, 21 bp, Artificial sequence
  SiRNA target sequence
atgaaaatggaattgtccttc

SEQ ID NO: 24511 - DNA, 21 bp, Artificial sequence
  SiRNA target sequence
tgaaaatggaattgtccttca

SEQ ID NO: 24512 - DNA, 21 bp, Artificial sequence
  SiRNA target sequence
gaaaatggaattgtccttcaa

SEQ ID NO: 24513 - DNA, 21 bp, Artificial sequence
  SiRNA target sequence
aaaatggaattgtccttcaat

SEQ ID NO: 24514 - DNA, 21 bp, Artificial sequence
  SiRNA target sequence
aaatggaattgtccttcaatg

SEQ ID NO: 24515 - DNA, 21 bp, Artificial sequence
  SiRNA target sequence
aatggaattgtccttcaatgg

SEQ ID NO: 24516 - DNA, 21 bp, Artificial sequence
  SiRNA target sequence
atggaattgtccttcaatggt

SEQ ID NO: 24517 - DNA, 21 bp, Artificial sequence
  SiRNA target sequence
tggaattgtccttcaatggtg

SEQ ID NO: 24518 - DNA, 21 bp, Artificial sequence
  SiRNA target sequence
ggaattgtccttcaatggtgc

SEQ ID NO: 24519 - DNA, 21 bp, Artificial sequence
  SiRNA target sequence
gaattgtccttcaatggtgca

SEQ ID NO: 24520 - DNA, 21 bp, Artificial sequence
  SiRNA target sequence
aattgtccttcaatggtgcaa

SEQ ID NO: 24521 - DNA, 21 bp, Artificial sequence
  SiRNA target sequence
attgtccttcaatggtgcaag

SEQ ID NO: 24522 - DNA, 21 bp, Artificial sequence
  SiRNA target sequence
ttgtccttcaatggtgcaagt

SEQ ID NO: 24523 - DNA, 21 bp, Artificial sequence
  SiRNA target sequence
tgtccttcaatggtgcaagtc

SEQ ID NO: 24524 - DNA, 21 bp, Artificial sequence
  SiRNA target sequence
gtccttcaatggtgcaagtct

SEQ ID NO: 24525 - DNA, 21 bp, Artificial sequence
  SiRNA target sequence
tccttcaatggtgcaagtctc

SEQ ID NO: 24526 - DNA, 21 bp, Artificial sequence
  SiRNA target sequence
ccttcaatggtgcaagtctct

SEQ ID NO: 24527 - DNA, 21 bp, Artificial sequence
  SiRNA target sequence
cttcaatggtgcaagtctctt

SEQ ID NO: 24528 - DNA, 21 bp, Artificial sequence
  SiRNA target sequence
ttcaatggtgcaagtctcttc

SEQ ID NO: 24529 - DNA, 21 bp, Artificial sequence
  SiRNA target sequence
tcaatggtgcaagtctcttcc

SEQ ID NO: 24530 - DNA, 21 bp, Artificial sequence
  SiRNA target sequence
caatggtgcaagtctcttcct

SEQ ID NO: 24531 - DNA, 21 bp, Artificial sequence
  SiRNA target sequence
aatggtgcaagtctcttccta

SEQ ID NO: 24532 - DNA, 21 bp, Artificial sequence
  SiRNA target sequence
atggtgcaagtctcttcctag

SEQ ID NO: 24533 - DNA, 21 bp, Artificial sequence
  SiRNA target sequence
tggtgcaagtctcttcctagt

SEQ ID NO: 24534 - DNA, 21 bp, Artificial sequence
  SiRNA target sequence
ggtgcaagtctcttcctagtg

SEQ ID NO: 24535 - DNA, 21 bp, Artificial sequence
  SiRNA target sequence
gtgcaagtctcttcctagtgg

SEQ ID NO: 24536 - DNA, 21 bp, Artificial sequence
  SiRNA target sequence
tgcaagtctcttcctagtggc

SEQ ID NO: 24537 - DNA, 21 bp, Artificial sequence
  SiRNA target sequence
gcaagtctcttcctagtggcc

SEQ ID NO: 24538 - DNA, 21 bp, Artificial sequence
  SiRNA target sequence
caagtctcttcctagtggcca

SEQ ID NO: 24539 - DNA, 21 bp, Artificial sequence
  SiRNA target sequence
aagtctcttcctagtggccat

SEQ ID NO: 24540 - DNA, 21 bp, Artificial sequence
  SiRNA target sequence
agtctcttcctagtggccatt

SEQ ID NO: 24541 - DNA, 21 bp, Artificial sequence
  SiRNA target sequence
gtctcttcctagtggccatta

SEQ ID NO: 24542 - DNA, 21 bp, Artificial sequence
  SiRNA target sequence
tctcttcctagtggccattat

SEQ ID NO: 24543 - DNA, 21 bp, Artificial sequence
  SiRNA target sequence
ctcttcctagtggccattatc

SEQ ID NO: 24544 - DNA, 21 bp, Artificial sequence
  SiRNA target sequence
tcttcctagtggccattatct

SEQ ID NO: 24545 - DNA, 21 bp, Artificial sequence
  SiRNA target sequence
cttcctagtggccattatctc

SEQ ID NO: 24546 - DNA, 21 bp, Artificial sequence
  SiRNA target sequence
ttcctagtggccattatctca

SEQ ID NO: 24547 - DNA, 21 bp, Artificial sequence
  SiRNA target sequence
tcctagtggccattatctcac

SEQ ID NO: 24548 - DNA, 21 bp, Artificial sequence
  SiRNA target sequence
cctagtggccattatctcacc

SEQ ID NO: 24549 - DNA, 21 bp, Artificial sequence
  SiRNA target sequence
ctagtggccattatctcaccg

SEQ ID NO: 24550 - DNA, 21 bp, Artificial sequence
  SiRNA target sequence
tagtggccattatctcaccgc

SEQ ID NO: 24551 - DNA, 21 bp, Artificial sequence
  SiRNA target sequence
agtggccattatctcaccgct

SEQ ID NO: 24552 - DNA, 21 bp, Artificial sequence
  SiRNA target sequence
gtggccattatctcaccgcta

SEQ ID NO: 24553 - DNA, 21 bp, Artificial sequence
  SiRNA target sequence
tggccattatctcaccgctat

SEQ ID NO: 24554 - DNA, 21 bp, Artificial sequence
  SiRNA target sequence
ggccattatctcaccgctatt

SEQ ID NO: 24555 - DNA, 21 bp, Artificial sequence
  SiRNA target sequence
gccattatctcaccgctatta

SEQ ID NO: 24556 - DNA, 21 bp, Artificial sequence
  SiRNA target sequence
ccattatctcaccgctattat

SEQ ID NO: 24557 - DNA, 21 bp, Artificial sequence
  SiRNA target sequence
cattatctcaccgctattatt

SEQ ID NO: 24558 - DNA, 21 bp, Artificial sequence
  SiRNA target sequence
attatctcaccgctattatta

SEQ ID NO: 24559 - DNA, 21 bp, Artificial sequence
  SiRNA target sequence
ttatctcaccgctattattaa

SEQ ID NO: 24560 - DNA, 21 bp, Artificial sequence
  SiRNA target sequence
tatctcaccgctattattaat

SEQ ID NO: 24561 - DNA, 21 bp, Artificial sequence
  SiRNA target sequence
atctcaccgctattattaatt

SEQ ID NO: 24562 - DNA, 21 bp, Artificial sequence
  SiRNA target sequence
tctcaccgctattattaattc

SEQ ID NO: 24563 - DNA, 21 bp, Artificial sequence
  SiRNA target sequence
ctcaccgctattattaattcc

SEQ ID NO: 24564 - DNA, 21 bp, Artificial sequence
  SiRNA target sequence
tcaccgctattattaattccg

SEQ ID NO: 24565 - DNA, 21 bp, Artificial sequence
  SiRNA target sequence
caccgctattattaattccgt

SEQ ID NO: 24566 - DNA, 21 bp, Artificial sequence
  SiRNA target sequence
accgctattattaattccgtc

SEQ ID NO: 24567 - DNA, 21 bp, Artificial sequence
  SiRNA target sequence
ccgctattattaattccgtct

SEQ ID NO: 24568 - DNA, 21 bp, Artificial sequence
  SiRNA target sequence
cgctattattaattccgtctt

SEQ ID NO: 24569 - DNA, 21 bp, Artificial sequence
  SiRNA target sequence
gctattattaattccgtcttt

SEQ ID NO: 24570 - DNA, 21 bp, Artificial sequence
  SiRNA target sequence
ctattattaattccgtctttg

SEQ ID NO: 24571 - DNA, 21 bp, Artificial sequence
  SiRNA target sequence
tattattaattccgtctttgt

SEQ ID NO: 24572 - DNA, 21 bp, Artificial sequence
  SiRNA target sequence
attattaattccgtctttgtg

SEQ ID NO: 24573 - DNA, 21 bp, Artificial sequence
  SiRNA target sequence
ttattaattccgtctttgtga

SEQ ID NO: 24574 - DNA, 21 bp, Artificial sequence
  SiRNA target sequence
tattaattccgtctttgtgaa

SEQ ID NO: 24575 - DNA, 21 bp, Artificial sequence
  SiRNA target sequence
attaattccgtctttgtgaac

SEQ ID NO: 24576 - DNA, 21 bp, Artificial sequence
  SiRNA target sequence
ttaattccgtctttgtgaact

SEQ ID NO: 24577 - DNA, 21 bp, Artificial sequence
  SiRNA target sequence
taattccgtctttgtgaactt

SEQ ID NO: 24578 - DNA, 21 bp, Artificial sequence
  SiRNA target sequence
aattccgtctttgtgaacttg

SEQ ID NO: 24579 - DNA, 21 bp, Artificial sequence
  SiRNA target sequence
attccgtctttgtgaacttgg

SEQ ID NO: 24580 - DNA, 21 bp, Artificial sequence
  SiRNA target sequence
ttccgtctttgtgaacttggt

SEQ ID NO: 24581 - DNA, 21 bp, Artificial sequence
  SiRNA target sequence
tccgtctttgtgaacttggtt

SEQ ID NO: 24582 - DNA, 21 bp, Artificial sequence
  SiRNA target sequence
ccgtctttgtgaacttggtta

SEQ ID NO: 24583 - DNA, 21 bp, Artificial sequence
  SiRNA target sequence
cgtctttgtgaacttggttat

SEQ ID NO: 24584 - DNA, 21 bp, Artificial sequence
  SiRNA target sequence
gtctttgtgaacttggttatg

SEQ ID NO: 24585 - DNA, 21 bp, Artificial sequence
  SiRNA target sequence
tctttgtgaacttggttatgt

SEQ ID NO: 24586 - DNA, 21 bp, Artificial sequence
  SiRNA target sequence
ctttgtgaacttggttatgtg

SEQ ID NO: 24587 - DNA, 21 bp, Artificial sequence
  SiRNA target sequence
tttgtgaacttggttatgtgt

SEQ ID NO: 24588 - DNA, 21 bp, Artificial sequence
  SiRNA target sequence
ttgtgaacttggttatgtgtc

SEQ ID NO: 24589 - DNA, 21 bp, Artificial sequence
  SiRNA target sequence
tgtgaacttggttatgtgtct

SEQ ID NO: 24590 - DNA, 21 bp, Artificial sequence
  SiRNA target sequence
gtgaacttggttatgtgtctc

SEQ ID NO: 24591 - DNA, 21 bp, Artificial sequence
  SiRNA target sequence
tgaacttggttatgtgtctcg

SEQ ID NO: 24592 - DNA, 21 bp, Artificial sequence
  SiRNA target sequence
gaacttggttatgtgtctcgt

SEQ ID NO: 24593 - DNA, 21 bp, Artificial sequence
  SiRNA target sequence
aacttggttatgtgtctcgta

SEQ ID NO: 24594 - DNA, 21 bp, Artificial sequence
  SiRNA target sequence
acttggttatgtgtctcgtat

SEQ ID NO: 24595 - DNA, 21 bp, Artificial sequence
  SiRNA target sequence
cttggttatgtgtctcgtatt

SEQ ID NO: 24596 - DNA, 21 bp, Artificial sequence
  SiRNA target sequence
ttggttatgtgtctcgtattt

SEQ ID NO: 24597 - DNA, 21 bp, Artificial sequence
  SiRNA target sequence
tggttatgtgtctcgtattta

SEQ ID NO: 24598 - DNA, 21 bp, Artificial sequence
  SiRNA target sequence
ggttatgtgtctcgtatttat

SEQ ID NO: 24599 - DNA, 21 bp, Artificial sequence
  SiRNA target sequence
gttatgtgtctcgtatttatg

SEQ ID NO: 24600 - DNA, 21 bp, Artificial sequence
  SiRNA target sequence
ttatgtgtctcgtatttatgg

SEQ ID NO: 24601 - DNA, 21 bp, Artificial sequence
  SiRNA target sequence
tatgtgtctcgtatttatgga

SEQ ID NO: 24602 - DNA, 21 bp, Artificial sequence
  SiRNA target sequence
atgtgtctcgtatttatggaa

SEQ ID NO: 24603 - DNA, 21 bp, Artificial sequence
  SiRNA target sequence
tgtgtctcgtatttatggaag

SEQ ID NO: 24604 - DNA, 21 bp, Artificial sequence
  SiRNA target sequence
gtgtctcgtatttatggaagc

SEQ ID NO: 24605 - DNA, 21 bp, Artificial sequence
  SiRNA target sequence
tgtctcgtatttatggaagct

SEQ ID NO: 24606 - DNA, 21 bp, Artificial sequence
  SiRNA target sequence
gtctcgtatttatggaagcta

SEQ ID NO: 24607 - DNA, 21 bp, Artificial sequence
  SiRNA target sequence
tctcgtatttatggaagctaa

SEQ ID NO: 24608 - DNA, 21 bp, Artificial sequence
  SiRNA target sequence
ctcgtatttatggaagctaat

SEQ ID NO: 24609 - DNA, 21 bp, Artificial sequence
  SiRNA target sequence
tcgtatttatggaagctaatc

SEQ ID NO: 24610 - DNA, 21 bp, Artificial sequence
  SiRNA target sequence
cgtatttatggaagctaatca

SEQ ID NO: 24611 - DNA, 21 bp, Artificial sequence
  SiRNA target sequence
gtatttatggaagctaatcaa

SEQ ID NO: 24612 - DNA, 21 bp, Artificial sequence
  SiRNA target sequence
tatttatggaagctaatcaaa

SEQ ID NO: 24613 - DNA, 21 bp, Artificial sequence
  SiRNA target sequence
atttatggaagctaatcaaaa

SEQ ID NO: 24614 - DNA, 21 bp, Artificial sequence
  SiRNA target sequence
tttatggaagctaatcaaaaa

SEQ ID NO: 24615 - DNA, 21 bp, Artificial sequence
  SiRNA target sequence
ttatggaagctaatcaaaaat

SEQ ID NO: 24616 - DNA, 21 bp, Artificial sequence
  SiRNA target sequence
tatggaagctaatcaaaaata

SEQ ID NO: 24617 - DNA, 21 bp, Artificial sequence
  SiRNA target sequence
atggaagctaatcaaaaatat

SEQ ID NO: 24618 - DNA, 21 bp, Artificial sequence
  SiRNA target sequence
tggaagctaatcaaaaatatt

SEQ ID NO: 24619 - DNA, 21 bp, Artificial sequence
  SiRNA target sequence
ggaagctaatcaaaaatattc

SEQ ID NO: 24620 - DNA, 21 bp, Artificial sequence
  SiRNA target sequence
gaagctaatcaaaaatattca

SEQ ID NO: 24621 - DNA, 21 bp, Artificial sequence
  SiRNA target sequence
aagctaatcaaaaatattcat

SEQ ID NO: 24622 - DNA, 21 bp, Artificial sequence
  SiRNA target sequence
agctaatcaaaaatattcatt

SEQ ID NO: 24623 - DNA, 21 bp, Artificial sequence
  SiRNA target sequence
gctaatcaaaaatattcattt

SEQ ID NO: 24624 - DNA, 21 bp, Artificial sequence
  SiRNA target sequence
ctaatcaaaaatattcattta

SEQ ID NO: 24625 - DNA, 21 bp, Artificial sequence
  SiRNA target sequence
taatcaaaaatattcatttac

SEQ ID NO: 24626 - DNA, 21 bp, Artificial sequence
  SiRNA target sequence
aatcaaaaatattcatttacg

SEQ ID NO: 24627 - DNA, 21 bp, Artificial sequence
  SiRNA target sequence
atcaaaaatattcatttacga

SEQ ID NO: 24628 - DNA, 21 bp, Artificial sequence
  SiRNA target sequence
tcaaaaatattcatttacgac

SEQ ID NO: 24629 - DNA, 21 bp, Artificial sequence
  SiRNA target sequence
caaaaatattcatttacgact

SEQ ID NO: 24630 - DNA, 21 bp, Artificial sequence
  SiRNA target sequence
aaaaatattcatttacgactg

SEQ ID NO: 24631 - DNA, 21 bp, Artificial sequence
  SiRNA target sequence
aaaatattcatttacgactgc

SEQ ID NO: 24632 - DNA, 21 bp, Artificial sequence
  SiRNA target sequence
aaatattcatttacgactgct

SEQ ID NO: 24633 - DNA, 21 bp, Artificial sequence
  SiRNA target sequence
aatattcatttacgactgctt

SEQ ID NO: 24634 - DNA, 21 bp, Artificial sequence
  SiRNA target sequence
atattcatttacgactgcttc

SEQ ID NO: 24635 - DNA, 21 bp, Artificial sequence
  SiRNA target sequence
tattcatttacgactgcttct

SEQ ID NO: 24636 - DNA, 21 bp, Artificial sequence
  SiRNA target sequence
attcatttacgactgcttctt

SEQ ID NO: 24637 - DNA, 21 bp, Artificial sequence
  SiRNA target sequence
ttcatttacgactgcttcttc

SEQ ID NO: 24638 - DNA, 21 bp, Artificial sequence
  SiRNA target sequence
tcatttacgactgcttcttca

SEQ ID NO: 24639 - DNA, 21 bp, Artificial sequence
  SiRNA target sequence
catttacgactgcttcttcat

SEQ ID NO: 24640 - DNA, 21 bp, Artificial sequence
  SiRNA target sequence
atttacgactgcttcttcatt

SEQ ID NO: 24641 - DNA, 21 bp, Artificial sequence
  SiRNA target sequence
tttacgactgcttcttcattt

SEQ ID NO: 24642 - DNA, 21 bp, Artificial sequence
  SiRNA target sequence
ttacgactgcttcttcatttt

SEQ ID NO: 24643 - DNA, 21 bp, Artificial sequence
  SiRNA target sequence
tacgactgcttcttcattttt

SEQ ID NO: 24644 - DNA, 21 bp, Artificial sequence
  SiRNA target sequence
acgactgcttcttcatttttc

SEQ ID NO: 24645 - DNA, 21 bp, Artificial sequence
  SiRNA target sequence
cgactgcttcttcatttttcc

SEQ ID NO: 24646 - DNA, 21 bp, Artificial sequence
  SiRNA target sequence
gactgcttcttcatttttccg

SEQ ID NO: 24647 - DNA, 21 bp, Artificial sequence
  SiRNA target sequence
actgcttcttcatttttccgt

SEQ ID NO: 24648 - DNA, 21 bp, Artificial sequence
  SiRNA target sequence
ctgcttcttcatttttccgtg

SEQ ID NO: 24649 - DNA, 21 bp, Artificial sequence
  SiRNA target sequence
tgcttcttcatttttccgtga

SEQ ID NO: 24650 - DNA, 21 bp, Artificial sequence
  SiRNA target sequence
gcttcttcatttttccgtgaa

SEQ ID NO: 24651 - DNA, 21 bp, Artificial sequence
  SiRNA target sequence
cttcttcatttttccgtgaat

SEQ ID NO: 24652 - DNA, 21 bp, Artificial sequence
  SiRNA target sequence
ttcttcatttttccgtgaatg

SEQ ID NO: 24653 - DNA, 21 bp, Artificial sequence
  SiRNA target sequence
tcttcatttttccgtgaatgt

SEQ ID NO: 24654 - DNA, 21 bp, Artificial sequence
  SiRNA target sequence
cttcatttttccgtgaatgtg

SEQ ID NO: 24655 - DNA, 21 bp, Artificial sequence
  SiRNA target sequence
ttcatttttccgtgaatgtgg

SEQ ID NO: 24656 - DNA, 21 bp, Artificial sequence
  SiRNA target sequence
tcatttttccgtgaatgtggt

SEQ ID NO: 24657 - DNA, 21 bp, Artificial sequence
  SiRNA target sequence
catttttccgtgaatgtggta

SEQ ID NO: 24658 - DNA, 21 bp, Artificial sequence
  SiRNA target sequence
atttttccgtgaatgtggtat

SEQ ID NO: 24659 - DNA, 21 bp, Artificial sequence
  SiRNA target sequence
tttttccgtgaatgtggtata

SEQ ID NO: 24660 - DNA, 21 bp, Artificial sequence
  SiRNA target sequence
ttttccgtgaatgtggtatag

SEQ ID NO: 24661 - DNA, 21 bp, Artificial sequence
  SiRNA target sequence
tttccgtgaatgtggtatagt

SEQ ID NO: 24662 - DNA, 21 bp, Artificial sequence
  SiRNA target sequence
ttccgtgaatgtggtatagta

SEQ ID NO: 24663 - DNA, 21 bp, Artificial sequence
  SiRNA target sequence
tccgtgaatgtggtatagtag

SEQ ID NO: 24664 - DNA, 21 bp, Artificial sequence
  SiRNA target sequence
ccgtgaatgtggtatagtagc

SEQ ID NO: 24665 - DNA, 21 bp, Artificial sequence
  SiRNA target sequence
cgtgaatgtggtatagtagca

SEQ ID NO: 24666 - DNA, 21 bp, Artificial sequence
  SiRNA target sequence
gtgaatgtggtatagtagcat

SEQ ID NO: 24667 - DNA, 21 bp, Artificial sequence
  SiRNA target sequence
tgaatgtggtatagtagcata

SEQ ID NO: 24668 - DNA, 21 bp, Artificial sequence
  SiRNA target sequence
gaatgtggtatagtagcatat

SEQ ID NO: 24669 - DNA, 21 bp, Artificial sequence
  SiRNA target sequence
aatgtggtatagtagcatatg

SEQ ID NO: 24670 - DNA, 21 bp, Artificial sequence
  SiRNA target sequence
atgtggtatagtagcatatgg

SEQ ID NO: 24671 - DNA, 21 bp, Artificial sequence
  SiRNA target sequence
tgtggtatagtagcatatgga

SEQ ID NO: 24672 - DNA, 21 bp, Artificial sequence
  SiRNA target sequence
gtggtatagtagcatatggag

SEQ ID NO: 24673 - DNA, 21 bp, Artificial sequence
  SiRNA target sequence
tggtatagtagcatatggaga

SEQ ID NO: 24674 - DNA, 21 bp, Artificial sequence
  SiRNA target sequence
ggtatagtagcatatggagat

SEQ ID NO: 24675 - DNA, 21 bp, Artificial sequence
  SiRNA target sequence
gtatagtagcatatggagatg

SEQ ID NO: 24676 - DNA, 21 bp, Artificial sequence
  SiRNA target sequence
tatagtagcatatggagatga

SEQ ID NO: 24677 - DNA, 21 bp, Artificial sequence
  SiRNA target sequence
atagtagcatatggagatgat

SEQ ID NO: 24678 - DNA, 21 bp, Artificial sequence
  SiRNA target sequence
tagtagcatatggagatgatc

SEQ ID NO: 24679 - DNA, 21 bp, Artificial sequence
  SiRNA target sequence
agtagcatatggagatgatca

SEQ ID NO: 24680 - DNA, 21 bp, Artificial sequence
  SiRNA target sequence
gtagcatatggagatgatcat

SEQ ID NO: 24681 - DNA, 21 bp, Artificial sequence
  SiRNA target sequence
tagcatatggagatgatcatg

SEQ ID NO: 24682 - DNA, 21 bp, Artificial sequence
  SiRNA target sequence
agcatatggagatgatcatgt

SEQ ID NO: 24683 - DNA, 21 bp, Artificial sequence
  SiRNA target sequence
gcatatggagatgatcatgtc

SEQ ID NO: 24684 - DNA, 21 bp, Artificial sequence
  SiRNA target sequence
catatggagatgatcatgtcg

SEQ ID NO: 24685 - DNA, 21 bp, Artificial sequence
  SiRNA target sequence
atatggagatgatcatgtcgt

SEQ ID NO: 24686 - DNA, 21 bp, Artificial sequence
  SiRNA target sequence
tatggagatgatcatgtcgtt

SEQ ID NO: 24687 - DNA, 21 bp, Artificial sequence
  SiRNA target sequence
atggagatgatcatgtcgttt

SEQ ID NO: 24688 - DNA, 21 bp, Artificial sequence
  SiRNA target sequence
tggagatgatcatgtcgtttc

SEQ ID NO: 24689 - DNA, 21 bp, Artificial sequence
  SiRNA target sequence
ggagatgatcatgtcgtttct

SEQ ID NO: 24690 - DNA, 21 bp, Artificial sequence
  SiRNA target sequence
gagatgatcatgtcgtttctg

SEQ ID NO: 24691 - DNA, 21 bp, Artificial sequence
  SiRNA target sequence
agatgatcatgtcgtttctgt

SEQ ID NO: 24692 - DNA, 21 bp, Artificial sequence
  SiRNA target sequence
gatgatcatgtcgtttctgtt

SEQ ID NO: 24693 - DNA, 21 bp, Artificial sequence
  SiRNA target sequence
atgatcatgtcgtttctgttc

SEQ ID NO: 24694 - DNA, 21 bp, Artificial sequence
  SiRNA target sequence
tgatcatgtcgtttctgttcc

SEQ ID NO: 24695 - DNA, 21 bp, Artificial sequence
  SiRNA target sequence
gatcatgtcgtttctgttcct

SEQ ID NO: 24696 - DNA, 21 bp, Artificial sequence
  SiRNA target sequence
atcatgtcgtttctgttcctg

SEQ ID NO: 24697 - DNA, 21 bp, Artificial sequence
  SiRNA target sequence
tcatgtcgtttctgttcctga

SEQ ID NO: 24698 - DNA, 21 bp, Artificial sequence
  SiRNA target sequence
catgtcgtttctgttcctgaa

SEQ ID NO: 24699 - DNA, 21 bp, Artificial sequence
  SiRNA target sequence
atgtcgtttctgttcctgaaa

SEQ ID NO: 24700 - DNA, 21 bp, Artificial sequence
  SiRNA target sequence
tgtcgtttctgttcctgaaaa

SEQ ID NO: 24701 - DNA, 21 bp, Artificial sequence
  SiRNA target sequence
gtcgtttctgttcctgaaaaa

SEQ ID NO: 24702 - DNA, 21 bp, Artificial sequence
  SiRNA target sequence
tcgtttctgttcctgaaaaat

SEQ ID NO: 24703 - DNA, 21 bp, Artificial sequence
  SiRNA target sequence
cgtttctgttcctgaaaaata

SEQ ID NO: 24704 - DNA, 21 bp, Artificial sequence
  SiRNA target sequence
gtttctgttcctgaaaaatac

SEQ ID NO: 24705 - DNA, 21 bp, Artificial sequence
  SiRNA target sequence
tttctgttcctgaaaaatact

SEQ ID NO: 24706 - DNA, 21 bp, Artificial sequence
  SiRNA target sequence
ttctgttcctgaaaaatactt

SEQ ID NO: 24707 - DNA, 21 bp, Artificial sequence
  SiRNA target sequence
tctgttcctgaaaaatactta

SEQ ID NO: 24708 - DNA, 21 bp, Artificial sequence
  SiRNA target sequence
ctgttcctgaaaaatacttat

SEQ ID NO: 24709 - DNA, 21 bp, Artificial sequence
  SiRNA target sequence
tgttcctgaaaaatacttatc

SEQ ID NO: 24710 - DNA, 21 bp, Artificial sequence
  SiRNA target sequence
gttcctgaaaaatacttatct

SEQ ID NO: 24711 - DNA, 21 bp, Artificial sequence
  SiRNA target sequence
ttcctgaaaaatacttatctg

SEQ ID NO: 24712 - DNA, 21 bp, Artificial sequence
  SiRNA target sequence
tcctgaaaaatacttatctgt

SEQ ID NO: 24713 - DNA, 21 bp, Artificial sequence
  SiRNA target sequence
cctgaaaaatacttatctgtg

SEQ ID NO: 24714 - DNA, 21 bp, Artificial sequence
  SiRNA target sequence
ctgaaaaatacttatctgtgt

SEQ ID NO: 24715 - DNA, 21 bp, Artificial sequence
  SiRNA target sequence
tgaaaaatacttatctgtgtt

SEQ ID NO: 24716 - DNA, 21 bp, Artificial sequence
  SiRNA target sequence
gaaaaatacttatctgtgttt

SEQ ID NO: 24717 - DNA, 21 bp, Artificial sequence
  SiRNA target sequence
aaaaatacttatctgtgttta

SEQ ID NO: 24718 - DNA, 21 bp, Artificial sequence
  SiRNA target sequence
aaaatacttatctgtgtttaa

SEQ ID NO: 24719 - DNA, 21 bp, Artificial sequence
  SiRNA target sequence
aaatacttatctgtgtttaat

SEQ ID NO: 24720 - DNA, 21 bp, Artificial sequence
  SiRNA target sequence
aatacttatctgtgtttaatc

SEQ ID NO: 24721 - DNA, 21 bp, Artificial sequence
  SiRNA target sequence
atacttatctgtgtttaatca

SEQ ID NO: 24722 - DNA, 21 bp, Artificial sequence
  SiRNA target sequence
tacttatctgtgtttaatcaa

SEQ ID NO: 24723 - DNA, 21 bp, Artificial sequence
  SiRNA target sequence
acttatctgtgtttaatcaac

SEQ ID NO: 24724 - DNA, 21 bp, Artificial sequence
  SiRNA target sequence
cttatctgtgtttaatcaaca

SEQ ID NO: 24725 - DNA, 21 bp, Artificial sequence
  SiRNA target sequence
ttatctgtgtttaatcaacag

SEQ ID NO: 24726 - DNA, 21 bp, Artificial sequence
  SiRNA target sequence
tatctgtgtttaatcaacaga

SEQ ID NO: 24727 - DNA, 21 bp, Artificial sequence
  SiRNA target sequence
atctgtgtttaatcaacagac

SEQ ID NO: 24728 - DNA, 21 bp, Artificial sequence
  SiRNA target sequence
tctgtgtttaatcaacagaca

SEQ ID NO: 24729 - DNA, 21 bp, Artificial sequence
  SiRNA target sequence
ctgtgtttaatcaacagacac

SEQ ID NO: 24730 - DNA, 21 bp, Artificial sequence
  SiRNA target sequence
tgtgtttaatcaacagacact

SEQ ID NO: 24731 - DNA, 21 bp, Artificial sequence
  SiRNA target sequence
gtgtttaatcaacagacactt

SEQ ID NO: 24732 - DNA, 21 bp, Artificial sequence
  SiRNA target sequence
tgtttaatcaacagacacttc

SEQ ID NO: 24733 - DNA, 21 bp, Artificial sequence
  SiRNA target sequence
gtttaatcaacagacacttcc

SEQ ID NO: 24734 - DNA, 21 bp, Artificial sequence
  SiRNA target sequence
tttaatcaacagacacttcca

SEQ ID NO: 24735 - DNA, 21 bp, Artificial sequence
  SiRNA target sequence
ttaatcaacagacacttccag

SEQ ID NO: 24736 - DNA, 21 bp, Artificial sequence
  SiRNA target sequence
taatcaacagacacttccagt

SEQ ID NO: 24737 - DNA, 21 bp, Artificial sequence
  SiRNA target sequence
aatcaacagacacttccagtg

SEQ ID NO: 24738 - DNA, 21 bp, Artificial sequence
  SiRNA target sequence
atcaacagacacttccagtgt

SEQ ID NO: 24739 - DNA, 21 bp, Artificial sequence
  SiRNA target sequence
tcaacagacacttccagtgtt

SEQ ID NO: 24740 - DNA, 21 bp, Artificial sequence
  SiRNA target sequence
caacagacacttccagtgttg

SEQ ID NO: 24741 - DNA, 21 bp, Artificial sequence
  SiRNA target sequence
aacagacacttccagtgttga

SEQ ID NO: 24742 - DNA, 21 bp, Artificial sequence
  SiRNA target sequence
acagacacttccagtgttgat

SEQ ID NO: 24743 - DNA, 21 bp, Artificial sequence
  SiRNA target sequence
cagacacttccagtgttgatg

SEQ ID NO: 24744 - DNA, 21 bp, Artificial sequence
  SiRNA target sequence
agacacttccagtgttgatga

SEQ ID NO: 24745 - DNA, 21 bp, Artificial sequence
  SiRNA target sequence
gacacttccagtgttgatgag

SEQ ID NO: 24746 - DNA, 21 bp, Artificial sequence
  SiRNA target sequence
acacttccagtgttgatgagt

SEQ ID NO: 24747 - DNA, 21 bp, Artificial sequence
  SiRNA target sequence
cacttccagtgttgatgagta

SEQ ID NO: 24748 - DNA, 21 bp, Artificial sequence
  SiRNA target sequence
acttccagtgttgatgagtaa

SEQ ID NO: 24749 - DNA, 21 bp, Artificial sequence
  SiRNA target sequence
cttccagtgttgatgagtaaa

SEQ ID NO: 24750 - DNA, 21 bp, Artificial sequence
  SiRNA target sequence
ttccagtgttgatgagtaaat

SEQ ID NO: 24751 - DNA, 21 bp, Artificial sequence
  SiRNA target sequence
tccagtgttgatgagtaaatt

SEQ ID NO: 24752 - DNA, 21 bp, Artificial sequence
  SiRNA target sequence
ccagtgttgatgagtaaattc

SEQ ID NO: 24753 - DNA, 21 bp, Artificial sequence
  SiRNA target sequence
cagtgttgatgagtaaattcg

SEQ ID NO: 24754 - DNA, 21 bp, Artificial sequence
  SiRNA target sequence
agtgttgatgagtaaattcgg

SEQ ID NO: 24755 - DNA, 21 bp, Artificial sequence
  SiRNA target sequence
gtgttgatgagtaaattcggg

SEQ ID NO: 24756 - DNA, 21 bp, Artificial sequence
  SiRNA target sequence
tgttgatgagtaaattcggga

SEQ ID NO: 24757 - DNA, 21 bp, Artificial sequence
  SiRNA target sequence
gttgatgagtaaattcgggat

SEQ ID NO: 24758 - DNA, 21 bp, Artificial sequence
  SiRNA target sequence
ttgatgagtaaattcgggatg

SEQ ID NO: 24759 - DNA, 21 bp, Artificial sequence
  SiRNA target sequence
tgatgagtaaattcgggatgt

SEQ ID NO: 24760 - DNA, 21 bp, Artificial sequence
  SiRNA target sequence
gatgagtaaattcgggatgtt

SEQ ID NO: 24761 - DNA, 21 bp, Artificial sequence
  SiRNA target sequence
atgagtaaattcgggatgttt

SEQ ID NO: 24762 - DNA, 21 bp, Artificial sequence
  SiRNA target sequence
tgagtaaattcgggatgtttt

SEQ ID NO: 24763 - DNA, 21 bp, Artificial sequence
  SiRNA target sequence
gagtaaattcgggatgtttta

SEQ ID NO: 24764 - DNA, 21 bp, Artificial sequence
  SiRNA target sequence
agtaaattcgggatgttttat

SEQ ID NO: 24765 - DNA, 21 bp, Artificial sequence
  SiRNA target sequence
gtaaattcgggatgttttata

SEQ ID NO: 24766 - DNA, 21 bp, Artificial sequence
  SiRNA target sequence
taaattcgggatgttttatac

SEQ ID NO: 24767 - DNA, 21 bp, Artificial sequence
  SiRNA target sequence
aaattcgggatgttttatacc

SEQ ID NO: 24768 - DNA, 21 bp, Artificial sequence
  SiRNA target sequence
aattcgggatgttttatacca

SEQ ID NO: 24769 - DNA, 21 bp, Artificial sequence
  SiRNA target sequence
attcgggatgttttataccat

SEQ ID NO: 24770 - DNA, 21 bp, Artificial sequence
  SiRNA target sequence
ttcgggatgttttataccata

SEQ ID NO: 24771 - DNA, 21 bp, Artificial sequence
  SiRNA target sequence
tcgggatgttttataccatag

SEQ ID NO: 24772 - DNA, 21 bp, Artificial sequence
  SiRNA target sequence
cgggatgttttataccataga

SEQ ID NO: 24773 - DNA, 21 bp, Artificial sequence
  SiRNA target sequence
gggatgttttataccatagaa

SEQ ID NO: 24774 - DNA, 21 bp, Artificial sequence
  SiRNA target sequence
ggatgttttataccatagaaa

SEQ ID NO: 24775 - DNA, 21 bp, Artificial sequence
  SiRNA target sequence
gatgttttataccatagaaac

SEQ ID NO: 24776 - DNA, 21 bp, Artificial sequence
  SiRNA target sequence
atgttttataccatagaaacc

SEQ ID NO: 24777 - DNA, 21 bp, Artificial sequence
  SiRNA target sequence
tgttttataccatagaaacca

SEQ ID NO: 24778 - DNA, 21 bp, Artificial sequence
  SiRNA target sequence
gttttataccatagaaaccaa

SEQ ID NO: 24779 - DNA, 21 bp, Artificial sequence
  SiRNA target sequence
ttttataccatagaaaccaag

SEQ ID NO: 24780 - DNA, 21 bp, Artificial sequence
  SiRNA target sequence
tttataccatagaaaccaagg

SEQ ID NO: 24781 - DNA, 21 bp, Artificial sequence
  SiRNA target sequence
ttataccatagaaaccaagga

SEQ ID NO: 24782 - DNA, 21 bp, Artificial sequence
  SiRNA target sequence
tataccatagaaaccaaggat

SEQ ID NO: 24783 - DNA, 21 bp, Artificial sequence
  SiRNA target sequence
ataccatagaaaccaaggatg

SEQ ID NO: 24784 - DNA, 21 bp, Artificial sequence
  SiRNA target sequence
taccatagaaaccaaggatga

SEQ ID NO: 24785 - DNA, 21 bp, Artificial sequence
  SiRNA target sequence
accatagaaaccaaggatgac

SEQ ID NO: 24786 - DNA, 21 bp, Artificial sequence
  SiRNA target sequence
ccatagaaaccaaggatgaca

SEQ ID NO: 24787 - DNA, 21 bp, Artificial sequence
  SiRNA target sequence
catagaaaccaaggatgacac

SEQ ID NO: 24788 - DNA, 21 bp, Artificial sequence
  SiRNA target sequence
atagaaaccaaggatgacaca

SEQ ID NO: 24789 - DNA, 21 bp, Artificial sequence
  SiRNA target sequence
tagaaaccaaggatgacacag

SEQ ID NO: 24790 - DNA, 21 bp, Artificial sequence
  SiRNA target sequence
agaaaccaaggatgacacaga

SEQ ID NO: 24791 - DNA, 21 bp, Artificial sequence
  SiRNA target sequence
gaaaccaaggatgacacagag

SEQ ID NO: 24792 - DNA, 21 bp, Artificial sequence
  SiRNA target sequence
aaaccaaggatgacacagaga

SEQ ID NO: 24793 - DNA, 21 bp, Artificial sequence
  SiRNA target sequence
aaccaaggatgacacagagat

SEQ ID NO: 24794 - DNA, 21 bp, Artificial sequence
  SiRNA target sequence
accaaggatgacacagagatt

SEQ ID NO: 24795 - DNA, 21 bp, Artificial sequence
  SiRNA target sequence
ccaaggatgacacagagattg

SEQ ID NO: 24796 - DNA, 21 bp, Artificial sequence
  SiRNA target sequence
caaggatgacacagagattga

SEQ ID NO: 24797 - DNA, 21 bp, Artificial sequence
  SiRNA target sequence
aaggatgacacagagattgat

SEQ ID NO: 24798 - DNA, 21 bp, Artificial sequence
  SiRNA target sequence
aggatgacacagagattgatt

SEQ ID NO: 24799 - DNA, 21 bp, Artificial sequence
  SiRNA target sequence
ggatgacacagagattgattt

SEQ ID NO: 24800 - DNA, 21 bp, Artificial sequence
  SiRNA target sequence
gatgacacagagattgatttc

SEQ ID NO: 24801 - DNA, 21 bp, Artificial sequence
  SiRNA target sequence
atgacacagagattgatttcc

SEQ ID NO: 24802 - DNA, 21 bp, Artificial sequence
  SiRNA target sequence
tgacacagagattgatttcct

SEQ ID NO: 24803 - DNA, 21 bp, Artificial sequence
  SiRNA target sequence
gacacagagattgatttcctt

SEQ ID NO: 24804 - DNA, 21 bp, Artificial sequence
  SiRNA target sequence
acacagagattgatttccttt

SEQ ID NO: 24805 - DNA, 21 bp, Artificial sequence
  SiRNA target sequence
cacagagattgatttcctttc

SEQ ID NO: 24806 - DNA, 21 bp, Artificial sequence
  SiRNA target sequence
acagagattgatttcctttcg

SEQ ID NO: 24807 - DNA, 21 bp, Artificial sequence
  SiRNA target sequence
cagagattgatttcctttcga

SEQ ID NO: 24808 - DNA, 21 bp, Artificial sequence
  SiRNA target sequence
agagattgatttcctttcgag

SEQ ID NO: 24809 - DNA, 21 bp, Artificial sequence
  SiRNA target sequence
gagattgatttcctttcgagg

SEQ ID NO: 24810 - DNA, 21 bp, Artificial sequence
  SiRNA target sequence
agattgatttcctttcgagga

SEQ ID NO: 24811 - DNA, 21 bp, Artificial sequence
  SiRNA target sequence
gattgatttcctttcgaggaa

SEQ ID NO: 24812 - DNA, 21 bp, Artificial sequence
  SiRNA target sequence
attgatttcctttcgaggaaa

SEQ ID NO: 24813 - DNA, 21 bp, Artificial sequence
  SiRNA target sequence
ttgatttcctttcgaggaaat

SEQ ID NO: 24814 - DNA, 21 bp, Artificial sequence
  SiRNA target sequence
tgatttcctttcgaggaaatt

SEQ ID NO: 24815 - DNA, 21 bp, Artificial sequence
  SiRNA target sequence
gatttcctttcgaggaaattg

SEQ ID NO: 24816 - DNA, 21 bp, Artificial sequence
  SiRNA target sequence
atttcctttcgaggaaattgg

SEQ ID NO: 24817 - DNA, 21 bp, Artificial sequence
  SiRNA target sequence
tttcctttcgaggaaattgga

SEQ ID NO: 24818 - DNA, 21 bp, Artificial sequence
  SiRNA target sequence
ttcctttcgaggaaattggaa

SEQ ID NO: 24819 - DNA, 21 bp, Artificial sequence
  SiRNA target sequence
tcctttcgaggaaattggaag

SEQ ID NO: 24820 - DNA, 21 bp, Artificial sequence
  SiRNA target sequence
cctttcgaggaaattggaaga

SEQ ID NO: 24821 - DNA, 21 bp, Artificial sequence
  SiRNA target sequence
ctttcgaggaaattggaagat

SEQ ID NO: 24822 - DNA, 21 bp, Artificial sequence
  SiRNA target sequence
tttcgaggaaattggaagatg

SEQ ID NO: 24823 - DNA, 21 bp, Artificial sequence
  SiRNA target sequence
ttcgaggaaattggaagatgt

SEQ ID NO: 24824 - DNA, 21 bp, Artificial sequence
  SiRNA target sequence
tcgaggaaattggaagatgtg

SEQ ID NO: 24825 - DNA, 21 bp, Artificial sequence
  SiRNA target sequence
cgaggaaattggaagatgtgt

SEQ ID NO: 24826 - DNA, 21 bp, Artificial sequence
  SiRNA target sequence
gaggaaattggaagatgtgtc

SEQ ID NO: 24827 - DNA, 21 bp, Artificial sequence
  SiRNA target sequence
aggaaattggaagatgtgtcg

SEQ ID NO: 24828 - DNA, 21 bp, Artificial sequence
  SiRNA target sequence
ggaaattggaagatgtgtcgt

SEQ ID NO: 24829 - DNA, 21 bp, Artificial sequence
  SiRNA target sequence
gaaattggaagatgtgtcgta

SEQ ID NO: 24830 - DNA, 21 bp, Artificial sequence
  SiRNA target sequence
aaattggaagatgtgtcgtac

SEQ ID NO: 24831 - DNA, 21 bp, Artificial sequence
  SiRNA target sequence
aattggaagatgtgtcgtact

SEQ ID NO: 24832 - DNA, 21 bp, Artificial sequence
  SiRNA target sequence
attggaagatgtgtcgtactt

SEQ ID NO: 24833 - DNA, 21 bp, Artificial sequence
  SiRNA target sequence
ttggaagatgtgtcgtacttg

SEQ ID NO: 24834 - DNA, 21 bp, Artificial sequence
  SiRNA target sequence
tggaagatgtgtcgtacttga

SEQ ID NO: 24835 - DNA, 21 bp, Artificial sequence
  SiRNA target sequence
ggaagatgtgtcgtacttgaa

SEQ ID NO: 24836 - DNA, 21 bp, Artificial sequence
  SiRNA target sequence
gaagatgtgtcgtacttgaag

SEQ ID NO: 24837 - DNA, 21 bp, Artificial sequence
  SiRNA target sequence
aagatgtgtcgtacttgaagc

SEQ ID NO: 24838 - DNA, 21 bp, Artificial sequence
  SiRNA target sequence
agatgtgtcgtacttgaagcg

SEQ ID NO: 24839 - DNA, 21 bp, Artificial sequence
  SiRNA target sequence
gatgtgtcgtacttgaagcgg

SEQ ID NO: 24840 - DNA, 21 bp, Artificial sequence
  SiRNA target sequence
atgtgtcgtacttgaagcgga

SEQ ID NO: 24841 - DNA, 21 bp, Artificial sequence
  SiRNA target sequence
tgtgtcgtacttgaagcggaa

SEQ ID NO: 24842 - DNA, 21 bp, Artificial sequence
  SiRNA target sequence
gtgtcgtacttgaagcggaat

SEQ ID NO: 24843 - DNA, 21 bp, Artificial sequence
  SiRNA target sequence
tgtcgtacttgaagcggaatt

SEQ ID NO: 24844 - DNA, 21 bp, Artificial sequence
  SiRNA target sequence
gtcgtacttgaagcggaattt

SEQ ID NO: 24845 - DNA, 21 bp, Artificial sequence
  SiRNA target sequence
tcgtacttgaagcggaatttt

SEQ ID NO: 24846 - DNA, 21 bp, Artificial sequence
  SiRNA target sequence
cgtacttgaagcggaattttg

SEQ ID NO: 24847 - DNA, 21 bp, Artificial sequence
  SiRNA target sequence
gtacttgaagcggaattttgt

SEQ ID NO: 24848 - DNA, 21 bp, Artificial sequence
  SiRNA target sequence
tacttgaagcggaattttgtt

SEQ ID NO: 24849 - DNA, 21 bp, Artificial sequence
  SiRNA target sequence
acttgaagcggaattttgttt

SEQ ID NO: 24850 - DNA, 21 bp, Artificial sequence
  SiRNA target sequence
cttgaagcggaattttgttta

SEQ ID NO: 24851 - DNA, 21 bp, Artificial sequence
  SiRNA target sequence
ttgaagcggaattttgtttat

SEQ ID NO: 24852 - DNA, 21 bp, Artificial sequence
  SiRNA target sequence
tgaagcggaattttgtttatg

SEQ ID NO: 24853 - DNA, 21 bp, Artificial sequence
  SiRNA target sequence
gaagcggaattttgtttatga

SEQ ID NO: 24854 - DNA, 21 bp, Artificial sequence
  SiRNA target sequence
aagcggaattttgtttatgac

SEQ ID NO: 24855 - DNA, 21 bp, Artificial sequence
  SiRNA target sequence
agcggaattttgtttatgacg

SEQ ID NO: 24856 - DNA, 21 bp, Artificial sequence
  SiRNA target sequence
gcggaattttgtttatgacga

SEQ ID NO: 24857 - DNA, 21 bp, Artificial sequence
  SiRNA target sequence
cggaattttgtttatgacgaa

SEQ ID NO: 24858 - DNA, 21 bp, Artificial sequence
  SiRNA target sequence
ggaattttgtttatgacgaat

SEQ ID NO: 24859 - DNA, 21 bp, Artificial sequence
  SiRNA target sequence
gaattttgtttatgacgaatc

SEQ ID NO: 24860 - DNA, 21 bp, Artificial sequence
  SiRNA target sequence
aattttgtttatgacgaatct

SEQ ID NO: 24861 - DNA, 21 bp, Artificial sequence
  SiRNA target sequence
attttgtttatgacgaatcta

SEQ ID NO: 24862 - DNA, 21 bp, Artificial sequence
  SiRNA target sequence
ttttgtttatgacgaatctag

SEQ ID NO: 24863 - DNA, 21 bp, Artificial sequence
  SiRNA target sequence
tttgtttatgacgaatctagg

SEQ ID NO: 24864 - DNA, 21 bp, Artificial sequence
  SiRNA target sequence
ttgtttatgacgaatctaggc

SEQ ID NO: 24865 - DNA, 21 bp, Artificial sequence
  SiRNA target sequence
tgtttatgacgaatctaggca

SEQ ID NO: 24866 - DNA, 21 bp, Artificial sequence
  SiRNA target sequence
gtttatgacgaatctaggcaa

SEQ ID NO: 24867 - DNA, 21 bp, Artificial sequence
  SiRNA target sequence
tttatgacgaatctaggcaac

SEQ ID NO: 24868 - DNA, 21 bp, Artificial sequence
  SiRNA target sequence
ttatgacgaatctaggcaacg

SEQ ID NO: 24869 - DNA, 21 bp, Artificial sequence
  SiRNA target sequence
tatgacgaatctaggcaacgt

SEQ ID NO: 24870 - DNA, 21 bp, Artificial sequence
  SiRNA target sequence
atgacgaatctaggcaacgtt

SEQ ID NO: 24871 - DNA, 21 bp, Artificial sequence
  SiRNA target sequence
tgacgaatctaggcaacgtta

SEQ ID NO: 24872 - DNA, 21 bp, Artificial sequence
  SiRNA target sequence
gacgaatctaggcaacgttat

SEQ ID NO: 24873 - DNA, 21 bp, Artificial sequence
  SiRNA target sequence
acgaatctaggcaacgttata

SEQ ID NO: 24874 - DNA, 21 bp, Artificial sequence
  SiRNA target sequence
cgaatctaggcaacgttatat

SEQ ID NO: 24875 - DNA, 21 bp, Artificial sequence
  SiRNA target sequence
gaatctaggcaacgttatatt

SEQ ID NO: 24876 - DNA, 21 bp, Artificial sequence
  SiRNA target sequence
aatctaggcaacgttatattg

SEQ ID NO: 24877 - DNA, 21 bp, Artificial sequence
  SiRNA target sequence
atctaggcaacgttatattgc

SEQ ID NO: 24878 - DNA, 21 bp, Artificial sequence
  SiRNA target sequence
tctaggcaacgttatattgct

SEQ ID NO: 24879 - DNA, 21 bp, Artificial sequence
  SiRNA target sequence
ctaggcaacgttatattgctc

SEQ ID NO: 24880 - DNA, 21 bp, Artificial sequence
  SiRNA target sequence
taggcaacgttatattgctcc

SEQ ID NO: 24881 - DNA, 21 bp, Artificial sequence
  SiRNA target sequence
aggcaacgttatattgctcct

SEQ ID NO: 24882 - DNA, 21 bp, Artificial sequence
  SiRNA target sequence
ggcaacgttatattgctcctc

SEQ ID NO: 24883 - DNA, 21 bp, Artificial sequence
  SiRNA target sequence
gcaacgttatattgctcctct

SEQ ID NO: 24884 - DNA, 21 bp, Artificial sequence
  SiRNA target sequence
caacgttatattgctcctctt

SEQ ID NO: 24885 - DNA, 21 bp, Artificial sequence
  SiRNA target sequence
aacgttatattgctcctcttt

SEQ ID NO: 24886 - DNA, 21 bp, Artificial sequence
  SiRNA target sequence
acgttatattgctcctctttc

SEQ ID NO: 24887 - DNA, 21 bp, Artificial sequence
  SiRNA target sequence
cgttatattgctcctctttct

SEQ ID NO: 24888 - DNA, 21 bp, Artificial sequence
  SiRNA target sequence
gttatattgctcctctttctc

SEQ ID NO: 24889 - DNA, 21 bp, Artificial sequence
  SiRNA target sequence
ttatattgctcctctttctct

SEQ ID NO: 24890 - DNA, 21 bp, Artificial sequence
  SiRNA target sequence
tatattgctcctctttctctg

SEQ ID NO: 24891 - DNA, 21 bp, Artificial sequence
  SiRNA target sequence
atattgctcctctttctctgg

SEQ ID NO: 24892 - DNA, 21 bp, Artificial sequence
  SiRNA target sequence
tattgctcctctttctctgga

SEQ ID NO: 24893 - DNA, 21 bp, Artificial sequence
  SiRNA target sequence
attgctcctctttctctggat

SEQ ID NO: 24894 - DNA, 21 bp, Artificial sequence
  SiRNA target sequence
ttgctcctctttctctggatg

SEQ ID NO: 24895 - DNA, 21 bp, Artificial sequence
  SiRNA target sequence
tgctcctctttctctggatgt

SEQ ID NO: 24896 - DNA, 21 bp, Artificial sequence
  SiRNA target sequence
gctcctctttctctggatgtt

SEQ ID NO: 24897 - DNA, 21 bp, Artificial sequence
  SiRNA target sequence
ctcctctttctctggatgtta

SEQ ID NO: 24898 - DNA, 21 bp, Artificial sequence
  SiRNA target sequence
tcctctttctctggatgttat

SEQ ID NO: 24899 - DNA, 21 bp, Artificial sequence
  SiRNA target sequence
cctctttctctggatgttata

SEQ ID NO: 24900 - DNA, 21 bp, Artificial sequence
  SiRNA target sequence
ctctttctctggatgttatat

SEQ ID NO: 24901 - DNA, 21 bp, Artificial sequence
  SiRNA target sequence
tctttctctggatgttatatt

SEQ ID NO: 24902 - DNA, 21 bp, Artificial sequence
  SiRNA target sequence
ctttctctggatgttatattg

SEQ ID NO: 24903 - DNA, 21 bp, Artificial sequence
  SiRNA target sequence
tttctctggatgttatattgg

SEQ ID NO: 24904 - DNA, 21 bp, Artificial sequence
  SiRNA target sequence
ttctctggatgttatattgga

SEQ ID NO: 24905 - DNA, 21 bp, Artificial sequence
  SiRNA target sequence
tctctggatgttatattggaa

SEQ ID NO: 24906 - DNA, 21 bp, Artificial sequence
  SiRNA target sequence
ctctggatgttatattggaaa

SEQ ID NO: 24907 - DNA, 21 bp, Artificial sequence
  SiRNA target sequence
tctggatgttatattggaaat

SEQ ID NO: 24908 - DNA, 21 bp, Artificial sequence
  SiRNA target sequence
ctggatgttatattggaaatg

SEQ ID NO: 24909 - DNA, 21 bp, Artificial sequence
  SiRNA target sequence
tggatgttatattggaaatgc

SEQ ID NO: 24910 - DNA, 21 bp, Artificial sequence
  SiRNA target sequence
ggatgttatattggaaatgcc

SEQ ID NO: 24911 - DNA, 21 bp, Artificial sequence
  SiRNA target sequence
gatgttatattggaaatgccc

SEQ ID NO: 24912 - DNA, 21 bp, Artificial sequence
  SiRNA target sequence
atgttatattggaaatgccca

SEQ ID NO: 24913 - DNA, 21 bp, Artificial sequence
  SiRNA target sequence
tgttatattggaaatgcccat

SEQ ID NO: 24914 - DNA, 21 bp, Artificial sequence
  SiRNA target sequence
gttatattggaaatgcccatg

SEQ ID NO: 24915 - DNA, 21 bp, Artificial sequence
  SiRNA target sequence
ttatattggaaatgcccatgt

SEQ ID NO: 24916 - DNA, 21 bp, Artificial sequence
  SiRNA target sequence
tatattggaaatgcccatgtg

SEQ ID NO: 24917 - DNA, 21 bp, Artificial sequence
  SiRNA target sequence
atattggaaatgcccatgtgg

SEQ ID NO: 24918 - DNA, 21 bp, Artificial sequence
  SiRNA target sequence
tattggaaatgcccatgtgga

SEQ ID NO: 24919 - DNA, 21 bp, Artificial sequence
  SiRNA target sequence
attggaaatgcccatgtggac

SEQ ID NO: 24920 - DNA, 21 bp, Artificial sequence
  SiRNA target sequence
ttggaaatgcccatgtggacc

SEQ ID NO: 24921 - DNA, 21 bp, Artificial sequence
  SiRNA target sequence
tggaaatgcccatgtggacca

SEQ ID NO: 24922 - DNA, 21 bp, Artificial sequence
  SiRNA target sequence
ggaaatgcccatgtggaccaa

SEQ ID NO: 24923 - DNA, 21 bp, Artificial sequence
  SiRNA target sequence
gaaatgcccatgtggaccaaa

SEQ ID NO: 24924 - DNA, 21 bp, Artificial sequence
  SiRNA target sequence
aaatgcccatgtggaccaaat

SEQ ID NO: 24925 - DNA, 21 bp, Artificial sequence
  SiRNA target sequence
aatgcccatgtggaccaaatc

SEQ ID NO: 24926 - DNA, 21 bp, Artificial sequence
  SiRNA target sequence
atgcccatgtggaccaaatct

SEQ ID NO: 24927 - DNA, 21 bp, Artificial sequence
  SiRNA target sequence
tgcccatgtggaccaaatcta

SEQ ID NO: 24928 - DNA, 21 bp, Artificial sequence
  SiRNA target sequence
gcccatgtggaccaaatctag

SEQ ID NO: 24929 - DNA, 21 bp, Artificial sequence
  SiRNA target sequence
cccatgtggaccaaatctagc

SEQ ID NO: 24930 - DNA, 21 bp, Artificial sequence
  SiRNA target sequence
ccatgtggaccaaatctagca

SEQ ID NO: 24931 - DNA, 21 bp, Artificial sequence
  SiRNA target sequence
catgtggaccaaatctagcag

SEQ ID NO: 24932 - DNA, 21 bp, Artificial sequence
  SiRNA target sequence
atgtggaccaaatctagcagg

SEQ ID NO: 24933 - DNA, 21 bp, Artificial sequence
  SiRNA target sequence
tgtggaccaaatctagcaggg

SEQ ID NO: 24934 - DNA, 21 bp, Artificial sequence
  SiRNA target sequence
gtggaccaaatctagcaggga

SEQ ID NO: 24935 - DNA, 21 bp, Artificial sequence
  SiRNA target sequence
tggaccaaatctagcagggac

SEQ ID NO: 24936 - DNA, 21 bp, Artificial sequence
  SiRNA target sequence
ggaccaaatctagcagggaca

SEQ ID NO: 24937 - DNA, 21 bp, Artificial sequence
  SiRNA target sequence
gaccaaatctagcagggacat

SEQ ID NO: 24938 - DNA, 21 bp, Artificial sequence
  SiRNA target sequence
accaaatctagcagggacatt

SEQ ID NO: 24939 - DNA, 21 bp, Artificial sequence
  SiRNA target sequence
ccaaatctagcagggacattg

SEQ ID NO: 24940 - DNA, 21 bp, Artificial sequence
  SiRNA target sequence
caaatctagcagggacattgt

SEQ ID NO: 24941 - DNA, 21 bp, Artificial sequence
  SiRNA target sequence
aaatctagcagggacattgta

SEQ ID NO: 24942 - DNA, 21 bp, Artificial sequence
  SiRNA target sequence
aatctagcagggacattgtaa

SEQ ID NO: 24943 - DNA, 21 bp, Artificial sequence
  SiRNA target sequence
atctagcagggacattgtaac

SEQ ID NO: 24944 - DNA, 21 bp, Artificial sequence
  SiRNA target sequence
tctagcagggacattgtaaca

SEQ ID NO: 24945 - DNA, 21 bp, Artificial sequence
  SiRNA target sequence
ctagcagggacattgtaacaa

SEQ ID NO: 24946 - DNA, 21 bp, Artificial sequence
  SiRNA target sequence
tagcagggacattgtaacaaa

SEQ ID NO: 24947 - DNA, 21 bp, Artificial sequence
  SiRNA target sequence
agcagggacattgtaacaaat

SEQ ID NO: 24948 - DNA, 21 bp, Artificial sequence
  SiRNA target sequence
gcagggacattgtaacaaatg

SEQ ID NO: 24949 - DNA, 21 bp, Artificial sequence
  SiRNA target sequence
cagggacattgtaacaaatgt

SEQ ID NO: 24950 - DNA, 21 bp, Artificial sequence
  SiRNA target sequence
agggacattgtaacaaatgta

SEQ ID NO: 24951 - DNA, 21 bp, Artificial sequence
  SiRNA target sequence
gggacattgtaacaaatgtat

SEQ ID NO: 24952 - DNA, 21 bp, Artificial sequence
  SiRNA target sequence
ggacattgtaacaaatgtatt

SEQ ID NO: 24953 - DNA, 21 bp, Artificial sequence
  SiRNA target sequence
gacattgtaacaaatgtattc

SEQ ID NO: 24954 - DNA, 21 bp, Artificial sequence
  SiRNA target sequence
acattgtaacaaatgtattct

SEQ ID NO: 24955 - DNA, 21 bp, Artificial sequence
  SiRNA target sequence
cattgtaacaaatgtattctg

SEQ ID NO: 24956 - DNA, 21 bp, Artificial sequence
  SiRNA target sequence
attgtaacaaatgtattctgt

SEQ ID NO: 24957 - DNA, 21 bp, Artificial sequence
  SiRNA target sequence
ttgtaacaaatgtattctgta

SEQ ID NO: 24958 - DNA, 21 bp, Artificial sequence
  SiRNA target sequence
tgtaacaaatgtattctgtaa

SEQ ID NO: 24959 - DNA, 21 bp, Artificial sequence
  SiRNA target sequence
gtaacaaatgtattctgtaat

SEQ ID NO: 24960 - DNA, 21 bp, Artificial sequence
  SiRNA target sequence
taacaaatgtattctgtaatt

SEQ ID NO: 24961 - DNA, 21 bp, Artificial sequence
  SiRNA target sequence
aacaaatgtattctgtaattt

SEQ ID NO: 24962 - DNA, 21 bp, Artificial sequence
  SiRNA target sequence
acaaatgtattctgtaatttg

SEQ ID NO: 24963 - DNA, 21 bp, Artificial sequence
  SiRNA target sequence
caaatgtattctgtaatttgg

SEQ ID NO: 24964 - DNA, 21 bp, Artificial sequence
  SiRNA target sequence
aaatgtattctgtaatttgga

SEQ ID NO: 24965 - DNA, 21 bp, Artificial sequence
  SiRNA target sequence
aatgtattctgtaatttggaa

SEQ ID NO: 24966 - DNA, 21 bp, Artificial sequence
  SiRNA target sequence
atgtattctgtaatttggaac

SEQ ID NO: 24967 - DNA, 21 bp, Artificial sequence
  SiRNA target sequence
tgtattctgtaatttggaaca

SEQ ID NO: 24968 - DNA, 21 bp, Artificial sequence
  SiRNA target sequence
gtattctgtaatttggaacac

SEQ ID NO: 24969 - DNA, 21 bp, Artificial sequence
  SiRNA target sequence
tattctgtaatttggaacacg

SEQ ID NO: 24970 - DNA, 21 bp, Artificial sequence
  SiRNA target sequence
attctgtaatttggaacacgc

SEQ ID NO: 24971 - DNA, 21 bp, Artificial sequence
  SiRNA target sequence
ttctgtaatttggaacacgct

SEQ ID NO: 24972 - DNA, 21 bp, Artificial sequence
  SiRNA target sequence
tctgtaatttggaacacgctc

SEQ ID NO: 24973 - DNA, 21 bp, Artificial sequence
  SiRNA target sequence
ctgtaatttggaacacgctct

SEQ ID NO: 24974 - DNA, 21 bp, Artificial sequence
  SiRNA target sequence
tgtaatttggaacacgctctc

SEQ ID NO: 24975 - DNA, 21 bp, Artificial sequence
  SiRNA target sequence
gtaatttggaacacgctctca

SEQ ID NO: 24976 - DNA, 21 bp, Artificial sequence
  SiRNA target sequence
taatttggaacacgctctcaa

SEQ ID NO: 24977 - DNA, 21 bp, Artificial sequence
  SiRNA target sequence
aatttggaacacgctctcaag

SEQ ID NO: 24978 - DNA, 21 bp, Artificial sequence
  SiRNA target sequence
atttggaacacgctctcaagg

SEQ ID NO: 24979 - DNA, 21 bp, Artificial sequence
  SiRNA target sequence
tttggaacacgctctcaagga

SEQ ID NO: 24980 - DNA, 21 bp, Artificial sequence
  SiRNA target sequence
ttggaacacgctctcaaggaa

SEQ ID NO: 24981 - DNA, 21 bp, Artificial sequence
  SiRNA target sequence
tggaacacgctctcaaggaat

SEQ ID NO: 24982 - DNA, 21 bp, Artificial sequence
  SiRNA target sequence
ggaacacgctctcaaggaatt

SEQ ID NO: 24983 - DNA, 21 bp, Artificial sequence
  SiRNA target sequence
gaacacgctctcaaggaatta

SEQ ID NO: 24984 - DNA, 21 bp, Artificial sequence
  SiRNA target sequence
aacacgctctcaaggaattat

SEQ ID NO: 24985 - DNA, 21 bp, Artificial sequence
  SiRNA target sequence
acacgctctcaaggaattatc

SEQ ID NO: 24986 - DNA, 21 bp, Artificial sequence
  SiRNA target sequence
cacgctctcaaggaattatca

SEQ ID NO: 24987 - DNA, 21 bp, Artificial sequence
  SiRNA target sequence
acgctctcaaggaattatcat

SEQ ID NO: 24988 - DNA, 21 bp, Artificial sequence
  SiRNA target sequence
cgctctcaaggaattatcatt

SEQ ID NO: 24989 - DNA, 21 bp, Artificial sequence
  SiRNA target sequence
gctctcaaggaattatcatta

SEQ ID NO: 24990 - DNA, 21 bp, Artificial sequence
  SiRNA target sequence
ctctcaaggaattatcattac

SEQ ID NO: 24991 - DNA, 21 bp, Artificial sequence
  SiRNA target sequence
tctcaaggaattatcattaca

SEQ ID NO: 24992 - DNA, 21 bp, Artificial sequence
  SiRNA target sequence
ctcaaggaattatcattacat

SEQ ID NO: 24993 - DNA, 21 bp, Artificial sequence
  SiRNA target sequence
tcaaggaattatcattacatg

SEQ ID NO: 24994 - DNA, 21 bp, Artificial sequence
  SiRNA target sequence
caaggaattatcattacatga

SEQ ID NO: 24995 - DNA, 21 bp, Artificial sequence
  SiRNA target sequence
aaggaattatcattacatgat

SEQ ID NO: 24996 - DNA, 21 bp, Artificial sequence
  SiRNA target sequence
aggaattatcattacatgata

SEQ ID NO: 24997 - DNA, 21 bp, Artificial sequence
  SiRNA target sequence
ggaattatcattacatgataa

SEQ ID NO: 24998 - DNA, 21 bp, Artificial sequence
  SiRNA target sequence
gaattatcattacatgataag

SEQ ID NO: 24999 - DNA, 21 bp, Artificial sequence
  SiRNA target sequence
aattatcattacatgataagg

SEQ ID NO: 25000 - DNA, 21 bp, Artificial sequence
  SiRNA target sequence
attatcattacatgataagga

SEQ ID NO: 25001 - DNA, 21 bp, Artificial sequence
  SiRNA target sequence
ttatcattacatgataaggaa

SEQ ID NO: 25002 - DNA, 21 bp, Artificial sequence
  SiRNA target sequence
tatcattacatgataaggaat

SEQ ID NO: 25003 - DNA, 21 bp, Artificial sequence
  SiRNA target sequence
atcattacatgataaggaatt

SEQ ID NO: 25004 - DNA, 21 bp, Artificial sequence
  SiRNA target sequence
tcattacatgataaggaattg

SEQ ID NO: 25005 - DNA, 21 bp, Artificial sequence
  SiRNA target sequence
cattacatgataaggaattgt

SEQ ID NO: 25006 - DNA, 21 bp, Artificial sequence
  SiRNA target sequence
attacatgataaggaattgtg

SEQ ID NO: 25007 - DNA, 21 bp, Artificial sequence
  SiRNA target sequence
ttacatgataaggaattgtgg

SEQ ID NO: 25008 - DNA, 21 bp, Artificial sequence
  SiRNA target sequence
tacatgataaggaattgtggg

SEQ ID NO: 25009 - DNA, 21 bp, Artificial sequence
  SiRNA target sequence
acatgataaggaattgtggga

SEQ ID NO: 25010 - DNA, 21 bp, Artificial sequence
  SiRNA target sequence
catgataaggaattgtgggat

SEQ ID NO: 25011 - DNA, 21 bp, Artificial sequence
  SiRNA target sequence
atgataaggaattgtgggata

SEQ ID NO: 25012 - DNA, 21 bp, Artificial sequence
  SiRNA target sequence
tgataaggaattgtgggataa

SEQ ID NO: 25013 - DNA, 21 bp, Artificial sequence
  SiRNA target sequence
gataaggaattgtgggataaa

SEQ ID NO: 25014 - DNA, 21 bp, Artificial sequence
  SiRNA target sequence
ataaggaattgtgggataaat

SEQ ID NO: 25015 - DNA, 21 bp, Artificial sequence
  SiRNA target sequence
taaggaattgtgggataaatg

SEQ ID NO: 25016 - DNA, 21 bp, Artificial sequence
  SiRNA target sequence
aaggaattgtgggataaatgg

SEQ ID NO: 25017 - DNA, 21 bp, Artificial sequence
  SiRNA target sequence
aggaattgtgggataaatgga

SEQ ID NO: 25018 - DNA, 21 bp, Artificial sequence
  SiRNA target sequence
ggaattgtgggataaatggag

SEQ ID NO: 25019 - DNA, 21 bp, Artificial sequence
  SiRNA target sequence
gaattgtgggataaatggagt

SEQ ID NO: 25020 - DNA, 21 bp, Artificial sequence
  SiRNA target sequence
aattgtgggataaatggagtc

SEQ ID NO: 25021 - DNA, 21 bp, Artificial sequence
  SiRNA target sequence
attgtgggataaatggagtcc

SEQ ID NO: 25022 - DNA, 21 bp, Artificial sequence
  SiRNA target sequence
ttgtgggataaatggagtcct

SEQ ID NO: 25023 - DNA, 21 bp, Artificial sequence
  SiRNA target sequence
tgtgggataaatggagtcctg

SEQ ID NO: 25024 - DNA, 21 bp, Artificial sequence
  SiRNA target sequence
gtgggataaatggagtcctgt

SEQ ID NO: 25025 - DNA, 21 bp, Artificial sequence
  SiRNA target sequence
tgggataaatggagtcctgta

SEQ ID NO: 25026 - DNA, 21 bp, Artificial sequence
  SiRNA target sequence
gggataaatggagtcctgtac

SEQ ID NO: 25027 - DNA, 21 bp, Artificial sequence
  SiRNA target sequence
ggataaatggagtcctgtact

SEQ ID NO: 25028 - DNA, 21 bp, Artificial sequence
  SiRNA target sequence
gataaatggagtcctgtactg

SEQ ID NO: 25029 - DNA, 21 bp, Artificial sequence
  SiRNA target sequence
ataaatggagtcctgtactgc

SEQ ID NO: 25030 - DNA, 21 bp, Artificial sequence
  SiRNA target sequence
taaatggagtcctgtactgca

SEQ ID NO: 25031 - DNA, 21 bp, Artificial sequence
  SiRNA target sequence
aaatggagtcctgtactgcat

SEQ ID NO: 25032 - DNA, 21 bp, Artificial sequence
  SiRNA target sequence
aatggagtcctgtactgcatt

SEQ ID NO: 25033 - DNA, 21 bp, Artificial sequence
  SiRNA target sequence
atggagtcctgtactgcattc

SEQ ID NO: 25034 - DNA, 21 bp, Artificial sequence
  SiRNA target sequence
tggagtcctgtactgcattcg

SEQ ID NO: 25035 - DNA, 21 bp, Artificial sequence
  SiRNA target sequence
ggagtcctgtactgcattcga

SEQ ID NO: 25036 - DNA, 21 bp, Artificial sequence
  SiRNA target sequence
gagtcctgtactgcattcgaa

SEQ ID NO: 25037 - DNA, 21 bp, Artificial sequence
  SiRNA target sequence
agtcctgtactgcattcgaag

SEQ ID NO: 25038 - DNA, 21 bp, Artificial sequence
  SiRNA target sequence
gtcctgtactgcattcgaaga

SEQ ID NO: 25039 - DNA, 21 bp, Artificial sequence
  SiRNA target sequence
tcctgtactgcattcgaagag

SEQ ID NO: 25040 - DNA, 21 bp, Artificial sequence
  SiRNA target sequence
cctgtactgcattcgaagagc

SEQ ID NO: 25041 - DNA, 21 bp, Artificial sequence
  SiRNA target sequence
ctgtactgcattcgaagagcg

SEQ ID NO: 25042 - DNA, 21 bp, Artificial sequence
  SiRNA target sequence
tgtactgcattcgaagagcga

SEQ ID NO: 25043 - DNA, 21 bp, Artificial sequence
  SiRNA target sequence
gtactgcattcgaagagcgag

SEQ ID NO: 25044 - DNA, 21 bp, Artificial sequence
  SiRNA target sequence
tactgcattcgaagagcgagg

SEQ ID NO: 25045 - DNA, 21 bp, Artificial sequence
  SiRNA target sequence
actgcattcgaagagcgagga

SEQ ID NO: 25046 - DNA, 21 bp, Artificial sequence
  SiRNA target sequence
ctgcattcgaagagcgaggaa

SEQ ID NO: 25047 - DNA, 21 bp, Artificial sequence
  SiRNA target sequence
tgcattcgaagagcgaggaag

SEQ ID NO: 25048 - DNA, 21 bp, Artificial sequence
  SiRNA target sequence
gcattcgaagagcgaggaagt

SEQ ID NO: 25049 - DNA, 21 bp, Artificial sequence
  SiRNA target sequence
cattcgaagagcgaggaagtt

SEQ ID NO: 25050 - DNA, 21 bp, Artificial sequence
  SiRNA target sequence
attcgaagagcgaggaagttc

SEQ ID NO: 25051 - DNA, 21 bp, Artificial sequence
  SiRNA target sequence
ttcgaagagcgaggaagttct

SEQ ID NO: 25052 - DNA, 21 bp, Artificial sequence
  SiRNA target sequence
tcgaagagcgaggaagttctg

SEQ ID NO: 25053 - DNA, 21 bp, Artificial sequence
  SiRNA target sequence
cgaagagcgaggaagttctga

SEQ ID NO: 25054 - DNA, 21 bp, Artificial sequence
  SiRNA target sequence
gaagagcgaggaagttctgaa

SEQ ID NO: 25055 - DNA, 21 bp, Artificial sequence
  SiRNA target sequence
aagagcgaggaagttctgaaa

SEQ ID NO: 25056 - DNA, 21 bp, Artificial sequence
  SiRNA target sequence
agagcgaggaagttctgaaaa

SEQ ID NO: 25057 - DNA, 21 bp, Artificial sequence
  SiRNA target sequence
gagcgaggaagttctgaaaat

SEQ ID NO: 25058 - DNA, 21 bp, Artificial sequence
  SiRNA target sequence
agcgaggaagttctgaaaatg

SEQ ID NO: 25059 - DNA, 21 bp, Artificial sequence
  SiRNA target sequence
gcgaggaagttctgaaaatgg

SEQ ID NO: 25060 - DNA, 21 bp, Artificial sequence
  SiRNA target sequence
cgaggaagttctgaaaatggt

SEQ ID NO: 25061 - DNA, 21 bp, Artificial sequence
  SiRNA target sequence
gaggaagttctgaaaatggtt

SEQ ID NO: 25062 - DNA, 21 bp, Artificial sequence
  SiRNA target sequence
aggaagttctgaaaatggttt

SEQ ID NO: 25063 - DNA, 21 bp, Artificial sequence
  SiRNA target sequence
ggaagttctgaaaatggtttc

SEQ ID NO: 25064 - DNA, 21 bp, Artificial sequence
  SiRNA target sequence
gaagttctgaaaatggtttct

SEQ ID NO: 25065 - DNA, 21 bp, Artificial sequence
  SiRNA target sequence
aagttctgaaaatggtttctt

SEQ ID NO: 25066 - DNA, 21 bp, Artificial sequence
  SiRNA target sequence
agttctgaaaatggtttcttc

SEQ ID NO: 25067 - DNA, 21 bp, Artificial sequence
  SiRNA target sequence
gttctgaaaatggtttcttct

SEQ ID NO: 25068 - DNA, 21 bp, Artificial sequence
  SiRNA target sequence
ttctgaaaatggtttcttctc

SEQ ID NO: 25069 - DNA, 21 bp, Artificial sequence
  SiRNA target sequence
tctgaaaatggtttcttctct

SEQ ID NO: 25070 - DNA, 21 bp, Artificial sequence
  SiRNA target sequence
ctgaaaatggtttcttctctg

SEQ ID NO: 25071 - DNA, 21 bp, Artificial sequence
  SiRNA target sequence
tgaaaatggtttcttctctga

SEQ ID NO: 25072 - DNA, 21 bp, Artificial sequence
  SiRNA target sequence
gaaaatggtttcttctctgaa

SEQ ID NO: 25073 - DNA, 21 bp, Artificial sequence
  SiRNA target sequence
aaaatggtttcttctctgaaa

SEQ ID NO: 25074 - DNA, 21 bp, Artificial sequence
  SiRNA target sequence
aaatggtttcttctctgaaat

SEQ ID NO: 25075 - DNA, 21 bp, Artificial sequence
  SiRNA target sequence
aatggtttcttctctgaaatt

SEQ ID NO: 25076 - DNA, 21 bp, Artificial sequence
  SiRNA target sequence
atggtttcttctctgaaattt

SEQ ID NO: 25077 - DNA, 21 bp, Artificial sequence
  SiRNA target sequence
tggtttcttctctgaaatttc

SEQ ID NO: 25078 - DNA, 21 bp, Artificial sequence
  SiRNA target sequence
ggtttcttctctgaaatttca

SEQ ID NO: 25079 - DNA, 21 bp, Artificial sequence
  SiRNA target sequence
gtttcttctctgaaatttcaa

SEQ ID NO: 25080 - DNA, 21 bp, Artificial sequence
  SiRNA target sequence
tttcttctctgaaatttcaag

SEQ ID NO: 25081 - DNA, 21 bp, Artificial sequence
  SiRNA target sequence
ttcttctctgaaatttcaaga

SEQ ID NO: 25082 - DNA, 21 bp, Artificial sequence
  SiRNA target sequence
tcttctctgaaatttcaagat

SEQ ID NO: 25083 - DNA, 21 bp, Artificial sequence
  SiRNA target sequence
cttctctgaaatttcaagatg

SEQ ID NO: 25084 - DNA, 21 bp, Artificial sequence
  SiRNA target sequence
ttctctgaaatttcaagatga

SEQ ID NO: 25085 - DNA, 21 bp, Artificial sequence
  SiRNA target sequence
tctctgaaatttcaagatgag

SEQ ID NO: 25086 - DNA, 21 bp, Artificial sequence
  SiRNA target sequence
ctctgaaatttcaagatgagg

SEQ ID NO: 25087 - DNA, 21 bp, Artificial sequence
  SiRNA target sequence
tctgaaatttcaagatgaggt

SEQ ID NO: 25088 - DNA, 21 bp, Artificial sequence
  SiRNA target sequence
ctgaaatttcaagatgaggtt

SEQ ID NO: 25089 - DNA, 21 bp, Artificial sequence
  SiRNA target sequence
tgaaatttcaagatgaggtta

SEQ ID NO: 25090 - DNA, 21 bp, Artificial sequence
  SiRNA target sequence
gaaatttcaagatgaggttag

SEQ ID NO: 25091 - DNA, 21 bp, Artificial sequence
  SiRNA target sequence
aaatttcaagatgaggttagg

SEQ ID NO: 25092 - DNA, 21 bp, Artificial sequence
  SiRNA target sequence
aatttcaagatgaggttaggg

SEQ ID NO: 25093 - DNA, 21 bp, Artificial sequence
  SiRNA target sequence
atttcaagatgaggttaggga

SEQ ID NO: 25094 - DNA, 21 bp, Artificial sequence
  SiRNA target sequence
tttcaagatgaggttagggaa

SEQ ID NO: 25095 - DNA, 21 bp, Artificial sequence
  SiRNA target sequence
ttcaagatgaggttagggaaa

SEQ ID NO: 25096 - DNA, 21 bp, Artificial sequence
  SiRNA target sequence
tcaagatgaggttagggaaat

SEQ ID NO: 25097 - DNA, 21 bp, Artificial sequence
  SiRNA target sequence
caagatgaggttagggaaatt

SEQ ID NO: 25098 - DNA, 21 bp, Artificial sequence
  SiRNA target sequence
aagatgaggttagggaaattg

SEQ ID NO: 25099 - DNA, 21 bp, Artificial sequence
  SiRNA target sequence
agatgaggttagggaaattgc

SEQ ID NO: 25100 - DNA, 21 bp, Artificial sequence
  SiRNA target sequence
gatgaggttagggaaattgct

SEQ ID NO: 25101 - DNA, 21 bp, Artificial sequence
  SiRNA target sequence
atgaggttagggaaattgctc

SEQ ID NO: 25102 - DNA, 21 bp, Artificial sequence
  SiRNA target sequence
tgaggttagggaaattgctct

SEQ ID NO: 25103 - DNA, 21 bp, Artificial sequence
  SiRNA target sequence
gaggttagggaaattgctctt

SEQ ID NO: 25104 - DNA, 21 bp, Artificial sequence
  SiRNA target sequence
aggttagggaaattgctcttg

SEQ ID NO: 25105 - DNA, 21 bp, Artificial sequence
  SiRNA target sequence
ggttagggaaattgctcttgg

SEQ ID NO: 25106 - DNA, 21 bp, Artificial sequence
  SiRNA target sequence
gttagggaaattgctcttggc

SEQ ID NO: 25107 - DNA, 21 bp, Artificial sequence
  SiRNA target sequence
ttagggaaattgctcttggcc

SEQ ID NO: 25108 - DNA, 21 bp, Artificial sequence
  SiRNA target sequence
tagggaaattgctcttggcct

SEQ ID NO: 25109 - DNA, 21 bp, Artificial sequence
  SiRNA target sequence
agggaaattgctcttggcctt

SEQ ID NO: 25110 - DNA, 21 bp, Artificial sequence
  SiRNA target sequence
gggaaattgctcttggccttt

SEQ ID NO: 25111 - DNA, 21 bp, Artificial sequence
  SiRNA target sequence
ggaaattgctcttggcctttt

SEQ ID NO: 25112 - DNA, 21 bp, Artificial sequence
  SiRNA target sequence
gaaattgctcttggcctttta

SEQ ID NO: 25113 - DNA, 21 bp, Artificial sequence
  SiRNA target sequence
aaattgctcttggccttttag

SEQ ID NO: 25114 - DNA, 21 bp, Artificial sequence
  SiRNA target sequence
aattgctcttggccttttagg

SEQ ID NO: 25115 - DNA, 21 bp, Artificial sequence
  SiRNA target sequence
attgctcttggccttttaggt

SEQ ID NO: 25116 - DNA, 21 bp, Artificial sequence
  SiRNA target sequence
ttgctcttggccttttaggtt

SEQ ID NO: 25117 - DNA, 21 bp, Artificial sequence
  SiRNA target sequence
tgctcttggccttttaggtta

SEQ ID NO: 25118 - DNA, 21 bp, Artificial sequence
  SiRNA target sequence
gctcttggccttttaggttac

SEQ ID NO: 25119 - DNA, 21 bp, Artificial sequence
  SiRNA target sequence
ctcttggccttttaggttacg

SEQ ID NO: 25120 - DNA, 21 bp, Artificial sequence
  SiRNA target sequence
tcttggccttttaggttacga

SEQ ID NO: 25121 - DNA, 21 bp, Artificial sequence
  SiRNA target sequence
cttggccttttaggttacgag

SEQ ID NO: 25122 - DNA, 21 bp, Artificial sequence
  SiRNA target sequence
ttggccttttaggttacgagt

SEQ ID NO: 25123 - DNA, 21 bp, Artificial sequence
  SiRNA target sequence
tggccttttaggttacgagta

SEQ ID NO: 25124 - DNA, 21 bp, Artificial sequence
  SiRNA target sequence
ggccttttaggttacgagtag

SEQ ID NO: 25125 - DNA, 21 bp, Artificial sequence
  SiRNA target sequence
gccttttaggttacgagtagt

SEQ ID NO: 25126 - DNA, 21 bp, Artificial sequence
  SiRNA target sequence
ccttttaggttacgagtagtt

SEQ ID NO: 25127 - DNA, 21 bp, Artificial sequence
  SiRNA target sequence
cttttaggttacgagtagttt

SEQ ID NO: 25128 - DNA, 21 bp, Artificial sequence
  SiRNA target sequence
ttttaggttacgagtagtttt

SEQ ID NO: 25129 - DNA, 21 bp, Artificial sequence
  SiRNA target sequence
tttaggttacgagtagttttc

SEQ ID NO: 25130 - DNA, 21 bp, Artificial sequence
  SiRNA target sequence
ttaggttacgagtagttttct

SEQ ID NO: 25131 - DNA, 21 bp, Artificial sequence
  SiRNA target sequence
taggttacgagtagttttctt

SEQ ID NO: 25132 - DNA, 21 bp, Artificial sequence
  SiRNA target sequence
aggttacgagtagttttctta

SEQ ID NO: 25133 - DNA, 21 bp, Artificial sequence
  SiRNA target sequence
ggttacgagtagttttcttat

SEQ ID NO: 25134 - DNA, 21 bp, Artificial sequence
  SiRNA target sequence
gttacgagtagttttcttatc

SEQ ID NO: 25135 - DNA, 21 bp, Artificial sequence
  SiRNA target sequence
ttacgagtagttttcttatca

SEQ ID NO: 25136 - DNA, 21 bp, Artificial sequence
  SiRNA target sequence
tacgagtagttttcttatcac

SEQ ID NO: 25137 - DNA, 21 bp, Artificial sequence
  SiRNA target sequence
acgagtagttttcttatcacc

SEQ ID NO: 25138 - DNA, 21 bp, Artificial sequence
  SiRNA target sequence
cgagtagttttcttatcacct

SEQ ID NO: 25139 - DNA, 21 bp, Artificial sequence
  SiRNA target sequence
gagtagttttcttatcacctt

SEQ ID NO: 25140 - DNA, 21 bp, Artificial sequence
  SiRNA target sequence
agtagttttcttatcaccttt

SEQ ID NO: 25141 - DNA, 21 bp, Artificial sequence
  SiRNA target sequence
gtagttttcttatcacctttt

SEQ ID NO: 25142 - DNA, 21 bp, Artificial sequence
  SiRNA target sequence
tagttttcttatcacctttta

SEQ ID NO: 25143 - DNA, 21 bp, Artificial sequence
  SiRNA target sequence
agttttcttatcaccttttaa

SEQ ID NO: 25144 - DNA, 21 bp, Artificial sequence
  SiRNA target sequence
gttttcttatcaccttttaaa

SEQ ID NO: 25145 - DNA, 21 bp, Artificial sequence
  SiRNA target sequence
ttttcttatcaccttttaaac

SEQ ID NO: 25146 - DNA, 21 bp, Artificial sequence
  SiRNA target sequence
tttcttatcaccttttaaacc

SEQ ID NO: 25147 - DNA, 21 bp, Artificial sequence
  SiRNA target sequence
ttcttatcaccttttaaacca

SEQ ID NO: 25148 - DNA, 21 bp, Artificial sequence
  SiRNA target sequence
tcttatcaccttttaaaccaa

SEQ ID NO: 25149 - DNA, 21 bp, Artificial sequence
  SiRNA target sequence
cttatcaccttttaaaccaac

SEQ ID NO: 25150 - DNA, 21 bp, Artificial sequence
  SiRNA target sequence
ttatcaccttttaaaccaaca

SEQ ID NO: 25151 - DNA, 21 bp, Artificial sequence
  SiRNA target sequence
tatcaccttttaaaccaacaa

SEQ ID NO: 25152 - DNA, 21 bp, Artificial sequence
  SiRNA target sequence
atcaccttttaaaccaacaat

SEQ ID NO: 25153 - DNA, 21 bp, Artificial sequence
  SiRNA target sequence
tcaccttttaaaccaacaatg

SEQ ID NO: 25154 - DNA, 21 bp, Artificial sequence
  SiRNA target sequence
caccttttaaaccaacaatgt

SEQ ID NO: 25155 - DNA, 21 bp, Artificial sequence
  SiRNA target sequence
accttttaaaccaacaatgtg

SEQ ID NO: 25156 - DNA, 21 bp, Artificial sequence
  SiRNA target sequence
ccttttaaaccaacaatgtga

SEQ ID NO: 25157 - DNA, 21 bp, Artificial sequence
  SiRNA target sequence
cttttaaaccaacaatgtgat

SEQ ID NO: 25158 - DNA, 21 bp, Artificial sequence
  SiRNA target sequence
ttttaaaccaacaatgtgatc

SEQ ID NO: 25159 - DNA, 21 bp, Artificial sequence
  SiRNA target sequence
tttaaaccaacaatgtgatct

SEQ ID NO: 25160 - DNA, 21 bp, Artificial sequence
  SiRNA target sequence
ttaaaccaacaatgtgatctt

SEQ ID NO: 25161 - DNA, 21 bp, Artificial sequence
  SiRNA target sequence
taaaccaacaatgtgatcttg

SEQ ID NO: 25162 - DNA, 21 bp, Artificial sequence
  SiRNA target sequence
aaaccaacaatgtgatcttgc

SEQ ID NO: 25163 - DNA, 21 bp, Artificial sequence
  SiRNA target sequence
aaccaacaatgtgatcttgct

SEQ ID NO: 25164 - DNA, 21 bp, Artificial sequence
  SiRNA target sequence
accaacaatgtgatcttgctc

SEQ ID NO: 25165 - DNA, 21 bp, Artificial sequence
  SiRNA target sequence
ccaacaatgtgatcttgctcg

SEQ ID NO: 25166 - DNA, 21 bp, Artificial sequence
  SiRNA target sequence
caacaatgtgatcttgctcgc

SEQ ID NO: 25167 - DNA, 21 bp, Artificial sequence
  SiRNA target sequence
aacaatgtgatcttgctcgca

SEQ ID NO: 25168 - DNA, 21 bp, Artificial sequence
  SiRNA target sequence
acaatgtgatcttgctcgcag

SEQ ID NO: 25169 - DNA, 21 bp, Artificial sequence
  SiRNA target sequence
caatgtgatcttgctcgcaga

SEQ ID NO: 25170 - DNA, 21 bp, Artificial sequence
  SiRNA target sequence
aatgtgatcttgctcgcagag

SEQ ID NO: 25171 - DNA, 21 bp, Artificial sequence
  SiRNA target sequence
atgtgatcttgctcgcagagg

SEQ ID NO: 25172 - DNA, 21 bp, Artificial sequence
  SiRNA target sequence
tgtgatcttgctcgcagaggc

SEQ ID NO: 25173 - DNA, 21 bp, Artificial sequence
  SiRNA target sequence
gtgatcttgctcgcagaggca

SEQ ID NO: 25174 - DNA, 21 bp, Artificial sequence
  SiRNA target sequence
tgatcttgctcgcagaggcaa

SEQ ID NO: 25175 - DNA, 21 bp, Artificial sequence
  SiRNA target sequence
gatcttgctcgcagaggcaaa

SEQ ID NO: 25176 - DNA, 21 bp, Artificial sequence
  SiRNA target sequence
atcttgctcgcagaggcaaaa

SEQ ID NO: 25177 - DNA, 21 bp, Artificial sequence
  SiRNA target sequence
tcttgctcgcagaggcaaaaa

SEQ ID NO: 25178 - DNA, 21 bp, Artificial sequence
  SiRNA target sequence
cttgctcgcagaggcaaaaat

SEQ ID NO: 25179 - DNA, 21 bp, Artificial sequence
  SiRNA target sequence
ttgctcgcagaggcaaaaatt

SEQ ID NO: 25180 - DNA, 21 bp, Artificial sequence
  SiRNA target sequence
tgctcgcagaggcaaaaattt

SEQ ID NO: 25181 - DNA, 21 bp, Artificial sequence
  SiRNA target sequence
gctcgcagaggcaaaaatttg

SEQ ID NO: 25182 - DNA, 21 bp, Artificial sequence
  SiRNA target sequence
ctcgcagaggcaaaaatttgc

SEQ ID NO: 25183 - DNA, 21 bp, Artificial sequence
  SiRNA target sequence
tcgcagaggcaaaaatttgca

SEQ ID NO: 25184 - DNA, 21 bp, Artificial sequence
  SiRNA target sequence
cgcagaggcaaaaatttgcac

SEQ ID NO: 25185 - DNA, 21 bp, Artificial sequence
  SiRNA target sequence
gcagaggcaaaaatttgcaca

SEQ ID NO: 25186 - DNA, 21 bp, Artificial sequence
  SiRNA target sequence
cagaggcaaaaatttgcacag

SEQ ID NO: 25187 - DNA, 21 bp, Artificial sequence
  SiRNA target sequence
agaggcaaaaatttgcacagt

SEQ ID NO: 25188 - DNA, 21 bp, Artificial sequence
  SiRNA target sequence
gaggcaaaaatttgcacagta

SEQ ID NO: 25189 - DNA, 21 bp, Artificial sequence
  SiRNA target sequence
aggcaaaaatttgcacagtat

SEQ ID NO: 25190 - DNA, 21 bp, Artificial sequence
  SiRNA target sequence
ggcaaaaatttgcacagtata

SEQ ID NO: 25191 - DNA, 21 bp, Artificial sequence
  SiRNA target sequence
gcaaaaatttgcacagtataa

SEQ ID NO: 25192 - DNA, 21 bp, Artificial sequence
  SiRNA target sequence
caaaaatttgcacagtataaa

SEQ ID NO: 25193 - DNA, 21 bp, Artificial sequence
  SiRNA target sequence
aaaaatttgcacagtataaaa

SEQ ID NO: 25194 - DNA, 21 bp, Artificial sequence
  SiRNA target sequence
aaaatttgcacagtataaaat

SEQ ID NO: 25195 - DNA, 21 bp, Artificial sequence
  SiRNA target sequence
aaatttgcacagtataaaatc

SEQ ID NO: 25196 - DNA, 21 bp, Artificial sequence
  SiRNA target sequence
aatttgcacagtataaaatct

SEQ ID NO: 25197 - DNA, 21 bp, Artificial sequence
  SiRNA target sequence
atttgcacagtataaaatctg

SEQ ID NO: 25198 - DNA, 21 bp, Artificial sequence
  SiRNA target sequence
tttgcacagtataaaatctgc

SEQ ID NO: 25199 - DNA, 21 bp, Artificial sequence
  SiRNA target sequence
ttgcacagtataaaatctgca

SEQ ID NO: 25200 - DNA, 21 bp, Artificial sequence
  SiRNA target sequence
tgcacagtataaaatctgcaa

SEQ ID NO: 25201 - DNA, 21 bp, Artificial sequence
  SiRNA target sequence
gcacagtataaaatctgcaag

SEQ ID NO: 25202 - DNA, 21 bp, Artificial sequence
  SiRNA target sequence
cacagtataaaatctgcaagt

SEQ ID NO: 25203 - DNA, 21 bp, Artificial sequence
  SiRNA target sequence
acagtataaaatctgcaagta

SEQ ID NO: 25204 - DNA, 21 bp, Artificial sequence
  SiRNA target sequence
cagtataaaatctgcaagtag

SEQ ID NO: 25205 - DNA, 21 bp, Artificial sequence
  SiRNA target sequence
agtataaaatctgcaagtagt

SEQ ID NO: 25206 - DNA, 21 bp, Artificial sequence
  SiRNA target sequence
gtataaaatctgcaagtagtg

SEQ ID NO: 25207 - DNA, 21 bp, Artificial sequence
  SiRNA target sequence
tataaaatctgcaagtagtgc

SEQ ID NO: 25208 - DNA, 21 bp, Artificial sequence
  SiRNA target sequence
ataaaatctgcaagtagtgct

SEQ ID NO: 25209 - DNA, 21 bp, Artificial sequence
  SiRNA target sequence
taaaatctgcaagtagtgcta

SEQ ID NO: 25210 - DNA, 21 bp, Artificial sequence
  SiRNA target sequence
aaaatctgcaagtagtgctat

SEQ ID NO: 25211 - DNA, 21 bp, Artificial sequence
  SiRNA target sequence
aaatctgcaagtagtgctatt

SEQ ID NO: 25212 - DNA, 21 bp, Artificial sequence
  SiRNA target sequence
aatctgcaagtagtgctattg

SEQ ID NO: 25213 - DNA, 21 bp, Artificial sequence
  SiRNA target sequence
atctgcaagtagtgctattgt

SEQ ID NO: 25214 - DNA, 21 bp, Artificial sequence
  SiRNA target sequence
tctgcaagtagtgctattgtt

SEQ ID NO: 25215 - DNA, 21 bp, Artificial sequence
  SiRNA target sequence
ctgcaagtagtgctattgttg

SEQ ID NO: 25216 - DNA, 21 bp, Artificial sequence
  SiRNA target sequence
tgcaagtagtgctattgttgg

SEQ ID NO: 25217 - DNA, 21 bp, Artificial sequence
  SiRNA target sequence
gcaagtagtgctattgttgga

SEQ ID NO: 25218 - DNA, 21 bp, Artificial sequence
  SiRNA target sequence
caagtagtgctattgttggaa

SEQ ID NO: 25219 - DNA, 21 bp, Artificial sequence
  SiRNA target sequence
aagtagtgctattgttggaat

SEQ ID NO: 25220 - DNA, 21 bp, Artificial sequence
  SiRNA target sequence
agtagtgctattgttggaatc

SEQ ID NO: 25221 - DNA, 21 bp, Artificial sequence
  SiRNA target sequence
gtagtgctattgttggaatca

SEQ ID NO: 25222 - DNA, 21 bp, Artificial sequence
  SiRNA target sequence
tagtgctattgttggaatcac

SEQ ID NO: 25223 - DNA, 21 bp, Artificial sequence
  SiRNA target sequence
agtgctattgttggaatcacc

SEQ ID NO: 25224 - DNA, 21 bp, Artificial sequence
  SiRNA target sequence
gtgctattgttggaatcaccg

SEQ ID NO: 25225 - DNA, 21 bp, Artificial sequence
  SiRNA target sequence
tgctattgttggaatcaccgt

SEQ ID NO: 25226 - DNA, 21 bp, Artificial sequence
  SiRNA target sequence
gctattgttggaatcaccgta

SEQ ID NO: 25227 - DNA, 21 bp, Artificial sequence
  SiRNA target sequence
ctattgttggaatcaccgtac

SEQ ID NO: 25228 - DNA, 21 bp, Artificial sequence
  SiRNA target sequence
tattgttggaatcaccgtacc

SEQ ID NO: 25229 - DNA, 21 bp, Artificial sequence
  SiRNA target sequence
attgttggaatcaccgtacct

SEQ ID NO: 25230 - DNA, 21 bp, Artificial sequence
  SiRNA target sequence
ttgttggaatcaccgtaccta

SEQ ID NO: 25231 - DNA, 21 bp, Artificial sequence
  SiRNA target sequence
tgttggaatcaccgtacctat

SEQ ID NO: 25232 - DNA, 21 bp, Artificial sequence
  SiRNA target sequence
gttggaatcaccgtacctatt

SEQ ID NO: 25233 - DNA, 21 bp, Artificial sequence
  SiRNA target sequence
ttggaatcaccgtacctattt

SEQ ID NO: 25234 - DNA, 21 bp, Artificial sequence
  SiRNA target sequence
tggaatcaccgtacctattta

SEQ ID NO: 25235 - DNA, 21 bp, Artificial sequence
  SiRNA target sequence
ggaatcaccgtacctatttag

SEQ ID NO: 25236 - DNA, 21 bp, Artificial sequence
  SiRNA target sequence
gaatcaccgtacctatttagg

SEQ ID NO: 25237 - DNA, 21 bp, Artificial sequence
  SiRNA target sequence
aatcaccgtacctatttaggt

SEQ ID NO: 25238 - DNA, 21 bp, Artificial sequence
  SiRNA target sequence
atcaccgtacctatttaggtt

SEQ ID NO: 25239 - DNA, 21 bp, Artificial sequence
  SiRNA target sequence
tcaccgtacctatttaggttt

SEQ ID NO: 25240 - DNA, 21 bp, Artificial sequence
  SiRNA target sequence
caccgtacctatttaggttta

SEQ ID NO: 25241 - DNA, 21 bp, Artificial sequence
  SiRNA target sequence
accgtacctatttaggtttac

SEQ ID NO: 25242 - DNA, 21 bp, Artificial sequence
  SiRNA target sequence
ccgtacctatttaggtttacg

SEQ ID NO: 25243 - DNA, 21 bp, Artificial sequence
  SiRNA target sequence
cgtacctatttaggtttacgc

SEQ ID NO: 25244 - DNA, 21 bp, Artificial sequence
  SiRNA target sequence
gtacctatttaggtttacgct

SEQ ID NO: 25245 - DNA, 21 bp, Artificial sequence
  SiRNA target sequence
tacctatttaggtttacgctc

SEQ ID NO: 25246 - DNA, 21 bp, Artificial sequence
  SiRNA target sequence
acctatttaggtttacgctcc

SEQ ID NO: 25247 - DNA, 21 bp, Artificial sequence
  SiRNA target sequence
cctatttaggtttacgctcca

SEQ ID NO: 25248 - DNA, 21 bp, Artificial sequence
  SiRNA target sequence
ctatttaggtttacgctccaa

SEQ ID NO: 25249 - DNA, 21 bp, Artificial sequence
  SiRNA target sequence
tatttaggtttacgctccaag

SEQ ID NO: 25250 - DNA, 21 bp, Artificial sequence
  SiRNA target sequence
atttaggtttacgctccaaga

SEQ ID NO: 25251 - DNA, 21 bp, Artificial sequence
  SiRNA target sequence
tttaggtttacgctccaagat

SEQ ID NO: 25252 - DNA, 21 bp, Artificial sequence
  SiRNA target sequence
ttaggtttacgctccaagatc

SEQ ID NO: 25253 - DNA, 21 bp, Artificial sequence
  SiRNA target sequence
taggtttacgctccaagatcg

SEQ ID NO: 25254 - DNA, 21 bp, Artificial sequence
  SiRNA target sequence
aggtttacgctccaagatcgg

SEQ ID NO: 25255 - DNA, 21 bp, Artificial sequence
  SiRNA target sequence
ggtttacgctccaagatcggt

SEQ ID NO: 25256 - DNA, 21 bp, Artificial sequence
  SiRNA target sequence
gtttacgctccaagatcggtg

SEQ ID NO: 25257 - DNA, 21 bp, Artificial sequence
  SiRNA target sequence
tttacgctccaagatcggtgg

SEQ ID NO: 25258 - DNA, 21 bp, Artificial sequence
  SiRNA target sequence
ttacgctccaagatcggtgga

SEQ ID NO: 25259 - DNA, 21 bp, Artificial sequence
  SiRNA target sequence
tacgctccaagatcggtggat

SEQ ID NO: 25260 - DNA, 21 bp, Artificial sequence
  SiRNA target sequence
acgctccaagatcggtggata

SEQ ID NO: 25261 - DNA, 21 bp, Artificial sequence
  SiRNA target sequence
cgctccaagatcggtggatag

SEQ ID NO: 25262 - DNA, 21 bp, Artificial sequence
  SiRNA target sequence
gctccaagatcggtggatagc

SEQ ID NO: 25263 - DNA, 21 bp, Artificial sequence
  SiRNA target sequence
ctccaagatcggtggatagca

SEQ ID NO: 25264 - DNA, 21 bp, Artificial sequence
  SiRNA target sequence
tccaagatcggtggatagcag

SEQ ID NO: 25265 - DNA, 21 bp, Artificial sequence
  SiRNA target sequence
ccaagatcggtggatagcagc

SEQ ID NO: 25266 - DNA, 21 bp, Artificial sequence
  SiRNA target sequence
caagatcggtggatagcagcc

SEQ ID NO: 25267 - DNA, 21 bp, Artificial sequence
  SiRNA target sequence
aagatcggtggatagcagccc

SEQ ID NO: 25268 - DNA, 21 bp, Artificial sequence
  SiRNA target sequence
agatcggtggatagcagccct

SEQ ID NO: 25269 - DNA, 21 bp, Artificial sequence
  SiRNA target sequence
gatcggtggatagcagcccta

SEQ ID NO: 25270 - DNA, 21 bp, Artificial sequence
  SiRNA target sequence
atcggtggatagcagccctat

SEQ ID NO: 25271 - DNA, 21 bp, Artificial sequence
  SiRNA target sequence
tcggtggatagcagccctatc

SEQ ID NO: 25272 - DNA, 21 bp, Artificial sequence
  SiRNA target sequence
cggtggatagcagccctatca

SEQ ID NO: 25273 - DNA, 21 bp, Artificial sequence
  SiRNA target sequence
ggtggatagcagccctatcaa

SEQ ID NO: 25274 - DNA, 21 bp, Artificial sequence
  SiRNA target sequence
gtggatagcagccctatcaat

SEQ ID NO: 25275 - DNA, 21 bp, Artificial sequence
  SiRNA target sequence
tggatagcagccctatcaata

SEQ ID NO: 25276 - DNA, 21 bp, Artificial sequence
  SiRNA target sequence
ggatagcagccctatcaatat

SEQ ID NO: 25277 - DNA, 21 bp, Artificial sequence
  SiRNA target sequence
gatagcagccctatcaatatc

SEQ ID NO: 25278 - DNA, 21 bp, Artificial sequence
  SiRNA target sequence
atagcagccctatcaatatct

SEQ ID NO: 25279 - DNA, 21 bp, Artificial sequence
  SiRNA target sequence
tagcagccctatcaatatcta

SEQ ID NO: 25280 - DNA, 21 bp, Artificial sequence
  SiRNA target sequence
agcagccctatcaatatctag

SEQ ID NO: 25281 - DNA, 21 bp, Artificial sequence
  SiRNA target sequence
gcagccctatcaatatctagg

SEQ ID NO: 25282 - DNA, 21 bp, Artificial sequence
  SiRNA target sequence
cagccctatcaatatctagga

SEQ ID NO: 25283 - DNA, 21 bp, Artificial sequence
  SiRNA target sequence
agccctatcaatatctaggag

SEQ ID NO: 25284 - DNA, 21 bp, Artificial sequence
  SiRNA target sequence
gccctatcaatatctaggaga

SEQ ID NO: 25285 - DNA, 21 bp, Artificial sequence
  SiRNA target sequence
ccctatcaatatctaggagaa

SEQ ID NO: 25286 - DNA, 21 bp, Artificial sequence
  SiRNA target sequence
cctatcaatatctaggagaac

SEQ ID NO: 25287 - DNA, 21 bp, Artificial sequence
  SiRNA target sequence
ctatcaatatctaggagaact

SEQ ID NO: 25288 - DNA, 21 bp, Artificial sequence
  SiRNA target sequence
tatcaatatctaggagaactg

SEQ ID NO: 25289 - DNA, 21 bp, Artificial sequence
  SiRNA target sequence
atcaatatctaggagaactgt

SEQ ID NO: 25290 - DNA, 21 bp, Artificial sequence
  SiRNA target sequence
tcaatatctaggagaactgtg

SEQ ID NO: 25291 - DNA, 21 bp, Artificial sequence
  SiRNA target sequence
caatatctaggagaactgtgc

SEQ ID NO: 25292 - DNA, 21 bp, Artificial sequence
  SiRNA target sequence
aatatctaggagaactgtgct

SEQ ID NO: 25293 - DNA, 21 bp, Artificial sequence
  SiRNA target sequence
atatctaggagaactgtgcta

SEQ ID NO: 25294 - DNA, 21 bp, Artificial sequence
  SiRNA target sequence
tatctaggagaactgtgctat

SEQ ID NO: 25295 - DNA, 21 bp, Artificial sequence
  SiRNA target sequence
atctaggagaactgtgctatg

SEQ ID NO: 25296 - DNA, 21 bp, Artificial sequence
  SiRNA target sequence
tctaggagaactgtgctatgt

SEQ ID NO: 25297 - DNA, 21 bp, Artificial sequence
  SiRNA target sequence
ctaggagaactgtgctatgtt

SEQ ID NO: 25298 - DNA, 21 bp, Artificial sequence
  SiRNA target sequence
taggagaactgtgctatgttt

SEQ ID NO: 25299 - DNA, 21 bp, Artificial sequence
  SiRNA target sequence
aggagaactgtgctatgttta

SEQ ID NO: 25300 - DNA, 21 bp, Artificial sequence
  SiRNA target sequence
ggagaactgtgctatgtttag

SEQ ID NO: 25301 - DNA, 21 bp, Artificial sequence
  SiRNA target sequence
gagaactgtgctatgtttaga

SEQ ID NO: 25302 - DNA, 21 bp, Artificial sequence
  SiRNA target sequence
agaactgtgctatgtttagaa

SEQ ID NO: 25303 - DNA, 21 bp, Artificial sequence
  SiRNA target sequence
gaactgtgctatgtttagaag

SEQ ID NO: 25304 - DNA, 21 bp, Artificial sequence
  SiRNA target sequence
aactgtgctatgtttagaaga

SEQ ID NO: 25305 - DNA, 21 bp, Artificial sequence
  SiRNA target sequence
actgtgctatgtttagaagat

SEQ ID NO: 25306 - DNA, 21 bp, Artificial sequence
  SiRNA target sequence
ctgtgctatgtttagaagatt

SEQ ID NO: 25307 - DNA, 21 bp, Artificial sequence
  SiRNA target sequence
tgtgctatgtttagaagatta

SEQ ID NO: 25308 - DNA, 21 bp, Artificial sequence
  SiRNA target sequence
gtgctatgtttagaagattag

SEQ ID NO: 25309 - DNA, 21 bp, Artificial sequence
  SiRNA target sequence
tgctatgtttagaagattagg

SEQ ID NO: 25310 - DNA, 21 bp, Artificial sequence
  SiRNA target sequence
gctatgtttagaagattaggt

SEQ ID NO: 25311 - DNA, 21 bp, Artificial sequence
  SiRNA target sequence
ctatgtttagaagattaggta

SEQ ID NO: 25312 - DNA, 21 bp, Artificial sequence
  SiRNA target sequence
tatgtttagaagattaggtag

SEQ ID NO: 25313 - DNA, 21 bp, Artificial sequence
  SiRNA target sequence
atgtttagaagattaggtagt

SEQ ID NO: 25314 - DNA, 21 bp, Artificial sequence
  SiRNA target sequence
tgtttagaagattaggtagtc

SEQ ID NO: 25315 - DNA, 21 bp, Artificial sequence
  SiRNA target sequence
gtttagaagattaggtagtct

SEQ ID NO: 25316 - DNA, 21 bp, Artificial sequence
  SiRNA target sequence
tttagaagattaggtagtctc

SEQ ID NO: 25317 - DNA, 21 bp, Artificial sequence
  SiRNA target sequence
ttagaagattaggtagtctct

SEQ ID NO: 25318 - DNA, 21 bp, Artificial sequence
  SiRNA target sequence
tagaagattaggtagtctcta

SEQ ID NO: 25319 - DNA, 21 bp, Artificial sequence
  SiRNA target sequence
agaagattaggtagtctctaa

SEQ ID NO: 25320 - DNA, 21 bp, Artificial sequence
  SiRNA target sequence
gaagattaggtagtctctaaa

SEQ ID NO: 25321 - DNA, 21 bp, Artificial sequence
  SiRNA target sequence
aagattaggtagtctctaaac

SEQ ID NO: 25322 - DNA, 21 bp, Artificial sequence
  SiRNA target sequence
agattaggtagtctctaaaca

SEQ ID NO: 25323 - DNA, 21 bp, Artificial sequence
  SiRNA target sequence
gattaggtagtctctaaacag

SEQ ID NO: 25324 - DNA, 21 bp, Artificial sequence
  SiRNA target sequence
attaggtagtctctaaacaga

SEQ ID NO: 25325 - DNA, 21 bp, Artificial sequence
  SiRNA target sequence
ttaggtagtctctaaacagaa

SEQ ID NO: 25326 - DNA, 21 bp, Artificial sequence
  SiRNA target sequence
taggtagtctctaaacagaac

SEQ ID NO: 25327 - DNA, 21 bp, Artificial sequence
  SiRNA target sequence
aggtagtctctaaacagaaca

SEQ ID NO: 25328 - DNA, 21 bp, Artificial sequence
  SiRNA target sequence
ggtagtctctaaacagaacaa

SEQ ID NO: 25329 - DNA, 21 bp, Artificial sequence
  SiRNA target sequence
gtagtctctaaacagaacaat

SEQ ID NO: 25330 - DNA, 21 bp, Artificial sequence
  SiRNA target sequence
tagtctctaaacagaacaatt

SEQ ID NO: 25331 - DNA, 21 bp, Artificial sequence
  SiRNA target sequence
agtctctaaacagaacaattt

SEQ ID NO: 25332 - DNA, 21 bp, Artificial sequence
  SiRNA target sequence
gtctctaaacagaacaattta

SEQ ID NO: 25333 - DNA, 21 bp, Artificial sequence
  SiRNA target sequence
tctctaaacagaacaatttac

SEQ ID NO: 25334 - DNA, 21 bp, Artificial sequence
  SiRNA target sequence
ctctaaacagaacaatttacc

SEQ ID NO: 25335 - DNA, 21 bp, Artificial sequence
  SiRNA target sequence
tctaaacagaacaatttacct

SEQ ID NO: 25336 - DNA, 21 bp, Artificial sequence
  SiRNA target sequence
ctaaacagaacaatttacctg

SEQ ID NO: 25337 - DNA, 21 bp, Artificial sequence
  SiRNA target sequence
taaacagaacaatttacctgc

SEQ ID NO: 25338 - DNA, 21 bp, Artificial sequence
  SiRNA target sequence
aaacagaacaatttacctgct

SEQ ID NO: 25339 - DNA, 21 bp, Artificial sequence
  SiRNA target sequence
aacagaacaatttacctgctg

SEQ ID NO: 25340 - DNA, 21 bp, Artificial sequence
  SiRNA target sequence
acagaacaatttacctgctga

SEQ ID NO: 25341 - DNA, 21 bp, Artificial sequence
  SiRNA target sequence
cagaacaatttacctgctgaa

SEQ ID NO: 25342 - DNA, 21 bp, Artificial sequence
  SiRNA target sequence
agaacaatttacctgctgaac

SEQ ID NO: 25343 - DNA, 21 bp, Artificial sequence
  SiRNA target sequence
gaacaatttacctgctgaaca

SEQ ID NO: 25344 - DNA, 21 bp, Artificial sequence
  SiRNA target sequence
aacaatttacctgctgaacaa

SEQ ID NO: 25345 - DNA, 21 bp, Artificial sequence
  SiRNA target sequence
acaatttacctgctgaacaaa

SEQ ID NO: 25346 - DNA, 21 bp, Artificial sequence
  SiRNA target sequence
caatttacctgctgaacaaat

SEQ ID NO: 25347 - DNA, 21 bp, Artificial sequence
  SiRNA target sequence
aatttacctgctgaacaaatt

SEQ ID NO: 25348 - DNA, 21 bp, Artificial sequence
  SiRNA target sequence
atttacctgctgaacaaatta

SEQ ID NO: 25349 - DNA, 21 bp, Artificial sequence
  SiRNA target sequence
tttacctgctgaacaaattaa

SEQ ID NO: 25350 - DNA, 21 bp, Artificial sequence
  SiRNA target sequence
ttacctgctgaacaaattaat

SEQ ID NO: 25351 - DNA, 21 bp, Artificial sequence
  SiRNA target sequence
tacctgctgaacaaattaatg

SEQ ID NO: 25352 - DNA, 21 bp, Artificial sequence
  SiRNA target sequence
acctgctgaacaaattaatga

SEQ ID NO: 25353 - DNA, 21 bp, Artificial sequence
  SiRNA target sequence
cctgctgaacaaattaatgaa

SEQ ID NO: 25354 - DNA, 21 bp, Artificial sequence
  SiRNA target sequence
ctgctgaacaaattaatgaaa

SEQ ID NO: 25355 - DNA, 21 bp, Artificial sequence
  SiRNA target sequence
tgctgaacaaattaatgaaaa

SEQ ID NO: 25356 - DNA, 21 bp, Artificial sequence
  SiRNA target sequence
gctgaacaaattaatgaaaat

SEQ ID NO: 25357 - DNA, 21 bp, Artificial sequence
  SiRNA target sequence
ctgaacaaattaatgaaaatt

SEQ ID NO: 25358 - DNA, 21 bp, Artificial sequence
  SiRNA target sequence
tgaacaaattaatgaaaatta

SEQ ID NO: 25359 - DNA, 21 bp, Artificial sequence
  SiRNA target sequence
gaacaaattaatgaaaattat

SEQ ID NO: 25360 - DNA, 21 bp, Artificial sequence
  SiRNA target sequence
aacaaattaatgaaaattatg

SEQ ID NO: 25361 - DNA, 21 bp, Artificial sequence
  SiRNA target sequence
acaaattaatgaaaattatga

SEQ ID NO: 25362 - DNA, 21 bp, Artificial sequence
  SiRNA target sequence
caaattaatgaaaattatgaa

SEQ ID NO: 25363 - DNA, 21 bp, Artificial sequence
  SiRNA target sequence
aaattaatgaaaattatgaaa

SEQ ID NO: 25364 - DNA, 21 bp, Artificial sequence
  SiRNA target sequence
aattaatgaaaattatgaaaa

SEQ ID NO: 25365 - DNA, 21 bp, Artificial sequence
  SiRNA target sequence
attaatgaaaattatgaaaat

SEQ ID NO: 25366 - DNA, 21 bp, Artificial sequence
  SiRNA target sequence
ttaatgaaaattatgaaaata

SEQ ID NO: 25367 - DNA, 21 bp, Artificial sequence
  SiRNA target sequence
taatgaaaattatgaaaataa

SEQ ID NO: 25368 - DNA, 21 bp, Artificial sequence
  SiRNA target sequence
aatgaaaattatgaaaataaa

SEQ ID NO: 25369 - DNA, 21 bp, Artificial sequence
  SiRNA target sequence
atgaaaattatgaaaataaac

SEQ ID NO: 25370 - DNA, 21 bp, Artificial sequence
  SiRNA target sequence
tgaaaattatgaaaataaaca

SEQ ID NO: 25371 - DNA, 21 bp, Artificial sequence
  SiRNA target sequence
gaaaattatgaaaataaacaa

SEQ ID NO: 25372 - DNA, 21 bp, Artificial sequence
  SiRNA target sequence
aaaattatgaaaataaacaac

SEQ ID NO: 25373 - DNA, 21 bp, Artificial sequence
  SiRNA target sequence
aaattatgaaaataaacaaca

SEQ ID NO: 25374 - DNA, 21 bp, Artificial sequence
  SiRNA target sequence
aattatgaaaataaacaacaa

SEQ ID NO: 25375 - DNA, 21 bp, Artificial sequence
  SiRNA target sequence
attatgaaaataaacaacaac

SEQ ID NO: 25376 - DNA, 21 bp, Artificial sequence
  SiRNA target sequence
ttatgaaaataaacaacaact

SEQ ID NO: 25377 - DNA, 21 bp, Artificial sequence
  SiRNA target sequence
tatgaaaataaacaacaactt

SEQ ID NO: 25378 - DNA, 21 bp, Artificial sequence
  SiRNA target sequence
atgaaaataaacaacaacttg

SEQ ID NO: 25379 - DNA, 21 bp, Artificial sequence
  SiRNA target sequence
tgaaaataaacaacaacttgt

SEQ ID NO: 25380 - DNA, 21 bp, Artificial sequence
  SiRNA target sequence
gaaaataaacaacaacttgtt

SEQ ID NO: 25381 - DNA, 21 bp, Artificial sequence
  SiRNA target sequence
aaaataaacaacaacttgttg

SEQ ID NO: 25382 - DNA, 21 bp, Artificial sequence
  SiRNA target sequence
aaataaacaacaacttgttga

SEQ ID NO: 25383 - DNA, 21 bp, Artificial sequence
  SiRNA target sequence
aataaacaacaacttgttgaa

SEQ ID NO: 25384 - DNA, 21 bp, Artificial sequence
  SiRNA target sequence
ataaacaacaacttgttgaac

SEQ ID NO: 25385 - DNA, 21 bp, Artificial sequence
  SiRNA target sequence
taaacaacaacttgttgaaca

SEQ ID NO: 25386 - DNA, 21 bp, Artificial sequence
  SiRNA target sequence
aaacaacaacttgttgaacag

SEQ ID NO: 25387 - DNA, 21 bp, Artificial sequence
  SiRNA target sequence
aacaacaacttgttgaacaga

SEQ ID NO: 25388 - DNA, 21 bp, Artificial sequence
  SiRNA target sequence
acaacaacttgttgaacagac

SEQ ID NO: 25389 - DNA, 21 bp, Artificial sequence
  SiRNA target sequence
caacaacttgttgaacagacc

SEQ ID NO: 25390 - DNA, 21 bp, Artificial sequence
  SiRNA target sequence
aacaacttgttgaacagaccg

SEQ ID NO: 25391 - DNA, 21 bp, Artificial sequence
  SiRNA target sequence
acaacttgttgaacagaccga

SEQ ID NO: 25392 - DNA, 21 bp, Artificial sequence
  SiRNA target sequence
caacttgttgaacagaccgaa

SEQ ID NO: 25393 - DNA, 21 bp, Artificial sequence
  SiRNA target sequence
aacttgttgaacagaccgaaa

SEQ ID NO: 25394 - DNA, 21 bp, Artificial sequence
  SiRNA target sequence
acttgttgaacagaccgaaat

SEQ ID NO: 25395 - DNA, 21 bp, Artificial sequence
  SiRNA target sequence
cttgttgaacagaccgaaatt

SEQ ID NO: 25396 - DNA, 21 bp, Artificial sequence
  SiRNA target sequence
ttgttgaacagaccgaaatta

SEQ ID NO: 25397 - DNA, 21 bp, Artificial sequence
  SiRNA target sequence
tgttgaacagaccgaaattac

SEQ ID NO: 25398 - DNA, 21 bp, Artificial sequence
  SiRNA target sequence
gttgaacagaccgaaattacc

SEQ ID NO: 25399 - DNA, 21 bp, Artificial sequence
  SiRNA target sequence
ttgaacagaccgaaattacca

SEQ ID NO: 25400 - DNA, 21 bp, Artificial sequence
  SiRNA target sequence
tgaacagaccgaaattaccac

SEQ ID NO: 25401 - DNA, 21 bp, Artificial sequence
  SiRNA target sequence
gaacagaccgaaattaccacc

SEQ ID NO: 25402 - DNA, 21 bp, Artificial sequence
  SiRNA target sequence
aacagaccgaaattaccacct

SEQ ID NO: 25403 - DNA, 21 bp, Artificial sequence
  SiRNA target sequence
acagaccgaaattaccacctt

SEQ ID NO: 25404 - DNA, 21 bp, Artificial sequence
  SiRNA target sequence
cagaccgaaattaccaccttt

SEQ ID NO: 25405 - DNA, 21 bp, Artificial sequence
  SiRNA target sequence
agaccgaaattaccacctttg

SEQ ID NO: 25406 - DNA, 21 bp, Artificial sequence
  SiRNA target sequence
gaccgaaattaccacctttga

SEQ ID NO: 25407 - DNA, 21 bp, Artificial sequence
  SiRNA target sequence
accgaaattaccacctttgaa

SEQ ID NO: 25408 - DNA, 21 bp, Artificial sequence
  SiRNA target sequence
ccgaaattaccacctttgaaa

SEQ ID NO: 25409 - DNA, 21 bp, Artificial sequence
  SiRNA target sequence
cgaaattaccacctttgaaaa

SEQ ID NO: 25410 - DNA, 21 bp, Artificial sequence
  SiRNA target sequence
gaaattaccacctttgaaaac

SEQ ID NO: 25411 - DNA, 21 bp, Artificial sequence
  SiRNA target sequence
aaattaccacctttgaaaacg

SEQ ID NO: 25412 - DNA, 21 bp, Artificial sequence
  SiRNA target sequence
aattaccacctttgaaaacga

SEQ ID NO: 25413 - DNA, 21 bp, Artificial sequence
  SiRNA target sequence
attaccacctttgaaaacgat

SEQ ID NO: 25414 - DNA, 21 bp, Artificial sequence
  SiRNA target sequence
ttaccacctttgaaaacgatt

SEQ ID NO: 25415 - DNA, 21 bp, Artificial sequence
  SiRNA target sequence
taccacctttgaaaacgattt

SEQ ID NO: 25416 - DNA, 21 bp, Artificial sequence
  SiRNA target sequence
accacctttgaaaacgatttg

SEQ ID NO: 25417 - DNA, 21 bp, Artificial sequence
  SiRNA target sequence
ccacctttgaaaacgatttga

SEQ ID NO: 25418 - DNA, 21 bp, Artificial sequence
  SiRNA target sequence
cacctttgaaaacgatttgat

SEQ ID NO: 25419 - DNA, 21 bp, Artificial sequence
  SiRNA target sequence
acctttgaaaacgatttgatc

SEQ ID NO: 25420 - DNA, 21 bp, Artificial sequence
  SiRNA target sequence
cctttgaaaacgatttgatcg

SEQ ID NO: 25421 - DNA, 21 bp, Artificial sequence
  SiRNA target sequence
ctttgaaaacgatttgatcgt

SEQ ID NO: 25422 - DNA, 21 bp, Artificial sequence
  SiRNA target sequence
tttgaaaacgatttgatcgtg

SEQ ID NO: 25423 - DNA, 21 bp, Artificial sequence
  SiRNA target sequence
ttgaaaacgatttgatcgtgc

SEQ ID NO: 25424 - DNA, 21 bp, Artificial sequence
  SiRNA target sequence
tgaaaacgatttgatcgtgct

SEQ ID NO: 25425 - DNA, 21 bp, Artificial sequence
  SiRNA target sequence
gaaaacgatttgatcgtgcta

SEQ ID NO: 25426 - DNA, 21 bp, Artificial sequence
  SiRNA target sequence
aaaacgatttgatcgtgctag

SEQ ID NO: 25427 - DNA, 21 bp, Artificial sequence
  SiRNA target sequence
aaacgatttgatcgtgctaga

SEQ ID NO: 25428 - DNA, 21 bp, Artificial sequence
  SiRNA target sequence
aacgatttgatcgtgctagag

SEQ ID NO: 25429 - DNA, 21 bp, Artificial sequence
  SiRNA target sequence
acgatttgatcgtgctagagg

SEQ ID NO: 25430 - DNA, 21 bp, Artificial sequence
  SiRNA target sequence
cgatttgatcgtgctagagga

SEQ ID NO: 25431 - DNA, 21 bp, Artificial sequence
  SiRNA target sequence
gatttgatcgtgctagaggat

SEQ ID NO: 25432 - DNA, 21 bp, Artificial sequence
  SiRNA target sequence
atttgatcgtgctagaggatg

SEQ ID NO: 25433 - DNA, 21 bp, Artificial sequence
  SiRNA target sequence
tttgatcgtgctagaggatgg

SEQ ID NO: 25434 - DNA, 21 bp, Artificial sequence
  SiRNA target sequence
ttgatcgtgctagaggatggg

SEQ ID NO: 25435 - DNA, 21 bp, Artificial sequence
  SiRNA target sequence
tgatcgtgctagaggatgggc

SEQ ID NO: 25436 - DNA, 21 bp, Artificial sequence
  SiRNA target sequence
gatcgtgctagaggatgggcc

SEQ ID NO: 25437 - DNA, 21 bp, Artificial sequence
  SiRNA target sequence
atcgtgctagaggatgggccg

SEQ ID NO: 25438 - DNA, 21 bp, Artificial sequence
  SiRNA target sequence
tcgtgctagaggatgggccgc

SEQ ID NO: 25439 - DNA, 21 bp, Artificial sequence
  SiRNA target sequence
cgtgctagaggatgggccgca

SEQ ID NO: 25440 - DNA, 21 bp, Artificial sequence
  SiRNA target sequence
gtgctagaggatgggccgcaa

SEQ ID NO: 25441 - DNA, 21 bp, Artificial sequence
  SiRNA target sequence
tgctagaggatgggccgcaaa

SEQ ID NO: 25442 - DNA, 21 bp, Artificial sequence
  SiRNA target sequence
gctagaggatgggccgcaaat

SEQ ID NO: 25443 - DNA, 21 bp, Artificial sequence
  SiRNA target sequence
ctagaggatgggccgcaaatg

SEQ ID NO: 25444 - DNA, 21 bp, Artificial sequence
  SiRNA target sequence
tagaggatgggccgcaaatgg

SEQ ID NO: 25445 - DNA, 21 bp, Artificial sequence
  SiRNA target sequence
agaggatgggccgcaaatgga

SEQ ID NO: 25446 - DNA, 21 bp, Artificial sequence
  SiRNA target sequence
gaggatgggccgcaaatggaa

SEQ ID NO: 25447 - DNA, 21 bp, Artificial sequence
  SiRNA target sequence
aggatgggccgcaaatggaag

SEQ ID NO: 25448 - DNA, 21 bp, Artificial sequence
  SiRNA target sequence
ggatgggccgcaaatggaaga

SEQ ID NO: 25449 - DNA, 21 bp, Artificial sequence
  SiRNA target sequence
gatgggccgcaaatggaagaa

SEQ ID NO: 25450 - DNA, 21 bp, Artificial sequence
  SiRNA target sequence
atgggccgcaaatggaagaat

SEQ ID NO: 25451 - DNA, 21 bp, Artificial sequence
  SiRNA target sequence
tgggccgcaaatggaagaatc

SEQ ID NO: 25452 - DNA, 21 bp, Artificial sequence
  SiRNA target sequence
gggccgcaaatggaagaatct

SEQ ID NO: 25453 - DNA, 21 bp, Artificial sequence
  SiRNA target sequence
ggccgcaaatggaagaatctc

SEQ ID NO: 25454 - DNA, 21 bp, Artificial sequence
  SiRNA target sequence
gccgcaaatggaagaatctct

SEQ ID NO: 25455 - DNA, 21 bp, Artificial sequence
  SiRNA target sequence
ccgcaaatggaagaatctctt

SEQ ID NO: 25456 - DNA, 21 bp, Artificial sequence
  SiRNA target sequence
cgcaaatggaagaatctcttc

SEQ ID NO: 25457 - DNA, 21 bp, Artificial sequence
  SiRNA target sequence
gcaaatggaagaatctcttcc

SEQ ID NO: 25458 - DNA, 21 bp, Artificial sequence
  SiRNA target sequence
caaatggaagaatctcttcct

SEQ ID NO: 25459 - DNA, 21 bp, Artificial sequence
  SiRNA target sequence
aaatggaagaatctcttcctt

SEQ ID NO: 25460 - DNA, 21 bp, Artificial sequence
  SiRNA target sequence
aatggaagaatctcttccttt

SEQ ID NO: 25461 - DNA, 21 bp, Artificial sequence
  SiRNA target sequence
atggaagaatctcttcctttt

SEQ ID NO: 25462 - DNA, 21 bp, Artificial sequence
  SiRNA target sequence
tggaagaatctcttccttttg

SEQ ID NO: 25463 - DNA, 21 bp, Artificial sequence
  SiRNA target sequence
ggaagaatctcttccttttgc

SEQ ID NO: 25464 - DNA, 21 bp, Artificial sequence
  SiRNA target sequence
gaagaatctcttccttttgcg

SEQ ID NO: 25465 - DNA, 21 bp, Artificial sequence
  SiRNA target sequence
aagaatctcttccttttgcgt

SEQ ID NO: 25466 - DNA, 21 bp, Artificial sequence
  SiRNA target sequence
agaatctcttccttttgcgtt

SEQ ID NO: 25467 - DNA, 21 bp, Artificial sequence
  SiRNA target sequence
gaatctcttccttttgcgttt

SEQ ID NO: 25468 - DNA, 21 bp, Artificial sequence
  SiRNA target sequence
aatctcttccttttgcgtttc

SEQ ID NO: 25469 - DNA, 21 bp, Artificial sequence
  SiRNA target sequence
atctcttccttttgcgtttca

SEQ ID NO: 25470 - DNA, 21 bp, Artificial sequence
  SiRNA target sequence
tctcttccttttgcgtttcac

SEQ ID NO: 25471 - DNA, 21 bp, Artificial sequence
  SiRNA target sequence
ctcttccttttgcgtttcacg

SEQ ID NO: 25472 - DNA, 21 bp, Artificial sequence
  SiRNA target sequence
tcttccttttgcgtttcacgg

SEQ ID NO: 25473 - DNA, 21 bp, Artificial sequence
  SiRNA target sequence
cttccttttgcgtttcacggg

SEQ ID NO: 25474 - DNA, 21 bp, Artificial sequence
  SiRNA target sequence
ttccttttgcgtttcacgggc

SEQ ID NO: 25475 - DNA, 21 bp, Artificial sequence
  SiRNA target sequence
tccttttgcgtttcacgggca

SEQ ID NO: 25476 - DNA, 21 bp, Artificial sequence
  SiRNA target sequence
ccttttgcgtttcacgggcag

SEQ ID NO: 25477 - DNA, 21 bp, Artificial sequence
  SiRNA target sequence
cttttgcgtttcacgggcagc

SEQ ID NO: 25478 - DNA, 21 bp, Artificial sequence
  SiRNA target sequence
ttttgcgtttcacgggcagca

SEQ ID NO: 25479 - DNA, 21 bp, Artificial sequence
  SiRNA target sequence
tttgcgtttcacgggcagcac

SEQ ID NO: 25480 - DNA, 21 bp, Artificial sequence
  SiRNA target sequence
ttgcgtttcacgggcagcaca

SEQ ID NO: 25481 - DNA, 21 bp, Artificial sequence
  SiRNA target sequence
tgcgtttcacgggcagcacac

SEQ ID NO: 25482 - DNA, 21 bp, Artificial sequence
  SiRNA target sequence
gcgtttcacgggcagcacact

SEQ ID NO: 25483 - DNA, 21 bp, Artificial sequence
  SiRNA target sequence
cgtttcacgggcagcacactg

SEQ ID NO: 25484 - DNA, 21 bp, Artificial sequence
  SiRNA target sequence
gtttcacgggcagcacactga

SEQ ID NO: 25485 - DNA, 21 bp, Artificial sequence
  SiRNA target sequence
tttcacgggcagcacactgat

SEQ ID NO: 25486 - DNA, 21 bp, Artificial sequence
  SiRNA target sequence
ttcacgggcagcacactgata

SEQ ID NO: 25487 - DNA, 21 bp, Artificial sequence
  SiRNA target sequence
tcacgggcagcacactgataa

SEQ ID NO: 25488 - DNA, 21 bp, Artificial sequence
  SiRNA target sequence
cacgggcagcacactgataat

SEQ ID NO: 25489 - DNA, 21 bp, Artificial sequence
  SiRNA target sequence
acgggcagcacactgataatc

SEQ ID NO: 25490 - DNA, 21 bp, Artificial sequence
  SiRNA target sequence
cgggcagcacactgataatcg

SEQ ID NO: 25491 - DNA, 21 bp, Artificial sequence
  SiRNA target sequence
gggcagcacactgataatcgt

SEQ ID NO: 25492 - DNA, 21 bp, Artificial sequence
  SiRNA target sequence
ggcagcacactgataatcgtc

SEQ ID NO: 25493 - DNA, 21 bp, Artificial sequence
  SiRNA target sequence
gcagcacactgataatcgtca

SEQ ID NO: 25494 - DNA, 21 bp, Artificial sequence
  SiRNA target sequence
cagcacactgataatcgtcaa

SEQ ID NO: 25495 - DNA, 21 bp, Artificial sequence
  SiRNA target sequence
agcacactgataatcgtcaac

SEQ ID NO: 25496 - DNA, 21 bp, Artificial sequence
  SiRNA target sequence
gcacactgataatcgtcaaca

SEQ ID NO: 25497 - DNA, 21 bp, Artificial sequence
  SiRNA target sequence
cacactgataatcgtcaacat

SEQ ID NO: 25498 - DNA, 21 bp, Artificial sequence
  SiRNA target sequence
acactgataatcgtcaacata

SEQ ID NO: 25499 - DNA, 21 bp, Artificial sequence
  SiRNA target sequence
cactgataatcgtcaacatac

SEQ ID NO: 25500 - DNA, 21 bp, Artificial sequence
  SiRNA target sequence
actgataatcgtcaacataca

SEQ ID NO: 25501 - DNA, 21 bp, Artificial sequence
  SiRNA target sequence
ctgataatcgtcaacatacag

SEQ ID NO: 25502 - DNA, 21 bp, Artificial sequence
  SiRNA target sequence
tgataatcgtcaacatacagt

SEQ ID NO: 25503 - DNA, 21 bp, Artificial sequence
  SiRNA target sequence
gataatcgtcaacatacagtg

SEQ ID NO: 25504 - DNA, 21 bp, Artificial sequence
  SiRNA target sequence
ataatcgtcaacatacagtgg

SEQ ID NO: 25505 - DNA, 21 bp, Artificial sequence
  SiRNA target sequence
taatcgtcaacatacagtggt

SEQ ID NO: 25506 - DNA, 21 bp, Artificial sequence
  SiRNA target sequence
aatcgtcaacatacagtggtt

SEQ ID NO: 25507 - DNA, 21 bp, Artificial sequence
  SiRNA target sequence
atcgtcaacatacagtggtta

SEQ ID NO: 25508 - DNA, 21 bp, Artificial sequence
  SiRNA target sequence
tcgtcaacatacagtggttaa

SEQ ID NO: 25509 - DNA, 21 bp, Artificial sequence
  SiRNA target sequence
cgtcaacatacagtggttaat

SEQ ID NO: 25510 - DNA, 21 bp, Artificial sequence
  SiRNA target sequence
gtcaacatacagtggttaatt

SEQ ID NO: 25511 - DNA, 21 bp, Artificial sequence
  SiRNA target sequence
tcaacatacagtggttaattt

SEQ ID NO: 25512 - DNA, 21 bp, Artificial sequence
  SiRNA target sequence
caacatacagtggttaatttc

SEQ ID NO: 25513 - DNA, 21 bp, Artificial sequence
  SiRNA target sequence
aacatacagtggttaatttct

SEQ ID NO: 25514 - DNA, 21 bp, Artificial sequence
  SiRNA target sequence
acatacagtggttaatttctt

SEQ ID NO: 25515 - DNA, 21 bp, Artificial sequence
  SiRNA target sequence
catacagtggttaatttcttg

SEQ ID NO: 25516 - DNA, 21 bp, Artificial sequence
  SiRNA target sequence
atacagtggttaatttcttgc

SEQ ID NO: 25517 - DNA, 21 bp, Artificial sequence
  SiRNA target sequence
tacagtggttaatttcttgca

SEQ ID NO: 25518 - DNA, 21 bp, Artificial sequence
  SiRNA target sequence
acagtggttaatttcttgcaa

SEQ ID NO: 25519 - DNA, 21 bp, Artificial sequence
  SiRNA target sequence
cagtggttaatttcttgcaac

SEQ ID NO: 25520 - DNA, 21 bp, Artificial sequence
  SiRNA target sequence
agtggttaatttcttgcaacg

SEQ ID NO: 25521 - DNA, 21 bp, Artificial sequence
  SiRNA target sequence
gtggttaatttcttgcaacgt

SEQ ID NO: 25522 - DNA, 21 bp, Artificial sequence
  SiRNA target sequence
tggttaatttcttgcaacgtc

SEQ ID NO: 25523 - DNA, 21 bp, Artificial sequence
  SiRNA target sequence
ggttaatttcttgcaacgtcc

SEQ ID NO: 25524 - DNA, 21 bp, Artificial sequence
  SiRNA target sequence
gttaatttcttgcaacgtccc

SEQ ID NO: 25525 - DNA, 21 bp, Artificial sequence
  SiRNA target sequence
ttaatttcttgcaacgtcccc

SEQ ID NO: 25526 - DNA, 21 bp, Artificial sequence
  SiRNA target sequence
taatttcttgcaacgtcccca

SEQ ID NO: 25527 - DNA, 21 bp, Artificial sequence
  SiRNA target sequence
aatttcttgcaacgtccccag

SEQ ID NO: 25528 - DNA, 21 bp, Artificial sequence
  SiRNA target sequence
atttcttgcaacgtccccagg

SEQ ID NO: 25529 - DNA, 21 bp, Artificial sequence
  SiRNA target sequence
tttcttgcaacgtccccaggt

SEQ ID NO: 25530 - DNA, 21 bp, Artificial sequence
  SiRNA target sequence
ttcttgcaacgtccccaggtt

SEQ ID NO: 25531 - DNA, 21 bp, Artificial sequence
  SiRNA target sequence
tcttgcaacgtccccaggtta

SEQ ID NO: 25532 - DNA, 21 bp, Artificial sequence
  SiRNA target sequence
cttgcaacgtccccaggttat

SEQ ID NO: 25533 - DNA, 21 bp, Artificial sequence
  SiRNA target sequence
ttgcaacgtccccaggttatt

SEQ ID NO: 25534 - DNA, 21 bp, Artificial sequence
  SiRNA target sequence
tgcaacgtccccaggttattt

SEQ ID NO: 25535 - DNA, 21 bp, Artificial sequence
  SiRNA target sequence
gcaacgtccccaggttatttt

SEQ ID NO: 25536 - DNA, 21 bp, Artificial sequence
  SiRNA target sequence
caacgtccccaggttattttt

SEQ ID NO: 25537 - DNA, 21 bp, Artificial sequence
  SiRNA target sequence
aacgtccccaggttatttttg

SEQ ID NO: 25538 - DNA, 21 bp, Artificial sequence
  SiRNA target sequence
acgtccccaggttatttttga

SEQ ID NO: 25539 - DNA, 21 bp, Artificial sequence
  SiRNA target sequence
cgtccccaggttatttttgat

SEQ ID NO: 25540 - DNA, 21 bp, Artificial sequence
  SiRNA target sequence
gtccccaggttatttttgatt

SEQ ID NO: 25541 - DNA, 21 bp, Artificial sequence
  SiRNA target sequence
tccccaggttatttttgattc

SEQ ID NO: 25542 - DNA, 21 bp, Artificial sequence
  SiRNA target sequence
ccccaggttatttttgattcg

SEQ ID NO: 25543 - DNA, 21 bp, Artificial sequence
  SiRNA target sequence
cccaggttatttttgattcgt

SEQ ID NO: 25544 - DNA, 21 bp, Artificial sequence
  SiRNA target sequence
ccaggttatttttgattcgtc

SEQ ID NO: 25545 - DNA, 21 bp, Artificial sequence
  SiRNA target sequence
caggttatttttgattcgtct

SEQ ID NO: 25546 - DNA, 21 bp, Artificial sequence
  SiRNA target sequence
aggttatttttgattcgtctt

SEQ ID NO: 25547 - DNA, 21 bp, Artificial sequence
  SiRNA target sequence
ggttatttttgattcgtcttg

SEQ ID NO: 25548 - DNA, 21 bp, Artificial sequence
  SiRNA target sequence
gttatttttgattcgtcttgg

SEQ ID NO: 25549 - DNA, 21 bp, Artificial sequence
  SiRNA target sequence
ttatttttgattcgtcttggg

SEQ ID NO: 25550 - DNA, 21 bp, Artificial sequence
  SiRNA target sequence
tatttttgattcgtcttgggc

SEQ ID NO: 25551 - DNA, 21 bp, Artificial sequence
  SiRNA target sequence
atttttgattcgtcttgggcg

SEQ ID NO: 25552 - DNA, 21 bp, Artificial sequence
  SiRNA target sequence
tttttgattcgtcttgggcgt

SEQ ID NO: 25553 - DNA, 21 bp, Artificial sequence
  SiRNA target sequence
ttttgattcgtcttgggcgtc

SEQ ID NO: 25554 - DNA, 21 bp, Artificial sequence
  SiRNA target sequence
tttgattcgtcttgggcgtct

SEQ ID NO: 25555 - DNA, 21 bp, Artificial sequence
  SiRNA target sequence
ttgattcgtcttgggcgtctg

SEQ ID NO: 25556 - DNA, 21 bp, Artificial sequence
  SiRNA target sequence
tgattcgtcttgggcgtctga

SEQ ID NO: 25557 - DNA, 21 bp, Artificial sequence
  SiRNA target sequence
gattcgtcttgggcgtctgat

SEQ ID NO: 25558 - DNA, 21 bp, Artificial sequence
  SiRNA target sequence
attcgtcttgggcgtctgatg

SEQ ID NO: 25559 - DNA, 21 bp, Artificial sequence
  SiRNA target sequence
ttcgtcttgggcgtctgatgt

SEQ ID NO: 25560 - DNA, 21 bp, Artificial sequence
  SiRNA target sequence
tcgtcttgggcgtctgatgta

SEQ ID NO: 25561 - DNA, 21 bp, Artificial sequence
  SiRNA target sequence
cgtcttgggcgtctgatgtac

SEQ ID NO: 25562 - DNA, 21 bp, Artificial sequence
  SiRNA target sequence
gtcttgggcgtctgatgtacc

SEQ ID NO: 25563 - DNA, 21 bp, Artificial sequence
  SiRNA target sequence
tcttgggcgtctgatgtacct

SEQ ID NO: 25564 - DNA, 21 bp, Artificial sequence
  SiRNA target sequence
cttgggcgtctgatgtacctc

SEQ ID NO: 25565 - DNA, 21 bp, Artificial sequence
  SiRNA target sequence
ttgggcgtctgatgtacctcg

SEQ ID NO: 25566 - DNA, 21 bp, Artificial sequence
  SiRNA target sequence
tgggcgtctgatgtacctcga

SEQ ID NO: 25567 - DNA, 21 bp, Artificial sequence
  SiRNA target sequence
gggcgtctgatgtacctcgaa

SEQ ID NO: 25568 - DNA, 21 bp, Artificial sequence
  SiRNA target sequence
ggcgtctgatgtacctcgaaa

SEQ ID NO: 25569 - DNA, 21 bp, Artificial sequence
  SiRNA target sequence
gcgtctgatgtacctcgaaac

SEQ ID NO: 25570 - DNA, 21 bp, Artificial sequence
  SiRNA target sequence
cgtctgatgtacctcgaaaca

SEQ ID NO: 25571 - DNA, 21 bp, Artificial sequence
  SiRNA target sequence
gtctgatgtacctcgaaacaa

SEQ ID NO: 25572 - DNA, 21 bp, Artificial sequence
  SiRNA target sequence
tctgatgtacctcgaaacaag

SEQ ID NO: 25573 - DNA, 21 bp, Artificial sequence
  SiRNA target sequence
ctgatgtacctcgaaacaagc

SEQ ID NO: 25574 - DNA, 21 bp, Artificial sequence
  SiRNA target sequence
tgatgtacctcgaaacaagca

SEQ ID NO: 25575 - DNA, 21 bp, Artificial sequence
  SiRNA target sequence
gatgtacctcgaaacaagcaa

SEQ ID NO: 25576 - DNA, 21 bp, Artificial sequence
  SiRNA target sequence
atgtacctcgaaacaagcaat

SEQ ID NO: 25577 - DNA, 21 bp, Artificial sequence
  SiRNA target sequence
tgtacctcgaaacaagcaatt

SEQ ID NO: 25578 - DNA, 21 bp, Artificial sequence
  SiRNA target sequence
gtacctcgaaacaagcaattc

SEQ ID NO: 25579 - DNA, 21 bp, Artificial sequence
  SiRNA target sequence
tacctcgaaacaagcaattca

SEQ ID NO: 25580 - DNA, 21 bp, Artificial sequence
  SiRNA target sequence
acctcgaaacaagcaattcat

SEQ ID NO: 25581 - DNA, 21 bp, Artificial sequence
  SiRNA target sequence
cctcgaaacaagcaattcatg

SEQ ID NO: 25582 - DNA, 21 bp, Artificial sequence
  SiRNA target sequence
ctcgaaacaagcaattcatgg

SEQ ID NO: 25583 - DNA, 21 bp, Artificial sequence
  SiRNA target sequence
tcgaaacaagcaattcatgga

SEQ ID NO: 25584 - DNA, 21 bp, Artificial sequence
  SiRNA target sequence
cgaaacaagcaattcatggat

SEQ ID NO: 25585 - DNA, 21 bp, Artificial sequence
  SiRNA target sequence
gaaacaagcaattcatggatt

SEQ ID NO: 25586 - DNA, 21 bp, Artificial sequence
  SiRNA target sequence
aaacaagcaattcatggattc

SEQ ID NO: 25587 - DNA, 21 bp, Artificial sequence
  SiRNA target sequence
aacaagcaattcatggattcg

SEQ ID NO: 25588 - DNA, 21 bp, Artificial sequence
  SiRNA target sequence
acaagcaattcatggattcga

SEQ ID NO: 25589 - DNA, 21 bp, Artificial sequence
  SiRNA target sequence
caagcaattcatggattcgat

SEQ ID NO: 25590 - DNA, 21 bp, Artificial sequence
  SiRNA target sequence
aagcaattcatggattcgatt

SEQ ID NO: 25591 - DNA, 21 bp, Artificial sequence
  SiRNA target sequence
agcaattcatggattcgatta

SEQ ID NO: 25592 - DNA, 21 bp, Artificial sequence
  SiRNA target sequence
gcaattcatggattcgattat

SEQ ID NO: 25593 - DNA, 21 bp, Artificial sequence
  SiRNA target sequence
caattcatggattcgattatg

SEQ ID NO: 25594 - DNA, 21 bp, Artificial sequence
  SiRNA target sequence
aattcatggattcgattatga

SEQ ID NO: 25595 - DNA, 21 bp, Artificial sequence
  SiRNA target sequence
attcatggattcgattatgat

SEQ ID NO: 25596 - DNA, 21 bp, Artificial sequence
  SiRNA target sequence
ttcatggattcgattatgata

SEQ ID NO: 25597 - DNA, 21 bp, Artificial sequence
  SiRNA target sequence
tcatggattcgattatgatac

SEQ ID NO: 25598 - DNA, 21 bp, Artificial sequence
  SiRNA target sequence
catggattcgattatgatacc

SEQ ID NO: 25599 - DNA, 21 bp, Artificial sequence
  SiRNA target sequence
atggattcgattatgatacct

SEQ ID NO: 25600 - DNA, 21 bp, Artificial sequence
  SiRNA target sequence
tggattcgattatgatacctg

SEQ ID NO: 25601 - DNA, 21 bp, Artificial sequence
  SiRNA target sequence
ggattcgattatgatacctga

SEQ ID NO: 25602 - DNA, 21 bp, Artificial sequence
  SiRNA target sequence
gattcgattatgatacctgat

SEQ ID NO: 25603 - DNA, 21 bp, Artificial sequence
  SiRNA target sequence
attcgattatgatacctgatg

SEQ ID NO: 25604 - DNA, 21 bp, Artificial sequence
  SiRNA target sequence
ttcgattatgatacctgatga

SEQ ID NO: 25605 - DNA, 21 bp, Artificial sequence
  SiRNA target sequence
tcgattatgatacctgatgat

SEQ ID NO: 25606 - DNA, 21 bp, Artificial sequence
  SiRNA target sequence
cgattatgatacctgatgata

SEQ ID NO: 25607 - DNA, 21 bp, Artificial sequence
  SiRNA target sequence
gattatgatacctgatgatat

SEQ ID NO: 25608 - DNA, 21 bp, Artificial sequence
  SiRNA target sequence
attatgatacctgatgatatc

SEQ ID NO: 25609 - DNA, 21 bp, Artificial sequence
  SiRNA target sequence
ttatgatacctgatgatatca

SEQ ID NO: 25610 - DNA, 21 bp, Artificial sequence
  SiRNA target sequence
tatgatacctgatgatatcat

SEQ ID NO: 25611 - DNA, 21 bp, Artificial sequence
  SiRNA target sequence
atgatacctgatgatatcatc

SEQ ID NO: 25612 - DNA, 21 bp, Artificial sequence
  SiRNA target sequence
tgatacctgatgatatcatct

SEQ ID NO: 25613 - DNA, 21 bp, Artificial sequence
  SiRNA target sequence
gatacctgatgatatcatctc

SEQ ID NO: 25614 - DNA, 21 bp, Artificial sequence
  SiRNA target sequence
atacctgatgatatcatctct

SEQ ID NO: 25615 - DNA, 21 bp, Artificial sequence
  SiRNA target sequence
tacctgatgatatcatctctt

SEQ ID NO: 25616 - DNA, 21 bp, Artificial sequence
  SiRNA target sequence
acctgatgatatcatctcttt

SEQ ID NO: 25617 - DNA, 21 bp, Artificial sequence
  SiRNA target sequence
cctgatgatatcatctctttt

SEQ ID NO: 25618 - DNA, 21 bp, Artificial sequence
  SiRNA target sequence
ctgatgatatcatctcttttc

SEQ ID NO: 25619 - DNA, 21 bp, Artificial sequence
  SiRNA target sequence
tgatgatatcatctcttttcc

SEQ ID NO: 25620 - DNA, 21 bp, Artificial sequence
  SiRNA target sequence
gatgatatcatctcttttccg

SEQ ID NO: 25621 - DNA, 21 bp, Artificial sequence
  SiRNA target sequence
atgatatcatctcttttccga

SEQ ID NO: 25622 - DNA, 21 bp, Artificial sequence
  SiRNA target sequence
tgatatcatctcttttccgat

SEQ ID NO: 25623 - DNA, 21 bp, Artificial sequence
  SiRNA target sequence
gatatcatctcttttccgatg

SEQ ID NO: 25624 - DNA, 21 bp, Artificial sequence
  SiRNA target sequence
atatcatctcttttccgatgt

SEQ ID NO: 25625 - DNA, 21 bp, Artificial sequence
  SiRNA target sequence
tatcatctcttttccgatgtt

SEQ ID NO: 25626 - DNA, 21 bp, Artificial sequence
  SiRNA target sequence
atcatctcttttccgatgttt

SEQ ID NO: 25627 - DNA, 21 bp, Artificial sequence
  SiRNA target sequence
tcatctcttttccgatgtttg

SEQ ID NO: 25628 - DNA, 21 bp, Artificial sequence
  SiRNA target sequence
catctcttttccgatgtttgc

SEQ ID NO: 25629 - DNA, 21 bp, Artificial sequence
  SiRNA target sequence
atctcttttccgatgtttgca

SEQ ID NO: 25630 - DNA, 21 bp, Artificial sequence
  SiRNA target sequence
tctcttttccgatgtttgcag

SEQ ID NO: 25631 - DNA, 21 bp, Artificial sequence
  SiRNA target sequence
ctcttttccgatgtttgcaga

SEQ ID NO: 25632 - DNA, 21 bp, Artificial sequence
  SiRNA target sequence
tcttttccgatgtttgcagag

SEQ ID NO: 25633 - DNA, 21 bp, Artificial sequence
  SiRNA target sequence
cttttccgatgtttgcagaga

SEQ ID NO: 25634 - DNA, 21 bp, Artificial sequence
  SiRNA target sequence
ttttccgatgtttgcagagaa

SEQ ID NO: 25635 - DNA, 21 bp, Artificial sequence
  SiRNA target sequence
tttccgatgtttgcagagaaa

SEQ ID NO: 25636 - DNA, 21 bp, Artificial sequence
  SiRNA target sequence
ttccgatgtttgcagagaaac

SEQ ID NO: 25637 - DNA, 21 bp, Artificial sequence
  SiRNA target sequence
tccgatgtttgcagagaaact

SEQ ID NO: 25638 - DNA, 21 bp, Artificial sequence
  SiRNA target sequence
ccgatgtttgcagagaaactc

SEQ ID NO: 25639 - DNA, 21 bp, Artificial sequence
  SiRNA target sequence
cgatgtttgcagagaaactca

SEQ ID NO: 25640 - DNA, 21 bp, Artificial sequence
  SiRNA target sequence
gatgtttgcagagaaactcaa

SEQ ID NO: 25641 - DNA, 21 bp, Artificial sequence
  SiRNA target sequence
atgtttgcagagaaactcaaa

SEQ ID NO: 25642 - DNA, 21 bp, Artificial sequence
  SiRNA target sequence
tgtttgcagagaaactcaaag

SEQ ID NO: 25643 - DNA, 21 bp, Artificial sequence
  SiRNA target sequence
gtttgcagagaaactcaaagg

SEQ ID NO: 25644 - DNA, 21 bp, Artificial sequence
  SiRNA target sequence
tttgcagagaaactcaaaggg

SEQ ID NO: 25645 - DNA, 21 bp, Artificial sequence
  SiRNA target sequence
ttgcagagaaactcaaagggt

SEQ ID NO: 25646 - DNA, 21 bp, Artificial sequence
  SiRNA target sequence
tgcagagaaactcaaagggtt

SEQ ID NO: 25647 - DNA, 21 bp, Artificial sequence
  SiRNA target sequence
gcagagaaactcaaagggttt

SEQ ID NO: 25648 - DNA, 21 bp, Artificial sequence
  SiRNA target sequence
cagagaaactcaaagggtttt

SEQ ID NO: 25649 - DNA, 21 bp, Artificial sequence
  SiRNA target sequence
agagaaactcaaagggttttc

SEQ ID NO: 25650 - DNA, 21 bp, Artificial sequence
  SiRNA target sequence
gagaaactcaaagggttttct

SEQ ID NO: 25651 - DNA, 21 bp, Artificial sequence
  SiRNA target sequence
agaaactcaaagggttttctt

SEQ ID NO: 25652 - DNA, 21 bp, Artificial sequence
  SiRNA target sequence
gaaactcaaagggttttcttc

SEQ ID NO: 25653 - DNA, 21 bp, Artificial sequence
  SiRNA target sequence
aaactcaaagggttttcttct

SEQ ID NO: 25654 - DNA, 21 bp, Artificial sequence
  SiRNA target sequence
aactcaaagggttttcttctt

SEQ ID NO: 25655 - DNA, 21 bp, Artificial sequence
  SiRNA target sequence
actcaaagggttttcttcttt

SEQ ID NO: 25656 - DNA, 21 bp, Artificial sequence
  SiRNA target sequence
ctcaaagggttttcttctttg

SEQ ID NO: 25657 - DNA, 21 bp, Artificial sequence
  SiRNA target sequence
tcaaagggttttcttctttga

SEQ ID NO: 25658 - DNA, 21 bp, Artificial sequence
  SiRNA target sequence
caaagggttttcttctttgag

SEQ ID NO: 25659 - DNA, 21 bp, Artificial sequence
  SiRNA target sequence
aaagggttttcttctttgaga

SEQ ID NO: 25660 - DNA, 21 bp, Artificial sequence
  SiRNA target sequence
aagggttttcttctttgagag

SEQ ID NO: 25661 - DNA, 21 bp, Artificial sequence
  SiRNA target sequence
agggttttcttctttgagagc

SEQ ID NO: 25662 - DNA, 21 bp, Artificial sequence
  SiRNA target sequence
gggttttcttctttgagagca

SEQ ID NO: 25663 - DNA, 21 bp, Artificial sequence
  SiRNA target sequence
ggttttcttctttgagagcaa

SEQ ID NO: 25664 - DNA, 21 bp, Artificial sequence
  SiRNA target sequence
gttttcttctttgagagcaac

SEQ ID NO: 25665 - DNA, 21 bp, Artificial sequence
  SiRNA target sequence
ttttcttctttgagagcaaca

SEQ ID NO: 25666 - DNA, 21 bp, Artificial sequence
  SiRNA target sequence
tttcttctttgagagcaacag

SEQ ID NO: 25667 - DNA, 21 bp, Artificial sequence
  SiRNA target sequence
ttcttctttgagagcaacagc

SEQ ID NO: 25668 - DNA, 21 bp, Artificial sequence
  SiRNA target sequence
tcttctttgagagcaacagct

SEQ ID NO: 25669 - DNA, 21 bp, Artificial sequence
  SiRNA target sequence
cttctttgagagcaacagctg

SEQ ID NO: 25670 - DNA, 21 bp, Artificial sequence
  SiRNA target sequence
ttctttgagagcaacagctgt

SEQ ID NO: 25671 - DNA, 21 bp, Artificial sequence
  SiRNA target sequence
tctttgagagcaacagctgtg

SEQ ID NO: 25672 - DNA, 21 bp, Artificial sequence
  SiRNA target sequence
ctttgagagcaacagctgtga

SEQ ID NO: 25673 - DNA, 21 bp, Artificial sequence
  SiRNA target sequence
tttgagagcaacagctgtgat

SEQ ID NO: 25674 - DNA, 21 bp, Artificial sequence
  SiRNA target sequence
ttgagagcaacagctgtgata

SEQ ID NO: 25675 - DNA, 21 bp, Artificial sequence
  SiRNA target sequence
tgagagcaacagctgtgataa

SEQ ID NO: 25676 - DNA, 21 bp, Artificial sequence
  SiRNA target sequence
gagagcaacagctgtgataac

SEQ ID NO: 25677 - DNA, 21 bp, Artificial sequence
  SiRNA target sequence
agagcaacagctgtgataaca

SEQ ID NO: 25678 - DNA, 21 bp, Artificial sequence
  SiRNA target sequence
gagcaacagctgtgataacag

SEQ ID NO: 25679 - DNA, 21 bp, Artificial sequence
  SiRNA target sequence
agcaacagctgtgataacagt

SEQ ID NO: 25680 - DNA, 21 bp, Artificial sequence
  SiRNA target sequence
gcaacagctgtgataacagta

SEQ ID NO: 25681 - DNA, 21 bp, Artificial sequence
  SiRNA target sequence
caacagctgtgataacagtac

SEQ ID NO: 25682 - DNA, 21 bp, Artificial sequence
  SiRNA target sequence
aacagctgtgataacagtaca

SEQ ID NO: 25683 - DNA, 21 bp, Artificial sequence
  SiRNA target sequence
acagctgtgataacagtacag

SEQ ID NO: 25684 - DNA, 21 bp, Artificial sequence
  SiRNA target sequence
cagctgtgataacagtacagt

SEQ ID NO: 25685 - DNA, 21 bp, Artificial sequence
  SiRNA target sequence
agctgtgataacagtacagtt

SEQ ID NO: 25686 - DNA, 21 bp, Artificial sequence
  SiRNA target sequence
gctgtgataacagtacagttt

SEQ ID NO: 25687 - DNA, 21 bp, Artificial sequence
  SiRNA target sequence
ctgtgataacagtacagtttc

SEQ ID NO: 25688 - DNA, 21 bp, Artificial sequence
  SiRNA target sequence
tgtgataacagtacagtttca

SEQ ID NO: 25689 - DNA, 21 bp, Artificial sequence
  SiRNA target sequence
gtgataacagtacagtttcag

SEQ ID NO: 25690 - DNA, 21 bp, Artificial sequence
  SiRNA target sequence
tgataacagtacagtttcaga

SEQ ID NO: 25691 - DNA, 21 bp, Artificial sequence
  SiRNA target sequence
gataacagtacagtttcagac

SEQ ID NO: 25692 - DNA, 21 bp, Artificial sequence
  SiRNA target sequence
ataacagtacagtttcagacg

SEQ ID NO: 25693 - DNA, 21 bp, Artificial sequence
  SiRNA target sequence
taacagtacagtttcagacgc

SEQ ID NO: 25694 - DNA, 21 bp, Artificial sequence
  SiRNA target sequence
aacagtacagtttcagacgca

SEQ ID NO: 25695 - DNA, 21 bp, Artificial sequence
  SiRNA target sequence
acagtacagtttcagacgcaa

SEQ ID NO: 25696 - DNA, 21 bp, Artificial sequence
  SiRNA target sequence
cagtacagtttcagacgcaac

SEQ ID NO: 25697 - DNA, 21 bp, Artificial sequence
  SiRNA target sequence
agtacagtttcagacgcaacc

SEQ ID NO: 25698 - DNA, 21 bp, Artificial sequence
  SiRNA target sequence
gtacagtttcagacgcaacca

SEQ ID NO: 25699 - DNA, 21 bp, Artificial sequence
  SiRNA target sequence
tacagtttcagacgcaaccat

SEQ ID NO: 25700 - DNA, 21 bp, Artificial sequence
  SiRNA target sequence
acagtttcagacgcaaccatt

SEQ ID NO: 25701 - DNA, 21 bp, Artificial sequence
  SiRNA target sequence
cagtttcagacgcaaccattt

SEQ ID NO: 25702 - DNA, 21 bp, Artificial sequence
  SiRNA target sequence
agtttcagacgcaaccatttc

SEQ ID NO: 25703 - DNA, 21 bp, Artificial sequence
  SiRNA target sequence
gtttcagacgcaaccatttca

SEQ ID NO: 25704 - DNA, 21 bp, Artificial sequence
  SiRNA target sequence
tttcagacgcaaccatttcaa

SEQ ID NO: 25705 - DNA, 21 bp, Artificial sequence
  SiRNA target sequence
ttcagacgcaaccatttcaag

SEQ ID NO: 25706 - DNA, 21 bp, Artificial sequence
  SiRNA target sequence
tcagacgcaaccatttcaagc

SEQ ID NO: 25707 - DNA, 21 bp, Artificial sequence
  SiRNA target sequence
cagacgcaaccatttcaagcg

SEQ ID NO: 25708 - DNA, 21 bp, Artificial sequence
  SiRNA target sequence
agacgcaaccatttcaagcgg

SEQ ID NO: 25709 - DNA, 21 bp, Artificial sequence
  SiRNA target sequence
gacgcaaccatttcaagcggg

SEQ ID NO: 25710 - DNA, 21 bp, Artificial sequence
  SiRNA target sequence
acgcaaccatttcaagcggga

SEQ ID NO: 25711 - DNA, 21 bp, Artificial sequence
  SiRNA target sequence
cgcaaccatttcaagcgggaa

SEQ ID NO: 25712 - DNA, 21 bp, Artificial sequence
  SiRNA target sequence
gcaaccatttcaagcgggaag

SEQ ID NO: 25713 - DNA, 21 bp, Artificial sequence
  SiRNA target sequence
caaccatttcaagcgggaaga

SEQ ID NO: 25714 - DNA, 21 bp, Artificial sequence
  SiRNA target sequence
aaccatttcaagcgggaagag

SEQ ID NO: 25715 - DNA, 21 bp, Artificial sequence
  SiRNA target sequence
accatttcaagcgggaagagt

SEQ ID NO: 25716 - DNA, 21 bp, Artificial sequence
  SiRNA target sequence
ccatttcaagcgggaagagtt

SEQ ID NO: 25717 - DNA, 21 bp, Artificial sequence
  SiRNA target sequence
catttcaagcgggaagagtta

SEQ ID NO: 25718 - DNA, 21 bp, Artificial sequence
  SiRNA target sequence
atttcaagcgggaagagttat

SEQ ID NO: 25719 - DNA, 21 bp, Artificial sequence
  SiRNA target sequence
tttcaagcgggaagagttatg

SEQ ID NO: 25720 - DNA, 21 bp, Artificial sequence
  SiRNA target sequence
ttcaagcgggaagagttatgt

SEQ ID NO: 25721 - DNA, 21 bp, Artificial sequence
  SiRNA target sequence
tcaagcgggaagagttatgtt

SEQ ID NO: 25722 - DNA, 21 bp, Artificial sequence
  SiRNA target sequence
caagcgggaagagttatgttg

SEQ ID NO: 25723 - DNA, 21 bp, Artificial sequence
  SiRNA target sequence
aagcgggaagagttatgttgg

SEQ ID NO: 25724 - DNA, 21 bp, Artificial sequence
  SiRNA target sequence
agcgggaagagttatgttggg

SEQ ID NO: 25725 - DNA, 21 bp, Artificial sequence
  SiRNA target sequence
gcgggaagagttatgttggga

SEQ ID NO: 25726 - DNA, 21 bp, Artificial sequence
  SiRNA target sequence
cgggaagagttatgttgggat

SEQ ID NO: 25727 - DNA, 21 bp, Artificial sequence
  SiRNA target sequence
gggaagagttatgttgggatc

SEQ ID NO: 25728 - DNA, 21 bp, Artificial sequence
  SiRNA target sequence
ggaagagttatgttgggatca

SEQ ID NO: 25729 - DNA, 21 bp, Artificial sequence
  SiRNA target sequence
gaagagttatgttgggatcat

SEQ ID NO: 25730 - DNA, 21 bp, Artificial sequence
  SiRNA target sequence
aagagttatgttgggatcatt

SEQ ID NO: 25731 - DNA, 21 bp, Artificial sequence
  SiRNA target sequence
agagttatgttgggatcattc

SEQ ID NO: 25732 - DNA, 21 bp, Artificial sequence
  SiRNA target sequence
gagttatgttgggatcattcc

SEQ ID NO: 25733 - DNA, 21 bp, Artificial sequence
  SiRNA target sequence
agttatgttgggatcattccc

SEQ ID NO: 25734 - DNA, 21 bp, Artificial sequence
  SiRNA target sequence
gttatgttgggatcattccca

SEQ ID NO: 25735 - DNA, 21 bp, Artificial sequence
  SiRNA target sequence
ttatgttgggatcattcccat

SEQ ID NO: 25736 - DNA, 21 bp, Artificial sequence
  SiRNA target sequence
tatgttgggatcattcccatt

SEQ ID NO: 25737 - DNA, 21 bp, Artificial sequence
  SiRNA target sequence
atgttgggatcattcccatta

SEQ ID NO: 25738 - DNA, 21 bp, Artificial sequence
  SiRNA target sequence
tgttgggatcattcccattac

SEQ ID NO: 25739 - DNA, 21 bp, Artificial sequence
  SiRNA target sequence
gttgggatcattcccattacc

SEQ ID NO: 25740 - DNA, 21 bp, Artificial sequence
  SiRNA target sequence
ttgggatcattcccattacca

SEQ ID NO: 25741 - DNA, 21 bp, Artificial sequence
  SiRNA target sequence
tgggatcattcccattaccaa

SEQ ID NO: 25742 - DNA, 21 bp, Artificial sequence
  SiRNA target sequence
gggatcattcccattaccaac

SEQ ID NO: 25743 - DNA, 21 bp, Artificial sequence
  SiRNA target sequence
ggatcattcccattaccaact

SEQ ID NO: 25744 - DNA, 21 bp, Artificial sequence
  SiRNA target sequence
gatcattcccattaccaactt

SEQ ID NO: 25745 - DNA, 21 bp, Artificial sequence
  SiRNA target sequence
atcattcccattaccaacttt

SEQ ID NO: 25746 - DNA, 21 bp, Artificial sequence
  SiRNA target sequence
tcattcccattaccaacttta

SEQ ID NO: 25747 - DNA, 21 bp, Artificial sequence
  SiRNA target sequence
cattcccattaccaactttaa

SEQ ID NO: 25748 - DNA, 21 bp, Artificial sequence
  SiRNA target sequence
attcccattaccaactttaaa

SEQ ID NO: 25749 - DNA, 21 bp, Artificial sequence
  SiRNA target sequence
ttcccattaccaactttaaat

SEQ ID NO: 25750 - DNA, 21 bp, Artificial sequence
  SiRNA target sequence
tcccattaccaactttaaatc

SEQ ID NO: 25751 - DNA, 21 bp, Artificial sequence
  SiRNA target sequence
cccattaccaactttaaatcc

SEQ ID NO: 25752 - DNA, 21 bp, Artificial sequence
  SiRNA target sequence
ccattaccaactttaaatcca

SEQ ID NO: 25753 - DNA, 21 bp, Artificial sequence
  SiRNA target sequence
cattaccaactttaaatccaa

SEQ ID NO: 25754 - DNA, 21 bp, Artificial sequence
  SiRNA target sequence
attaccaactttaaatccaac

SEQ ID NO: 25755 - DNA, 21 bp, Artificial sequence
  SiRNA target sequence
ttaccaactttaaatccaact

SEQ ID NO: 25756 - DNA, 21 bp, Artificial sequence
  SiRNA target sequence
taccaactttaaatccaacta

SEQ ID NO: 25757 - DNA, 21 bp, Artificial sequence
  SiRNA target sequence
accaactttaaatccaactag

SEQ ID NO: 25758 - DNA, 21 bp, Artificial sequence
  SiRNA target sequence
ccaactttaaatccaactagg

SEQ ID NO: 25759 - DNA, 21 bp, Artificial sequence
  SiRNA target sequence
caactttaaatccaactaggg

SEQ ID NO: 25760 - DNA, 21 bp, Artificial sequence
  SiRNA target sequence
aactttaaatccaactagggt

SEQ ID NO: 25761 - DNA, 21 bp, Artificial sequence
  SiRNA target sequence
actttaaatccaactagggtt

SEQ ID NO: 25762 - DNA, 21 bp, Artificial sequence
  SiRNA target sequence
ctttaaatccaactagggtta

SEQ ID NO: 25763 - DNA, 21 bp, Artificial sequence
  SiRNA target sequence
tttaaatccaactagggttaa

SEQ ID NO: 25764 - DNA, 21 bp, Artificial sequence
  SiRNA target sequence
ttaaatccaactagggttaag

SEQ ID NO: 25765 - DNA, 21 bp, Artificial sequence
  SiRNA target sequence
taaatccaactagggttaagt

SEQ ID NO: 25766 - DNA, 21 bp, Artificial sequence
  SiRNA target sequence
aaatccaactagggttaagtt

SEQ ID NO: 25767 - DNA, 21 bp, Artificial sequence
  SiRNA target sequence
aatccaactagggttaagttt

SEQ ID NO: 25768 - DNA, 21 bp, Artificial sequence
  SiRNA target sequence
atccaactagggttaagtttg

SEQ ID NO: 25769 - DNA, 21 bp, Artificial sequence
  SiRNA target sequence
tccaactagggttaagtttgc

SEQ ID NO: 25770 - DNA, 21 bp, Artificial sequence
  SiRNA target sequence
ccaactagggttaagtttgct

SEQ ID NO: 25771 - DNA, 21 bp, Artificial sequence
  SiRNA target sequence
caactagggttaagtttgcta

SEQ ID NO: 25772 - DNA, 21 bp, Artificial sequence
  SiRNA target sequence
aactagggttaagtttgctac

SEQ ID NO: 25773 - DNA, 21 bp, Artificial sequence
  SiRNA target sequence
actagggttaagtttgctact

SEQ ID NO: 25774 - DNA, 21 bp, Artificial sequence
  SiRNA target sequence
ctagggttaagtttgctacta

SEQ ID NO: 25775 - DNA, 21 bp, Artificial sequence
  SiRNA target sequence
tagggttaagtttgctactaa

SEQ ID NO: 25776 - DNA, 21 bp, Artificial sequence
  SiRNA target sequence
agggttaagtttgctactaac

SEQ ID NO: 25777 - DNA, 21 bp, Artificial sequence
  SiRNA target sequence
gggttaagtttgctactaacc

SEQ ID NO: 25778 - DNA, 21 bp, Artificial sequence
  SiRNA target sequence
ggttaagtttgctactaacca

SEQ ID NO: 25779 - DNA, 21 bp, Artificial sequence
  SiRNA target sequence
gttaagtttgctactaaccat

SEQ ID NO: 25780 - DNA, 21 bp, Artificial sequence
  SiRNA target sequence
ttaagtttgctactaaccatg

SEQ ID NO: 25781 - DNA, 21 bp, Artificial sequence
  SiRNA target sequence
taagtttgctactaaccatgt

SEQ ID NO: 25782 - DNA, 21 bp, Artificial sequence
  SiRNA target sequence
aagtttgctactaaccatgtg

SEQ ID NO: 25783 - DNA, 21 bp, Artificial sequence
  SiRNA target sequence
agtttgctactaaccatgtgt

SEQ ID NO: 25784 - DNA, 21 bp, Artificial sequence
  SiRNA target sequence
gtttgctactaaccatgtgtc

SEQ ID NO: 25785 - DNA, 21 bp, Artificial sequence
  SiRNA target sequence
tttgctactaaccatgtgtcc

SEQ ID NO: 25786 - DNA, 21 bp, Artificial sequence
  SiRNA target sequence
ttgctactaaccatgtgtccc

SEQ ID NO: 25787 - DNA, 21 bp, Artificial sequence
  SiRNA target sequence
tgctactaaccatgtgtcccg

SEQ ID NO: 25788 - DNA, 21 bp, Artificial sequence
  SiRNA target sequence
gctactaaccatgtgtcccgg

SEQ ID NO: 25789 - DNA, 21 bp, Artificial sequence
  SiRNA target sequence
ctactaaccatgtgtcccggt

SEQ ID NO: 25790 - DNA, 21 bp, Artificial sequence
  SiRNA target sequence
tactaaccatgtgtcccggtt

SEQ ID NO: 25791 - DNA, 21 bp, Artificial sequence
  SiRNA target sequence
actaaccatgtgtcccggttg

SEQ ID NO: 25792 - DNA, 21 bp, Artificial sequence
  SiRNA target sequence
ctaaccatgtgtcccggttga

SEQ ID NO: 25793 - DNA, 21 bp, Artificial sequence
  SiRNA target sequence
taaccatgtgtcccggttgat

SEQ ID NO: 25794 - DNA, 21 bp, Artificial sequence
  SiRNA target sequence
aaccatgtgtcccggttgatg

SEQ ID NO: 25795 - DNA, 21 bp, Artificial sequence
  SiRNA target sequence
accatgtgtcccggttgatgc

SEQ ID NO: 25796 - DNA, 21 bp, Artificial sequence
  SiRNA target sequence
ccatgtgtcccggttgatgct

SEQ ID NO: 25797 - DNA, 21 bp, Artificial sequence
  SiRNA target sequence
catgtgtcccggttgatgctt

SEQ ID NO: 25798 - DNA, 21 bp, Artificial sequence
  SiRNA target sequence
atgtgtcccggttgatgcttt

SEQ ID NO: 25799 - DNA, 21 bp, Artificial sequence
  SiRNA target sequence
tgtgtcccggttgatgctttt

SEQ ID NO: 25800 - DNA, 21 bp, Artificial sequence
  SiRNA target sequence
gtgtcccggttgatgcttttg

SEQ ID NO: 25801 - DNA, 21 bp, Artificial sequence
  SiRNA target sequence
tgtcccggttgatgcttttga

SEQ ID NO: 25802 - DNA, 21 bp, Artificial sequence
  SiRNA target sequence
gtcccggttgatgcttttgaa

SEQ ID NO: 25803 - DNA, 21 bp, Artificial sequence
  SiRNA target sequence
tcccggttgatgcttttgaac

SEQ ID NO: 25804 - DNA, 21 bp, Artificial sequence
  SiRNA target sequence
cccggttgatgcttttgaacc

SEQ ID NO: 25805 - DNA, 21 bp, Artificial sequence
  SiRNA target sequence
ccggttgatgcttttgaacca

SEQ ID NO: 25806 - DNA, 21 bp, Artificial sequence
  SiRNA target sequence
cggttgatgcttttgaaccac

SEQ ID NO: 25807 - DNA, 21 bp, Artificial sequence
  SiRNA target sequence
ggttgatgcttttgaaccacg

SEQ ID NO: 25808 - DNA, 21 bp, Artificial sequence
  SiRNA target sequence
gttgatgcttttgaaccacgt

SEQ ID NO: 25809 - DNA, 21 bp, Artificial sequence
  SiRNA target sequence
ttgatgcttttgaaccacgtg

SEQ ID NO: 25810 - DNA, 21 bp, Artificial sequence
  SiRNA target sequence
tgatgcttttgaaccacgtgc

SEQ ID NO: 25811 - DNA, 21 bp, Artificial sequence
  SiRNA target sequence
gatgcttttgaaccacgtgca

SEQ ID NO: 25812 - DNA, 21 bp, Artificial sequence
  SiRNA target sequence
atgcttttgaaccacgtgcaa

SEQ ID NO: 25813 - DNA, 21 bp, Artificial sequence
  SiRNA target sequence
tgcttttgaaccacgtgcaat

SEQ ID NO: 25814 - DNA, 21 bp, Artificial sequence
  SiRNA target sequence
gcttttgaaccacgtgcaatg

SEQ ID NO: 25815 - DNA, 21 bp, Artificial sequence
  SiRNA target sequence
cttttgaaccacgtgcaatgt

SEQ ID NO: 25816 - DNA, 21 bp, Artificial sequence
  SiRNA target sequence
ttttgaaccacgtgcaatgtg

SEQ ID NO: 25817 - DNA, 21 bp, Artificial sequence
  SiRNA target sequence
tttgaaccacgtgcaatgtga

SEQ ID NO: 25818 - DNA, 21 bp, Artificial sequence
  SiRNA target sequence
ttgaaccacgtgcaatgtgat

SEQ ID NO: 25819 - DNA, 21 bp, Artificial sequence
  SiRNA target sequence
tgaaccacgtgcaatgtgata

SEQ ID NO: 25820 - DNA, 21 bp, Artificial sequence
  SiRNA target sequence
gaaccacgtgcaatgtgatat

SEQ ID NO: 25821 - DNA, 21 bp, Artificial sequence
  SiRNA target sequence
aaccacgtgcaatgtgatatt

SEQ ID NO: 25822 - DNA, 21 bp, Artificial sequence
  SiRNA target sequence
accacgtgcaatgtgatattg

SEQ ID NO: 25823 - DNA, 21 bp, Artificial sequence
  SiRNA target sequence
ccacgtgcaatgtgatattgc

SEQ ID NO: 25824 - DNA, 21 bp, Artificial sequence
  SiRNA target sequence
cacgtgcaatgtgatattgcc

SEQ ID NO: 25825 - DNA, 21 bp, Artificial sequence
  SiRNA target sequence
acgtgcaatgtgatattgcca

SEQ ID NO: 25826 - DNA, 21 bp, Artificial sequence
  SiRNA target sequence
cgtgcaatgtgatattgccaa

SEQ ID NO: 25827 - DNA, 21 bp, Artificial sequence
  SiRNA target sequence
gtgcaatgtgatattgccaag

SEQ ID NO: 25828 - DNA, 21 bp, Artificial sequence
  SiRNA target sequence
tgcaatgtgatattgccaagg

SEQ ID NO: 25829 - DNA, 21 bp, Artificial sequence
  SiRNA target sequence
gcaatgtgatattgccaagga

SEQ ID NO: 25830 - DNA, 21 bp, Artificial sequence
  SiRNA target sequence
caatgtgatattgccaaggag

SEQ ID NO: 25831 - DNA, 21 bp, Artificial sequence
  SiRNA target sequence
aatgtgatattgccaaggaga

SEQ ID NO: 25832 - DNA, 21 bp, Artificial sequence
  SiRNA target sequence
atgtgatattgccaaggagac

SEQ ID NO: 25833 - DNA, 21 bp, Artificial sequence
  SiRNA target sequence
tgtgatattgccaaggagact

SEQ ID NO: 25834 - DNA, 21 bp, Artificial sequence
  SiRNA target sequence
gtgatattgccaaggagactg

SEQ ID NO: 25835 - DNA, 21 bp, Artificial sequence
  SiRNA target sequence
tgatattgccaaggagactga

SEQ ID NO: 25836 - DNA, 21 bp, Artificial sequence
  SiRNA target sequence
gatattgccaaggagactgag

SEQ ID NO: 25837 - DNA, 21 bp, Artificial sequence
  SiRNA target sequence
atattgccaaggagactgagg

SEQ ID NO: 25838 - DNA, 21 bp, Artificial sequence
  SiRNA target sequence
tattgccaaggagactgaggt

SEQ ID NO: 25839 - DNA, 21 bp, Artificial sequence
  SiRNA target sequence
attgccaaggagactgaggtt

SEQ ID NO: 25840 - DNA, 21 bp, Artificial sequence
  SiRNA target sequence
ttgccaaggagactgaggttt

SEQ ID NO: 25841 - DNA, 21 bp, Artificial sequence
  SiRNA target sequence
tgccaaggagactgaggtttc

SEQ ID NO: 25842 - DNA, 21 bp, Artificial sequence
  SiRNA target sequence
gccaaggagactgaggtttcg

SEQ ID NO: 25843 - DNA, 21 bp, Artificial sequence
  SiRNA target sequence
ccaaggagactgaggtttcgt

SEQ ID NO: 25844 - DNA, 21 bp, Artificial sequence
  SiRNA target sequence
caaggagactgaggtttcgtt

SEQ ID NO: 25845 - DNA, 21 bp, Artificial sequence
  SiRNA target sequence
aaggagactgaggtttcgtta

SEQ ID NO: 25846 - DNA, 21 bp, Artificial sequence
  SiRNA target sequence
aggagactgaggtttcgttac

SEQ ID NO: 25847 - DNA, 21 bp, Artificial sequence
  SiRNA target sequence
ggagactgaggtttcgttacg

SEQ ID NO: 25848 - DNA, 21 bp, Artificial sequence
  SiRNA target sequence
gagactgaggtttcgttacga

SEQ ID NO: 25849 - DNA, 21 bp, Artificial sequence
  SiRNA target sequence
agactgaggtttcgttacgaa

SEQ ID NO: 25850 - DNA, 21 bp, Artificial sequence
  SiRNA target sequence
gactgaggtttcgttacgaat

SEQ ID NO: 25851 - DNA, 21 bp, Artificial sequence
  SiRNA target sequence
actgaggtttcgttacgaatt

SEQ ID NO: 25852 - DNA, 21 bp, Artificial sequence
  SiRNA target sequence
ctgaggtttcgttacgaattc

SEQ ID NO: 25853 - DNA, 21 bp, Artificial sequence
  SiRNA target sequence
tgaggtttcgttacgaattcc

SEQ ID NO: 25854 - DNA, 21 bp, Artificial sequence
  SiRNA target sequence
gaggtttcgttacgaattcct

SEQ ID NO: 25855 - DNA, 21 bp, Artificial sequence
  SiRNA target sequence
aggtttcgttacgaattcctt

SEQ ID NO: 25856 - DNA, 21 bp, Artificial sequence
  SiRNA target sequence
ggtttcgttacgaattccttt

SEQ ID NO: 25857 - DNA, 21 bp, Artificial sequence
  SiRNA target sequence
gtttcgttacgaattcctttt

SEQ ID NO: 25858 - DNA, 21 bp, Artificial sequence
  SiRNA target sequence
tttcgttacgaattccttttg

SEQ ID NO: 25859 - DNA, 21 bp, Artificial sequence
  SiRNA target sequence
ttcgttacgaattccttttgt

SEQ ID NO: 25860 - DNA, 21 bp, Artificial sequence
  SiRNA target sequence
tcgttacgaattccttttgtt

SEQ ID NO: 25861 - DNA, 21 bp, Artificial sequence
  SiRNA target sequence
cgttacgaattccttttgttt

SEQ ID NO: 25862 - DNA, 21 bp, Artificial sequence
  SiRNA target sequence
gttacgaattccttttgtttc

SEQ ID NO: 25863 - DNA, 21 bp, Artificial sequence
  SiRNA target sequence
ttacgaattccttttgtttcc

SEQ ID NO: 25864 - DNA, 21 bp, Artificial sequence
  SiRNA target sequence
tacgaattccttttgtttccc

SEQ ID NO: 25865 - DNA, 21 bp, Artificial sequence
  SiRNA target sequence
acgaattccttttgtttcccc

SEQ ID NO: 25866 - DNA, 21 bp, Artificial sequence
  SiRNA target sequence
cgaattccttttgtttcccca

SEQ ID NO: 25867 - DNA, 21 bp, Artificial sequence
  SiRNA target sequence
gaattccttttgtttccccat

SEQ ID NO: 25868 - DNA, 21 bp, Artificial sequence
  SiRNA target sequence
aattccttttgtttccccata

SEQ ID NO: 25869 - DNA, 21 bp, Artificial sequence
  SiRNA target sequence
attccttttgtttccccatac

SEQ ID NO: 25870 - DNA, 21 bp, Artificial sequence
  SiRNA target sequence
ttccttttgtttccccataca

SEQ ID NO: 25871 - DNA, 21 bp, Artificial sequence
  SiRNA target sequence
tccttttgtttccccatacaa

SEQ ID NO: 25872 - DNA, 21 bp, Artificial sequence
  SiRNA target sequence
ccttttgtttccccatacaat

SEQ ID NO: 25873 - DNA, 21 bp, Artificial sequence
  SiRNA target sequence
cttttgtttccccatacaatt

SEQ ID NO: 25874 - DNA, 21 bp, Artificial sequence
  SiRNA target sequence
ttttgtttccccatacaattc

SEQ ID NO: 25875 - DNA, 21 bp, Artificial sequence
  SiRNA target sequence
tttgtttccccatacaattca

SEQ ID NO: 25876 - DNA, 21 bp, Artificial sequence
  SiRNA target sequence
ttgtttccccatacaattcat

SEQ ID NO: 25877 - DNA, 21 bp, Artificial sequence
  SiRNA target sequence
tgtttccccatacaattcata

SEQ ID NO: 25878 - DNA, 21 bp, Artificial sequence
  SiRNA target sequence
gtttccccatacaattcatat

SEQ ID NO: 25879 - DNA, 21 bp, Artificial sequence
  SiRNA target sequence
tttccccatacaattcatatg

SEQ ID NO: 25880 - DNA, 21 bp, Artificial sequence
  SiRNA target sequence
ttccccatacaattcatatga

SEQ ID NO: 25881 - DNA, 21 bp, Artificial sequence
  SiRNA target sequence
tccccatacaattcatatgat

SEQ ID NO: 25882 - DNA, 21 bp, Artificial sequence
  SiRNA target sequence
ccccatacaattcatatgatt

SEQ ID NO: 25883 - DNA, 21 bp, Artificial sequence
  SiRNA target sequence
cccatacaattcatatgattt

SEQ ID NO: 25884 - DNA, 21 bp, Artificial sequence
  SiRNA target sequence
ccatacaattcatatgatttg

SEQ ID NO: 25885 - DNA, 21 bp, Artificial sequence
  SiRNA target sequence
catacaattcatatgatttgg

SEQ ID NO: 25886 - DNA, 21 bp, Artificial sequence
  SiRNA target sequence
atacaattcatatgatttggt

SEQ ID NO: 25887 - DNA, 21 bp, Artificial sequence
  SiRNA target sequence
tacaattcatatgatttggtt

SEQ ID NO: 25888 - DNA, 21 bp, Artificial sequence
  SiRNA target sequence
acaattcatatgatttggttt

SEQ ID NO: 25889 - DNA, 21 bp, Artificial sequence
  SiRNA target sequence
caattcatatgatttggtttc

SEQ ID NO: 25890 - DNA, 21 bp, Artificial sequence
  SiRNA target sequence
aattcatatgatttggtttcg

SEQ ID NO: 25891 - DNA, 21 bp, Artificial sequence
  SiRNA target sequence
attcatatgatttggtttcga

SEQ ID NO: 25892 - DNA, 21 bp, Artificial sequence
  SiRNA target sequence
ttcatatgatttggtttcgaa

SEQ ID NO: 25893 - DNA, 21 bp, Artificial sequence
  SiRNA target sequence
tcatatgatttggtttcgaag

SEQ ID NO: 25894 - DNA, 21 bp, Artificial sequence
  SiRNA target sequence
catatgatttggtttcgaagc

SEQ ID NO: 25895 - DNA, 21 bp, Artificial sequence
  SiRNA target sequence
atatgatttggtttcgaagcg

SEQ ID NO: 25896 - DNA, 21 bp, Artificial sequence
  SiRNA target sequence
tatgatttggtttcgaagcgt

SEQ ID NO: 25897 - DNA, 21 bp, Artificial sequence
  SiRNA target sequence
atgatttggtttcgaagcgtt

SEQ ID NO: 25898 - DNA, 21 bp, Artificial sequence
  SiRNA target sequence
tgatttggtttcgaagcgttt

SEQ ID NO: 25899 - DNA, 21 bp, Artificial sequence
  SiRNA target sequence
gatttggtttcgaagcgtttt

SEQ ID NO: 25900 - DNA, 21 bp, Artificial sequence
  SiRNA target sequence
atttggtttcgaagcgttttc

SEQ ID NO: 25901 - DNA, 21 bp, Artificial sequence
  SiRNA target sequence
tttggtttcgaagcgttttcc

SEQ ID NO: 25902 - DNA, 21 bp, Artificial sequence
  SiRNA target sequence
ttggtttcgaagcgttttccg

SEQ ID NO: 25903 - DNA, 21 bp, Artificial sequence
  SiRNA target sequence
tggtttcgaagcgttttccgt

SEQ ID NO: 25904 - DNA, 21 bp, Artificial sequence
  SiRNA target sequence
ggtttcgaagcgttttccgtg

SEQ ID NO: 25905 - DNA, 21 bp, Artificial sequence
  SiRNA target sequence
gtttcgaagcgttttccgtgg

SEQ ID NO: 25906 - DNA, 21 bp, Artificial sequence
  SiRNA target sequence
tttcgaagcgttttccgtggg

SEQ ID NO: 25907 - DNA, 21 bp, Artificial sequence
  SiRNA target sequence
ttcgaagcgttttccgtgggc

SEQ ID NO: 25908 - DNA, 21 bp, Artificial sequence
  SiRNA target sequence
tcgaagcgttttccgtgggca

SEQ ID NO: 25909 - DNA, 21 bp, Artificial sequence
  SiRNA target sequence
cgaagcgttttccgtgggcaa

SEQ ID NO: 25910 - DNA, 21 bp, Artificial sequence
  SiRNA target sequence
gaagcgttttccgtgggcaaa

SEQ ID NO: 25911 - DNA, 21 bp, Artificial sequence
  SiRNA target sequence
aagcgttttccgtgggcaaag

SEQ ID NO: 25912 - DNA, 21 bp, Artificial sequence
  SiRNA target sequence
agcgttttccgtgggcaaagg

SEQ ID NO: 25913 - DNA, 21 bp, Artificial sequence
  SiRNA target sequence
gcgttttccgtgggcaaaggt

SEQ ID NO: 25914 - DNA, 21 bp, Artificial sequence
  SiRNA target sequence
cgttttccgtgggcaaaggtg

SEQ ID NO: 25915 - DNA, 21 bp, Artificial sequence
  SiRNA target sequence
gttttccgtgggcaaaggtgg

SEQ ID NO: 25916 - DNA, 21 bp, Artificial sequence
  SiRNA target sequence
ttttccgtgggcaaaggtggt

SEQ ID NO: 25917 - DNA, 21 bp, Artificial sequence
  SiRNA target sequence
tttccgtgggcaaaggtggtt

SEQ ID NO: 25918 - DNA, 21 bp, Artificial sequence
  SiRNA target sequence
ttccgtgggcaaaggtggttg

SEQ ID NO: 25919 - DNA, 21 bp, Artificial sequence
  SiRNA target sequence
tccgtgggcaaaggtggttgg

SEQ ID NO: 25920 - DNA, 21 bp, Artificial sequence
  SiRNA target sequence
ccgtgggcaaaggtggttggg

SEQ ID NO: 25921 - DNA, 21 bp, Artificial sequence
  SiRNA target sequence
cgtgggcaaaggtggttgggt

SEQ ID NO: 25922 - DNA, 21 bp, Artificial sequence
  SiRNA target sequence
gtgggcaaaggtggttgggtt

SEQ ID NO: 25923 - DNA, 21 bp, Artificial sequence
  SiRNA target sequence
tgggcaaaggtggttgggtta

SEQ ID NO: 25924 - DNA, 21 bp, Artificial sequence
  SiRNA target sequence
gggcaaaggtggttgggttag

SEQ ID NO: 25925 - DNA, 21 bp, Artificial sequence
  SiRNA target sequence
ggcaaaggtggttgggttagt

SEQ ID NO: 25926 - DNA, 21 bp, Artificial sequence
  SiRNA target sequence
gcaaaggtggttgggttagtg

SEQ ID NO: 25927 - DNA, 21 bp, Artificial sequence
  SiRNA target sequence
caaaggtggttgggttagtgt

SEQ ID NO: 25928 - DNA, 21 bp, Artificial sequence
  SiRNA target sequence
aaaggtggttgggttagtgta

SEQ ID NO: 25929 - DNA, 21 bp, Artificial sequence
  SiRNA target sequence
aaggtggttgggttagtgtac

SEQ ID NO: 25930 - DNA, 21 bp, Artificial sequence
  SiRNA target sequence
aggtggttgggttagtgtact

SEQ ID NO: 25931 - DNA, 21 bp, Artificial sequence
  SiRNA target sequence
ggtggttgggttagtgtactc

SEQ ID NO: 25932 - DNA, 21 bp, Artificial sequence
  SiRNA target sequence
gtggttgggttagtgtactcc

SEQ ID NO: 25933 - DNA, 21 bp, Artificial sequence
  SiRNA target sequence
tggttgggttagtgtactccc

SEQ ID NO: 25934 - DNA, 21 bp, Artificial sequence
  SiRNA target sequence
ggttgggttagtgtactcccc

SEQ ID NO: 25935 - DNA, 21 bp, Artificial sequence
  SiRNA target sequence
gttgggttagtgtactccccc

SEQ ID NO: 25936 - DNA, 21 bp, Artificial sequence
  SiRNA target sequence
ttgggttagtgtactcccccc

SEQ ID NO: 25937 - DNA, 21 bp, Artificial sequence
  SiRNA target sequence
tgggttagtgtactcccccct

SEQ ID NO: 25938 - DNA, 21 bp, Artificial sequence
  SiRNA target sequence
gggttagtgtactccccccta

SEQ ID NO: 25939 - DNA, 21 bp, Artificial sequence
  SiRNA target sequence
ggttagtgtactcccccctaa

SEQ ID NO: 25940 - DNA, 21 bp, Artificial sequence
  SiRNA target sequence
gttagtgtactcccccctaac

SEQ ID NO: 25941 - DNA, 21 bp, Artificial sequence
  SiRNA target sequence
ttagtgtactcccccctaact

SEQ ID NO: 25942 - DNA, 21 bp, Artificial sequence
  SiRNA target sequence
tagtgtactcccccctaacta

SEQ ID NO: 25943 - DNA, 21 bp, Artificial sequence
  SiRNA target sequence
agtgtactcccccctaactac

SEQ ID NO: 25944 - DNA, 21 bp, Artificial sequence
  SiRNA target sequence
gtgtactcccccctaactaca

SEQ ID NO: 25945 - DNA, 21 bp, Artificial sequence
  SiRNA target sequence
tgtactcccccctaactacaa

SEQ ID NO: 25946 - DNA, 21 bp, Artificial sequence
  SiRNA target sequence
gtactcccccctaactacaac

SEQ ID NO: 25947 - DNA, 21 bp, Artificial sequence
  SiRNA target sequence
tactcccccctaactacaact

SEQ ID NO: 25948 - DNA, 21 bp, Artificial sequence
  SiRNA target sequence
actcccccctaactacaacta

SEQ ID NO: 25949 - DNA, 21 bp, Artificial sequence
  SiRNA target sequence
ctcccccctaactacaactat

SEQ ID NO: 25950 - DNA, 21 bp, Artificial sequence
  SiRNA target sequence
tcccccctaactacaactatt

SEQ ID NO: 25951 - DNA, 21 bp, Artificial sequence
  SiRNA target sequence
cccccctaactacaactattc

SEQ ID NO: 25952 - DNA, 21 bp, Artificial sequence
  SiRNA target sequence
ccccctaactacaactattcc

SEQ ID NO: 25953 - DNA, 21 bp, Artificial sequence
  SiRNA target sequence
cccctaactacaactattccc

SEQ ID NO: 25954 - DNA, 21 bp, Artificial sequence
  SiRNA target sequence
ccctaactacaactattcccg

SEQ ID NO: 25955 - DNA, 21 bp, Artificial sequence
  SiRNA target sequence
cctaactacaactattcccgt

SEQ ID NO: 25956 - DNA, 21 bp, Artificial sequence
  SiRNA target sequence
ctaactacaactattcccgta

SEQ ID NO: 25957 - DNA, 21 bp, Artificial sequence
  SiRNA target sequence
taactacaactattcccgtag

SEQ ID NO: 25958 - DNA, 21 bp, Artificial sequence
  SiRNA target sequence
aactacaactattcccgtaga

SEQ ID NO: 25959 - DNA, 21 bp, Artificial sequence
  SiRNA target sequence
actacaactattcccgtagat

SEQ ID NO: 25960 - DNA, 21 bp, Artificial sequence
  SiRNA target sequence
ctacaactattcccgtagatt

SEQ ID NO: 25961 - DNA, 21 bp, Artificial sequence
  SiRNA target sequence
tacaactattcccgtagattt

SEQ ID NO: 25962 - DNA, 21 bp, Artificial sequence
  SiRNA target sequence
acaactattcccgtagatttc

SEQ ID NO: 25963 - DNA, 21 bp, Artificial sequence
  SiRNA target sequence
caactattcccgtagatttca

SEQ ID NO: 25964 - DNA, 21 bp, Artificial sequence
  SiRNA target sequence
aactattcccgtagatttcat

SEQ ID NO: 25965 - DNA, 21 bp, Artificial sequence
  SiRNA target sequence
actattcccgtagatttcata

SEQ ID NO: 25966 - DNA, 21 bp, Artificial sequence
  SiRNA target sequence
ctattcccgtagatttcatag

SEQ ID NO: 25967 - DNA, 21 bp, Artificial sequence
  SiRNA target sequence
tattcccgtagatttcatagt

SEQ ID NO: 25968 - DNA, 21 bp, Artificial sequence
  SiRNA target sequence
attcccgtagatttcatagta

SEQ ID NO: 25969 - DNA, 21 bp, Artificial sequence
  SiRNA target sequence
ttcccgtagatttcatagtat

SEQ ID NO: 25970 - DNA, 21 bp, Artificial sequence
  SiRNA target sequence
tcccgtagatttcatagtata

SEQ ID NO: 25971 - DNA, 21 bp, Artificial sequence
  SiRNA target sequence
cccgtagatttcatagtatac

SEQ ID NO: 25972 - DNA, 21 bp, Artificial sequence
  SiRNA target sequence
ccgtagatttcatagtatacg

SEQ ID NO: 25973 - DNA, 21 bp, Artificial sequence
  SiRNA target sequence
cgtagatttcatagtatacgg

SEQ ID NO: 25974 - DNA, 21 bp, Artificial sequence
  SiRNA target sequence
gtagatttcatagtatacggt

SEQ ID NO: 25975 - DNA, 21 bp, Artificial sequence
  SiRNA target sequence
tagatttcatagtatacggtc

SEQ ID NO: 25976 - DNA, 21 bp, Artificial sequence
  SiRNA target sequence
agatttcatagtatacggtca

SEQ ID NO: 25977 - DNA, 21 bp, Artificial sequence
  SiRNA target sequence
gatttcatagtatacggtcat

SEQ ID NO: 25978 - DNA, 21 bp, Artificial sequence
  SiRNA target sequence
atttcatagtatacggtcatt

SEQ ID NO: 25979 - DNA, 21 bp, Artificial sequence
  SiRNA target sequence
tttcatagtatacggtcattt

SEQ ID NO: 25980 - DNA, 21 bp, Artificial sequence
  SiRNA target sequence
ttcatagtatacggtcatttt

SEQ ID NO: 25981 - DNA, 21 bp, Artificial sequence
  SiRNA target sequence
tcatagtatacggtcattttg

SEQ ID NO: 25982 - DNA, 21 bp, Artificial sequence
  SiRNA target sequence
catagtatacggtcattttga

SEQ ID NO: 25983 - DNA, 21 bp, Artificial sequence
  SiRNA target sequence
atagtatacggtcattttgag

SEQ ID NO: 25984 - DNA, 21 bp, Artificial sequence
  SiRNA target sequence
tagtatacggtcattttgagg

SEQ ID NO: 25985 - DNA, 21 bp, Artificial sequence
  SiRNA target sequence
agtatacggtcattttgagga

SEQ ID NO: 25986 - DNA, 21 bp, Artificial sequence
  SiRNA target sequence
gtatacggtcattttgaggac

SEQ ID NO: 25987 - DNA, 21 bp, Artificial sequence
  SiRNA target sequence
tatacggtcattttgaggacg

SEQ ID NO: 25988 - DNA, 21 bp, Artificial sequence
  SiRNA target sequence
atacggtcattttgaggacgt

SEQ ID NO: 25989 - DNA, 21 bp, Artificial sequence
  SiRNA target sequence
tacggtcattttgaggacgtg

SEQ ID NO: 25990 - DNA, 21 bp, Artificial sequence
  SiRNA target sequence
acggtcattttgaggacgtgg

SEQ ID NO: 25991 - DNA, 21 bp, Artificial sequence
  SiRNA target sequence
cggtcattttgaggacgtgga

SEQ ID NO: 25992 - DNA, 21 bp, Artificial sequence
  SiRNA target sequence
ggtcattttgaggacgtggag

SEQ ID NO: 25993 - DNA, 21 bp, Artificial sequence
  SiRNA target sequence
gtcattttgaggacgtggagt

SEQ ID NO: 25994 - DNA, 21 bp, Artificial sequence
  SiRNA target sequence
tcattttgaggacgtggagtt

SEQ ID NO: 25995 - DNA, 21 bp, Artificial sequence
  SiRNA target sequence
cattttgaggacgtggagttg

SEQ ID NO: 25996 - DNA, 21 bp, Artificial sequence
  SiRNA target sequence
attttgaggacgtggagttgg

SEQ ID NO: 25997 - DNA, 21 bp, Artificial sequence
  SiRNA target sequence
ttttgaggacgtggagttggg

SEQ ID NO: 25998 - DNA, 21 bp, Artificial sequence
  SiRNA target sequence
tttgaggacgtggagttgggt

SEQ ID NO: 25999 - DNA, 21 bp, Artificial sequence
  SiRNA target sequence
ttgaggacgtggagttgggtt

SEQ ID NO: 26000 - DNA, 21 bp, Artificial sequence
  SiRNA target sequence
tgaggacgtggagttgggttg

SEQ ID NO: 26001 - DNA, 21 bp, Artificial sequence
  SiRNA target sequence
gaggacgtggagttgggttgc

SEQ ID NO: 26002 - DNA, 21 bp, Artificial sequence
  SiRNA target sequence
aggacgtggagttgggttgcc

SEQ ID NO: 26003 - DNA, 21 bp, Artificial sequence
  SiRNA target sequence
ggacgtggagttgggttgccc

SEQ ID NO: 26004 - DNA, 21 bp, Artificial sequence
  SiRNA target sequence
gacgtggagttgggttgccca

SEQ ID NO: 26005 - DNA, 21 bp, Artificial sequence
  SiRNA target sequence
acgtggagttgggttgcccaa

SEQ ID NO: 26006 - DNA, 21 bp, Artificial sequence
  SiRNA target sequence
cgtggagttgggttgcccaac

SEQ ID NO: 26007 - DNA, 21 bp, Artificial sequence
  SiRNA target sequence
gtggagttgggttgcccaact

SEQ ID NO: 26008 - DNA, 21 bp, Artificial sequence
  SiRNA target sequence
tggagttgggttgcccaactt

SEQ ID NO: 26009 - DNA, 21 bp, Artificial sequence
  SiRNA target sequence
ggagttgggttgcccaacttc

SEQ ID NO: 26010 - DNA, 21 bp, Artificial sequence
  SiRNA target sequence
gagttgggttgcccaacttct

SEQ ID NO: 26011 - DNA, 21 bp, Artificial sequence
  SiRNA target sequence
agttgggttgcccaacttctg

SEQ ID NO: 26012 - DNA, 21 bp, Artificial sequence
  SiRNA target sequence
gttgggttgcccaacttctgg

SEQ ID NO: 26013 - DNA, 21 bp, Artificial sequence
  SiRNA target sequence
ttgggttgcccaacttctggg

SEQ ID NO: 26014 - DNA, 21 bp, Artificial sequence
  SiRNA target sequence
tgggttgcccaacttctggga

SEQ ID NO: 26015 - DNA, 21 bp, Artificial sequence
  SiRNA target sequence
gggttgcccaacttctgggat

SEQ ID NO: 26016 - DNA, 21 bp, Artificial sequence
  SiRNA target sequence
ggttgcccaacttctgggatg

SEQ ID NO: 26017 - DNA, 21 bp, Artificial sequence
  SiRNA target sequence
gttgcccaacttctgggatgt

SEQ ID NO: 26018 - DNA, 21 bp, Artificial sequence
  SiRNA target sequence
ttgcccaacttctgggatgtt

SEQ ID NO: 26019 - DNA, 21 bp, Artificial sequence
  SiRNA target sequence
tgcccaacttctgggatgttg

SEQ ID NO: 26020 - DNA, 21 bp, Artificial sequence
  SiRNA target sequence
gcccaacttctgggatgttgg

SEQ ID NO: 26021 - DNA, 21 bp, Artificial sequence
  SiRNA target sequence
cccaacttctgggatgttggc

SEQ ID NO: 26022 - DNA, 21 bp, Artificial sequence
  SiRNA target sequence
ccaacttctgggatgttggct

SEQ ID NO: 26023 - DNA, 21 bp, Artificial sequence
  SiRNA target sequence
caacttctgggatgttggctc

SEQ ID NO: 26024 - DNA, 21 bp, Artificial sequence
  SiRNA target sequence
aacttctgggatgttggctca

SEQ ID NO: 26025 - DNA, 21 bp, Artificial sequence
  SiRNA target sequence
acttctgggatgttggctcaa

SEQ ID NO: 26026 - DNA, 21 bp, Artificial sequence
  SiRNA target sequence
cttctgggatgttggctcaag

SEQ ID NO: 26027 - DNA, 21 bp, Artificial sequence
  SiRNA target sequence
ttctgggatgttggctcaagc

SEQ ID NO: 26028 - DNA, 21 bp, Artificial sequence
  SiRNA target sequence
tctgggatgttggctcaagcc

SEQ ID NO: 26029 - DNA, 21 bp, Artificial sequence
  SiRNA target sequence
ctgggatgttggctcaagccg

SEQ ID NO: 26030 - DNA, 21 bp, Artificial sequence
  SiRNA target sequence
tgggatgttggctcaagccgg

SEQ ID NO: 26031 - DNA, 21 bp, Artificial sequence
  SiRNA target sequence
gggatgttggctcaagccggt

SEQ ID NO: 26032 - DNA, 21 bp, Artificial sequence
  SiRNA target sequence
ggatgttggctcaagccggtc

SEQ ID NO: 26033 - DNA, 21 bp, Artificial sequence
  SiRNA target sequence
gatgttggctcaagccggtct

SEQ ID NO: 26034 - DNA, 21 bp, Artificial sequence
  SiRNA target sequence
atgttggctcaagccggtctg

SEQ ID NO: 26035 - DNA, 21 bp, Artificial sequence
  SiRNA target sequence
tgttggctcaagccggtctga

SEQ ID NO: 26036 - DNA, 21 bp, Artificial sequence
  SiRNA target sequence
gttggctcaagccggtctgaa

SEQ ID NO: 26037 - DNA, 21 bp, Artificial sequence
  SiRNA target sequence
ttggctcaagccggtctgaag

SEQ ID NO: 26038 - DNA, 21 bp, Artificial sequence
  SiRNA target sequence
tggctcaagccggtctgaagg

SEQ ID NO: 26039 - DNA, 21 bp, Artificial sequence
  SiRNA target sequence
ggctcaagccggtctgaaggt

SEQ ID NO: 26040 - DNA, 21 bp, Artificial sequence
  SiRNA target sequence
gctcaagccggtctgaaggta

SEQ ID NO: 26041 - DNA, 21 bp, Artificial sequence
  SiRNA target sequence
ctcaagccggtctgaaggtac

SEQ ID NO: 26042 - DNA, 21 bp, Artificial sequence
  SiRNA target sequence
tcaagccggtctgaaggtaca

SEQ ID NO: 26043 - DNA, 21 bp, Artificial sequence
  SiRNA target sequence
caagccggtctgaaggtacaa

SEQ ID NO: 26044 - DNA, 21 bp, Artificial sequence
  SiRNA target sequence
aagccggtctgaaggtacaac

SEQ ID NO: 26045 - DNA, 21 bp, Artificial sequence
  SiRNA target sequence
agccggtctgaaggtacaacc

SEQ ID NO: 26046 - DNA, 21 bp, Artificial sequence
  SiRNA target sequence
gccggtctgaaggtacaacct

SEQ ID NO: 26047 - DNA, 21 bp, Artificial sequence
  SiRNA target sequence
ccggtctgaaggtacaacctc

SEQ ID NO: 26048 - DNA, 21 bp, Artificial sequence
  SiRNA target sequence
cggtctgaaggtacaacctcc

SEQ ID NO: 26049 - DNA, 21 bp, Artificial sequence
  SiRNA target sequence
ggtctgaaggtacaacctcct

SEQ ID NO: 26050 - DNA, 21 bp, Artificial sequence
  SiRNA target sequence
gtctgaaggtacaacctccta

SEQ ID NO: 26051 - DNA, 21 bp, Artificial sequence
  SiRNA target sequence
tctgaaggtacaacctcctac

SEQ ID NO: 26052 - DNA, 21 bp, Artificial sequence
  SiRNA target sequence
ctgaaggtacaacctcctaca

SEQ ID NO: 26053 - DNA, 21 bp, Artificial sequence
  SiRNA target sequence
tgaaggtacaacctcctacaa

SEQ ID NO: 26054 - DNA, 21 bp, Artificial sequence
  SiRNA target sequence
gaaggtacaacctcctacaaa

SEQ ID NO: 26055 - DNA, 21 bp, Artificial sequence
  SiRNA target sequence
aaggtacaacctcctacaaac

SEQ ID NO: 26056 - DNA, 21 bp, Artificial sequence
  SiRNA target sequence
aggtacaacctcctacaaact

SEQ ID NO: 26057 - DNA, 21 bp, Artificial sequence
  SiRNA target sequence
ggtacaacctcctacaaactc

SEQ ID NO: 26058 - DNA, 21 bp, Artificial sequence
  SiRNA target sequence
gtacaacctcctacaaactct

SEQ ID NO: 26059 - DNA, 21 bp, Artificial sequence
  SiRNA target sequence
tacaacctcctacaaactctg

SEQ ID NO: 26060 - DNA, 21 bp, Artificial sequence
  SiRNA target sequence
acaacctcctacaaactctga

SEQ ID NO: 26061 - DNA, 21 bp, Artificial sequence
  SiRNA target sequence
caacctcctacaaactctgac

SEQ ID NO: 26062 - DNA, 21 bp, Artificial sequence
  SiRNA target sequence
aacctcctacaaactctgact

SEQ ID NO: 26063 - DNA, 21 bp, Artificial sequence
  SiRNA target sequence
acctcctacaaactctgactc

SEQ ID NO: 26064 - DNA, 21 bp, Artificial sequence
  SiRNA target sequence
cctcctacaaactctgactct

SEQ ID NO: 26065 - DNA, 21 bp, Artificial sequence
  SiRNA target sequence
ctcctacaaactctgactctc

SEQ ID NO: 26066 - DNA, 21 bp, Artificial sequence
  SiRNA target sequence
tcctacaaactctgactctcg

SEQ ID NO: 26067 - DNA, 21 bp, Artificial sequence
  SiRNA target sequence
cctacaaactctgactctcga

SEQ ID NO: 26068 - DNA, 21 bp, Artificial sequence
  SiRNA target sequence
ctacaaactctgactctcgac

SEQ ID NO: 26069 - DNA, 21 bp, Artificial sequence
  SiRNA target sequence
tacaaactctgactctcgaca

SEQ ID NO: 26070 - DNA, 21 bp, Artificial sequence
  SiRNA target sequence
acaaactctgactctcgacag

SEQ ID NO: 26071 - DNA, 21 bp, Artificial sequence
  SiRNA target sequence
caaactctgactctcgacagc

SEQ ID NO: 26072 - DNA, 21 bp, Artificial sequence
  SiRNA target sequence
aaactctgactctcgacagcg

SEQ ID NO: 26073 - DNA, 21 bp, Artificial sequence
  SiRNA target sequence
aactctgactctcgacagcgt

SEQ ID NO: 26074 - DNA, 21 bp, Artificial sequence
  SiRNA target sequence
actctgactctcgacagcgtg

SEQ ID NO: 26075 - DNA, 21 bp, Artificial sequence
  SiRNA target sequence
ctctgactctcgacagcgtgc

SEQ ID NO: 26076 - DNA, 21 bp, Artificial sequence
  SiRNA target sequence
tctgactctcgacagcgtgcc

SEQ ID NO: 26077 - DNA, 21 bp, Artificial sequence
  SiRNA target sequence
ctgactctcgacagcgtgcca

SEQ ID NO: 26078 - DNA, 21 bp, Artificial sequence
  SiRNA target sequence
tgactctcgacagcgtgccaa

SEQ ID NO: 26079 - DNA, 21 bp, Artificial sequence
  SiRNA target sequence
gactctcgacagcgtgccaaa

SEQ ID NO: 26080 - DNA, 21 bp, Artificial sequence
  SiRNA target sequence
actctcgacagcgtgccaaag

SEQ ID NO: 26081 - DNA, 21 bp, Artificial sequence
  SiRNA target sequence
ctctcgacagcgtgccaaaga

SEQ ID NO: 26082 - DNA, 21 bp, Artificial sequence
  SiRNA target sequence
tctcgacagcgtgccaaagag

SEQ ID NO: 26083 - DNA, 21 bp, Artificial sequence
  SiRNA target sequence
ctcgacagcgtgccaaagaga

SEQ ID NO: 26084 - DNA, 21 bp, Artificial sequence
  SiRNA target sequence
tcgacagcgtgccaaagagag

SEQ ID NO: 26085 - DNA, 21 bp, Artificial sequence
  SiRNA target sequence
cgacagcgtgccaaagagagt

SEQ ID NO: 26086 - DNA, 21 bp, Artificial sequence
  SiRNA target sequence
gacagcgtgccaaagagagta

SEQ ID NO: 26087 - DNA, 21 bp, Artificial sequence
  SiRNA target sequence
acagcgtgccaaagagagtaa

SEQ ID NO: 26088 - DNA, 21 bp, Artificial sequence
  SiRNA target sequence
cagcgtgccaaagagagtaag

SEQ ID NO: 26089 - DNA, 21 bp, Artificial sequence
  SiRNA target sequence
agcgtgccaaagagagtaagg

SEQ ID NO: 26090 - DNA, 21 bp, Artificial sequence
  SiRNA target sequence
gcgtgccaaagagagtaaggg

SEQ ID NO: 26091 - DNA, 21 bp, Artificial sequence
  SiRNA target sequence
cgtgccaaagagagtaagggc

SEQ ID NO: 26092 - DNA, 21 bp, Artificial sequence
  SiRNA target sequence
gtgccaaagagagtaagggca

SEQ ID NO: 26093 - DNA, 21 bp, Artificial sequence
  SiRNA target sequence
tgccaaagagagtaagggcaa

SEQ ID NO: 26094 - DNA, 21 bp, Artificial sequence
  SiRNA target sequence
gccaaagagagtaagggcaaa

SEQ ID NO: 26095 - DNA, 21 bp, Artificial sequence
  SiRNA target sequence
ccaaagagagtaagggcaaaa

SEQ ID NO: 26096 - DNA, 21 bp, Artificial sequence
  SiRNA target sequence
caaagagagtaagggcaaaaa

SEQ ID NO: 26097 - DNA, 21 bp, Artificial sequence
  SiRNA target sequence
aaagagagtaagggcaaaaag

SEQ ID NO: 26098 - DNA, 21 bp, Artificial sequence
  SiRNA target sequence
aagagagtaagggcaaaaagg

SEQ ID NO: 26099 - DNA, 21 bp, Artificial sequence
  SiRNA target sequence
agagagtaagggcaaaaagga

SEQ ID NO: 26100 - DNA, 21 bp, Artificial sequence
  SiRNA target sequence
gagagtaagggcaaaaaggat

SEQ ID NO: 26101 - DNA, 21 bp, Artificial sequence
  SiRNA target sequence
agagtaagggcaaaaaggatt

SEQ ID NO: 26102 - DNA, 21 bp, Artificial sequence
  SiRNA target sequence
gagtaagggcaaaaaggatta

SEQ ID NO: 26103 - DNA, 21 bp, Artificial sequence
  SiRNA target sequence
agtaagggcaaaaaggattac

SEQ ID NO: 26104 - DNA, 21 bp, Artificial sequence
  SiRNA target sequence
gtaagggcaaaaaggattact

SEQ ID NO: 26105 - DNA, 21 bp, Artificial sequence
  SiRNA target sequence
taagggcaaaaaggattactc

SEQ ID NO: 26106 - DNA, 21 bp, Artificial sequence
  SiRNA target sequence
aagggcaaaaaggattactct

SEQ ID NO: 26107 - DNA, 21 bp, Artificial sequence
  SiRNA target sequence
agggcaaaaaggattactcta

SEQ ID NO: 26108 - DNA, 21 bp, Artificial sequence
  SiRNA target sequence
gggcaaaaaggattactctaa

SEQ ID NO: 26109 - DNA, 21 bp, Artificial sequence
  SiRNA target sequence
ggcaaaaaggattactctaag

SEQ ID NO: 26110 - DNA, 21 bp, Artificial sequence
  SiRNA target sequence
gcaaaaaggattactctaaga

SEQ ID NO: 26111 - DNA, 21 bp, Artificial sequence
  SiRNA target sequence
caaaaaggattactctaagac

SEQ ID NO: 26112 - DNA, 21 bp, Artificial sequence
  SiRNA target sequence
aaaaaggattactctaagaca

SEQ ID NO: 26113 - DNA, 21 bp, Artificial sequence
  SiRNA target sequence
aaaaggattactctaagacag

SEQ ID NO: 26114 - DNA, 21 bp, Artificial sequence
  SiRNA target sequence
aaaggattactctaagacagg

SEQ ID NO: 26115 - DNA, 21 bp, Artificial sequence
  SiRNA target sequence
aaggattactctaagacagga

SEQ ID NO: 26116 - DNA, 21 bp, Artificial sequence
  SiRNA target sequence
aggattactctaagacaggag

SEQ ID NO: 26117 - DNA, 21 bp, Artificial sequence
  SiRNA target sequence
ggattactctaagacaggagc

SEQ ID NO: 26118 - DNA, 21 bp, Artificial sequence
  SiRNA target sequence
gattactctaagacaggagca

SEQ ID NO: 26119 - DNA, 21 bp, Artificial sequence
  SiRNA target sequence
attactctaagacaggagcag

SEQ ID NO: 26120 - DNA, 21 bp, Artificial sequence
  SiRNA target sequence
ttactctaagacaggagcagc

SEQ ID NO: 26121 - DNA, 21 bp, Artificial sequence
  SiRNA target sequence
tactctaagacaggagcagct

SEQ ID NO: 26122 - DNA, 21 bp, Artificial sequence
  SiRNA target sequence
actctaagacaggagcagctt

SEQ ID NO: 26123 - DNA, 21 bp, Artificial sequence
  SiRNA target sequence
ctctaagacaggagcagcttt

SEQ ID NO: 26124 - DNA, 21 bp, Artificial sequence
  SiRNA target sequence
tctaagacaggagcagctttt

SEQ ID NO: 26125 - DNA, 21 bp, Artificial sequence
  SiRNA target sequence
ctaagacaggagcagctttta

SEQ ID NO: 26126 - DNA, 21 bp, Artificial sequence
  SiRNA target sequence
taagacaggagcagcttttaa

SEQ ID NO: 26127 - DNA, 21 bp, Artificial sequence
  SiRNA target sequence
aagacaggagcagcttttaaa

SEQ ID NO: 26128 - DNA, 21 bp, Artificial sequence
  SiRNA target sequence
agacaggagcagcttttaaac

SEQ ID NO: 26129 - DNA, 21 bp, Artificial sequence
  SiRNA target sequence
gacaggagcagcttttaaaca

SEQ ID NO: 26130 - DNA, 21 bp, Artificial sequence
  SiRNA target sequence
acaggagcagcttttaaacaa

SEQ ID NO: 26131 - DNA, 21 bp, Artificial sequence
  SiRNA target sequence
caggagcagcttttaaacaat

SEQ ID NO: 26132 - DNA, 21 bp, Artificial sequence
  SiRNA target sequence
aggagcagcttttaaacaatc

SEQ ID NO: 26133 - DNA, 21 bp, Artificial sequence
  SiRNA target sequence
ggagcagcttttaaacaatct

SEQ ID NO: 26134 - DNA, 21 bp, Artificial sequence
  SiRNA target sequence
gagcagcttttaaacaatctg

SEQ ID NO: 26135 - DNA, 21 bp, Artificial sequence
  SiRNA target sequence
agcagcttttaaacaatctgt

SEQ ID NO: 26136 - DNA, 21 bp, Artificial sequence
  SiRNA target sequence
gcagcttttaaacaatctgtt

SEQ ID NO: 26137 - DNA, 21 bp, Artificial sequence
  SiRNA target sequence
cagcttttaaacaatctgttt

SEQ ID NO: 26138 - DNA, 21 bp, Artificial sequence
  SiRNA target sequence
agcttttaaacaatctgtttc

SEQ ID NO: 26139 - DNA, 21 bp, Artificial sequence
  SiRNA target sequence
gcttttaaacaatctgtttcg

SEQ ID NO: 26140 - DNA, 21 bp, Artificial sequence
  SiRNA target sequence
cttttaaacaatctgtttcga

SEQ ID NO: 26141 - DNA, 21 bp, Artificial sequence
  SiRNA target sequence
ttttaaacaatctgtttcgaa

SEQ ID NO: 26142 - DNA, 21 bp, Artificial sequence
  SiRNA target sequence
tttaaacaatctgtttcgaag

SEQ ID NO: 26143 - DNA, 21 bp, Artificial sequence
  SiRNA target sequence
ttaaacaatctgtttcgaagc

SEQ ID NO: 26144 - DNA, 21 bp, Artificial sequence
  SiRNA target sequence
taaacaatctgtttcgaagct

SEQ ID NO: 26145 - DNA, 21 bp, Artificial sequence
  SiRNA target sequence
aaacaatctgtttcgaagctg

SEQ ID NO: 26146 - DNA, 21 bp, Artificial sequence
  SiRNA target sequence
aacaatctgtttcgaagctgg

SEQ ID NO: 26147 - DNA, 21 bp, Artificial sequence
  SiRNA target sequence
acaatctgtttcgaagctggg

SEQ ID NO: 26148 - DNA, 21 bp, Artificial sequence
  SiRNA target sequence
caatctgtttcgaagctgggc

SEQ ID NO: 26149 - DNA, 21 bp, Artificial sequence
  SiRNA target sequence
aatctgtttcgaagctgggcg

SEQ ID NO: 26150 - DNA, 21 bp, Artificial sequence
  SiRNA target sequence
atctgtttcgaagctgggcga

SEQ ID NO: 26151 - DNA, 21 bp, Artificial sequence
  SiRNA target sequence
tctgtttcgaagctgggcgaa

SEQ ID NO: 26152 - DNA, 21 bp, Artificial sequence
  SiRNA target sequence
ctgtttcgaagctgggcgaac

SEQ ID NO: 26153 - DNA, 21 bp, Artificial sequence
  SiRNA target sequence
tgtttcgaagctgggcgaaca

SEQ ID NO: 26154 - DNA, 21 bp, Artificial sequence
  SiRNA target sequence
gtttcgaagctgggcgaacat

SEQ ID NO: 26155 - DNA, 21 bp, Artificial sequence
  SiRNA target sequence
tttcgaagctgggcgaacatc

SEQ ID NO: 26156 - DNA, 21 bp, Artificial sequence
  SiRNA target sequence
ttcgaagctgggcgaacatct

SEQ ID NO: 26157 - DNA, 21 bp, Artificial sequence
  SiRNA target sequence
tcgaagctgggcgaacatcta

SEQ ID NO: 26158 - DNA, 21 bp, Artificial sequence
  SiRNA target sequence
cgaagctgggcgaacatctac

SEQ ID NO: 26159 - DNA, 21 bp, Artificial sequence
  SiRNA target sequence
gaagctgggcgaacatctacc

SEQ ID NO: 26160 - DNA, 21 bp, Artificial sequence
  SiRNA target sequence
aagctgggcgaacatctacct

SEQ ID NO: 26161 - DNA, 21 bp, Artificial sequence
  SiRNA target sequence
agctgggcgaacatctacctt

SEQ ID NO: 26162 - DNA, 21 bp, Artificial sequence
  SiRNA target sequence
gctgggcgaacatctaccttt

SEQ ID NO: 26163 - DNA, 21 bp, Artificial sequence
  SiRNA target sequence
ctgggcgaacatctacctttc

SEQ ID NO: 26164 - DNA, 21 bp, Artificial sequence
  SiRNA target sequence
tgggcgaacatctacctttcc

SEQ ID NO: 26165 - DNA, 21 bp, Artificial sequence
  SiRNA target sequence
gggcgaacatctacctttcct

SEQ ID NO: 26166 - DNA, 21 bp, Artificial sequence
  SiRNA target sequence
ggcgaacatctacctttcctc

SEQ ID NO: 26167 - DNA, 21 bp, Artificial sequence
  SiRNA target sequence
gcgaacatctacctttcctca

SEQ ID NO: 26168 - DNA, 21 bp, Artificial sequence
  SiRNA target sequence
cgaacatctacctttcctcaa

SEQ ID NO: 26169 - DNA, 21 bp, Artificial sequence
  SiRNA target sequence
gaacatctacctttcctcaaa

SEQ ID NO: 26170 - DNA, 21 bp, Artificial sequence
  SiRNA target sequence
aacatctacctttcctcaaat

SEQ ID NO: 26171 - DNA, 21 bp, Artificial sequence
  SiRNA target sequence
acatctacctttcctcaaatc

SEQ ID NO: 26172 - DNA, 21 bp, Artificial sequence
  SiRNA target sequence
catctacctttcctcaaatca

SEQ ID NO: 26173 - DNA, 21 bp, Artificial sequence
  SiRNA target sequence
atctacctttcctcaaatcag

SEQ ID NO: 26174 - DNA, 21 bp, Artificial sequence
  SiRNA target sequence
tctacctttcctcaaatcagg

SEQ ID NO: 26175 - DNA, 21 bp, Artificial sequence
  SiRNA target sequence
ctacctttcctcaaatcagga

SEQ ID NO: 26176 - DNA, 21 bp, Artificial sequence
  SiRNA target sequence
tacctttcctcaaatcaggag

SEQ ID NO: 26177 - DNA, 21 bp, Artificial sequence
  SiRNA target sequence
acctttcctcaaatcaggagc

SEQ ID NO: 26178 - DNA, 21 bp, Artificial sequence
  SiRNA target sequence
cctttcctcaaatcaggagcg

SEQ ID NO: 26179 - DNA, 21 bp, Artificial sequence
  SiRNA target sequence
ctttcctcaaatcaggagcga

SEQ ID NO: 26180 - DNA, 21 bp, Artificial sequence
  SiRNA target sequence
tttcctcaaatcaggagcgaa

SEQ ID NO: 26181 - DNA, 21 bp, Artificial sequence
  SiRNA target sequence
ttcctcaaatcaggagcgaac

SEQ ID NO: 26182 - DNA, 21 bp, Artificial sequence
  SiRNA target sequence
tcctcaaatcaggagcgaact

SEQ ID NO: 26183 - DNA, 21 bp, Artificial sequence
  SiRNA target sequence
cctcaaatcaggagcgaactg

SEQ ID NO: 26184 - DNA, 21 bp, Artificial sequence
  SiRNA target sequence
ctcaaatcaggagcgaactgg

SEQ ID NO: 26185 - DNA, 21 bp, Artificial sequence
  SiRNA target sequence
tcaaatcaggagcgaactggg

SEQ ID NO: 26186 - DNA, 21 bp, Artificial sequence
  SiRNA target sequence
caaatcaggagcgaactgggt

SEQ ID NO: 26187 - DNA, 21 bp, Artificial sequence
  SiRNA target sequence
aaatcaggagcgaactgggtc

SEQ ID NO: 26188 - DNA, 21 bp, Artificial sequence
  SiRNA target sequence
aatcaggagcgaactgggtca

SEQ ID NO: 26189 - DNA, 21 bp, Artificial sequence
  SiRNA target sequence
atcaggagcgaactgggtcag

SEQ ID NO: 26190 - DNA, 21 bp, Artificial sequence
  SiRNA target sequence
tcaggagcgaactgggtcagt

SEQ ID NO: 26191 - DNA, 21 bp, Artificial sequence
  SiRNA target sequence
caggagcgaactgggtcagtg

SEQ ID NO: 26192 - DNA, 21 bp, Artificial sequence
  SiRNA target sequence
aggagcgaactgggtcagtga

SEQ ID NO: 26193 - DNA, 21 bp, Artificial sequence
  SiRNA target sequence
ggagcgaactgggtcagtgag

SEQ ID NO: 26194 - DNA, 21 bp, Artificial sequence
  SiRNA target sequence
gagcgaactgggtcagtgaga

SEQ ID NO: 26195 - DNA, 21 bp, Artificial sequence
  SiRNA target sequence
agcgaactgggtcagtgagaa

SEQ ID NO: 26196 - DNA, 21 bp, Artificial sequence
  SiRNA target sequence
gcgaactgggtcagtgagaat

SEQ ID NO: 26197 - DNA, 21 bp, Artificial sequence
  SiRNA target sequence
cgaactgggtcagtgagaata

SEQ ID NO: 26198 - DNA, 21 bp, Artificial sequence
  SiRNA target sequence
gaactgggtcagtgagaatat

SEQ ID NO: 26199 - DNA, 21 bp, Artificial sequence
  SiRNA target sequence
aactgggtcagtgagaatatt

SEQ ID NO: 26200 - DNA, 21 bp, Artificial sequence
  SiRNA target sequence
actgggtcagtgagaatattc

SEQ ID NO: 26201 - DNA, 21 bp, Artificial sequence
  SiRNA target sequence
ctgggtcagtgagaatattct

SEQ ID NO: 26202 - DNA, 21 bp, Artificial sequence
  SiRNA target sequence
tgggtcagtgagaatattctg

SEQ ID NO: 26203 - DNA, 21 bp, Artificial sequence
  SiRNA target sequence
gggtcagtgagaatattctgc

SEQ ID NO: 26204 - DNA, 21 bp, Artificial sequence
  SiRNA target sequence
ggtcagtgagaatattctgca

SEQ ID NO: 26205 - DNA, 21 bp, Artificial sequence
  SiRNA target sequence
gtcagtgagaatattctgcaa

SEQ ID NO: 26206 - DNA, 21 bp, Artificial sequence
  SiRNA target sequence
tcagtgagaatattctgcaac

SEQ ID NO: 26207 - DNA, 21 bp, Artificial sequence
  SiRNA target sequence
cagtgagaatattctgcaacc

SEQ ID NO: 26208 - DNA, 21 bp, Artificial sequence
  SiRNA target sequence
agtgagaatattctgcaacct

SEQ ID NO: 26209 - DNA, 21 bp, Artificial sequence
  SiRNA target sequence
gtgagaatattctgcaacctg

SEQ ID NO: 26210 - DNA, 21 bp, Artificial sequence
  SiRNA target sequence
tgagaatattctgcaacctgc

SEQ ID NO: 26211 - DNA, 21 bp, Artificial sequence
  SiRNA target sequence
gagaatattctgcaacctgca

SEQ ID NO: 26212 - DNA, 21 bp, Artificial sequence
  SiRNA target sequence
agaatattctgcaacctgcag

SEQ ID NO: 26213 - DNA, 21 bp, Artificial sequence
  SiRNA target sequence
gaatattctgcaacctgcaga

SEQ ID NO: 26214 - DNA, 21 bp, Artificial sequence
  SiRNA target sequence
aatattctgcaacctgcagat

SEQ ID NO: 26215 - DNA, 21 bp, Artificial sequence
  SiRNA target sequence
atattctgcaacctgcagatg

SEQ ID NO: 26216 - DNA, 21 bp, Artificial sequence
  SiRNA target sequence
tattctgcaacctgcagatga

SEQ ID NO: 26217 - DNA, 21 bp, Artificial sequence
  SiRNA target sequence
attctgcaacctgcagatgaa

SEQ ID NO: 26218 - DNA, 21 bp, Artificial sequence
  SiRNA target sequence
ttctgcaacctgcagatgaaa

SEQ ID NO: 26219 - DNA, 21 bp, Artificial sequence
  SiRNA target sequence
tctgcaacctgcagatgaaat

SEQ ID NO: 26220 - DNA, 21 bp, Artificial sequence
  SiRNA target sequence
ctgcaacctgcagatgaaatc

SEQ ID NO: 26221 - DNA, 21 bp, Artificial sequence
  SiRNA target sequence
tgcaacctgcagatgaaatca

SEQ ID NO: 26222 - DNA, 21 bp, Artificial sequence
  SiRNA target sequence
gcaacctgcagatgaaatcat

SEQ ID NO: 26223 - DNA, 21 bp, Artificial sequence
  SiRNA target sequence
caacctgcagatgaaatcata

SEQ ID NO: 26224 - DNA, 21 bp, Artificial sequence
  SiRNA target sequence
aacctgcagatgaaatcatag

SEQ ID NO: 26225 - DNA, 21 bp, Artificial sequence
  SiRNA target sequence
acctgcagatgaaatcatagg

SEQ ID NO: 26226 - DNA, 21 bp, Artificial sequence
  SiRNA target sequence
cctgcagatgaaatcatagga

SEQ ID NO: 26227 - DNA, 21 bp, Artificial sequence
  SiRNA target sequence
ctgcagatgaaatcataggac

SEQ ID NO: 26228 - DNA, 21 bp, Artificial sequence
  SiRNA target sequence
tgcagatgaaatcataggacc

SEQ ID NO: 26229 - DNA, 21 bp, Artificial sequence
  SiRNA target sequence
gcagatgaaatcataggacct

SEQ ID NO: 26230 - DNA, 21 bp, Artificial sequence
  SiRNA target sequence
cagatgaaatcataggaccta

SEQ ID NO: 26231 - DNA, 21 bp, Artificial sequence
  SiRNA target sequence
agatgaaatcataggacctat

SEQ ID NO: 26232 - DNA, 21 bp, Artificial sequence
  SiRNA target sequence
gatgaaatcataggacctata

SEQ ID NO: 26233 - DNA, 21 bp, Artificial sequence
  SiRNA target sequence
atgaaatcataggacctatat

SEQ ID NO: 26234 - DNA, 21 bp, Artificial sequence
  SiRNA target sequence
tgaaatcataggacctatatt

SEQ ID NO: 26235 - DNA, 21 bp, Artificial sequence
  SiRNA target sequence
gaaatcataggacctatattg

SEQ ID NO: 26236 - DNA, 21 bp, Artificial sequence
  SiRNA target sequence
aaatcataggacctatattgt

SEQ ID NO: 26237 - DNA, 21 bp, Artificial sequence
  SiRNA target sequence
aatcataggacctatattgtc

SEQ ID NO: 26238 - DNA, 21 bp, Artificial sequence
  SiRNA target sequence
atcataggacctatattgtct

SEQ ID NO: 26239 - DNA, 21 bp, Artificial sequence
  SiRNA target sequence
tcataggacctatattgtctc

SEQ ID NO: 26240 - DNA, 21 bp, Artificial sequence
  SiRNA target sequence
cataggacctatattgtctct

SEQ ID NO: 26241 - DNA, 21 bp, Artificial sequence
  SiRNA target sequence
ataggacctatattgtctctt

SEQ ID NO: 26242 - DNA, 21 bp, Artificial sequence
  SiRNA target sequence
taggacctatattgtctcttt

SEQ ID NO: 26243 - DNA, 21 bp, Artificial sequence
  SiRNA target sequence
aggacctatattgtctctttt

SEQ ID NO: 26244 - DNA, 21 bp, Artificial sequence
  SiRNA target sequence
ggacctatattgtctcttttt

SEQ ID NO: 26245 - DNA, 21 bp, Artificial sequence
  SiRNA target sequence
gacctatattgtctctttttg

SEQ ID NO: 26246 - DNA, 21 bp, Artificial sequence
  SiRNA target sequence
acctatattgtctctttttgg

SEQ ID NO: 26247 - DNA, 21 bp, Artificial sequence
  SiRNA target sequence
cctatattgtctctttttggg

SEQ ID NO: 26248 - DNA, 21 bp, Artificial sequence
  SiRNA target sequence
ctatattgtctctttttgggt

SEQ ID NO: 26249 - DNA, 21 bp, Artificial sequence
  SiRNA target sequence
tatattgtctctttttgggtt

SEQ ID NO: 26250 - DNA, 21 bp, Artificial sequence
  SiRNA target sequence
atattgtctctttttgggttc

SEQ ID NO: 26251 - DNA, 21 bp, Artificial sequence
  SiRNA target sequence
tattgtctctttttgggttct

SEQ ID NO: 26252 - DNA, 21 bp, Artificial sequence
  SiRNA target sequence
attgtctctttttgggttctc

SEQ ID NO: 26253 - DNA, 21 bp, Artificial sequence
  SiRNA target sequence
ttgtctctttttgggttctcg

SEQ ID NO: 26254 - DNA, 21 bp, Artificial sequence
  SiRNA target sequence
tgtctctttttgggttctcga

SEQ ID NO: 26255 - DNA, 21 bp, Artificial sequence
  SiRNA target sequence
gtctctttttgggttctcgaa

SEQ ID NO: 26256 - DNA, 21 bp, Artificial sequence
  SiRNA target sequence
tctctttttgggttctcgaag

SEQ ID NO: 26257 - DNA, 21 bp, Artificial sequence
  SiRNA target sequence
ctctttttgggttctcgaagc

SEQ ID NO: 26258 - DNA, 21 bp, Artificial sequence
  SiRNA target sequence
tctttttgggttctcgaagcc

SEQ ID NO: 26259 - DNA, 21 bp, Artificial sequence
  SiRNA target sequence
ctttttgggttctcgaagcct

SEQ ID NO: 26260 - DNA, 21 bp, Artificial sequence
  SiRNA target sequence
tttttgggttctcgaagcctc

SEQ ID NO: 26261 - DNA, 21 bp, Artificial sequence
  SiRNA target sequence
ttttgggttctcgaagcctct

SEQ ID NO: 26262 - DNA, 21 bp, Artificial sequence
  SiRNA target sequence
tttgggttctcgaagcctctt

SEQ ID NO: 26263 - DNA, 21 bp, Artificial sequence
  SiRNA target sequence
ttgggttctcgaagcctcttt

SEQ ID NO: 26264 - DNA, 21 bp, Artificial sequence
  SiRNA target sequence
tgggttctcgaagcctctttt

SEQ ID NO: 26265 - DNA, 21 bp, Artificial sequence
  SiRNA target sequence
gggttctcgaagcctcttttg

SEQ ID NO: 26266 - DNA, 21 bp, Artificial sequence
  SiRNA target sequence
ggttctcgaagcctcttttgc

SEQ ID NO: 26267 - DNA, 21 bp, Artificial sequence
  SiRNA target sequence
gttctcgaagcctcttttgcc

SEQ ID NO: 26268 - DNA, 21 bp, Artificial sequence
  SiRNA target sequence
ttctcgaagcctcttttgccc

SEQ ID NO: 26269 - DNA, 21 bp, Artificial sequence
  SiRNA target sequence
tctcgaagcctcttttgccca

SEQ ID NO: 26270 - DNA, 21 bp, Artificial sequence
  SiRNA target sequence
ctcgaagcctcttttgcccat

SEQ ID NO: 26271 - DNA, 21 bp, Artificial sequence
  SiRNA target sequence
tcgaagcctcttttgcccatt

SEQ ID NO: 26272 - DNA, 21 bp, Artificial sequence
  SiRNA target sequence
cgaagcctcttttgcccatta

SEQ ID NO: 26273 - DNA, 21 bp, Artificial sequence
  SiRNA target sequence
gaagcctcttttgcccattac

SEQ ID NO: 26274 - DNA, 21 bp, Artificial sequence
  SiRNA target sequence
aagcctcttttgcccattact

SEQ ID NO: 26275 - DNA, 21 bp, Artificial sequence
  SiRNA target sequence
agcctcttttgcccattacta

SEQ ID NO: 26276 - DNA, 21 bp, Artificial sequence
  SiRNA target sequence
gcctcttttgcccattactaa

SEQ ID NO: 26277 - DNA, 21 bp, Artificial sequence
  SiRNA target sequence
cctcttttgcccattactaat

SEQ ID NO: 26278 - DNA, 21 bp, Artificial sequence
  SiRNA target sequence
ctcttttgcccattactaatc

SEQ ID NO: 26279 - DNA, 21 bp, Artificial sequence
  SiRNA target sequence
tcttttgcccattactaatcc

SEQ ID NO: 26280 - DNA, 21 bp, Artificial sequence
  SiRNA target sequence
cttttgcccattactaatccc

SEQ ID NO: 26281 - DNA, 21 bp, Artificial sequence
  SiRNA target sequence
ttttgcccattactaatccca

SEQ ID NO: 26282 - DNA, 21 bp, Artificial sequence
  SiRNA target sequence
tttgcccattactaatcccac

SEQ ID NO: 26283 - DNA, 21 bp, Artificial sequence
  SiRNA target sequence
ttgcccattactaatcccacc

SEQ ID NO: 26284 - DNA, 21 bp, Artificial sequence
  SiRNA target sequence
tgcccattactaatcccaccg

SEQ ID NO: 26285 - DNA, 21 bp, Artificial sequence
  SiRNA target sequence
gcccattactaatcccaccgt

SEQ ID NO: 26286 - DNA, 21 bp, Artificial sequence
  SiRNA target sequence
cccattactaatcccaccgtt

SEQ ID NO: 26287 - DNA, 21 bp, Artificial sequence
  SiRNA target sequence
ccattactaatcccaccgttt

SEQ ID NO: 26288 - DNA, 21 bp, Artificial sequence
  SiRNA target sequence
cattactaatcccaccgtttt

SEQ ID NO: 26289 - DNA, 21 bp, Artificial sequence
  SiRNA target sequence
attactaatcccaccgttttg

SEQ ID NO: 26290 - DNA, 21 bp, Artificial sequence
  SiRNA target sequence
ttactaatcccaccgttttgc

SEQ ID NO: 26291 - DNA, 21 bp, Artificial sequence
  SiRNA target sequence
tactaatcccaccgttttgcg

SEQ ID NO: 26292 - DNA, 21 bp, Artificial sequence
  SiRNA target sequence
actaatcccaccgttttgcgg

SEQ ID NO: 26293 - DNA, 21 bp, Artificial sequence
  SiRNA target sequence
ctaatcccaccgttttgcggc

SEQ ID NO: 26294 - DNA, 21 bp, Artificial sequence
  SiRNA target sequence
taatcccaccgttttgcggcc

SEQ ID NO: 26295 - DNA, 21 bp, Artificial sequence
  SiRNA target sequence
aatcccaccgttttgcggcct

SEQ ID NO: 26296 - DNA, 21 bp, Artificial sequence
  SiRNA target sequence
atcccaccgttttgcggcctg

SEQ ID NO: 26297 - DNA, 21 bp, Artificial sequence
  SiRNA target sequence
tcccaccgttttgcggcctgc

SEQ ID NO: 26298 - DNA, 21 bp, Artificial sequence
  SiRNA target sequence
cccaccgttttgcggcctgcg

SEQ ID NO: 26299 - DNA, 21 bp, Artificial sequence
  SiRNA target sequence
ccaccgttttgcggcctgcga

SEQ ID NO: 26300 - DNA, 21 bp, Artificial sequence
  SiRNA target sequence
caccgttttgcggcctgcgaa

SEQ ID NO: 26301 - DNA, 21 bp, Artificial sequence
  SiRNA target sequence
accgttttgcggcctgcgaat

SEQ ID NO: 26302 - DNA, 21 bp, Artificial sequence
  SiRNA target sequence
ccgttttgcggcctgcgaata

SEQ ID NO: 26303 - DNA, 21 bp, Artificial sequence
  SiRNA target sequence
cgttttgcggcctgcgaatac

SEQ ID NO: 26304 - DNA, 21 bp, Artificial sequence
  SiRNA target sequence
gttttgcggcctgcgaatacc

SEQ ID NO: 26305 - DNA, 21 bp, Artificial sequence
  SiRNA target sequence
ttttgcggcctgcgaatacct

SEQ ID NO: 26306 - DNA, 21 bp, Artificial sequence
  SiRNA target sequence
tttgcggcctgcgaatacctt

SEQ ID NO: 26307 - DNA, 21 bp, Artificial sequence
  SiRNA target sequence
ttgcggcctgcgaataccttt

SEQ ID NO: 26308 - DNA, 21 bp, Artificial sequence
  SiRNA target sequence
tgcggcctgcgaatacctttg

SEQ ID NO: 26309 - DNA, 21 bp, Artificial sequence
  SiRNA target sequence
gcggcctgcgaatacctttgc

SEQ ID NO: 26310 - DNA, 21 bp, Artificial sequence
  SiRNA target sequence
cggcctgcgaatacctttgct

SEQ ID NO: 26311 - DNA, 21 bp, Artificial sequence
  SiRNA target sequence
ggcctgcgaatacctttgcta

SEQ ID NO: 26312 - DNA, 21 bp, Artificial sequence
  SiRNA target sequence
gcctgcgaatacctttgctat

SEQ ID NO: 26313 - DNA, 21 bp, Artificial sequence
  SiRNA target sequence
cctgcgaatacctttgctatc

SEQ ID NO: 26314 - DNA, 21 bp, Artificial sequence
  SiRNA target sequence
ctgcgaatacctttgctatca

SEQ ID NO: 26315 - DNA, 21 bp, Artificial sequence
  SiRNA target sequence
tgcgaatacctttgctatcac

SEQ ID NO: 26316 - DNA, 21 bp, Artificial sequence
  SiRNA target sequence
gcgaatacctttgctatcact

SEQ ID NO: 26317 - DNA, 21 bp, Artificial sequence
  SiRNA target sequence
cgaatacctttgctatcactg

SEQ ID NO: 26318 - DNA, 21 bp, Artificial sequence
  SiRNA target sequence
gaatacctttgctatcactga

SEQ ID NO: 26319 - DNA, 21 bp, Artificial sequence
  SiRNA target sequence
aatacctttgctatcactgat

SEQ ID NO: 26320 - DNA, 21 bp, Artificial sequence
  SiRNA target sequence
atacctttgctatcactgata

SEQ ID NO: 26321 - DNA, 21 bp, Artificial sequence
  SiRNA target sequence
tacctttgctatcactgatac

SEQ ID NO: 26322 - DNA, 21 bp, Artificial sequence
  SiRNA target sequence
acctttgctatcactgatacc

SEQ ID NO: 26323 - DNA, 21 bp, Artificial sequence
  SiRNA target sequence
cctttgctatcactgatacca

SEQ ID NO: 26324 - DNA, 21 bp, Artificial sequence
  SiRNA target sequence
ctttgctatcactgataccaa

SEQ ID NO: 26325 - DNA, 21 bp, Artificial sequence
  SiRNA target sequence
tttgctatcactgataccaat

SEQ ID NO: 26326 - DNA, 21 bp, Artificial sequence
  SiRNA target sequence
ttgctatcactgataccaatg

SEQ ID NO: 26327 - DNA, 21 bp, Artificial sequence
  SiRNA target sequence
tgctatcactgataccaatga

SEQ ID NO: 26328 - DNA, 21 bp, Artificial sequence
  SiRNA target sequence
gctatcactgataccaatgat

SEQ ID NO: 26329 - DNA, 21 bp, Artificial sequence
  SiRNA target sequence
ctatcactgataccaatgata

SEQ ID NO: 26330 - DNA, 21 bp, Artificial sequence
  SiRNA target sequence
tatcactgataccaatgatat

SEQ ID NO: 26331 - DNA, 21 bp, Artificial sequence
  SiRNA target sequence
atcactgataccaatgatatg

SEQ ID NO: 26332 - DNA, 21 bp, Artificial sequence
  SiRNA target sequence
tcactgataccaatgatatgt

SEQ ID NO: 26333 - DNA, 21 bp, Artificial sequence
  SiRNA target sequence
cactgataccaatgatatgtc

SEQ ID NO: 26334 - DNA, 21 bp, Artificial sequence
  SiRNA target sequence
actgataccaatgatatgtcg

SEQ ID NO: 26335 - DNA, 21 bp, Artificial sequence
  SiRNA target sequence
ctgataccaatgatatgtcgc

SEQ ID NO: 26336 - DNA, 21 bp, Artificial sequence
  SiRNA target sequence
tgataccaatgatatgtcgca

SEQ ID NO: 26337 - DNA, 21 bp, Artificial sequence
  SiRNA target sequence
gataccaatgatatgtcgcat

SEQ ID NO: 26338 - DNA, 21 bp, Artificial sequence
  SiRNA target sequence
ataccaatgatatgtcgcata

SEQ ID NO: 26339 - DNA, 21 bp, Artificial sequence
  SiRNA target sequence
taccaatgatatgtcgcatag

SEQ ID NO: 26340 - DNA, 21 bp, Artificial sequence
  SiRNA target sequence
accaatgatatgtcgcatagt

SEQ ID NO: 26341 - DNA, 21 bp, Artificial sequence
  SiRNA target sequence
ccaatgatatgtcgcatagtc

SEQ ID NO: 26342 - DNA, 21 bp, Artificial sequence
  SiRNA target sequence
caatgatatgtcgcatagtct

SEQ ID NO: 26343 - DNA, 21 bp, Artificial sequence
  SiRNA target sequence
aatgatatgtcgcatagtctg

SEQ ID NO: 26344 - DNA, 21 bp, Artificial sequence
  SiRNA target sequence
atgatatgtcgcatagtctgg

SEQ ID NO: 26345 - DNA, 21 bp, Artificial sequence
  SiRNA target sequence
tgatatgtcgcatagtctggc

SEQ ID NO: 26346 - DNA, 21 bp, Artificial sequence
  SiRNA target sequence
gatatgtcgcatagtctggcg

SEQ ID NO: 26347 - DNA, 21 bp, Artificial sequence
  SiRNA target sequence
atatgtcgcatagtctggcgc

SEQ ID NO: 26348 - DNA, 21 bp, Artificial sequence
  SiRNA target sequence
tatgtcgcatagtctggcgct

SEQ ID NO: 26349 - DNA, 21 bp, Artificial sequence
  SiRNA target sequence
atgtcgcatagtctggcgctt

SEQ ID NO: 26350 - DNA, 21 bp, Artificial sequence
  SiRNA target sequence
tgtcgcatagtctggcgcttt

SEQ ID NO: 26351 - DNA, 21 bp, Artificial sequence
  SiRNA target sequence
gtcgcatagtctggcgctttc

SEQ ID NO: 26352 - DNA, 21 bp, Artificial sequence
  SiRNA target sequence
tcgcatagtctggcgctttct

SEQ ID NO: 26353 - DNA, 21 bp, Artificial sequence
  SiRNA target sequence
cgcatagtctggcgctttcta

SEQ ID NO: 26354 - DNA, 21 bp, Artificial sequence
  SiRNA target sequence
gcatagtctggcgctttctaa

SEQ ID NO: 26355 - DNA, 21 bp, Artificial sequence
  SiRNA target sequence
catagtctggcgctttctaac

SEQ ID NO: 26356 - DNA, 21 bp, Artificial sequence
  SiRNA target sequence
atagtctggcgctttctaacg

SEQ ID NO: 26357 - DNA, 21 bp, Artificial sequence
  SiRNA target sequence
tagtctggcgctttctaacga

SEQ ID NO: 26358 - DNA, 21 bp, Artificial sequence
  SiRNA target sequence
agtctggcgctttctaacgat

SEQ ID NO: 26359 - DNA, 21 bp, Artificial sequence
  SiRNA target sequence
gtctggcgctttctaacgata

SEQ ID NO: 26360 - DNA, 21 bp, Artificial sequence
  SiRNA target sequence
tctggcgctttctaacgatac

SEQ ID NO: 26361 - DNA, 21 bp, Artificial sequence
  SiRNA target sequence
ctggcgctttctaacgatact

SEQ ID NO: 26362 - DNA, 21 bp, Artificial sequence
  SiRNA target sequence
tggcgctttctaacgatacta

SEQ ID NO: 26363 - DNA, 21 bp, Artificial sequence
  SiRNA target sequence
ggcgctttctaacgatactaa

SEQ ID NO: 26364 - DNA, 21 bp, Artificial sequence
  SiRNA target sequence
gcgctttctaacgatactaat

SEQ ID NO: 26365 - DNA, 21 bp, Artificial sequence
  SiRNA target sequence
cgctttctaacgatactaatg

SEQ ID NO: 26366 - DNA, 21 bp, Artificial sequence
  SiRNA target sequence
gctttctaacgatactaatgt

SEQ ID NO: 26367 - DNA, 21 bp, Artificial sequence
  SiRNA target sequence
ctttctaacgatactaatgta

SEQ ID NO: 26368 - DNA, 21 bp, Artificial sequence
  SiRNA target sequence
tttctaacgatactaatgtac

SEQ ID NO: 26369 - DNA, 21 bp, Artificial sequence
  SiRNA target sequence
ttctaacgatactaatgtacc

SEQ ID NO: 26370 - DNA, 21 bp, Artificial sequence
  SiRNA target sequence
tctaacgatactaatgtaccg

SEQ ID NO: 26371 - DNA, 21 bp, Artificial sequence
  SiRNA target sequence
ctaacgatactaatgtaccgt

SEQ ID NO: 26372 - DNA, 21 bp, Artificial sequence
  SiRNA target sequence
taacgatactaatgtaccgtt

SEQ ID NO: 26373 - DNA, 21 bp, Artificial sequence
  SiRNA target sequence
aacgatactaatgtaccgttt

SEQ ID NO: 26374 - DNA, 21 bp, Artificial sequence
  SiRNA target sequence
acgatactaatgtaccgtttg

SEQ ID NO: 26375 - DNA, 21 bp, Artificial sequence
  SiRNA target sequence
cgatactaatgtaccgtttgt

SEQ ID NO: 26376 - DNA, 21 bp, Artificial sequence
  SiRNA target sequence
gatactaatgtaccgtttgtt

SEQ ID NO: 26377 - DNA, 21 bp, Artificial sequence
  SiRNA target sequence
atactaatgtaccgtttgtta

SEQ ID NO: 26378 - DNA, 21 bp, Artificial sequence
  SiRNA target sequence
tactaatgtaccgtttgttaa

SEQ ID NO: 26379 - DNA, 21 bp, Artificial sequence
  SiRNA target sequence
actaatgtaccgtttgttaag

SEQ ID NO: 26380 - DNA, 21 bp, Artificial sequence
  SiRNA target sequence
ctaatgtaccgtttgttaagg

SEQ ID NO: 26381 - DNA, 21 bp, Artificial sequence
  SiRNA target sequence
taatgtaccgtttgttaaggc

SEQ ID NO: 26382 - DNA, 21 bp, Artificial sequence
  SiRNA target sequence
aatgtaccgtttgttaaggcg

SEQ ID NO: 26383 - DNA, 21 bp, Artificial sequence
  SiRNA target sequence
atgtaccgtttgttaaggcgc

SEQ ID NO: 26384 - DNA, 21 bp, Artificial sequence
  SiRNA target sequence
tgtaccgtttgttaaggcgct

SEQ ID NO: 26385 - DNA, 21 bp, Artificial sequence
  SiRNA target sequence
gtaccgtttgttaaggcgctt

SEQ ID NO: 26386 - DNA, 21 bp, Artificial sequence
  SiRNA target sequence
taccgtttgttaaggcgcttg

SEQ ID NO: 26387 - DNA, 21 bp, Artificial sequence
  SiRNA target sequence
accgtttgttaaggcgcttga

SEQ ID NO: 26388 - DNA, 21 bp, Artificial sequence
  SiRNA target sequence
ccgtttgttaaggcgcttgat

SEQ ID NO: 26389 - DNA, 21 bp, Artificial sequence
  SiRNA target sequence
cgtttgttaaggcgcttgatg

SEQ ID NO: 26390 - DNA, 21 bp, Artificial sequence
  SiRNA target sequence
gtttgttaaggcgcttgatgg

SEQ ID NO: 26391 - DNA, 21 bp, Artificial sequence
  SiRNA target sequence
tttgttaaggcgcttgatggg

SEQ ID NO: 26392 - DNA, 21 bp, Artificial sequence
  SiRNA target sequence
ttgttaaggcgcttgatgggt

SEQ ID NO: 26393 - DNA, 21 bp, Artificial sequence
  SiRNA target sequence
tgttaaggcgcttgatgggtc

SEQ ID NO: 26394 - DNA, 21 bp, Artificial sequence
  SiRNA target sequence
gttaaggcgcttgatgggtca

SEQ ID NO: 26395 - DNA, 21 bp, Artificial sequence
  SiRNA target sequence
ttaaggcgcttgatgggtcag

SEQ ID NO: 26396 - DNA, 21 bp, Artificial sequence
  SiRNA target sequence
taaggcgcttgatgggtcagg

SEQ ID NO: 26397 - DNA, 21 bp, Artificial sequence
  SiRNA target sequence
aaggcgcttgatgggtcaggt

SEQ ID NO: 26398 - DNA, 21 bp, Artificial sequence
  SiRNA target sequence
aggcgcttgatgggtcaggtt

SEQ ID NO: 26399 - DNA, 21 bp, Artificial sequence
  SiRNA target sequence
ggcgcttgatgggtcaggttt

SEQ ID NO: 26400 - DNA, 21 bp, Artificial sequence
  SiRNA target sequence
gcgcttgatgggtcaggtttg

SEQ ID NO: 26401 - DNA, 21 bp, Artificial sequence
  SiRNA target sequence
cgcttgatgggtcaggtttgg

SEQ ID NO: 26402 - DNA, 21 bp, Artificial sequence
  SiRNA target sequence
gcttgatgggtcaggtttgga

SEQ ID NO: 26403 - DNA, 21 bp, Artificial sequence
  SiRNA target sequence
cttgatgggtcaggtttggac

SEQ ID NO: 26404 - DNA, 21 bp, Artificial sequence
  SiRNA target sequence
ttgatgggtcaggtttggacg

SEQ ID NO: 26405 - DNA, 21 bp, Artificial sequence
  SiRNA target sequence
tgatgggtcaggtttggacga

SEQ ID NO: 26406 - DNA, 21 bp, Artificial sequence
  SiRNA target sequence
gatgggtcaggtttggacgaa

SEQ ID NO: 26407 - DNA, 21 bp, Artificial sequence
  SiRNA target sequence
atgggtcaggtttggacgaaa

SEQ ID NO: 26408 - DNA, 21 bp, Artificial sequence
  SiRNA target sequence
tgggtcaggtttggacgaaat

SEQ ID NO: 26409 - DNA, 21 bp, Artificial sequence
  SiRNA target sequence
gggtcaggtttggacgaaatg

SEQ ID NO: 26410 - DNA, 21 bp, Artificial sequence
  SiRNA target sequence
ggtcaggtttggacgaaatga

SEQ ID NO: 26411 - DNA, 21 bp, Artificial sequence
  SiRNA target sequence
gtcaggtttggacgaaatgag

SEQ ID NO: 26412 - DNA, 21 bp, Artificial sequence
  SiRNA target sequence
tcaggtttggacgaaatgagt

SEQ ID NO: 26413 - DNA, 21 bp, Artificial sequence
  SiRNA target sequence
caggtttggacgaaatgagtt

SEQ ID NO: 26414 - DNA, 21 bp, Artificial sequence
  SiRNA target sequence
aggtttggacgaaatgagttt

SEQ ID NO: 26415 - DNA, 21 bp, Artificial sequence
  SiRNA target sequence
ggtttggacgaaatgagtttc

SEQ ID NO: 26416 - DNA, 21 bp, Artificial sequence
  SiRNA target sequence
gtttggacgaaatgagtttcg

SEQ ID NO: 26417 - DNA, 21 bp, Artificial sequence
  SiRNA target sequence
tttggacgaaatgagtttcga

SEQ ID NO: 26418 - DNA, 21 bp, Artificial sequence
  SiRNA target sequence
ttggacgaaatgagtttcgat

SEQ ID NO: 26419 - DNA, 21 bp, Artificial sequence
  SiRNA target sequence
tggacgaaatgagtttcgatt

SEQ ID NO: 26420 - DNA, 21 bp, Artificial sequence
  SiRNA target sequence
ggacgaaatgagtttcgatta

SEQ ID NO: 26421 - DNA, 21 bp, Artificial sequence
  SiRNA target sequence
gacgaaatgagtttcgattac

SEQ ID NO: 26422 - DNA, 21 bp, Artificial sequence
  SiRNA target sequence
acgaaatgagtttcgattacc

SEQ ID NO: 26423 - DNA, 21 bp, Artificial sequence
  SiRNA target sequence
cgaaatgagtttcgattacct

SEQ ID NO: 26424 - DNA, 21 bp, Artificial sequence
  SiRNA target sequence
gaaatgagtttcgattaccta

SEQ ID NO: 26425 - DNA, 21 bp, Artificial sequence
  SiRNA target sequence
aaatgagtttcgattacctaa

SEQ ID NO: 26426 - DNA, 21 bp, Artificial sequence
  SiRNA target sequence
aatgagtttcgattacctaaa

SEQ ID NO: 26427 - DNA, 21 bp, Artificial sequence
  SiRNA target sequence
atgagtttcgattacctaaag

SEQ ID NO: 26428 - DNA, 21 bp, Artificial sequence
  SiRNA target sequence
tgagtttcgattacctaaaga

SEQ ID NO: 26429 - DNA, 21 bp, Artificial sequence
  SiRNA target sequence
gagtttcgattacctaaagaa

SEQ ID NO: 26430 - DNA, 21 bp, Artificial sequence
  SiRNA target sequence
agtttcgattacctaaagaaa

SEQ ID NO: 26431 - DNA, 21 bp, Artificial sequence
  SiRNA target sequence
gtttcgattacctaaagaaaa

SEQ ID NO: 26432 - DNA, 21 bp, Artificial sequence
  SiRNA target sequence
tttcgattacctaaagaaaat

SEQ ID NO: 26433 - DNA, 21 bp, Artificial sequence
  SiRNA target sequence
ttcgattacctaaagaaaata

SEQ ID NO: 26434 - DNA, 21 bp, Artificial sequence
  SiRNA target sequence
tcgattacctaaagaaaatac

SEQ ID NO: 26435 - DNA, 21 bp, Artificial sequence
  SiRNA target sequence
cgattacctaaagaaaatacc

SEQ ID NO: 26436 - DNA, 21 bp, Artificial sequence
  SiRNA target sequence
gattacctaaagaaaataccc

SEQ ID NO: 26437 - DNA, 21 bp, Artificial sequence
  SiRNA target sequence
attacctaaagaaaatacccc

SEQ ID NO: 26438 - DNA, 21 bp, Artificial sequence
  SiRNA target sequence
ttacctaaagaaaatacccca

SEQ ID NO: 26439 - DNA, 21 bp, Artificial sequence
  SiRNA target sequence
tacctaaagaaaataccccaa

SEQ ID NO: 26440 - DNA, 21 bp, Artificial sequence
  SiRNA target sequence
acctaaagaaaataccccaat

SEQ ID NO: 26441 - DNA, 21 bp, Artificial sequence
  SiRNA target sequence
cctaaagaaaataccccaatt

SEQ ID NO: 26442 - DNA, 21 bp, Artificial sequence
  SiRNA target sequence
ctaaagaaaataccccaattc

SEQ ID NO: 26443 - DNA, 21 bp, Artificial sequence
  SiRNA target sequence
taaagaaaataccccaattca

SEQ ID NO: 26444 - DNA, 21 bp, Artificial sequence
  SiRNA target sequence
aaagaaaataccccaattcat

SEQ ID NO: 26445 - DNA, 21 bp, Artificial sequence
  SiRNA target sequence
aagaaaataccccaattcata

SEQ ID NO: 26446 - DNA, 21 bp, Artificial sequence
  SiRNA target sequence
agaaaataccccaattcatac

SEQ ID NO: 26447 - DNA, 21 bp, Artificial sequence
  SiRNA target sequence
gaaaataccccaattcataca

SEQ ID NO: 26448 - DNA, 21 bp, Artificial sequence
  SiRNA target sequence
aaaataccccaattcatacag

SEQ ID NO: 26449 - DNA, 21 bp, Artificial sequence
  SiRNA target sequence
aaataccccaattcatacagt

SEQ ID NO: 26450 - DNA, 21 bp, Artificial sequence
  SiRNA target sequence
aataccccaattcatacagtc

SEQ ID NO: 26451 - DNA, 21 bp, Artificial sequence
  SiRNA target sequence
ataccccaattcatacagtca

SEQ ID NO: 26452 - DNA, 21 bp, Artificial sequence
  SiRNA target sequence
taccccaattcatacagtcaa

SEQ ID NO: 26453 - DNA, 21 bp, Artificial sequence
  SiRNA target sequence
accccaattcatacagtcaaa

SEQ ID NO: 26454 - DNA, 21 bp, Artificial sequence
  SiRNA target sequence
ccccaattcatacagtcaaag

SEQ ID NO: 26455 - DNA, 21 bp, Artificial sequence
  SiRNA target sequence
cccaattcatacagtcaaagt

SEQ ID NO: 26456 - DNA, 21 bp, Artificial sequence
  SiRNA target sequence
ccaattcatacagtcaaagtt

SEQ ID NO: 26457 - DNA, 21 bp, Artificial sequence
  SiRNA target sequence
caattcatacagtcaaagttc

SEQ ID NO: 26458 - DNA, 21 bp, Artificial sequence
  SiRNA target sequence
aattcatacagtcaaagttct

SEQ ID NO: 26459 - DNA, 21 bp, Artificial sequence
  SiRNA target sequence
attcatacagtcaaagttctt

SEQ ID NO: 26460 - DNA, 21 bp, Artificial sequence
  SiRNA target sequence
ttcatacagtcaaagttcttc

SEQ ID NO: 26461 - DNA, 21 bp, Artificial sequence
  SiRNA target sequence
tcatacagtcaaagttcttca

SEQ ID NO: 26462 - DNA, 21 bp, Artificial sequence
  SiRNA target sequence
catacagtcaaagttcttcac

SEQ ID NO: 26463 - DNA, 21 bp, Artificial sequence
  SiRNA target sequence
atacagtcaaagttcttcacc

SEQ ID NO: 26464 - DNA, 21 bp, Artificial sequence
  SiRNA target sequence
tacagtcaaagttcttcacca

SEQ ID NO: 26465 - DNA, 21 bp, Artificial sequence
  SiRNA target sequence
acagtcaaagttcttcaccac

SEQ ID NO: 26466 - DNA, 21 bp, Artificial sequence
  SiRNA target sequence
cagtcaaagttcttcaccacc

SEQ ID NO: 26467 - DNA, 21 bp, Artificial sequence
  SiRNA target sequence
agtcaaagttcttcaccacct

SEQ ID NO: 26468 - DNA, 21 bp, Artificial sequence
  SiRNA target sequence
gtcaaagttcttcaccacctc

SEQ ID NO: 26469 - DNA, 21 bp, Artificial sequence
  SiRNA target sequence
tcaaagttcttcaccacctca

SEQ ID NO: 26470 - DNA, 21 bp, Artificial sequence
  SiRNA target sequence
caaagttcttcaccacctcaa

SEQ ID NO: 26471 - DNA, 21 bp, Artificial sequence
  SiRNA target sequence
aaagttcttcaccacctcaac

SEQ ID NO: 26472 - DNA, 21 bp, Artificial sequence
  SiRNA target sequence
aagttcttcaccacctcaact

SEQ ID NO: 26473 - DNA, 21 bp, Artificial sequence
  SiRNA target sequence
agttcttcaccacctcaacta

SEQ ID NO: 26474 - DNA, 21 bp, Artificial sequence
  SiRNA target sequence
gttcttcaccacctcaactaa

SEQ ID NO: 26475 - DNA, 21 bp, Artificial sequence
  SiRNA target sequence
ttcttcaccacctcaactaaa

SEQ ID NO: 26476 - DNA, 21 bp, Artificial sequence
  SiRNA target sequence
tcttcaccacctcaactaaac

SEQ ID NO: 26477 - DNA, 21 bp, Artificial sequence
  SiRNA target sequence
cttcaccacctcaactaaacc

SEQ ID NO: 26478 - DNA, 21 bp, Artificial sequence
  SiRNA target sequence
ttcaccacctcaactaaacct

SEQ ID NO: 26479 - DNA, 21 bp, Artificial sequence
  SiRNA target sequence
tcaccacctcaactaaacctc

SEQ ID NO: 26480 - DNA, 21 bp, Artificial sequence
  SiRNA target sequence
caccacctcaactaaacctca

SEQ ID NO: 26481 - DNA, 21 bp, Artificial sequence
  SiRNA target sequence
accacctcaactaaacctcaa

SEQ ID NO: 26482 - DNA, 21 bp, Artificial sequence
  SiRNA target sequence
ccacctcaactaaacctcaag

SEQ ID NO: 26483 - DNA, 21 bp, Artificial sequence
  SiRNA target sequence
cacctcaactaaacctcaaga

SEQ ID NO: 26484 - DNA, 21 bp, Artificial sequence
  SiRNA target sequence
acctcaactaaacctcaagag

SEQ ID NO: 26485 - DNA, 21 bp, Artificial sequence
  SiRNA target sequence
cctcaactaaacctcaagagg

SEQ ID NO: 26486 - DNA, 21 bp, Artificial sequence
  SiRNA target sequence
ctcaactaaacctcaagaggt

SEQ ID NO: 26487 - DNA, 21 bp, Artificial sequence
  SiRNA target sequence
tcaactaaacctcaagaggtt

SEQ ID NO: 26488 - DNA, 21 bp, Artificial sequence
  SiRNA target sequence
caactaaacctcaagaggttc

SEQ ID NO: 26489 - DNA, 21 bp, Artificial sequence
  SiRNA target sequence
aactaaacctcaagaggttct

SEQ ID NO: 26490 - DNA, 21 bp, Artificial sequence
  SiRNA target sequence
actaaacctcaagaggttctg

SEQ ID NO: 26491 - DNA, 21 bp, Artificial sequence
  SiRNA target sequence
ctaaacctcaagaggttctgt

SEQ ID NO: 26492 - DNA, 21 bp, Artificial sequence
  SiRNA target sequence
taaacctcaagaggttctgtt

SEQ ID NO: 26493 - DNA, 21 bp, Artificial sequence
  SiRNA target sequence
aaacctcaagaggttctgttt

SEQ ID NO: 26494 - DNA, 21 bp, Artificial sequence
  SiRNA target sequence
aacctcaagaggttctgtttc

SEQ ID NO: 26495 - DNA, 21 bp, Artificial sequence
  SiRNA target sequence
acctcaagaggttctgtttca

SEQ ID NO: 26496 - DNA, 21 bp, Artificial sequence
  SiRNA target sequence
cctcaagaggttctgtttcag

SEQ ID NO: 26497 - DNA, 21 bp, Artificial sequence
  SiRNA target sequence
ctcaagaggttctgtttcaga

SEQ ID NO: 26498 - DNA, 21 bp, Artificial sequence
  SiRNA target sequence
tcaagaggttctgtttcagac

SEQ ID NO: 26499 - DNA, 21 bp, Artificial sequence
  SiRNA target sequence
caagaggttctgtttcagact

SEQ ID NO: 26500 - DNA, 21 bp, Artificial sequence
  SiRNA target sequence
aagaggttctgtttcagacta

SEQ ID NO: 26501 - DNA, 21 bp, Artificial sequence
  SiRNA target sequence
agaggttctgtttcagactaa

SEQ ID NO: 26502 - DNA, 21 bp, Artificial sequence
  SiRNA target sequence
gaggttctgtttcagactaaa

SEQ ID NO: 26503 - DNA, 21 bp, Artificial sequence
  SiRNA target sequence
aggttctgtttcagactaaag

SEQ ID NO: 26504 - DNA, 21 bp, Artificial sequence
  SiRNA target sequence
ggttctgtttcagactaaagt

SEQ ID NO: 26505 - DNA, 21 bp, Artificial sequence
  SiRNA target sequence
gttctgtttcagactaaagtg

SEQ ID NO: 26506 - DNA, 21 bp, Artificial sequence
  SiRNA target sequence
ttctgtttcagactaaagtga

SEQ ID NO: 26507 - DNA, 21 bp, Artificial sequence
  SiRNA target sequence
tctgtttcagactaaagtgat

SEQ ID NO: 26508 - DNA, 21 bp, Artificial sequence
  SiRNA target sequence
ctgtttcagactaaagtgatg

SEQ ID NO: 26509 - DNA, 21 bp, Artificial sequence
  SiRNA target sequence
tgtttcagactaaagtgatgc

SEQ ID NO: 26510 - DNA, 21 bp, Artificial sequence
  SiRNA target sequence
gtttcagactaaagtgatgcc

SEQ ID NO: 26511 - DNA, 21 bp, Artificial sequence
  SiRNA target sequence
tttcagactaaagtgatgcca

SEQ ID NO: 26512 - DNA, 21 bp, Artificial sequence
  SiRNA target sequence
ttcagactaaagtgatgccac

SEQ ID NO: 26513 - DNA, 21 bp, Artificial sequence
  SiRNA target sequence
tcagactaaagtgatgccaca

SEQ ID NO: 26514 - DNA, 21 bp, Artificial sequence
  SiRNA target sequence
cagactaaagtgatgccacat

SEQ ID NO: 26515 - DNA, 21 bp, Artificial sequence
  SiRNA target sequence
agactaaagtgatgccacatt

SEQ ID NO: 26516 - DNA, 21 bp, Artificial sequence
  SiRNA target sequence
gactaaagtgatgccacatta

SEQ ID NO: 26517 - DNA, 21 bp, Artificial sequence
  SiRNA target sequence
actaaagtgatgccacattac

SEQ ID NO: 26518 - DNA, 21 bp, Artificial sequence
  SiRNA target sequence
ctaaagtgatgccacattact

SEQ ID NO: 26519 - DNA, 21 bp, Artificial sequence
  SiRNA target sequence
taaagtgatgccacattactt

SEQ ID NO: 26520 - DNA, 21 bp, Artificial sequence
  SiRNA target sequence
aaagtgatgccacattacttt

SEQ ID NO: 26521 - DNA, 21 bp, Artificial sequence
  SiRNA target sequence
aagtgatgccacattactttg

SEQ ID NO: 26522 - DNA, 21 bp, Artificial sequence
  SiRNA target sequence
agtgatgccacattactttgt

SEQ ID NO: 26523 - DNA, 21 bp, Artificial sequence
  SiRNA target sequence
gtgatgccacattactttgtc

SEQ ID NO: 26524 - DNA, 21 bp, Artificial sequence
  SiRNA target sequence
tgatgccacattactttgtcc

SEQ ID NO: 26525 - DNA, 21 bp, Artificial sequence
  SiRNA target sequence
gatgccacattactttgtccc

SEQ ID NO: 26526 - DNA, 21 bp, Artificial sequence
  SiRNA target sequence
atgccacattactttgtccct

SEQ ID NO: 26527 - DNA, 21 bp, Artificial sequence
  SiRNA target sequence
tgccacattactttgtccctg

SEQ ID NO: 26528 - DNA, 21 bp, Artificial sequence
  SiRNA target sequence
gccacattactttgtccctgc

SEQ ID NO: 26529 - DNA, 21 bp, Artificial sequence
  SiRNA target sequence
ccacattactttgtccctgct

SEQ ID NO: 26530 - DNA, 21 bp, Artificial sequence
  SiRNA target sequence
cacattactttgtccctgctg

SEQ ID NO: 26531 - DNA, 21 bp, Artificial sequence
  SiRNA target sequence
acattactttgtccctgctgg

SEQ ID NO: 26532 - DNA, 21 bp, Artificial sequence
  SiRNA target sequence
cattactttgtccctgctggt

SEQ ID NO: 26533 - DNA, 21 bp, Artificial sequence
  SiRNA target sequence
attactttgtccctgctggtg

SEQ ID NO: 26534 - DNA, 21 bp, Artificial sequence
  SiRNA target sequence
ttactttgtccctgctggtga

SEQ ID NO: 26535 - DNA, 21 bp, Artificial sequence
  SiRNA target sequence
tactttgtccctgctggtgat

SEQ ID NO: 26536 - DNA, 21 bp, Artificial sequence
  SiRNA target sequence
actttgtccctgctggtgatg

SEQ ID NO: 26537 - DNA, 21 bp, Artificial sequence
  SiRNA target sequence
ctttgtccctgctggtgatgt

SEQ ID NO: 26538 - DNA, 21 bp, Artificial sequence
  SiRNA target sequence
tttgtccctgctggtgatgtg

SEQ ID NO: 26539 - DNA, 21 bp, Artificial sequence
  SiRNA target sequence
ttgtccctgctggtgatgtga

SEQ ID NO: 26540 - DNA, 21 bp, Artificial sequence
  SiRNA target sequence
tgtccctgctggtgatgtgaa

SEQ ID NO: 26541 - DNA, 21 bp, Artificial sequence
  SiRNA target sequence
gtccctgctggtgatgtgaat

SEQ ID NO: 26542 - DNA, 21 bp, Artificial sequence
  SiRNA target sequence
tccctgctggtgatgtgaata

SEQ ID NO: 26543 - DNA, 21 bp, Artificial sequence
  SiRNA target sequence
ccctgctggtgatgtgaatat

SEQ ID NO: 26544 - DNA, 21 bp, Artificial sequence
  SiRNA target sequence
cctgctggtgatgtgaatatc

SEQ ID NO: 26545 - DNA, 21 bp, Artificial sequence
  SiRNA target sequence
ctgctggtgatgtgaatatcg

SEQ ID NO: 26546 - DNA, 21 bp, Artificial sequence
  SiRNA target sequence
tgctggtgatgtgaatatcgc

SEQ ID NO: 26547 - DNA, 21 bp, Artificial sequence
  SiRNA target sequence
gctggtgatgtgaatatcgct

SEQ ID NO: 26548 - DNA, 21 bp, Artificial sequence
  SiRNA target sequence
ctggtgatgtgaatatcgcta

SEQ ID NO: 26549 - DNA, 21 bp, Artificial sequence
  SiRNA target sequence
tggtgatgtgaatatcgctat

SEQ ID NO: 26550 - DNA, 21 bp, Artificial sequence
  SiRNA target sequence
ggtgatgtgaatatcgctatg

SEQ ID NO: 26551 - DNA, 21 bp, Artificial sequence
  SiRNA target sequence
gtgatgtgaatatcgctatgg

SEQ ID NO: 26552 - DNA, 21 bp, Artificial sequence
  SiRNA target sequence
tgatgtgaatatcgctatgga

SEQ ID NO: 26553 - DNA, 21 bp, Artificial sequence
  SiRNA target sequence
gatgtgaatatcgctatggac

SEQ ID NO: 26554 - DNA, 21 bp, Artificial sequence
  SiRNA target sequence
atgtgaatatcgctatggaca

SEQ ID NO: 26555 - DNA, 21 bp, Artificial sequence
  SiRNA target sequence
tgtgaatatcgctatggacaa

SEQ ID NO: 26556 - DNA, 21 bp, Artificial sequence
  SiRNA target sequence
gtgaatatcgctatggacaag

SEQ ID NO: 26557 - DNA, 21 bp, Artificial sequence
  SiRNA target sequence
tgaatatcgctatggacaagg

SEQ ID NO: 26558 - DNA, 21 bp, Artificial sequence
  SiRNA target sequence
gaatatcgctatggacaagga

SEQ ID NO: 26559 - DNA, 21 bp, Artificial sequence
  SiRNA target sequence
aatatcgctatggacaaggat

SEQ ID NO: 26560 - DNA, 21 bp, Artificial sequence
  SiRNA target sequence
atatcgctatggacaaggata

SEQ ID NO: 26561 - DNA, 21 bp, Artificial sequence
  SiRNA target sequence
tatcgctatggacaaggatac

SEQ ID NO: 26562 - DNA, 21 bp, Artificial sequence
  SiRNA target sequence
atcgctatggacaaggatacg

SEQ ID NO: 26563 - DNA, 21 bp, Artificial sequence
  SiRNA target sequence
tcgctatggacaaggatacga

SEQ ID NO: 26564 - DNA, 21 bp, Artificial sequence
  SiRNA target sequence
cgctatggacaaggatacgat

SEQ ID NO: 26565 - DNA, 21 bp, Artificial sequence
  SiRNA target sequence
gctatggacaaggatacgatt

SEQ ID NO: 26566 - DNA, 21 bp, Artificial sequence
  SiRNA target sequence
ctatggacaaggatacgatta

SEQ ID NO: 26567 - DNA, 21 bp, Artificial sequence
  SiRNA target sequence
tatggacaaggatacgattag

SEQ ID NO: 26568 - DNA, 21 bp, Artificial sequence
  SiRNA target sequence
atggacaaggatacgattaga

SEQ ID NO: 26569 - DNA, 21 bp, Artificial sequence
  SiRNA target sequence
tggacaaggatacgattagaa

SEQ ID NO: 26570 - DNA, 21 bp, Artificial sequence
  SiRNA target sequence
ggacaaggatacgattagaac

SEQ ID NO: 26571 - DNA, 21 bp, Artificial sequence
  SiRNA target sequence
gacaaggatacgattagaacg

SEQ ID NO: 26572 - DNA, 21 bp, Artificial sequence
  SiRNA target sequence
acaaggatacgattagaacga

SEQ ID NO: 26573 - DNA, 21 bp, Artificial sequence
  SiRNA target sequence
caaggatacgattagaacgat

SEQ ID NO: 26574 - DNA, 21 bp, Artificial sequence
  SiRNA target sequence
aaggatacgattagaacgatc

SEQ ID NO: 26575 - DNA, 21 bp, Artificial sequence
  SiRNA target sequence
aggatacgattagaacgatct

SEQ ID NO: 26576 - DNA, 21 bp, Artificial sequence
  SiRNA target sequence
ggatacgattagaacgatctg

SEQ ID NO: 26577 - DNA, 21 bp, Artificial sequence
  SiRNA target sequence
gatacgattagaacgatctgg

SEQ ID NO: 26578 - DNA, 21 bp, Artificial sequence
  SiRNA target sequence
atacgattagaacgatctggc

SEQ ID NO: 26579 - DNA, 21 bp, Artificial sequence
  SiRNA target sequence
tacgattagaacgatctggca

SEQ ID NO: 26580 - DNA, 21 bp, Artificial sequence
  SiRNA target sequence
acgattagaacgatctggcaa

SEQ ID NO: 26581 - DNA, 21 bp, Artificial sequence
  SiRNA target sequence
cgattagaacgatctggcaac

SEQ ID NO: 26582 - DNA, 21 bp, Artificial sequence
  SiRNA target sequence
gattagaacgatctggcaacc

SEQ ID NO: 26583 - DNA, 21 bp, Artificial sequence
  SiRNA target sequence
attagaacgatctggcaaccc

SEQ ID NO: 26584 - DNA, 21 bp, Artificial sequence
  SiRNA target sequence
ttagaacgatctggcaaccca

SEQ ID NO: 26585 - DNA, 21 bp, Artificial sequence
  SiRNA target sequence
tagaacgatctggcaacccag

SEQ ID NO: 26586 - DNA, 21 bp, Artificial sequence
  SiRNA target sequence
agaacgatctggcaacccagt

SEQ ID NO: 26587 - DNA, 21 bp, Artificial sequence
  SiRNA target sequence
gaacgatctggcaacccagtc

SEQ ID NO: 26588 - DNA, 21 bp, Artificial sequence
  SiRNA target sequence
aacgatctggcaacccagtca

SEQ ID NO: 26589 - DNA, 21 bp, Artificial sequence
  SiRNA target sequence
acgatctggcaacccagtcat

SEQ ID NO: 26590 - DNA, 21 bp, Artificial sequence
  SiRNA target sequence
cgatctggcaacccagtcatt

SEQ ID NO: 26591 - DNA, 21 bp, Artificial sequence
  SiRNA target sequence
gatctggcaacccagtcattt

SEQ ID NO: 26592 - DNA, 21 bp, Artificial sequence
  SiRNA target sequence
atctggcaacccagtcattta

SEQ ID NO: 26593 - DNA, 21 bp, Artificial sequence
  SiRNA target sequence
tctggcaacccagtcatttag

SEQ ID NO: 26594 - DNA, 21 bp, Artificial sequence
  SiRNA target sequence
ctggcaacccagtcatttagc

SEQ ID NO: 26595 - DNA, 21 bp, Artificial sequence
  SiRNA target sequence
tggcaacccagtcatttagct

SEQ ID NO: 26596 - DNA, 21 bp, Artificial sequence
  SiRNA target sequence
ggcaacccagtcatttagctt

SEQ ID NO: 26597 - DNA, 21 bp, Artificial sequence
  SiRNA target sequence
gcaacccagtcatttagctta

SEQ ID NO: 26598 - DNA, 21 bp, Artificial sequence
  SiRNA target sequence
caacccagtcatttagcttat

SEQ ID NO: 26599 - DNA, 21 bp, Artificial sequence
  SiRNA target sequence
aacccagtcatttagcttata

SEQ ID NO: 26600 - DNA, 21 bp, Artificial sequence
  SiRNA target sequence
acccagtcatttagcttatat

SEQ ID NO: 26601 - DNA, 21 bp, Artificial sequence
  SiRNA target sequence
cccagtcatttagcttatatc

SEQ ID NO: 26602 - DNA, 21 bp, Artificial sequence
  SiRNA target sequence
ccagtcatttagcttatatca

SEQ ID NO: 26603 - DNA, 21 bp, Artificial sequence
  SiRNA target sequence
cagtcatttagcttatatcac

SEQ ID NO: 26604 - DNA, 21 bp, Artificial sequence
  SiRNA target sequence
agtcatttagcttatatcact

SEQ ID NO: 26605 - DNA, 21 bp, Artificial sequence
  SiRNA target sequence
gtcatttagcttatatcactt

SEQ ID NO: 26606 - DNA, 21 bp, Artificial sequence
  SiRNA target sequence
tcatttagcttatatcacttc

SEQ ID NO: 26607 - DNA, 21 bp, Artificial sequence
  SiRNA target sequence
catttagcttatatcacttcc

SEQ ID NO: 26608 - DNA, 21 bp, Artificial sequence
  SiRNA target sequence
atttagcttatatcacttcca

SEQ ID NO: 26609 - DNA, 21 bp, Artificial sequence
  SiRNA target sequence
tttagcttatatcacttccat

SEQ ID NO: 26610 - DNA, 21 bp, Artificial sequence
  SiRNA target sequence
ttagcttatatcacttccatg

SEQ ID NO: 26611 - DNA, 21 bp, Artificial sequence
  SiRNA target sequence
tagcttatatcacttccatgt

SEQ ID NO: 26612 - DNA, 21 bp, Artificial sequence
  SiRNA target sequence
agcttatatcacttccatgtt

SEQ ID NO: 26613 - DNA, 21 bp, Artificial sequence
  SiRNA target sequence
gcttatatcacttccatgttc

SEQ ID NO: 26614 - DNA, 21 bp, Artificial sequence
  SiRNA target sequence
cttatatcacttccatgttca

SEQ ID NO: 26615 - DNA, 21 bp, Artificial sequence
  SiRNA target sequence
ttatatcacttccatgttcaa

SEQ ID NO: 26616 - DNA, 21 bp, Artificial sequence
  SiRNA target sequence
tatatcacttccatgttcaag

SEQ ID NO: 26617 - DNA, 21 bp, Artificial sequence
  SiRNA target sequence
atatcacttccatgttcaagt

SEQ ID NO: 26618 - DNA, 21 bp, Artificial sequence
  SiRNA target sequence
tatcacttccatgttcaagta

SEQ ID NO: 26619 - DNA, 21 bp, Artificial sequence
  SiRNA target sequence
atcacttccatgttcaagtat

SEQ ID NO: 26620 - DNA, 21 bp, Artificial sequence
  SiRNA target sequence
tcacttccatgttcaagtatt

SEQ ID NO: 26621 - DNA, 21 bp, Artificial sequence
  SiRNA target sequence
cacttccatgttcaagtattg

SEQ ID NO: 26622 - DNA, 21 bp, Artificial sequence
  SiRNA target sequence
acttccatgttcaagtattgg

SEQ ID NO: 26623 - DNA, 21 bp, Artificial sequence
  SiRNA target sequence
cttccatgttcaagtattgga

SEQ ID NO: 26624 - DNA, 21 bp, Artificial sequence
  SiRNA target sequence
ttccatgttcaagtattggac

SEQ ID NO: 26625 - DNA, 21 bp, Artificial sequence
  SiRNA target sequence
tccatgttcaagtattggacg

SEQ ID NO: 26626 - DNA, 21 bp, Artificial sequence
  SiRNA target sequence
ccatgttcaagtattggacgg

SEQ ID NO: 26627 - DNA, 21 bp, Artificial sequence
  SiRNA target sequence
catgttcaagtattggacggg

SEQ ID NO: 26628 - DNA, 21 bp, Artificial sequence
  SiRNA target sequence
atgttcaagtattggacgggt

SEQ ID NO: 26629 - DNA, 21 bp, Artificial sequence
  SiRNA target sequence
tgttcaagtattggacgggtt

SEQ ID NO: 26630 - DNA, 21 bp, Artificial sequence
  SiRNA target sequence
gttcaagtattggacgggttc

SEQ ID NO: 26631 - DNA, 21 bp, Artificial sequence
  SiRNA target sequence
ttcaagtattggacgggttcg

SEQ ID NO: 26632 - DNA, 21 bp, Artificial sequence
  SiRNA target sequence
tcaagtattggacgggttcgc

SEQ ID NO: 26633 - DNA, 21 bp, Artificial sequence
  SiRNA target sequence
caagtattggacgggttcgct

SEQ ID NO: 26634 - DNA, 21 bp, Artificial sequence
  SiRNA target sequence
aagtattggacgggttcgctc

SEQ ID NO: 26635 - DNA, 21 bp, Artificial sequence
  SiRNA target sequence
agtattggacgggttcgctcg

SEQ ID NO: 26636 - DNA, 21 bp, Artificial sequence
  SiRNA target sequence
gtattggacgggttcgctcgt

SEQ ID NO: 26637 - DNA, 21 bp, Artificial sequence
  SiRNA target sequence
tattggacgggttcgctcgtg

SEQ ID NO: 26638 - DNA, 21 bp, Artificial sequence
  SiRNA target sequence
attggacgggttcgctcgtgt

SEQ ID NO: 26639 - DNA, 21 bp, Artificial sequence
  SiRNA target sequence
ttggacgggttcgctcgtgta

SEQ ID NO: 26640 - DNA, 21 bp, Artificial sequence
  SiRNA target sequence
tggacgggttcgctcgtgtat

SEQ ID NO: 26641 - DNA, 21 bp, Artificial sequence
  SiRNA target sequence
ggacgggttcgctcgtgtata

SEQ ID NO: 26642 - DNA, 21 bp, Artificial sequence
  SiRNA target sequence
gacgggttcgctcgtgtatac

SEQ ID NO: 26643 - DNA, 21 bp, Artificial sequence
  SiRNA target sequence
acgggttcgctcgtgtatact

SEQ ID NO: 26644 - DNA, 21 bp, Artificial sequence
  SiRNA target sequence
cgggttcgctcgtgtatactt

SEQ ID NO: 26645 - DNA, 21 bp, Artificial sequence
  SiRNA target sequence
gggttcgctcgtgtatacttt

SEQ ID NO: 26646 - DNA, 21 bp, Artificial sequence
  SiRNA target sequence
ggttcgctcgtgtatactttc

SEQ ID NO: 26647 - DNA, 21 bp, Artificial sequence
  SiRNA target sequence
gttcgctcgtgtatactttca

SEQ ID NO: 26648 - DNA, 21 bp, Artificial sequence
  SiRNA target sequence
ttcgctcgtgtatactttcaa

SEQ ID NO: 26649 - DNA, 21 bp, Artificial sequence
  SiRNA target sequence
tcgctcgtgtatactttcaaa

SEQ ID NO: 26650 - DNA, 21 bp, Artificial sequence
  SiRNA target sequence
cgctcgtgtatactttcaaat

SEQ ID NO: 26651 - DNA, 21 bp, Artificial sequence
  SiRNA target sequence
gctcgtgtatactttcaaatt

SEQ ID NO: 26652 - DNA, 21 bp, Artificial sequence
  SiRNA target sequence
ctcgtgtatactttcaaattt

SEQ ID NO: 26653 - DNA, 21 bp, Artificial sequence
  SiRNA target sequence
tcgtgtatactttcaaatttg

SEQ ID NO: 26654 - DNA, 21 bp, Artificial sequence
  SiRNA target sequence
cgtgtatactttcaaatttgt

SEQ ID NO: 26655 - DNA, 21 bp, Artificial sequence
  SiRNA target sequence
gtgtatactttcaaatttgtt

SEQ ID NO: 26656 - DNA, 21 bp, Artificial sequence
  SiRNA target sequence
tgtatactttcaaatttgtta

SEQ ID NO: 26657 - DNA, 21 bp, Artificial sequence
  SiRNA target sequence
gtatactttcaaatttgttaa

SEQ ID NO: 26658 - DNA, 21 bp, Artificial sequence
  SiRNA target sequence
tatactttcaaatttgttaaa

SEQ ID NO: 26659 - DNA, 21 bp, Artificial sequence
  SiRNA target sequence
atactttcaaatttgttaaaa

SEQ ID NO: 26660 - DNA, 21 bp, Artificial sequence
  SiRNA target sequence
tactttcaaatttgttaaaac

SEQ ID NO: 26661 - DNA, 21 bp, Artificial sequence
  SiRNA target sequence
actttcaaatttgttaaaaca

SEQ ID NO: 26662 - DNA, 21 bp, Artificial sequence
  SiRNA target sequence
ctttcaaatttgttaaaacag

SEQ ID NO: 26663 - DNA, 21 bp, Artificial sequence
  SiRNA target sequence
tttcaaatttgttaaaacaga

SEQ ID NO: 26664 - DNA, 21 bp, Artificial sequence
  SiRNA target sequence
ttcaaatttgttaaaacagac

SEQ ID NO: 26665 - DNA, 21 bp, Artificial sequence
  SiRNA target sequence
tcaaatttgttaaaacagact

SEQ ID NO: 26666 - DNA, 21 bp, Artificial sequence
  SiRNA target sequence
caaatttgttaaaacagacta

SEQ ID NO: 26667 - DNA, 21 bp, Artificial sequence
  SiRNA target sequence
aaatttgttaaaacagactac

SEQ ID NO: 26668 - DNA, 21 bp, Artificial sequence
  SiRNA target sequence
aatttgttaaaacagactacc

SEQ ID NO: 26669 - DNA, 21 bp, Artificial sequence
  SiRNA target sequence
atttgttaaaacagactacca

SEQ ID NO: 26670 - DNA, 21 bp, Artificial sequence
  SiRNA target sequence
tttgttaaaacagactaccat

SEQ ID NO: 26671 - DNA, 21 bp, Artificial sequence
  SiRNA target sequence
ttgttaaaacagactaccatt

SEQ ID NO: 26672 - DNA, 21 bp, Artificial sequence
  SiRNA target sequence
tgttaaaacagactaccattc

SEQ ID NO: 26673 - DNA, 21 bp, Artificial sequence
  SiRNA target sequence
gttaaaacagactaccattct

SEQ ID NO: 26674 - DNA, 21 bp, Artificial sequence
  SiRNA target sequence
ttaaaacagactaccattctg

SEQ ID NO: 26675 - DNA, 21 bp, Artificial sequence
  SiRNA target sequence
taaaacagactaccattctgg

SEQ ID NO: 26676 - DNA, 21 bp, Artificial sequence
  SiRNA target sequence
aaaacagactaccattctggt

SEQ ID NO: 26677 - DNA, 21 bp, Artificial sequence
  SiRNA target sequence
aaacagactaccattctggta

SEQ ID NO: 26678 - DNA, 21 bp, Artificial sequence
  SiRNA target sequence
aacagactaccattctggtag

SEQ ID NO: 26679 - DNA, 21 bp, Artificial sequence
  SiRNA target sequence
acagactaccattctggtagg

SEQ ID NO: 26680 - DNA, 21 bp, Artificial sequence
  SiRNA target sequence
cagactaccattctggtaggg

SEQ ID NO: 26681 - DNA, 21 bp, Artificial sequence
  SiRNA target sequence
agactaccattctggtagggt

SEQ ID NO: 26682 - DNA, 21 bp, Artificial sequence
  SiRNA target sequence
gactaccattctggtagggtg

SEQ ID NO: 26683 - DNA, 21 bp, Artificial sequence
  SiRNA target sequence
actaccattctggtagggtgg

SEQ ID NO: 26684 - DNA, 21 bp, Artificial sequence
  SiRNA target sequence
ctaccattctggtagggtgga

SEQ ID NO: 26685 - DNA, 21 bp, Artificial sequence
  SiRNA target sequence
taccattctggtagggtggaa

SEQ ID NO: 26686 - DNA, 21 bp, Artificial sequence
  SiRNA target sequence
accattctggtagggtggaaa

SEQ ID NO: 26687 - DNA, 21 bp, Artificial sequence
  SiRNA target sequence
ccattctggtagggtggaaat

SEQ ID NO: 26688 - DNA, 21 bp, Artificial sequence
  SiRNA target sequence
cattctggtagggtggaaatt

SEQ ID NO: 26689 - DNA, 21 bp, Artificial sequence
  SiRNA target sequence
attctggtagggtggaaattt

SEQ ID NO: 26690 - DNA, 21 bp, Artificial sequence
  SiRNA target sequence
ttctggtagggtggaaatttc

SEQ ID NO: 26691 - DNA, 21 bp, Artificial sequence
  SiRNA target sequence
tctggtagggtggaaatttct

SEQ ID NO: 26692 - DNA, 21 bp, Artificial sequence
  SiRNA target sequence
ctggtagggtggaaatttctt

SEQ ID NO: 26693 - DNA, 21 bp, Artificial sequence
  SiRNA target sequence
tggtagggtggaaatttcttt

SEQ ID NO: 26694 - DNA, 21 bp, Artificial sequence
  SiRNA target sequence
ggtagggtggaaatttctttc

SEQ ID NO: 26695 - DNA, 21 bp, Artificial sequence
  SiRNA target sequence
gtagggtggaaatttctttcc

SEQ ID NO: 26696 - DNA, 21 bp, Artificial sequence
  SiRNA target sequence
tagggtggaaatttctttcca

SEQ ID NO: 26697 - DNA, 21 bp, Artificial sequence
  SiRNA target sequence
agggtggaaatttctttccac

SEQ ID NO: 26698 - DNA, 21 bp, Artificial sequence
  SiRNA target sequence
gggtggaaatttctttccacc

SEQ ID NO: 26699 - DNA, 21 bp, Artificial sequence
  SiRNA target sequence
ggtggaaatttctttccaccc

SEQ ID NO: 26700 - DNA, 21 bp, Artificial sequence
  SiRNA target sequence
gtggaaatttctttccaccct

SEQ ID NO: 26701 - DNA, 21 bp, Artificial sequence
  SiRNA target sequence
tggaaatttctttccaccctt

SEQ ID NO: 26702 - DNA, 21 bp, Artificial sequence
  SiRNA target sequence
ggaaatttctttccacccttt

SEQ ID NO: 26703 - DNA, 21 bp, Artificial sequence
  SiRNA target sequence
gaaatttctttccaccctttt

SEQ ID NO: 26704 - DNA, 21 bp, Artificial sequence
  SiRNA target sequence
aaatttctttccacccttttt

SEQ ID NO: 26705 - DNA, 21 bp, Artificial sequence
  SiRNA target sequence
aatttctttccaccctttttc

SEQ ID NO: 26706 - DNA, 21 bp, Artificial sequence
  SiRNA target sequence
atttctttccaccctttttct

SEQ ID NO: 26707 - DNA, 21 bp, Artificial sequence
  SiRNA target sequence
tttctttccaccctttttctg

SEQ ID NO: 26708 - DNA, 21 bp, Artificial sequence
  SiRNA target sequence
ttctttccaccctttttctga

SEQ ID NO: 26709 - DNA, 21 bp, Artificial sequence
  SiRNA target sequence
tctttccaccctttttctgat

SEQ ID NO: 26710 - DNA, 21 bp, Artificial sequence
  SiRNA target sequence
ctttccaccctttttctgatt

SEQ ID NO: 26711 - DNA, 21 bp, Artificial sequence
  SiRNA target sequence
tttccaccctttttctgatta

SEQ ID NO: 26712 - DNA, 21 bp, Artificial sequence
  SiRNA target sequence
ttccaccctttttctgattat

SEQ ID NO: 26713 - DNA, 21 bp, Artificial sequence
  SiRNA target sequence
tccaccctttttctgattata

SEQ ID NO: 26714 - DNA, 21 bp, Artificial sequence
  SiRNA target sequence
ccaccctttttctgattatac

SEQ ID NO: 26715 - DNA, 21 bp, Artificial sequence
  SiRNA target sequence
caccctttttctgattatacc

SEQ ID NO: 26716 - DNA, 21 bp, Artificial sequence
  SiRNA target sequence
accctttttctgattataccg

SEQ ID NO: 26717 - DNA, 21 bp, Artificial sequence
  SiRNA target sequence
ccctttttctgattataccgc

SEQ ID NO: 26718 - DNA, 21 bp, Artificial sequence
  SiRNA target sequence
cctttttctgattataccgct

SEQ ID NO: 26719 - DNA, 21 bp, Artificial sequence
  SiRNA target sequence
ctttttctgattataccgctg

SEQ ID NO: 26720 - DNA, 21 bp, Artificial sequence
  SiRNA target sequence
tttttctgattataccgctgg

SEQ ID NO: 26721 - DNA, 21 bp, Artificial sequence
  SiRNA target sequence
ttttctgattataccgctggt

SEQ ID NO: 26722 - DNA, 21 bp, Artificial sequence
  SiRNA target sequence
tttctgattataccgctggta

SEQ ID NO: 26723 - DNA, 21 bp, Artificial sequence
  SiRNA target sequence
ttctgattataccgctggtac

SEQ ID NO: 26724 - DNA, 21 bp, Artificial sequence
  SiRNA target sequence
tctgattataccgctggtacc

SEQ ID NO: 26725 - DNA, 21 bp, Artificial sequence
  SiRNA target sequence
ctgattataccgctggtacct

SEQ ID NO: 26726 - DNA, 21 bp, Artificial sequence
  SiRNA target sequence
tgattataccgctggtaccta

SEQ ID NO: 26727 - DNA, 21 bp, Artificial sequence
  SiRNA target sequence
gattataccgctggtacctat

SEQ ID NO: 26728 - DNA, 21 bp, Artificial sequence
  SiRNA target sequence
attataccgctggtacctatt

SEQ ID NO: 26729 - DNA, 21 bp, Artificial sequence
  SiRNA target sequence
ttataccgctggtacctattc

SEQ ID NO: 26730 - DNA, 21 bp, Artificial sequence
  SiRNA target sequence
tataccgctggtacctattcg

SEQ ID NO: 26731 - DNA, 21 bp, Artificial sequence
  SiRNA target sequence
ataccgctggtacctattcgg

SEQ ID NO: 26732 - DNA, 21 bp, Artificial sequence
  SiRNA target sequence
taccgctggtacctattcgga

SEQ ID NO: 26733 - DNA, 21 bp, Artificial sequence
  SiRNA target sequence
accgctggtacctattcggat

SEQ ID NO: 26734 - DNA, 21 bp, Artificial sequence
  SiRNA target sequence
ccgctggtacctattcggatt

SEQ ID NO: 26735 - DNA, 21 bp, Artificial sequence
  SiRNA target sequence
cgctggtacctattcggatta

SEQ ID NO: 26736 - DNA, 21 bp, Artificial sequence
  SiRNA target sequence
gctggtacctattcggattat

SEQ ID NO: 26737 - DNA, 21 bp, Artificial sequence
  SiRNA target sequence
ctggtacctattcggattata

SEQ ID NO: 26738 - DNA, 21 bp, Artificial sequence
  SiRNA target sequence
tggtacctattcggattatac

SEQ ID NO: 26739 - DNA, 21 bp, Artificial sequence
  SiRNA target sequence
ggtacctattcggattatact

SEQ ID NO: 26740 - DNA, 21 bp, Artificial sequence
  SiRNA target sequence
gtacctattcggattatactt

SEQ ID NO: 26741 - DNA, 21 bp, Artificial sequence
  SiRNA target sequence
tacctattcggattatactta

SEQ ID NO: 26742 - DNA, 21 bp, Artificial sequence
  SiRNA target sequence
acctattcggattatacttat

SEQ ID NO: 26743 - DNA, 21 bp, Artificial sequence
  SiRNA target sequence
cctattcggattatacttata

SEQ ID NO: 26744 - DNA, 21 bp, Artificial sequence
  SiRNA target sequence
ctattcggattatacttatag

SEQ ID NO: 26745 - DNA, 21 bp, Artificial sequence
  SiRNA target sequence
tattcggattatacttatagg

SEQ ID NO: 26746 - DNA, 21 bp, Artificial sequence
  SiRNA target sequence
attcggattatacttatagga

SEQ ID NO: 26747 - DNA, 21 bp, Artificial sequence
  SiRNA target sequence
ttcggattatacttataggat

SEQ ID NO: 26748 - DNA, 21 bp, Artificial sequence
  SiRNA target sequence
tcggattatacttataggatc

SEQ ID NO: 26749 - DNA, 21 bp, Artificial sequence
  SiRNA target sequence
cggattatacttataggatca

SEQ ID NO: 26750 - DNA, 21 bp, Artificial sequence
  SiRNA target sequence
ggattatacttataggatcat

SEQ ID NO: 26751 - DNA, 21 bp, Artificial sequence
  SiRNA target sequence
gattatacttataggatcata

SEQ ID NO: 26752 - DNA, 21 bp, Artificial sequence
  SiRNA target sequence
attatacttataggatcatag

SEQ ID NO: 26753 - DNA, 21 bp, Artificial sequence
  SiRNA target sequence
ttatacttataggatcatagt

SEQ ID NO: 26754 - DNA, 21 bp, Artificial sequence
  SiRNA target sequence
tatacttataggatcatagtg

SEQ ID NO: 26755 - DNA, 21 bp, Artificial sequence
  SiRNA target sequence
atacttataggatcatagtgg

SEQ ID NO: 26756 - DNA, 21 bp, Artificial sequence
  SiRNA target sequence
tacttataggatcatagtgga

SEQ ID NO: 26757 - DNA, 21 bp, Artificial sequence
  SiRNA target sequence
acttataggatcatagtggat

SEQ ID NO: 26758 - DNA, 21 bp, Artificial sequence
  SiRNA target sequence
cttataggatcatagtggatt

SEQ ID NO: 26759 - DNA, 21 bp, Artificial sequence
  SiRNA target sequence
ttataggatcatagtggattt

SEQ ID NO: 26760 - DNA, 21 bp, Artificial sequence
  SiRNA target sequence
tataggatcatagtggatttg

SEQ ID NO: 26761 - DNA, 21 bp, Artificial sequence
  SiRNA target sequence
ataggatcatagtggatttga

SEQ ID NO: 26762 - DNA, 21 bp, Artificial sequence
  SiRNA target sequence
taggatcatagtggatttgag

SEQ ID NO: 26763 - DNA, 21 bp, Artificial sequence
  SiRNA target sequence
aggatcatagtggatttgagg

SEQ ID NO: 26764 - DNA, 21 bp, Artificial sequence
  SiRNA target sequence
ggatcatagtggatttgaggg

SEQ ID NO: 26765 - DNA, 21 bp, Artificial sequence
  SiRNA target sequence
gatcatagtggatttgaggga

SEQ ID NO: 26766 - DNA, 21 bp, Artificial sequence
  SiRNA target sequence
atcatagtggatttgagggaa

SEQ ID NO: 26767 - DNA, 21 bp, Artificial sequence
  SiRNA target sequence
tcatagtggatttgagggaaa

SEQ ID NO: 26768 - DNA, 21 bp, Artificial sequence
  SiRNA target sequence
catagtggatttgagggaaaa

SEQ ID NO: 26769 - DNA, 21 bp, Artificial sequence
  SiRNA target sequence
atagtggatttgagggaaaag

SEQ ID NO: 26770 - DNA, 21 bp, Artificial sequence
  SiRNA target sequence
tagtggatttgagggaaaagt

SEQ ID NO: 26771 - DNA, 21 bp, Artificial sequence
  SiRNA target sequence
agtggatttgagggaaaagtc

SEQ ID NO: 26772 - DNA, 21 bp, Artificial sequence
  SiRNA target sequence
gtggatttgagggaaaagtct

SEQ ID NO: 26773 - DNA, 21 bp, Artificial sequence
  SiRNA target sequence
tggatttgagggaaaagtctg

SEQ ID NO: 26774 - DNA, 21 bp, Artificial sequence
  SiRNA target sequence
ggatttgagggaaaagtctga

SEQ ID NO: 26775 - DNA, 21 bp, Artificial sequence
  SiRNA target sequence
gatttgagggaaaagtctgag

SEQ ID NO: 26776 - DNA, 21 bp, Artificial sequence
  SiRNA target sequence
atttgagggaaaagtctgagt

SEQ ID NO: 26777 - DNA, 21 bp, Artificial sequence
  SiRNA target sequence
tttgagggaaaagtctgagtt

SEQ ID NO: 26778 - DNA, 21 bp, Artificial sequence
  SiRNA target sequence
ttgagggaaaagtctgagttt

SEQ ID NO: 26779 - DNA, 21 bp, Artificial sequence
  SiRNA target sequence
tgagggaaaagtctgagtttt

SEQ ID NO: 26780 - DNA, 21 bp, Artificial sequence
  SiRNA target sequence
gagggaaaagtctgagttttc

SEQ ID NO: 26781 - DNA, 21 bp, Artificial sequence
  SiRNA target sequence
agggaaaagtctgagttttcg

SEQ ID NO: 26782 - DNA, 21 bp, Artificial sequence
  SiRNA target sequence
gggaaaagtctgagttttcgg

SEQ ID NO: 26783 - DNA, 21 bp, Artificial sequence
  SiRNA target sequence
ggaaaagtctgagttttcggt

SEQ ID NO: 26784 - DNA, 21 bp, Artificial sequence
  SiRNA target sequence
gaaaagtctgagttttcggtc

SEQ ID NO: 26785 - DNA, 21 bp, Artificial sequence
  SiRNA target sequence
aaaagtctgagttttcggtca

SEQ ID NO: 26786 - DNA, 21 bp, Artificial sequence
  SiRNA target sequence
aaagtctgagttttcggtcac

SEQ ID NO: 26787 - DNA, 21 bp, Artificial sequence
  SiRNA target sequence
aagtctgagttttcggtcaca

SEQ ID NO: 26788 - DNA, 21 bp, Artificial sequence
  SiRNA target sequence
agtctgagttttcggtcacaa

SEQ ID NO: 26789 - DNA, 21 bp, Artificial sequence
  SiRNA target sequence
gtctgagttttcggtcacaat

SEQ ID NO: 26790 - DNA, 21 bp, Artificial sequence
  SiRNA target sequence
tctgagttttcggtcacaata

SEQ ID NO: 26791 - DNA, 21 bp, Artificial sequence
  SiRNA target sequence
ctgagttttcggtcacaatac

SEQ ID NO: 26792 - DNA, 21 bp, Artificial sequence
  SiRNA target sequence
tgagttttcggtcacaatacc

SEQ ID NO: 26793 - DNA, 21 bp, Artificial sequence
  SiRNA target sequence
gagttttcggtcacaatacct

SEQ ID NO: 26794 - DNA, 21 bp, Artificial sequence
  SiRNA target sequence
agttttcggtcacaatacctt

SEQ ID NO: 26795 - DNA, 21 bp, Artificial sequence
  SiRNA target sequence
gttttcggtcacaataccttt

SEQ ID NO: 26796 - DNA, 21 bp, Artificial sequence
  SiRNA target sequence
ttttcggtcacaatacctttc

SEQ ID NO: 26797 - DNA, 21 bp, Artificial sequence
  SiRNA target sequence
tttcggtcacaatacctttca

SEQ ID NO: 26798 - DNA, 21 bp, Artificial sequence
  SiRNA target sequence
ttcggtcacaatacctttcat

SEQ ID NO: 26799 - DNA, 21 bp, Artificial sequence
  SiRNA target sequence
tcggtcacaatacctttcatt

SEQ ID NO: 26800 - DNA, 21 bp, Artificial sequence
  SiRNA target sequence
cggtcacaatacctttcattt

SEQ ID NO: 26801 - DNA, 21 bp, Artificial sequence
  SiRNA target sequence
ggtcacaatacctttcatttc

SEQ ID NO: 26802 - DNA, 21 bp, Artificial sequence
  SiRNA target sequence
gtcacaatacctttcatttct

SEQ ID NO: 26803 - DNA, 21 bp, Artificial sequence
  SiRNA target sequence
tcacaatacctttcatttctc

SEQ ID NO: 26804 - DNA, 21 bp, Artificial sequence
  SiRNA target sequence
cacaatacctttcatttctcc

SEQ ID NO: 26805 - DNA, 21 bp, Artificial sequence
  SiRNA target sequence
acaatacctttcatttctcca

SEQ ID NO: 26806 - DNA, 21 bp, Artificial sequence
  SiRNA target sequence
caatacctttcatttctccag

SEQ ID NO: 26807 - DNA, 21 bp, Artificial sequence
  SiRNA target sequence
aatacctttcatttctccagt

SEQ ID NO: 26808 - DNA, 21 bp, Artificial sequence
  SiRNA target sequence
atacctttcatttctccagtt

SEQ ID NO: 26809 - DNA, 21 bp, Artificial sequence
  SiRNA target sequence
tacctttcatttctccagttc

SEQ ID NO: 26810 - DNA, 21 bp, Artificial sequence
  SiRNA target sequence
acctttcatttctccagttcc

SEQ ID NO: 26811 - DNA, 21 bp, Artificial sequence
  SiRNA target sequence
cctttcatttctccagttcca

SEQ ID NO: 26812 - DNA, 21 bp, Artificial sequence
  SiRNA target sequence
ctttcatttctccagttccat

SEQ ID NO: 26813 - DNA, 21 bp, Artificial sequence
  SiRNA target sequence
tttcatttctccagttccata

SEQ ID NO: 26814 - DNA, 21 bp, Artificial sequence
  SiRNA target sequence
ttcatttctccagttccatat

SEQ ID NO: 26815 - DNA, 21 bp, Artificial sequence
  SiRNA target sequence
tcatttctccagttccatata

SEQ ID NO: 26816 - DNA, 21 bp, Artificial sequence
  SiRNA target sequence
catttctccagttccatataa

SEQ ID NO: 26817 - DNA, 21 bp, Artificial sequence
  SiRNA target sequence
atttctccagttccatataaa

SEQ ID NO: 26818 - DNA, 21 bp, Artificial sequence
  SiRNA target sequence
tttctccagttccatataaac

SEQ ID NO: 26819 - DNA, 21 bp, Artificial sequence
  SiRNA target sequence
ttctccagttccatataaacg

SEQ ID NO: 26820 - DNA, 21 bp, Artificial sequence
  SiRNA target sequence
tctccagttccatataaacgc

SEQ ID NO: 26821 - DNA, 21 bp, Artificial sequence
  SiRNA target sequence
ctccagttccatataaacgca

SEQ ID NO: 26822 - DNA, 21 bp, Artificial sequence
  SiRNA target sequence
tccagttccatataaacgcat

SEQ ID NO: 26823 - DNA, 21 bp, Artificial sequence
  SiRNA target sequence
ccagttccatataaacgcata

SEQ ID NO: 26824 - DNA, 21 bp, Artificial sequence
  SiRNA target sequence
cagttccatataaacgcatat

SEQ ID NO: 26825 - DNA, 21 bp, Artificial sequence
  SiRNA target sequence
agttccatataaacgcatatc

SEQ ID NO: 26826 - DNA, 21 bp, Artificial sequence
  SiRNA target sequence
gttccatataaacgcatatct

SEQ ID NO: 26827 - DNA, 21 bp, Artificial sequence
  SiRNA target sequence
ttccatataaacgcatatcta

SEQ ID NO: 26828 - DNA, 21 bp, Artificial sequence
  SiRNA target sequence
tccatataaacgcatatctaa

SEQ ID NO: 26829 - DNA, 21 bp, Artificial sequence
  SiRNA target sequence
ccatataaacgcatatctaag

SEQ ID NO: 26830 - DNA, 21 bp, Artificial sequence
  SiRNA target sequence
catataaacgcatatctaagc

SEQ ID NO: 26831 - DNA, 21 bp, Artificial sequence
  SiRNA target sequence
atataaacgcatatctaagcc

SEQ ID NO: 26832 - DNA, 21 bp, Artificial sequence
  SiRNA target sequence
tataaacgcatatctaagcca

SEQ ID NO: 26833 - DNA, 21 bp, Artificial sequence
  SiRNA target sequence
ataaacgcatatctaagccag

SEQ ID NO: 26834 - DNA, 21 bp, Artificial sequence
  SiRNA target sequence
taaacgcatatctaagccaga

SEQ ID NO: 26835 - DNA, 21 bp, Artificial sequence
  SiRNA target sequence
aaacgcatatctaagccagat

SEQ ID NO: 26836 - DNA, 21 bp, Artificial sequence
  SiRNA target sequence
aacgcatatctaagccagatt

SEQ ID NO: 26837 - DNA, 21 bp, Artificial sequence
  SiRNA target sequence
acgcatatctaagccagattg

SEQ ID NO: 26838 - DNA, 21 bp, Artificial sequence
  SiRNA target sequence
cgcatatctaagccagattgg

SEQ ID NO: 26839 - DNA, 21 bp, Artificial sequence
  SiRNA target sequence
gcatatctaagccagattggg

SEQ ID NO: 26840 - DNA, 21 bp, Artificial sequence
  SiRNA target sequence
catatctaagccagattggga

SEQ ID NO: 26841 - DNA, 21 bp, Artificial sequence
  SiRNA target sequence
atatctaagccagattgggat

SEQ ID NO: 26842 - DNA, 21 bp, Artificial sequence
  SiRNA target sequence
tatctaagccagattgggata

SEQ ID NO: 26843 - DNA, 21 bp, Artificial sequence
  SiRNA target sequence
atctaagccagattgggataa

SEQ ID NO: 26844 - DNA, 21 bp, Artificial sequence
  SiRNA target sequence
tctaagccagattgggataag

SEQ ID NO: 26845 - DNA, 21 bp, Artificial sequence
  SiRNA target sequence
ctaagccagattgggataagc

SEQ ID NO: 26846 - DNA, 21 bp, Artificial sequence
  SiRNA target sequence
taagccagattgggataagcc

SEQ ID NO: 26847 - DNA, 21 bp, Artificial sequence
  SiRNA target sequence
aagccagattgggataagccc

SEQ ID NO: 26848 - DNA, 21 bp, Artificial sequence
  SiRNA target sequence
agccagattgggataagccct

SEQ ID NO: 26849 - DNA, 21 bp, Artificial sequence
  SiRNA target sequence
gccagattgggataagcccta

SEQ ID NO: 26850 - DNA, 21 bp, Artificial sequence
  SiRNA target sequence
ccagattgggataagccctat

SEQ ID NO: 26851 - DNA, 21 bp, Artificial sequence
  SiRNA target sequence
cagattgggataagccctatt

SEQ ID NO: 26852 - DNA, 21 bp, Artificial sequence
  SiRNA target sequence
agattgggataagccctattc

SEQ ID NO: 26853 - DNA, 21 bp, Artificial sequence
  SiRNA target sequence
gattgggataagccctattcc

SEQ ID NO: 26854 - DNA, 21 bp, Artificial sequence
  SiRNA target sequence
attgggataagccctattcca

SEQ ID NO: 26855 - DNA, 21 bp, Artificial sequence
  SiRNA target sequence
ttgggataagccctattccaa

SEQ ID NO: 26856 - DNA, 21 bp, Artificial sequence
  SiRNA target sequence
tgggataagccctattccaaa

SEQ ID NO: 26857 - DNA, 21 bp, Artificial sequence
  SiRNA target sequence
gggataagccctattccaaat

SEQ ID NO: 26858 - DNA, 21 bp, Artificial sequence
  SiRNA target sequence
ggataagccctattccaaatt

SEQ ID NO: 26859 - DNA, 21 bp, Artificial sequence
  SiRNA target sequence
gataagccctattccaaattt

SEQ ID NO: 26860 - DNA, 21 bp, Artificial sequence
  SiRNA target sequence
ataagccctattccaaatttg

SEQ ID NO: 26861 - DNA, 21 bp, Artificial sequence
  SiRNA target sequence
taagccctattccaaatttgc

SEQ ID NO: 26862 - DNA, 21 bp, Artificial sequence
  SiRNA target sequence
aagccctattccaaatttgct

SEQ ID NO: 26863 - DNA, 21 bp, Artificial sequence
  SiRNA target sequence
agccctattccaaatttgctc

SEQ ID NO: 26864 - DNA, 21 bp, Artificial sequence
  SiRNA target sequence
gccctattccaaatttgctca

SEQ ID NO: 26865 - DNA, 21 bp, Artificial sequence
  SiRNA target sequence
ccctattccaaatttgctcat

SEQ ID NO: 26866 - DNA, 21 bp, Artificial sequence
  SiRNA target sequence
cctattccaaatttgctcatg

SEQ ID NO: 26867 - DNA, 21 bp, Artificial sequence
  SiRNA target sequence
ctattccaaatttgctcatgc

SEQ ID NO: 26868 - DNA, 21 bp, Artificial sequence
  SiRNA target sequence
tattccaaatttgctcatgct

SEQ ID NO: 26869 - DNA, 21 bp, Artificial sequence
  SiRNA target sequence
attccaaatttgctcatgcta

SEQ ID NO: 26870 - DNA, 21 bp, Artificial sequence
  SiRNA target sequence
ttccaaatttgctcatgctag

SEQ ID NO: 26871 - DNA, 21 bp, Artificial sequence
  SiRNA target sequence
tccaaatttgctcatgctagt

SEQ ID NO: 26872 - DNA, 21 bp, Artificial sequence
  SiRNA target sequence
ccaaatttgctcatgctagta

SEQ ID NO: 26873 - DNA, 21 bp, Artificial sequence
  SiRNA target sequence
caaatttgctcatgctagtac

SEQ ID NO: 26874 - DNA, 21 bp, Artificial sequence
  SiRNA target sequence
aaatttgctcatgctagtacg

SEQ ID NO: 26875 - DNA, 21 bp, Artificial sequence
  SiRNA target sequence
aatttgctcatgctagtacgg

SEQ ID NO: 26876 - DNA, 21 bp, Artificial sequence
  SiRNA target sequence
atttgctcatgctagtacggg

SEQ ID NO: 26877 - DNA, 21 bp, Artificial sequence
  SiRNA target sequence
tttgctcatgctagtacgggt

SEQ ID NO: 26878 - DNA, 21 bp, Artificial sequence
  SiRNA target sequence
ttgctcatgctagtacgggta

SEQ ID NO: 26879 - DNA, 21 bp, Artificial sequence
  SiRNA target sequence
tgctcatgctagtacgggtac

SEQ ID NO: 26880 - DNA, 21 bp, Artificial sequence
  SiRNA target sequence
gctcatgctagtacgggtact

SEQ ID NO: 26881 - DNA, 21 bp, Artificial sequence
  SiRNA target sequence
ctcatgctagtacgggtactc

SEQ ID NO: 26882 - DNA, 21 bp, Artificial sequence
  SiRNA target sequence
tcatgctagtacgggtactct

SEQ ID NO: 26883 - DNA, 21 bp, Artificial sequence
  SiRNA target sequence
catgctagtacgggtactcta

SEQ ID NO: 26884 - DNA, 21 bp, Artificial sequence
  SiRNA target sequence
atgctagtacgggtactctag

SEQ ID NO: 26885 - DNA, 21 bp, Artificial sequence
  SiRNA target sequence
tgctagtacgggtactctagt

SEQ ID NO: 26886 - DNA, 21 bp, Artificial sequence
  SiRNA target sequence
gctagtacgggtactctagtc

SEQ ID NO: 26887 - DNA, 21 bp, Artificial sequence
  SiRNA target sequence
ctagtacgggtactctagtct

SEQ ID NO: 26888 - DNA, 21 bp, Artificial sequence
  SiRNA target sequence
tagtacgggtactctagtctt

SEQ ID NO: 26889 - DNA, 21 bp, Artificial sequence
  SiRNA target sequence
agtacgggtactctagtcttg

SEQ ID NO: 26890 - DNA, 21 bp, Artificial sequence
  SiRNA target sequence
gtacgggtactctagtcttga

SEQ ID NO: 26891 - DNA, 21 bp, Artificial sequence
  SiRNA target sequence
tacgggtactctagtcttgaa

SEQ ID NO: 26892 - DNA, 21 bp, Artificial sequence
  SiRNA target sequence
acgggtactctagtcttgaag

SEQ ID NO: 26893 - DNA, 21 bp, Artificial sequence
  SiRNA target sequence
cgggtactctagtcttgaagg

SEQ ID NO: 26894 - DNA, 21 bp, Artificial sequence
  SiRNA target sequence
gggtactctagtcttgaaggc

SEQ ID NO: 26895 - DNA, 21 bp, Artificial sequence
  SiRNA target sequence
ggtactctagtcttgaaggcg

SEQ ID NO: 26896 - DNA, 21 bp, Artificial sequence
  SiRNA target sequence
gtactctagtcttgaaggcgt

SEQ ID NO: 26897 - DNA, 21 bp, Artificial sequence
  SiRNA target sequence
tactctagtcttgaaggcgtt

SEQ ID NO: 26898 - DNA, 21 bp, Artificial sequence
  SiRNA target sequence
actctagtcttgaaggcgttg

SEQ ID NO: 26899 - DNA, 21 bp, Artificial sequence
  SiRNA target sequence
ctctagtcttgaaggcgttga

SEQ ID NO: 26900 - DNA, 21 bp, Artificial sequence
  SiRNA target sequence
tctagtcttgaaggcgttgac

SEQ ID NO: 26901 - DNA, 21 bp, Artificial sequence
  SiRNA target sequence
ctagtcttgaaggcgttgaca

SEQ ID NO: 26902 - DNA, 21 bp, Artificial sequence
  SiRNA target sequence
tagtcttgaaggcgttgacat

SEQ ID NO: 26903 - DNA, 21 bp, Artificial sequence
  SiRNA target sequence
agtcttgaaggcgttgacatc

SEQ ID NO: 26904 - DNA, 21 bp, Artificial sequence
  SiRNA target sequence
gtcttgaaggcgttgacatcg

SEQ ID NO: 26905 - DNA, 21 bp, Artificial sequence
  SiRNA target sequence
tcttgaaggcgttgacatcgt

SEQ ID NO: 26906 - DNA, 21 bp, Artificial sequence
  SiRNA target sequence
cttgaaggcgttgacatcgtt

SEQ ID NO: 26907 - DNA, 21 bp, Artificial sequence
  SiRNA target sequence
ttgaaggcgttgacatcgtta

SEQ ID NO: 26908 - DNA, 21 bp, Artificial sequence
  SiRNA target sequence
tgaaggcgttgacatcgttaa

SEQ ID NO: 26909 - DNA, 21 bp, Artificial sequence
  SiRNA target sequence
gaaggcgttgacatcgttaaa

SEQ ID NO: 26910 - DNA, 21 bp, Artificial sequence
  SiRNA target sequence
aaggcgttgacatcgttaaaa

SEQ ID NO: 26911 - DNA, 21 bp, Artificial sequence
  SiRNA target sequence
aggcgttgacatcgttaaaag

SEQ ID NO: 26912 - DNA, 21 bp, Artificial sequence
  SiRNA target sequence
ggcgttgacatcgttaaaagc

SEQ ID NO: 26913 - DNA, 21 bp, Artificial sequence
  SiRNA target sequence
gcgttgacatcgttaaaagca

SEQ ID NO: 26914 - DNA, 21 bp, Artificial sequence
  SiRNA target sequence
cgttgacatcgttaaaagcaa

SEQ ID NO: 26915 - DNA, 21 bp, Artificial sequence
  SiRNA target sequence
gttgacatcgttaaaagcaac

SEQ ID NO: 26916 - DNA, 21 bp, Artificial sequence
  SiRNA target sequence
ttgacatcgttaaaagcaact

SEQ ID NO: 26917 - DNA, 21 bp, Artificial sequence
  SiRNA target sequence
tgacatcgttaaaagcaacta

SEQ ID NO: 26918 - DNA, 21 bp, Artificial sequence
  SiRNA target sequence
gacatcgttaaaagcaactaa

SEQ ID NO: 26919 - DNA, 21 bp, Artificial sequence
  SiRNA target sequence
acatcgttaaaagcaactaat

SEQ ID NO: 26920 - DNA, 21 bp, Artificial sequence
  SiRNA target sequence
catcgttaaaagcaactaata

SEQ ID NO: 26921 - DNA, 21 bp, Artificial sequence
  SiRNA target sequence
atcgttaaaagcaactaatac

SEQ ID NO: 26922 - DNA, 21 bp, Artificial sequence
  SiRNA target sequence
tcgttaaaagcaactaatacc

SEQ ID NO: 26923 - DNA, 21 bp, Artificial sequence
  SiRNA target sequence
cgttaaaagcaactaataccg

SEQ ID NO: 26924 - DNA, 21 bp, Artificial sequence
  SiRNA target sequence
gttaaaagcaactaataccgt

SEQ ID NO: 26925 - DNA, 21 bp, Artificial sequence
  SiRNA target sequence
ttaaaagcaactaataccgtg

SEQ ID NO: 26926 - DNA, 21 bp, Artificial sequence
  SiRNA target sequence
taaaagcaactaataccgtgg

SEQ ID NO: 26927 - DNA, 21 bp, Artificial sequence
  SiRNA target sequence
aaaagcaactaataccgtggt

SEQ ID NO: 26928 - DNA, 21 bp, Artificial sequence
  SiRNA target sequence
aaagcaactaataccgtggtt

SEQ ID NO: 26929 - DNA, 21 bp, Artificial sequence
  SiRNA target sequence
aagcaactaataccgtggttt

SEQ ID NO: 26930 - DNA, 21 bp, Artificial sequence
  SiRNA target sequence
agcaactaataccgtggtttc

SEQ ID NO: 26931 - DNA, 21 bp, Artificial sequence
  SiRNA target sequence
gcaactaataccgtggtttcc

SEQ ID NO: 26932 - DNA, 21 bp, Artificial sequence
  SiRNA target sequence
caactaataccgtggtttcca

SEQ ID NO: 26933 - DNA, 21 bp, Artificial sequence
  SiRNA target sequence
aactaataccgtggtttccaa

SEQ ID NO: 26934 - DNA, 21 bp, Artificial sequence
  SiRNA target sequence
actaataccgtggtttccaat

SEQ ID NO: 26935 - DNA, 21 bp, Artificial sequence
  SiRNA target sequence
ctaataccgtggtttccaatt

SEQ ID NO: 26936 - DNA, 21 bp, Artificial sequence
  SiRNA target sequence
taataccgtggtttccaattc

SEQ ID NO: 26937 - DNA, 21 bp, Artificial sequence
  SiRNA target sequence
aataccgtggtttccaattct

SEQ ID NO: 26938 - DNA, 21 bp, Artificial sequence
  SiRNA target sequence
ataccgtggtttccaattctg

SEQ ID NO: 26939 - DNA, 21 bp, Artificial sequence
  SiRNA target sequence
taccgtggtttccaattctgt

SEQ ID NO: 26940 - DNA, 21 bp, Artificial sequence
  SiRNA target sequence
accgtggtttccaattctgtg

SEQ ID NO: 26941 - DNA, 21 bp, Artificial sequence
  SiRNA target sequence
ccgtggtttccaattctgtgg

SEQ ID NO: 26942 - DNA, 21 bp, Artificial sequence
  SiRNA target sequence
cgtggtttccaattctgtgga

SEQ ID NO: 26943 - DNA, 21 bp, Artificial sequence
  SiRNA target sequence
gtggtttccaattctgtggaa

SEQ ID NO: 26944 - DNA, 21 bp, Artificial sequence
  SiRNA target sequence
tggtttccaattctgtggaaa

SEQ ID NO: 26945 - DNA, 21 bp, Artificial sequence
  SiRNA target sequence
ggtttccaattctgtggaaat

SEQ ID NO: 26946 - DNA, 21 bp, Artificial sequence
  SiRNA target sequence
gtttccaattctgtggaaatc

SEQ ID NO: 26947 - DNA, 21 bp, Artificial sequence
  SiRNA target sequence
tttccaattctgtggaaatct

SEQ ID NO: 26948 - DNA, 21 bp, Artificial sequence
  SiRNA target sequence
ttccaattctgtggaaatctt

SEQ ID NO: 26949 - DNA, 21 bp, Artificial sequence
  SiRNA target sequence
tccaattctgtggaaatcttg

SEQ ID NO: 26950 - DNA, 21 bp, Artificial sequence
  SiRNA target sequence
ccaattctgtggaaatcttga

SEQ ID NO: 26951 - DNA, 21 bp, Artificial sequence
  SiRNA target sequence
caattctgtggaaatcttgat

SEQ ID NO: 26952 - DNA, 21 bp, Artificial sequence
  SiRNA target sequence
aattctgtggaaatcttgata

SEQ ID NO: 26953 - DNA, 21 bp, Artificial sequence
  SiRNA target sequence
attctgtggaaatcttgatag

SEQ ID NO: 26954 - DNA, 21 bp, Artificial sequence
  SiRNA target sequence
ttctgtggaaatcttgataga

SEQ ID NO: 26955 - DNA, 21 bp, Artificial sequence
  SiRNA target sequence
tctgtggaaatcttgatagaa

SEQ ID NO: 26956 - DNA, 21 bp, Artificial sequence
  SiRNA target sequence
ctgtggaaatcttgatagaag

SEQ ID NO: 26957 - DNA, 21 bp, Artificial sequence
  SiRNA target sequence
tgtggaaatcttgatagaagt

SEQ ID NO: 26958 - DNA, 21 bp, Artificial sequence
  SiRNA target sequence
gtggaaatcttgatagaagtt

SEQ ID NO: 26959 - DNA, 21 bp, Artificial sequence
  SiRNA target sequence
tggaaatcttgatagaagtta

SEQ ID NO: 26960 - DNA, 21 bp, Artificial sequence
  SiRNA target sequence
ggaaatcttgatagaagttaa

SEQ ID NO: 26961 - DNA, 21 bp, Artificial sequence
  SiRNA target sequence
gaaatcttgatagaagttaat

SEQ ID NO: 26962 - DNA, 21 bp, Artificial sequence
  SiRNA target sequence
aaatcttgatagaagttaatg

SEQ ID NO: 26963 - DNA, 21 bp, Artificial sequence
  SiRNA target sequence
aatcttgatagaagttaatgc

SEQ ID NO: 26964 - DNA, 21 bp, Artificial sequence
  SiRNA target sequence
atcttgatagaagttaatgct

SEQ ID NO: 26965 - DNA, 21 bp, Artificial sequence
  SiRNA target sequence
tcttgatagaagttaatgctg

SEQ ID NO: 26966 - DNA, 21 bp, Artificial sequence
  SiRNA target sequence
cttgatagaagttaatgctgg

SEQ ID NO: 26967 - DNA, 21 bp, Artificial sequence
  SiRNA target sequence
ttgatagaagttaatgctgga

SEQ ID NO: 26968 - DNA, 21 bp, Artificial sequence
  SiRNA target sequence
tgatagaagttaatgctggag

SEQ ID NO: 26969 - DNA, 21 bp, Artificial sequence
  SiRNA target sequence
gatagaagttaatgctggaga

SEQ ID NO: 26970 - DNA, 21 bp, Artificial sequence
  SiRNA target sequence
atagaagttaatgctggagac

SEQ ID NO: 26971 - DNA, 21 bp, Artificial sequence
  SiRNA target sequence
tagaagttaatgctggagacg

SEQ ID NO: 26972 - DNA, 21 bp, Artificial sequence
  SiRNA target sequence
agaagttaatgctggagacga

SEQ ID NO: 26973 - DNA, 21 bp, Artificial sequence
  SiRNA target sequence
gaagttaatgctggagacgac

SEQ ID NO: 26974 - DNA, 21 bp, Artificial sequence
  SiRNA target sequence
aagttaatgctggagacgact

SEQ ID NO: 26975 - DNA, 21 bp, Artificial sequence
  SiRNA target sequence
agttaatgctggagacgactt

SEQ ID NO: 26976 - DNA, 21 bp, Artificial sequence
  SiRNA target sequence
gttaatgctggagacgacttc

SEQ ID NO: 26977 - DNA, 21 bp, Artificial sequence
  SiRNA target sequence
ttaatgctggagacgacttca

SEQ ID NO: 26978 - DNA, 21 bp, Artificial sequence
  SiRNA target sequence
taatgctggagacgacttcaa

SEQ ID NO: 26979 - DNA, 21 bp, Artificial sequence
  SiRNA target sequence
aatgctggagacgacttcaac

SEQ ID NO: 26980 - DNA, 21 bp, Artificial sequence
  SiRNA target sequence
atgctggagacgacttcaacg

SEQ ID NO: 26981 - DNA, 21 bp, Artificial sequence
  SiRNA target sequence
tgctggagacgacttcaacgt

SEQ ID NO: 26982 - DNA, 21 bp, Artificial sequence
  SiRNA target sequence
gctggagacgacttcaacgtt

SEQ ID NO: 26983 - DNA, 21 bp, Artificial sequence
  SiRNA target sequence
ctggagacgacttcaacgtta

SEQ ID NO: 26984 - DNA, 21 bp, Artificial sequence
  SiRNA target sequence
tggagacgacttcaacgttat

SEQ ID NO: 26985 - DNA, 21 bp, Artificial sequence
  SiRNA target sequence
ggagacgacttcaacgttatt

SEQ ID NO: 26986 - DNA, 21 bp, Artificial sequence
  SiRNA target sequence
gagacgacttcaacgttattg

SEQ ID NO: 26987 - DNA, 21 bp, Artificial sequence
  SiRNA target sequence
agacgacttcaacgttattgc

SEQ ID NO: 26988 - DNA, 21 bp, Artificial sequence
  SiRNA target sequence
gacgacttcaacgttattgct

SEQ ID NO: 26989 - DNA, 21 bp, Artificial sequence
  SiRNA target sequence
acgacttcaacgttattgctc

SEQ ID NO: 26990 - DNA, 21 bp, Artificial sequence
  SiRNA target sequence
cgacttcaacgttattgctcc

SEQ ID NO: 26991 - DNA, 21 bp, Artificial sequence
  SiRNA target sequence
gacttcaacgttattgctccc

SEQ ID NO: 26992 - DNA, 21 bp, Artificial sequence
  SiRNA target sequence
acttcaacgttattgctccca

SEQ ID NO: 26993 - DNA, 21 bp, Artificial sequence
  SiRNA target sequence
cttcaacgttattgctcccat

SEQ ID NO: 26994 - DNA, 21 bp, Artificial sequence
  SiRNA target sequence
ttcaacgttattgctcccatc

SEQ ID NO: 26995 - DNA, 21 bp, Artificial sequence
  SiRNA target sequence
tcaacgttattgctcccatcg

SEQ ID NO: 26996 - DNA, 21 bp, Artificial sequence
  SiRNA target sequence
caacgttattgctcccatcga

SEQ ID NO: 26997 - DNA, 21 bp, Artificial sequence
  SiRNA target sequence
aacgttattgctcccatcgaa

SEQ ID NO: 26998 - DNA, 21 bp, Artificial sequence
  SiRNA target sequence
acgttattgctcccatcgaaa

SEQ ID NO: 26999 - DNA, 21 bp, Artificial sequence
  SiRNA target sequence
cgttattgctcccatcgaaaa

SEQ ID NO: 27000 - DNA, 21 bp, Artificial sequence
  SiRNA target sequence
gttattgctcccatcgaaaac

SEQ ID NO: 27001 - DNA, 21 bp, Artificial sequence
  SiRNA target sequence
ttattgctcccatcgaaaaca

SEQ ID NO: 27002 - DNA, 21 bp, Artificial sequence
  SiRNA target sequence
tattgctcccatcgaaaacat

SEQ ID NO: 27003 - DNA, 21 bp, Artificial sequence
  SiRNA target sequence
attgctcccatcgaaaacatc

SEQ ID NO: 27004 - DNA, 21 bp, Artificial sequence
  SiRNA target sequence
ttgctcccatcgaaaacatct

SEQ ID NO: 27005 - DNA, 21 bp, Artificial sequence
  SiRNA target sequence
tgctcccatcgaaaacatctt

SEQ ID NO: 27006 - DNA, 21 bp, Artificial sequence
  SiRNA target sequence
gctcccatcgaaaacatcttt

SEQ ID NO: 27007 - DNA, 21 bp, Artificial sequence
  SiRNA target sequence
ctcccatcgaaaacatctttt

SEQ ID NO: 27008 - DNA, 21 bp, Artificial sequence
  SiRNA target sequence
tcccatcgaaaacatcttttt

SEQ ID NO: 27009 - DNA, 21 bp, Artificial sequence
  SiRNA target sequence
cccatcgaaaacatctttttc

SEQ ID NO: 27010 - DNA, 21 bp, Artificial sequence
  SiRNA target sequence
ccatcgaaaacatctttttcc

SEQ ID NO: 27011 - DNA, 21 bp, Artificial sequence
  SiRNA target sequence
catcgaaaacatctttttccc

SEQ ID NO: 27012 - DNA, 21 bp, Artificial sequence
  SiRNA target sequence
atcgaaaacatctttttcccc

SEQ ID NO: 27013 - DNA, 21 bp, Artificial sequence
  SiRNA target sequence
tcgaaaacatctttttcccct

SEQ ID NO: 27014 - DNA, 21 bp, Artificial sequence
  SiRNA target sequence
cgaaaacatctttttcccctt

SEQ ID NO: 27015 - DNA, 21 bp, Artificial sequence
  SiRNA target sequence
gaaaacatctttttccccttc

SEQ ID NO: 27016 - DNA, 21 bp, Artificial sequence
  SiRNA target sequence
aaaacatctttttccccttct

SEQ ID NO: 27017 - DNA, 21 bp, Artificial sequence
  SiRNA target sequence
aaacatctttttccccttctc

SEQ ID NO: 27018 - DNA, 21 bp, Artificial sequence
  SiRNA target sequence
aacatctttttccccttctct

SEQ ID NO: 27019 - DNA, 21 bp, Artificial sequence
  SiRNA target sequence
acatctttttccccttctctc

SEQ ID NO: 27020 - DNA, 21 bp, Artificial sequence
  SiRNA target sequence
catctttttccccttctctct

SEQ ID NO: 27021 - DNA, 21 bp, Artificial sequence
  SiRNA target sequence
atctttttccccttctctctg

SEQ ID NO: 27022 - DNA, 21 bp, Artificial sequence
  SiRNA target sequence
tctttttccccttctctctgt

SEQ ID NO: 27023 - DNA, 21 bp, Artificial sequence
  SiRNA target sequence
ctttttccccttctctctgtc

SEQ ID NO: 27024 - DNA, 21 bp, Artificial sequence
  SiRNA target sequence
tttttccccttctctctgtct

SEQ ID NO: 27025 - DNA, 21 bp, Artificial sequence
  SiRNA target sequence
ttttccccttctctctgtctc

SEQ ID NO: 27026 - DNA, 21 bp, Artificial sequence
  SiRNA target sequence
tttccccttctctctgtctcc

SEQ ID NO: 27027 - DNA, 21 bp, Artificial sequence
  SiRNA target sequence
ttccccttctctctgtctcca

SEQ ID NO: 27028 - DNA, 21 bp, Artificial sequence
  SiRNA target sequence
tccccttctctctgtctccag

SEQ ID NO: 27029 - DNA, 21 bp, Artificial sequence
  SiRNA target sequence
ccccttctctctgtctccagg

SEQ ID NO: 27030 - DNA, 21 bp, Artificial sequence
  SiRNA target sequence
cccttctctctgtctccaggg

SEQ ID NO: 27031 - DNA, 21 bp, Artificial sequence
  SiRNA target sequence
ccttctctctgtctccaggga

SEQ ID NO: 27032 - DNA, 21 bp, Artificial sequence
  SiRNA target sequence
cttctctctgtctccagggag

SEQ ID NO: 27033 - DNA, 21 bp, Artificial sequence
  SiRNA target sequence
ttctctctgtctccagggaga

SEQ ID NO: 27034 - DNA, 21 bp, Artificial sequence
  SiRNA target sequence
tctctctgtctccagggagag

SEQ ID NO: 27035 - DNA, 21 bp, Artificial sequence
  SiRNA target sequence
ctctctgtctccagggagagg

SEQ ID NO: 27036 - DNA, 21 bp, Artificial sequence
  SiRNA target sequence
tctctgtctccagggagaggg

SEQ ID NO: 27037 - DNA, 21 bp, Artificial sequence
  SiRNA target sequence
ctctgtctccagggagaggga

SEQ ID NO: 27038 - DNA, 21 bp, Artificial sequence
  SiRNA target sequence
tctgtctccagggagagggag

SEQ ID NO: 27039 - DNA, 21 bp, Artificial sequence
  SiRNA target sequence
ctgtctccagggagagggagt

SEQ ID NO: 27040 - DNA, 21 bp, Artificial sequence
  SiRNA target sequence
tgtctccagggagagggagta

SEQ ID NO: 27041 - DNA, 21 bp, Artificial sequence
  SiRNA target sequence
gtctccagggagagggagtat

SEQ ID NO: 27042 - DNA, 21 bp, Artificial sequence
  SiRNA target sequence
tctccagggagagggagtatg

SEQ ID NO: 27043 - DNA, 21 bp, Artificial sequence
  SiRNA target sequence
ctccagggagagggagtatgg

SEQ ID NO: 27044 - DNA, 21 bp, Artificial sequence
  SiRNA target sequence
tccagggagagggagtatggt

SEQ ID NO: 27045 - DNA, 21 bp, Artificial sequence
  SiRNA target sequence
ccagggagagggagtatggtt

SEQ ID NO: 27046 - DNA, 21 bp, Artificial sequence
  SiRNA target sequence
cagggagagggagtatggttg

SEQ ID NO: 27047 - DNA, 21 bp, Artificial sequence
  SiRNA target sequence
agggagagggagtatggttgc

SEQ ID NO: 27048 - DNA, 21 bp, Artificial sequence
  SiRNA target sequence
gggagagggagtatggttgct

SEQ ID NO: 27049 - DNA, 21 bp, Artificial sequence
  SiRNA target sequence
ggagagggagtatggttgctc

SEQ ID NO: 27050 - DNA, 21 bp, Artificial sequence
  SiRNA target sequence
gagagggagtatggttgctca

SEQ ID NO: 27051 - DNA, 21 bp, Artificial sequence
  SiRNA target sequence
agagggagtatggttgctcaa

SEQ ID NO: 27052 - DNA, 21 bp, Artificial sequence
  SiRNA target sequence
gagggagtatggttgctcaat

SEQ ID NO: 27053 - DNA, 21 bp, Artificial sequence
  SiRNA target sequence
agggagtatggttgctcaatc

SEQ ID NO: 27054 - DNA, 21 bp, Artificial sequence
  SiRNA target sequence
gggagtatggttgctcaatct

SEQ ID NO: 27055 - DNA, 21 bp, Artificial sequence
  SiRNA target sequence
ggagtatggttgctcaatcta

SEQ ID NO: 27056 - DNA, 21 bp, Artificial sequence
  SiRNA target sequence
gagtatggttgctcaatctaa

SEQ ID NO: 27057 - DNA, 21 bp, Artificial sequence
  SiRNA target sequence
agtatggttgctcaatctaat

SEQ ID NO: 27058 - DNA, 21 bp, Artificial sequence
  SiRNA target sequence
gtatggttgctcaatctaatt

SEQ ID NO: 27059 - DNA, 21 bp, Artificial sequence
  SiRNA target sequence
tatggttgctcaatctaattc

SEQ ID NO: 27060 - DNA, 21 bp, Artificial sequence
  SiRNA target sequence
atggttgctcaatctaattcg

SEQ ID NO: 27061 - DNA, 21 bp, Artificial sequence
  SiRNA target sequence
tggttgctcaatctaattcgg

SEQ ID NO: 27062 - DNA, 21 bp, Artificial sequence
  SiRNA target sequence
ggttgctcaatctaattcggg

SEQ ID NO: 27063 - DNA, 21 bp, Artificial sequence
  SiRNA target sequence
gttgctcaatctaattcgggg

SEQ ID NO: 27064 - DNA, 21 bp, Artificial sequence
  SiRNA target sequence
ttgctcaatctaattcgggga

SEQ ID NO: 27065 - DNA, 21 bp, Artificial sequence
  SiRNA target sequence
tgctcaatctaattcggggac

SEQ ID NO: 27066 - DNA, 21 bp, Artificial sequence
  SiRNA target sequence
gctcaatctaattcggggact

SEQ ID NO: 27067 - DNA, 21 bp, Artificial sequence
  SiRNA target sequence
ctcaatctaattcggggactg

SEQ ID NO: 27068 - DNA, 21 bp, Artificial sequence
  SiRNA target sequence
tcaatctaattcggggactga

SEQ ID NO: 27069 - DNA, 21 bp, Artificial sequence
  SiRNA target sequence
caatctaattcggggactgaa

SEQ ID NO: 27070 - DNA, 21 bp, Artificial sequence
  SiRNA target sequence
aatctaattcggggactgaac

SEQ ID NO: 27071 - DNA, 21 bp, Artificial sequence
  SiRNA target sequence
atctaattcggggactgaaca

SEQ ID NO: 27072 - DNA, 21 bp, Artificial sequence
  SiRNA target sequence
tctaattcggggactgaacaa

SEQ ID NO: 27073 - DNA, 21 bp, Artificial sequence
  SiRNA target sequence
ctaattcggggactgaacaac

SEQ ID NO: 27074 - DNA, 21 bp, Artificial sequence
  SiRNA target sequence
taattcggggactgaacaaca

SEQ ID NO: 27075 - DNA, 21 bp, Artificial sequence
  SiRNA target sequence
aattcggggactgaacaacaa

SEQ ID NO: 27076 - DNA, 21 bp, Artificial sequence
  SiRNA target sequence
attcggggactgaacaacaaa

SEQ ID NO: 27077 - DNA, 21 bp, Artificial sequence
  SiRNA target sequence
ttcggggactgaacaacaaaa

SEQ ID NO: 27078 - DNA, 21 bp, Artificial sequence
  SiRNA target sequence
tcggggactgaacaacaaaat

SEQ ID NO: 27079 - DNA, 21 bp, Artificial sequence
  SiRNA target sequence
cggggactgaacaacaaaatc

SEQ ID NO: 27080 - DNA, 21 bp, Artificial sequence
  SiRNA target sequence
ggggactgaacaacaaaatcc

SEQ ID NO: 27081 - DNA, 21 bp, Artificial sequence
  SiRNA target sequence
gggactgaacaacaaaatccc

SEQ ID NO: 27082 - DNA, 21 bp, Artificial sequence
  SiRNA target sequence
ggactgaacaacaaaatccca

SEQ ID NO: 27083 - DNA, 21 bp, Artificial sequence
  SiRNA target sequence
gactgaacaacaaaatcccag

SEQ ID NO: 27084 - DNA, 21 bp, Artificial sequence
  SiRNA target sequence
actgaacaacaaaatcccagg

SEQ ID NO: 27085 - DNA, 21 bp, Artificial sequence
  SiRNA target sequence
ctgaacaacaaaatcccaggg

SEQ ID NO: 27086 - DNA, 21 bp, Artificial sequence
  SiRNA target sequence
tgaacaacaaaatcccagggg

SEQ ID NO: 27087 - DNA, 21 bp, Artificial sequence
  SiRNA target sequence
gaacaacaaaatcccagggga

SEQ ID NO: 27088 - DNA, 21 bp, Artificial sequence
  SiRNA target sequence
aacaacaaaatcccaggggat

SEQ ID NO: 27089 - DNA, 21 bp, Artificial sequence
  SiRNA target sequence
acaacaaaatcccaggggatc

SEQ ID NO: 27090 - DNA, 21 bp, Artificial sequence
  SiRNA target sequence
caacaaaatcccaggggatct

SEQ ID NO: 27091 - DNA, 21 bp, Artificial sequence
  SiRNA target sequence
aacaaaatcccaggggatctt

SEQ ID NO: 27092 - DNA, 21 bp, Artificial sequence
  SiRNA target sequence
acaaaatcccaggggatcttc

SEQ ID NO: 27093 - DNA, 21 bp, Artificial sequence
  SiRNA target sequence
caaaatcccaggggatcttct

SEQ ID NO: 27094 - DNA, 21 bp, Artificial sequence
  SiRNA target sequence
aaaatcccaggggatcttctt

SEQ ID NO: 27095 - DNA, 21 bp, Artificial sequence
  SiRNA target sequence
aaatcccaggggatcttcttt

SEQ ID NO: 27096 - DNA, 21 bp, Artificial sequence
  SiRNA target sequence
aatcccaggggatcttctttg

SEQ ID NO: 27097 - DNA, 21 bp, Artificial sequence
  SiRNA target sequence
atcccaggggatcttctttgt

SEQ ID NO: 27098 - DNA, 21 bp, Artificial sequence
  SiRNA target sequence
tcccaggggatcttctttgtt

SEQ ID NO: 27099 - DNA, 21 bp, Artificial sequence
  SiRNA target sequence
cccaggggatcttctttgtta

SEQ ID NO: 27100 - DNA, 21 bp, Artificial sequence
  SiRNA target sequence
ccaggggatcttctttgttaa

SEQ ID NO: 27101 - DNA, 21 bp, Artificial sequence
  SiRNA target sequence
caggggatcttctttgttaac

SEQ ID NO: 27102 - DNA, 21 bp, Artificial sequence
  SiRNA target sequence
aggggatcttctttgttaact

SEQ ID NO: 27103 - DNA, 21 bp, Artificial sequence
  SiRNA target sequence
ggggatcttctttgttaactg

SEQ ID NO: 27104 - DNA, 21 bp, Artificial sequence
  SiRNA target sequence
gggatcttctttgttaactga

SEQ ID NO: 27105 - DNA, 21 bp, Artificial sequence
  SiRNA target sequence
ggatcttctttgttaactgac

SEQ ID NO: 27106 - DNA, 21 bp, Artificial sequence
  SiRNA target sequence
gatcttctttgttaactgacc

SEQ ID NO: 27107 - DNA, 21 bp, Artificial sequence
  SiRNA target sequence
atcttctttgttaactgaccc

SEQ ID NO: 27108 - DNA, 21 bp, Artificial sequence
  SiRNA target sequence
tcttctttgttaactgaccca

SEQ ID NO: 27109 - DNA, 21 bp, Artificial sequence
  SiRNA target sequence
cttctttgttaactgacccag

SEQ ID NO: 27110 - DNA, 21 bp, Artificial sequence
  SiRNA target sequence
ttctttgttaactgacccaga

SEQ ID NO: 27111 - DNA, 21 bp, Artificial sequence
  SiRNA target sequence
tctttgttaactgacccagag

SEQ ID NO: 27112 - DNA, 21 bp, Artificial sequence
  SiRNA target sequence
ctttgttaactgacccagagt

SEQ ID NO: 27113 - DNA, 21 bp, Artificial sequence
  SiRNA target sequence
tttgttaactgacccagagtc

SEQ ID NO: 27114 - DNA, 21 bp, Artificial sequence
  SiRNA target sequence
ttgttaactgacccagagtca

SEQ ID NO: 27115 - DNA, 21 bp, Artificial sequence
  SiRNA target sequence
tgttaactgacccagagtcaa

SEQ ID NO: 27116 - DNA, 21 bp, Artificial sequence
  SiRNA target sequence
gttaactgacccagagtcaat

SEQ ID NO: 27117 - DNA, 21 bp, Artificial sequence
  SiRNA target sequence
ttaactgacccagagtcaata

SEQ ID NO: 27118 - DNA, 21 bp, Artificial sequence
  SiRNA target sequence
taactgacccagagtcaataa

SEQ ID NO: 27119 - DNA, 21 bp, Artificial sequence
  SiRNA target sequence
aactgacccagagtcaataac

SEQ ID NO: 27120 - DNA, 21 bp, Artificial sequence
  SiRNA target sequence
actgacccagagtcaataacg

SEQ ID NO: 27121 - DNA, 21 bp, Artificial sequence
  SiRNA target sequence
ctgacccagagtcaataacga

SEQ ID NO: 27122 - DNA, 21 bp, Artificial sequence
  SiRNA target sequence
tgacccagagtcaataacgaa

SEQ ID NO: 27123 - DNA, 21 bp, Artificial sequence
  SiRNA target sequence
gacccagagtcaataacgaag

SEQ ID NO: 27124 - DNA, 21 bp, Artificial sequence
  SiRNA target sequence
acccagagtcaataacgaagt

SEQ ID NO: 27125 - DNA, 21 bp, Artificial sequence
  SiRNA target sequence
cccagagtcaataacgaagtc

SEQ ID NO: 27126 - DNA, 21 bp, Artificial sequence
  SiRNA target sequence
ccagagtcaataacgaagtct

SEQ ID NO: 27127 - DNA, 21 bp, Artificial sequence
  SiRNA target sequence
cagagtcaataacgaagtctg

SEQ ID NO: 27128 - DNA, 21 bp, Artificial sequence
  SiRNA target sequence
agagtcaataacgaagtctga

SEQ ID NO: 27129 - DNA, 21 bp, Artificial sequence
  SiRNA target sequence
gagtcaataacgaagtctgat

SEQ ID NO: 27130 - DNA, 21 bp, Artificial sequence
  SiRNA target sequence
agtcaataacgaagtctgatc

SEQ ID NO: 27131 - DNA, 21 bp, Artificial sequence
  SiRNA target sequence
gtcaataacgaagtctgatcc

SEQ ID NO: 27132 - DNA, 21 bp, Artificial sequence
  SiRNA target sequence
tcaataacgaagtctgatcct

SEQ ID NO: 27133 - DNA, 21 bp, Artificial sequence
  SiRNA target sequence
caataacgaagtctgatcctt

SEQ ID NO: 27134 - DNA, 21 bp, Artificial sequence
  SiRNA target sequence
aataacgaagtctgatcctta

SEQ ID NO: 27135 - DNA, 21 bp, Artificial sequence
  SiRNA target sequence
ataacgaagtctgatccttac

SEQ ID NO: 27136 - DNA, 21 bp, Artificial sequence
  SiRNA target sequence
taacgaagtctgatccttaca

SEQ ID NO: 27137 - DNA, 21 bp, Artificial sequence
  SiRNA target sequence
aacgaagtctgatccttacaa

SEQ ID NO: 27138 - DNA, 21 bp, Artificial sequence
  SiRNA target sequence
acgaagtctgatccttacaat

SEQ ID NO: 27139 - DNA, 21 bp, Artificial sequence
  SiRNA target sequence
cgaagtctgatccttacaatc

SEQ ID NO: 27140 - DNA, 21 bp, Artificial sequence
  SiRNA target sequence
gaagtctgatccttacaatcc

SEQ ID NO: 27141 - DNA, 21 bp, Artificial sequence
  SiRNA target sequence
aagtctgatccttacaatccg

SEQ ID NO: 27142 - DNA, 21 bp, Artificial sequence
  SiRNA target sequence
agtctgatccttacaatccga

SEQ ID NO: 27143 - DNA, 21 bp, Artificial sequence
  SiRNA target sequence
gtctgatccttacaatccgaa

SEQ ID NO: 27144 - DNA, 21 bp, Artificial sequence
  SiRNA target sequence
tctgatccttacaatccgaat

SEQ ID NO: 27145 - DNA, 21 bp, Artificial sequence
  SiRNA target sequence
ctgatccttacaatccgaata

SEQ ID NO: 27146 - DNA, 21 bp, Artificial sequence
  SiRNA target sequence
tgatccttacaatccgaatat

SEQ ID NO: 27147 - DNA, 21 bp, Artificial sequence
  SiRNA target sequence
gatccttacaatccgaatatt

SEQ ID NO: 27148 - DNA, 21 bp, Artificial sequence
  SiRNA target sequence
atccttacaatccgaatattt

SEQ ID NO: 27149 - DNA, 21 bp, Artificial sequence
  SiRNA target sequence
tccttacaatccgaatatttc

SEQ ID NO: 27150 - DNA, 21 bp, Artificial sequence
  SiRNA target sequence
ccttacaatccgaatatttct

SEQ ID NO: 27151 - DNA, 21 bp, Artificial sequence
  SiRNA target sequence
cttacaatccgaatatttctc

SEQ ID NO: 27152 - DNA, 21 bp, Artificial sequence
  SiRNA target sequence
ttacaatccgaatatttctct

SEQ ID NO: 27153 - DNA, 21 bp, Artificial sequence
  SiRNA target sequence
tacaatccgaatatttctctc

SEQ ID NO: 27154 - DNA, 21 bp, Artificial sequence
  SiRNA target sequence
acaatccgaatatttctctct

SEQ ID NO: 27155 - DNA, 21 bp, Artificial sequence
  SiRNA target sequence
caatccgaatatttctctctt

SEQ ID NO: 27156 - DNA, 21 bp, Artificial sequence
  SiRNA target sequence
aatccgaatatttctctcttg

SEQ ID NO: 27157 - DNA, 21 bp, Artificial sequence
  SiRNA target sequence
atccgaatatttctctcttga

SEQ ID NO: 27158 - DNA, 21 bp, Artificial sequence
  SiRNA target sequence
tccgaatatttctctcttgat

SEQ ID NO: 27159 - DNA, 21 bp, Artificial sequence
  SiRNA target sequence
ccgaatatttctctcttgatt

SEQ ID NO: 27160 - DNA, 21 bp, Artificial sequence
  SiRNA target sequence
cgaatatttctctcttgatta

SEQ ID NO: 27161 - DNA, 21 bp, Artificial sequence
  SiRNA target sequence
gaatatttctctcttgattag

SEQ ID NO: 27162 - DNA, 21 bp, Artificial sequence
  SiRNA target sequence
aatatttctctcttgattagc

SEQ ID NO: 27163 - DNA, 21 bp, Artificial sequence
  SiRNA target sequence
atatttctctcttgattagcg

SEQ ID NO: 27164 - DNA, 21 bp, Artificial sequence
  SiRNA target sequence
tatttctctcttgattagcgg

SEQ ID NO: 27165 - DNA, 21 bp, Artificial sequence
  SiRNA target sequence
atttctctcttgattagcgga

SEQ ID NO: 27166 - DNA, 21 bp, Artificial sequence
  SiRNA target sequence
tttctctcttgattagcggag

SEQ ID NO: 27167 - DNA, 21 bp, Artificial sequence
  SiRNA target sequence
ttctctcttgattagcggaga

SEQ ID NO: 27168 - DNA, 21 bp, Artificial sequence
  SiRNA target sequence
tctctcttgattagcggagaa

SEQ ID NO: 27169 - DNA, 21 bp, Artificial sequence
  SiRNA target sequence
ctctcttgattagcggagaag

SEQ ID NO: 27170 - DNA, 21 bp, Artificial sequence
  SiRNA target sequence
tctcttgattagcggagaagt

SEQ ID NO: 27171 - DNA, 21 bp, Artificial sequence
  SiRNA target sequence
ctcttgattagcggagaagtt

SEQ ID NO: 27172 - DNA, 21 bp, Artificial sequence
  SiRNA target sequence
tcttgattagcggagaagttt

SEQ ID NO: 27173 - DNA, 21 bp, Artificial sequence
  SiRNA target sequence
cttgattagcggagaagtttt

SEQ ID NO: 27174 - DNA, 21 bp, Artificial sequence
  SiRNA target sequence
ttgattagcggagaagttttt

SEQ ID NO: 27175 - DNA, 21 bp, Artificial sequence
  SiRNA target sequence
tgattagcggagaagttttta

SEQ ID NO: 27176 - DNA, 21 bp, Artificial sequence
  SiRNA target sequence
gattagcggagaagtttttac

SEQ ID NO: 27177 - DNA, 21 bp, Artificial sequence
  SiRNA target sequence
attagcggagaagtttttact

SEQ ID NO: 27178 - DNA, 21 bp, Artificial sequence
  SiRNA target sequence
ttagcggagaagtttttacta

SEQ ID NO: 27179 - DNA, 21 bp, Artificial sequence
  SiRNA target sequence
tagcggagaagtttttactaa

SEQ ID NO: 27180 - DNA, 21 bp, Artificial sequence
  SiRNA target sequence
agcggagaagtttttactaac

SEQ ID NO: 27181 - DNA, 21 bp, Artificial sequence
  SiRNA target sequence
gcggagaagtttttactaact

SEQ ID NO: 27182 - DNA, 21 bp, Artificial sequence
  SiRNA target sequence
cggagaagtttttactaactt

SEQ ID NO: 27183 - DNA, 21 bp, Artificial sequence
  SiRNA target sequence
ggagaagtttttactaacttc

SEQ ID NO: 27184 - DNA, 21 bp, Artificial sequence
  SiRNA target sequence
gagaagtttttactaacttca

SEQ ID NO: 27185 - DNA, 21 bp, Artificial sequence
  SiRNA target sequence
agaagtttttactaacttcag

SEQ ID NO: 27186 - DNA, 21 bp, Artificial sequence
  SiRNA target sequence
gaagtttttactaacttcaga

SEQ ID NO: 27187 - DNA, 21 bp, Artificial sequence
  SiRNA target sequence
aagtttttactaacttcagaa

SEQ ID NO: 27188 - DNA, 21 bp, Artificial sequence
  SiRNA target sequence
agtttttactaacttcagaaa

SEQ ID NO: 27189 - DNA, 21 bp, Artificial sequence
  SiRNA target sequence
gtttttactaacttcagaaac

SEQ ID NO: 27190 - DNA, 21 bp, Artificial sequence
  SiRNA target sequence
tttttactaacttcagaaact

SEQ ID NO: 27191 - DNA, 21 bp, Artificial sequence
  SiRNA target sequence
ttttactaacttcagaaactt

SEQ ID NO: 27192 - DNA, 21 bp, Artificial sequence
  SiRNA target sequence
tttactaacttcagaaacttg

SEQ ID NO: 27193 - DNA, 21 bp, Artificial sequence
  SiRNA target sequence
ttactaacttcagaaacttga

SEQ ID NO: 27194 - DNA, 21 bp, Artificial sequence
  SiRNA target sequence
tactaacttcagaaacttgat

SEQ ID NO: 27195 - DNA, 21 bp, Artificial sequence
  SiRNA target sequence
actaacttcagaaacttgatt

SEQ ID NO: 27196 - DNA, 21 bp, Artificial sequence
  SiRNA target sequence
ctaacttcagaaacttgatta

SEQ ID NO: 27197 - DNA, 21 bp, Artificial sequence
  SiRNA target sequence
taacttcagaaacttgattaa

SEQ ID NO: 27198 - DNA, 21 bp, Artificial sequence
  SiRNA target sequence
aacttcagaaacttgattaag

SEQ ID NO: 27199 - DNA, 21 bp, Artificial sequence
  SiRNA target sequence
acttcagaaacttgattaaga

SEQ ID NO: 27200 - DNA, 21 bp, Artificial sequence
  SiRNA target sequence
cttcagaaacttgattaagag

SEQ ID NO: 27201 - DNA, 21 bp, Artificial sequence
  SiRNA target sequence
ttcagaaacttgattaagaga

SEQ ID NO: 27202 - DNA, 21 bp, Artificial sequence
  SiRNA target sequence
tcagaaacttgattaagagag

SEQ ID NO: 27203 - DNA, 21 bp, Artificial sequence
  SiRNA target sequence
cagaaacttgattaagagagt

SEQ ID NO: 27204 - DNA, 21 bp, Artificial sequence
  SiRNA target sequence
agaaacttgattaagagagta

SEQ ID NO: 27205 - DNA, 21 bp, Artificial sequence
  SiRNA target sequence
gaaacttgattaagagagtaa

SEQ ID NO: 27206 - DNA, 21 bp, Artificial sequence
  SiRNA target sequence
aaacttgattaagagagtaaa

SEQ ID NO: 27207 - DNA, 21 bp, Artificial sequence
  SiRNA target sequence
aacttgattaagagagtaaat

SEQ ID NO: 27208 - DNA, 21 bp, Artificial sequence
  SiRNA target sequence
acttgattaagagagtaaatt

SEQ ID NO: 27209 - DNA, 21 bp, Artificial sequence
  SiRNA target sequence
cttgattaagagagtaaattt

SEQ ID NO: 27210 - DNA, 21 bp, Artificial sequence
  SiRNA target sequence
ttgattaagagagtaaatttc

SEQ ID NO: 27211 - DNA, 21 bp, Artificial sequence
  SiRNA target sequence
tgattaagagagtaaatttca

SEQ ID NO: 27212 - DNA, 21 bp, Artificial sequence
  SiRNA target sequence
gattaagagagtaaatttcag

SEQ ID NO: 27213 - DNA, 21 bp, Artificial sequence
  SiRNA target sequence
attaagagagtaaatttcaga

SEQ ID NO: 27214 - DNA, 21 bp, Artificial sequence
  SiRNA target sequence
ttaagagagtaaatttcagaa

SEQ ID NO: 27215 - DNA, 21 bp, Artificial sequence
  SiRNA target sequence
taagagagtaaatttcagaaa

SEQ ID NO: 27216 - DNA, 21 bp, Artificial sequence
  SiRNA target sequence
aagagagtaaatttcagaaag

SEQ ID NO: 27217 - DNA, 21 bp, Artificial sequence
  SiRNA target sequence
agagagtaaatttcagaaagg

SEQ ID NO: 27218 - DNA, 21 bp, Artificial sequence
  SiRNA target sequence
gagagtaaatttcagaaaggc

SEQ ID NO: 27219 - DNA, 21 bp, Artificial sequence
  SiRNA target sequence
agagtaaatttcagaaaggct

SEQ ID NO: 27220 - DNA, 21 bp, Artificial sequence
  SiRNA target sequence
gagtaaatttcagaaaggcta

SEQ ID NO: 27221 - DNA, 21 bp, Artificial sequence
  SiRNA target sequence
agtaaatttcagaaaggctac

SEQ ID NO: 27222 - DNA, 21 bp, Artificial sequence
  SiRNA target sequence
gtaaatttcagaaaggctact

SEQ ID NO: 27223 - DNA, 21 bp, Artificial sequence
  SiRNA target sequence
taaatttcagaaaggctacta

SEQ ID NO: 27224 - DNA, 21 bp, Artificial sequence
  SiRNA target sequence
aaatttcagaaaggctactac

SEQ ID NO: 27225 - DNA, 21 bp, Artificial sequence
  SiRNA target sequence
aatttcagaaaggctactaca

SEQ ID NO: 27226 - DNA, 21 bp, Artificial sequence
  SiRNA target sequence
atttcagaaaggctactacat

SEQ ID NO: 27227 - DNA, 21 bp, Artificial sequence
  SiRNA target sequence
tttcagaaaggctactacatt

SEQ ID NO: 27228 - DNA, 21 bp, Artificial sequence
  SiRNA target sequence
ttcagaaaggctactacattg

SEQ ID NO: 27229 - DNA, 21 bp, Artificial sequence
  SiRNA target sequence
tcagaaaggctactacattga

SEQ ID NO: 27230 - DNA, 21 bp, Artificial sequence
  SiRNA target sequence
cagaaaggctactacattgaa

SEQ ID NO: 27231 - DNA, 21 bp, Artificial sequence
  SiRNA target sequence
agaaaggctactacattgaat

SEQ ID NO: 27232 - DNA, 21 bp, Artificial sequence
  SiRNA target sequence
gaaaggctactacattgaatg

SEQ ID NO: 27233 - DNA, 21 bp, Artificial sequence
  SiRNA target sequence
aaaggctactacattgaatgg

SEQ ID NO: 27234 - DNA, 21 bp, Artificial sequence
  SiRNA target sequence
aaggctactacattgaatgga

SEQ ID NO: 27235 - DNA, 21 bp, Artificial sequence
  SiRNA target sequence
aggctactacattgaatggaa

SEQ ID NO: 27236 - DNA, 21 bp, Artificial sequence
  SiRNA target sequence
ggctactacattgaatggaaa

SEQ ID NO: 27237 - DNA, 21 bp, Artificial sequence
  SiRNA target sequence
gctactacattgaatggaaag

SEQ ID NO: 27238 - DNA, 21 bp, Artificial sequence
  SiRNA target sequence
ctactacattgaatggaaagc

SEQ ID NO: 27239 - DNA, 21 bp, Artificial sequence
  SiRNA target sequence
tactacattgaatggaaagcg

SEQ ID NO: 27240 - DNA, 21 bp, Artificial sequence
  SiRNA target sequence
actacattgaatggaaagcgt

SEQ ID NO: 27241 - DNA, 21 bp, Artificial sequence
  SiRNA target sequence
ctacattgaatggaaagcgta

SEQ ID NO: 27242 - DNA, 21 bp, Artificial sequence
  SiRNA target sequence
tacattgaatggaaagcgtat

SEQ ID NO: 27243 - DNA, 21 bp, Artificial sequence
  SiRNA target sequence
acattgaatggaaagcgtatc

SEQ ID NO: 27244 - DNA, 21 bp, Artificial sequence
  SiRNA target sequence
cattgaatggaaagcgtatcg

SEQ ID NO: 27245 - DNA, 21 bp, Artificial sequence
  SiRNA target sequence
attgaatggaaagcgtatcgg

SEQ ID NO: 27246 - DNA, 21 bp, Artificial sequence
  SiRNA target sequence
ttgaatggaaagcgtatcgga

SEQ ID NO: 27247 - DNA, 21 bp, Artificial sequence
  SiRNA target sequence
tgaatggaaagcgtatcggag

SEQ ID NO: 27248 - DNA, 21 bp, Artificial sequence
  SiRNA target sequence
gaatggaaagcgtatcggaga

SEQ ID NO: 27249 - DNA, 21 bp, Artificial sequence
  SiRNA target sequence
aatggaaagcgtatcggagat

SEQ ID NO: 27250 - DNA, 21 bp, Artificial sequence
  SiRNA target sequence
atggaaagcgtatcggagata

SEQ ID NO: 27251 - DNA, 21 bp, Artificial sequence
  SiRNA target sequence
tggaaagcgtatcggagatac

SEQ ID NO: 27252 - DNA, 21 bp, Artificial sequence
  SiRNA target sequence
ggaaagcgtatcggagatacg

SEQ ID NO: 27253 - DNA, 21 bp, Artificial sequence
  SiRNA target sequence
gaaagcgtatcggagatacgt

SEQ ID NO: 27254 - DNA, 21 bp, Artificial sequence
  SiRNA target sequence
aaagcgtatcggagatacgtt

SEQ ID NO: 27255 - DNA, 21 bp, Artificial sequence
  SiRNA target sequence
aagcgtatcggagatacgttt

SEQ ID NO: 27256 - DNA, 21 bp, Artificial sequence
  SiRNA target sequence
agcgtatcggagatacgtttc

SEQ ID NO: 27257 - DNA, 21 bp, Artificial sequence
  SiRNA target sequence
gcgtatcggagatacgtttcc

SEQ ID NO: 27258 - DNA, 21 bp, Artificial sequence
  SiRNA target sequence
cgtatcggagatacgtttccc

SEQ ID NO: 27259 - DNA, 21 bp, Artificial sequence
  SiRNA target sequence
gtatcggagatacgtttcccg

SEQ ID NO: 27260 - DNA, 21 bp, Artificial sequence
  SiRNA target sequence
tatcggagatacgtttcccgt

SEQ ID NO: 27261 - DNA, 21 bp, Artificial sequence
  SiRNA target sequence
atcggagatacgtttcccgtt

SEQ ID NO: 27262 - DNA, 21 bp, Artificial sequence
  SiRNA target sequence
tcggagatacgtttcccgtta

SEQ ID NO: 27263 - DNA, 21 bp, Artificial sequence
  SiRNA target sequence
cggagatacgtttcccgttaa

SEQ ID NO: 27264 - DNA, 21 bp, Artificial sequence
  SiRNA target sequence
ggagatacgtttcccgttaat

SEQ ID NO: 27265 - DNA, 21 bp, Artificial sequence
  SiRNA target sequence
gagatacgtttcccgttaata

SEQ ID NO: 27266 - DNA, 21 bp, Artificial sequence
  SiRNA target sequence
agatacgtttcccgttaatag

SEQ ID NO: 27267 - DNA, 21 bp, Artificial sequence
  SiRNA target sequence
gatacgtttcccgttaatagc

SEQ ID NO: 27268 - DNA, 21 bp, Artificial sequence
  SiRNA target sequence
atacgtttcccgttaatagcc

SEQ ID NO: 27269 - DNA, 21 bp, Artificial sequence
  SiRNA target sequence
tacgtttcccgttaatagcct

SEQ ID NO: 27270 - DNA, 21 bp, Artificial sequence
  SiRNA target sequence
acgtttcccgttaatagcctg

SEQ ID NO: 27271 - DNA, 21 bp, Artificial sequence
  SiRNA target sequence
cgtttcccgttaatagcctga

SEQ ID NO: 27272 - DNA, 21 bp, Artificial sequence
  SiRNA target sequence
gtttcccgttaatagcctgat

SEQ ID NO: 27273 - DNA, 21 bp, Artificial sequence
  SiRNA target sequence
tttcccgttaatagcctgatt

SEQ ID NO: 27274 - DNA, 21 bp, Artificial sequence
  SiRNA target sequence
ttcccgttaatagcctgattg

SEQ ID NO: 27275 - DNA, 21 bp, Artificial sequence
  SiRNA target sequence
tcccgttaatagcctgattga

SEQ ID NO: 27276 - DNA, 21 bp, Artificial sequence
  SiRNA target sequence
cccgttaatagcctgattgaa

SEQ ID NO: 27277 - DNA, 21 bp, Artificial sequence
  SiRNA target sequence
ccgttaatagcctgattgaag

SEQ ID NO: 27278 - DNA, 21 bp, Artificial sequence
  SiRNA target sequence
cgttaatagcctgattgaagc

SEQ ID NO: 27279 - DNA, 21 bp, Artificial sequence
  SiRNA target sequence
gttaatagcctgattgaagca

SEQ ID NO: 27280 - DNA, 21 bp, Artificial sequence
  SiRNA target sequence
ttaatagcctgattgaagcac

SEQ ID NO: 27281 - DNA, 21 bp, Artificial sequence
  SiRNA target sequence
taatagcctgattgaagcacc

SEQ ID NO: 27282 - DNA, 21 bp, Artificial sequence
  SiRNA target sequence
aatagcctgattgaagcaccc

SEQ ID NO: 27283 - DNA, 21 bp, Artificial sequence
  SiRNA target sequence
atagcctgattgaagcacccc

SEQ ID NO: 27284 - DNA, 21 bp, Artificial sequence
  SiRNA target sequence
tagcctgattgaagcaccccg

SEQ ID NO: 27285 - DNA, 21 bp, Artificial sequence
  SiRNA target sequence
agcctgattgaagcaccccgt

SEQ ID NO: 27286 - DNA, 21 bp, Artificial sequence
  SiRNA target sequence
gcctgattgaagcaccccgtc

SEQ ID NO: 27287 - DNA, 21 bp, Artificial sequence
  SiRNA target sequence
cctgattgaagcaccccgtct

SEQ ID NO: 27288 - DNA, 21 bp, Artificial sequence
  SiRNA target sequence
ctgattgaagcaccccgtctt

SEQ ID NO: 27289 - DNA, 21 bp, Artificial sequence
  SiRNA target sequence
tgattgaagcaccccgtcttg

SEQ ID NO: 27290 - DNA, 21 bp, Artificial sequence
  SiRNA target sequence
gattgaagcaccccgtcttga

SEQ ID NO: 27291 - DNA, 21 bp, Artificial sequence
  SiRNA target sequence
attgaagcaccccgtcttgat

SEQ ID NO: 27292 - DNA, 21 bp, Artificial sequence
  SiRNA target sequence
ttgaagcaccccgtcttgata

SEQ ID NO: 27293 - DNA, 21 bp, Artificial sequence
  SiRNA target sequence
tgaagcaccccgtcttgatat

SEQ ID NO: 27294 - DNA, 21 bp, Artificial sequence
  SiRNA target sequence
gaagcaccccgtcttgatata

SEQ ID NO: 27295 - DNA, 21 bp, Artificial sequence
  SiRNA target sequence
aagcaccccgtcttgatatag

SEQ ID NO: 27296 - DNA, 21 bp, Artificial sequence
  SiRNA target sequence
agcaccccgtcttgatatagc

SEQ ID NO: 27297 - DNA, 21 bp, Artificial sequence
  SiRNA target sequence
gcaccccgtcttgatatagct

SEQ ID NO: 27298 - DNA, 21 bp, Artificial sequence
  SiRNA target sequence
caccccgtcttgatatagctc

SEQ ID NO: 27299 - DNA, 21 bp, Artificial sequence
  SiRNA target sequence
accccgtcttgatatagctca

SEQ ID NO: 27300 - DNA, 21 bp, Artificial sequence
  SiRNA target sequence
ccccgtcttgatatagctcaa

SEQ ID NO: 27301 - DNA, 21 bp, Artificial sequence
  SiRNA target sequence
cccgtcttgatatagctcaat

SEQ ID NO: 27302 - DNA, 21 bp, Artificial sequence
  SiRNA target sequence
ccgtcttgatatagctcaata

SEQ ID NO: 27303 - DNA, 21 bp, Artificial sequence
  SiRNA target sequence
cgtcttgatatagctcaatac

SEQ ID NO: 27304 - DNA, 21 bp, Artificial sequence
  SiRNA target sequence
gtcttgatatagctcaatacg

SEQ ID NO: 27305 - DNA, 21 bp, Artificial sequence
  SiRNA target sequence
tcttgatatagctcaatacgt

SEQ ID NO: 27306 - DNA, 21 bp, Artificial sequence
  SiRNA target sequence
cttgatatagctcaatacgtc

SEQ ID NO: 27307 - DNA, 21 bp, Artificial sequence
  SiRNA target sequence
ttgatatagctcaatacgtcg

SEQ ID NO: 27308 - DNA, 21 bp, Artificial sequence
  SiRNA target sequence
tgatatagctcaatacgtcga

SEQ ID NO: 27309 - DNA, 21 bp, Artificial sequence
  SiRNA target sequence
gatatagctcaatacgtcgat

SEQ ID NO: 27310 - DNA, 21 bp, Artificial sequence
  SiRNA target sequence
atatagctcaatacgtcgata

SEQ ID NO: 27311 - DNA, 21 bp, Artificial sequence
  SiRNA target sequence
tatagctcaatacgtcgatac

SEQ ID NO: 27312 - DNA, 21 bp, Artificial sequence
  SiRNA target sequence
atagctcaatacgtcgatact

SEQ ID NO: 27313 - DNA, 21 bp, Artificial sequence
  SiRNA target sequence
tagctcaatacgtcgatactg

SEQ ID NO: 27314 - DNA, 21 bp, Artificial sequence
  SiRNA target sequence
agctcaatacgtcgatactga

SEQ ID NO: 27315 - DNA, 21 bp, Artificial sequence
  SiRNA target sequence
gctcaatacgtcgatactgaa

SEQ ID NO: 27316 - DNA, 21 bp, Artificial sequence
  SiRNA target sequence
ctcaatacgtcgatactgaaa

SEQ ID NO: 27317 - DNA, 21 bp, Artificial sequence
  SiRNA target sequence
tcaatacgtcgatactgaaac

SEQ ID NO: 27318 - DNA, 21 bp, Artificial sequence
  SiRNA target sequence
caatacgtcgatactgaaacc

SEQ ID NO: 27319 - DNA, 21 bp, Artificial sequence
  SiRNA target sequence
aatacgtcgatactgaaacca

SEQ ID NO: 27320 - DNA, 21 bp, Artificial sequence
  SiRNA target sequence
atacgtcgatactgaaaccaa

SEQ ID NO: 27321 - DNA, 21 bp, Artificial sequence
  SiRNA target sequence
tacgtcgatactgaaaccaag

SEQ ID NO: 27322 - DNA, 21 bp, Artificial sequence
  SiRNA target sequence
acgtcgatactgaaaccaagg

SEQ ID NO: 27323 - DNA, 21 bp, Artificial sequence
  SiRNA target sequence
cgtcgatactgaaaccaagga

SEQ ID NO: 27324 - DNA, 21 bp, Artificial sequence
  SiRNA target sequence
gtcgatactgaaaccaaggag

SEQ ID NO: 27325 - DNA, 21 bp, Artificial sequence
  SiRNA target sequence
tcgatactgaaaccaaggagg

SEQ ID NO: 27326 - DNA, 21 bp, Artificial sequence
  SiRNA target sequence
cgatactgaaaccaaggaggc

SEQ ID NO: 27327 - DNA, 21 bp, Artificial sequence
  SiRNA target sequence
gatactgaaaccaaggaggct

SEQ ID NO: 27328 - DNA, 21 bp, Artificial sequence
  SiRNA target sequence
atactgaaaccaaggaggcta

SEQ ID NO: 27329 - DNA, 21 bp, Artificial sequence
  SiRNA target sequence
tactgaaaccaaggaggctaa

SEQ ID NO: 27330 - DNA, 21 bp, Artificial sequence
  SiRNA target sequence
actgaaaccaaggaggctaaa

SEQ ID NO: 27331 - DNA, 21 bp, Artificial sequence
  SiRNA target sequence
ctgaaaccaaggaggctaaat

SEQ ID NO: 27332 - DNA, 21 bp, Artificial sequence
  SiRNA target sequence
tgaaaccaaggaggctaaata

SEQ ID NO: 27333 - DNA, 21 bp, Artificial sequence
  SiRNA target sequence
gaaaccaaggaggctaaatat

SEQ ID NO: 27334 - DNA, 21 bp, Artificial sequence
  SiRNA target sequence
aaaccaaggaggctaaatatg

SEQ ID NO: 27335 - DNA, 21 bp, Artificial sequence
  SiRNA target sequence
aaccaaggaggctaaatatgg

SEQ ID NO: 27336 - DNA, 21 bp, Artificial sequence
  SiRNA target sequence
accaaggaggctaaatatgga

SEQ ID NO: 27337 - DNA, 21 bp, Artificial sequence
  SiRNA target sequence
ccaaggaggctaaatatggat

SEQ ID NO: 27338 - DNA, 21 bp, Artificial sequence
  SiRNA target sequence
caaggaggctaaatatggatt

SEQ ID NO: 27339 - DNA, 21 bp, Artificial sequence
  SiRNA target sequence
aaggaggctaaatatggattt

SEQ ID NO: 27340 - DNA, 21 bp, Artificial sequence
  SiRNA target sequence
aggaggctaaatatggattta

SEQ ID NO: 27341 - DNA, 21 bp, Artificial sequence
  SiRNA target sequence
ggaggctaaatatggatttag

SEQ ID NO: 27342 - DNA, 21 bp, Artificial sequence
  SiRNA target sequence
gaggctaaatatggatttagt

SEQ ID NO: 27343 - DNA, 21 bp, Artificial sequence
  SiRNA target sequence
aggctaaatatggatttagtt

SEQ ID NO: 27344 - DNA, 21 bp, Artificial sequence
  SiRNA target sequence
ggctaaatatggatttagttt

SEQ ID NO: 27345 - DNA, 21 bp, Artificial sequence
  SiRNA target sequence
gctaaatatggatttagtttc

SEQ ID NO: 27346 - DNA, 21 bp, Artificial sequence
  SiRNA target sequence
ctaaatatggatttagtttct

SEQ ID NO: 27347 - DNA, 21 bp, Artificial sequence
  SiRNA target sequence
taaatatggatttagtttctt

SEQ ID NO: 27348 - DNA, 21 bp, Artificial sequence
  SiRNA target sequence
aaatatggatttagtttcttt

SEQ ID NO: 27349 - DNA, 21 bp, Artificial sequence
  SiRNA target sequence
aatatggatttagtttctttt

SEQ ID NO: 27350 - DNA, 21 bp, Artificial sequence
  SiRNA target sequence
atatggatttagtttcttttg

SEQ ID NO: 27351 - DNA, 21 bp, Artificial sequence
  SiRNA target sequence
tatggatttagtttcttttgg

SEQ ID NO: 27352 - DNA, 21 bp, Artificial sequence
  SiRNA target sequence
atggatttagtttcttttggt

SEQ ID NO: 27353 - DNA, 21 bp, Artificial sequence
  SiRNA target sequence
tggatttagtttcttttggtc

SEQ ID NO: 27354 - DNA, 21 bp, Artificial sequence
  SiRNA target sequence
ggatttagtttcttttggtcg

SEQ ID NO: 27355 - DNA, 21 bp, Artificial sequence
  SiRNA target sequence
gatttagtttcttttggtcgg

SEQ ID NO: 27356 - DNA, 21 bp, Artificial sequence
  SiRNA target sequence
atttagtttcttttggtcggc

SEQ ID NO: 27357 - DNA, 21 bp, Artificial sequence
  SiRNA target sequence
tttagtttcttttggtcggct

SEQ ID NO: 27358 - DNA, 21 bp, Artificial sequence
  SiRNA target sequence
ttagtttcttttggtcggctc

SEQ ID NO: 27359 - DNA, 21 bp, Artificial sequence
  SiRNA target sequence
tagtttcttttggtcggctcc

SEQ ID NO: 27360 - DNA, 21 bp, Artificial sequence
  SiRNA target sequence
agtttcttttggtcggctccc

SEQ ID NO: 27361 - DNA, 21 bp, Artificial sequence
  SiRNA target sequence
gtttcttttggtcggctccca

SEQ ID NO: 27362 - DNA, 21 bp, Artificial sequence
  SiRNA target sequence
tttcttttggtcggctcccac

SEQ ID NO: 27363 - DNA, 21 bp, Artificial sequence
  SiRNA target sequence
ttcttttggtcggctcccact

SEQ ID NO: 27364 - DNA, 21 bp, Artificial sequence
  SiRNA target sequence
tcttttggtcggctcccacta

SEQ ID NO: 27365 - DNA, 21 bp, Artificial sequence
  SiRNA target sequence
cttttggtcggctcccactac

SEQ ID NO: 27366 - DNA, 21 bp, Artificial sequence
  SiRNA target sequence
ttttggtcggctcccactacc

SEQ ID NO: 27367 - DNA, 21 bp, Artificial sequence
  SiRNA target sequence
tttggtcggctcccactacct

SEQ ID NO: 27368 - DNA, 21 bp, Artificial sequence
  SiRNA target sequence
ttggtcggctcccactacctt

SEQ ID NO: 27369 - DNA, 21 bp, Artificial sequence
  SiRNA target sequence
tggtcggctcccactacctta

SEQ ID NO: 27370 - DNA, 21 bp, Artificial sequence
  SiRNA target sequence
ggtcggctcccactaccttaa

SEQ ID NO: 27371 - DNA, 21 bp, Artificial sequence
  SiRNA target sequence
gtcggctcccactaccttaaa

SEQ ID NO: 27372 - DNA, 21 bp, Artificial sequence
  SiRNA target sequence
tcggctcccactaccttaaac

SEQ ID NO: 27373 - DNA, 21 bp, Artificial sequence
  SiRNA target sequence
cggctcccactaccttaaaca

SEQ ID NO: 27374 - DNA, 21 bp, Artificial sequence
  SiRNA target sequence
ggctcccactaccttaaacat

SEQ ID NO: 27375 - DNA, 21 bp, Artificial sequence
  SiRNA target sequence
gctcccactaccttaaacata

SEQ ID NO: 27376 - DNA, 21 bp, Artificial sequence
  SiRNA target sequence
ctcccactaccttaaacatag

SEQ ID NO: 27377 - DNA, 21 bp, Artificial sequence
  SiRNA target sequence
tcccactaccttaaacatagt

SEQ ID NO: 27378 - DNA, 21 bp, Artificial sequence
  SiRNA target sequence
cccactaccttaaacatagtg

SEQ ID NO: 27379 - DNA, 21 bp, Artificial sequence
  SiRNA target sequence
ccactaccttaaacatagtgg

SEQ ID NO: 27380 - DNA, 21 bp, Artificial sequence
  SiRNA target sequence
cactaccttaaacatagtggc

SEQ ID NO: 27381 - DNA, 21 bp, Artificial sequence
  SiRNA target sequence
actaccttaaacatagtggcg

SEQ ID NO: 27382 - DNA, 21 bp, Artificial sequence
  SiRNA target sequence
ctaccttaaacatagtggcgg

SEQ ID NO: 27383 - DNA, 21 bp, Artificial sequence
  SiRNA target sequence
taccttaaacatagtggcgga

SEQ ID NO: 27384 - DNA, 21 bp, Artificial sequence
  SiRNA target sequence
accttaaacatagtggcggag

SEQ ID NO: 27385 - DNA, 21 bp, Artificial sequence
  SiRNA target sequence
ccttaaacatagtggcggaga

SEQ ID NO: 27386 - DNA, 21 bp, Artificial sequence
  SiRNA target sequence
cttaaacatagtggcggagat

SEQ ID NO: 27387 - DNA, 21 bp, Artificial sequence
  SiRNA target sequence
ttaaacatagtggcggagatg

SEQ ID NO: 27388 - DNA, 21 bp, Artificial sequence
  SiRNA target sequence
taaacatagtggcggagatgt

SEQ ID NO: 27389 - DNA, 21 bp, Artificial sequence
  SiRNA target sequence
aaacatagtggcggagatgta

SEQ ID NO: 27390 - DNA, 21 bp, Artificial sequence
  SiRNA target sequence
aacatagtggcggagatgtat

SEQ ID NO: 27391 - DNA, 21 bp, Artificial sequence
  SiRNA target sequence
acatagtggcggagatgtatg

SEQ ID NO: 27392 - DNA, 21 bp, Artificial sequence
  SiRNA target sequence
catagtggcggagatgtatgc

SEQ ID NO: 27393 - DNA, 21 bp, Artificial sequence
  SiRNA target sequence
atagtggcggagatgtatgcg

SEQ ID NO: 27394 - DNA, 21 bp, Artificial sequence
  SiRNA target sequence
tagtggcggagatgtatgcgc

SEQ ID NO: 27395 - DNA, 21 bp, Artificial sequence
  SiRNA target sequence
agtggcggagatgtatgcgct

SEQ ID NO: 27396 - DNA, 21 bp, Artificial sequence
  SiRNA target sequence
gtggcggagatgtatgcgcta

SEQ ID NO: 27397 - DNA, 21 bp, Artificial sequence
  SiRNA target sequence
tggcggagatgtatgcgctat

SEQ ID NO: 27398 - DNA, 21 bp, Artificial sequence
  SiRNA target sequence
ggcggagatgtatgcgctata

SEQ ID NO: 27399 - DNA, 21 bp, Artificial sequence
  SiRNA target sequence
gcggagatgtatgcgctatat

SEQ ID NO: 27400 - DNA, 21 bp, Artificial sequence
  SiRNA target sequence
cggagatgtatgcgctatatc

SEQ ID NO: 27401 - DNA, 21 bp, Artificial sequence
  SiRNA target sequence
ggagatgtatgcgctatatcg

SEQ ID NO: 27402 - DNA, 21 bp, Artificial sequence
  SiRNA target sequence
gagatgtatgcgctatatcga

SEQ ID NO: 27403 - DNA, 21 bp, Artificial sequence
  SiRNA target sequence
agatgtatgcgctatatcgag

SEQ ID NO: 27404 - DNA, 21 bp, Artificial sequence
  SiRNA target sequence
gatgtatgcgctatatcgagg

SEQ ID NO: 27405 - DNA, 21 bp, Artificial sequence
  SiRNA target sequence
atgtatgcgctatatcgagga

SEQ ID NO: 27406 - DNA, 21 bp, Artificial sequence
  SiRNA target sequence
tgtatgcgctatatcgaggag

SEQ ID NO: 27407 - DNA, 21 bp, Artificial sequence
  SiRNA target sequence
gtatgcgctatatcgaggagg

SEQ ID NO: 27408 - DNA, 21 bp, Artificial sequence
  SiRNA target sequence
tatgcgctatatcgaggagga

SEQ ID NO: 27409 - DNA, 21 bp, Artificial sequence
  SiRNA target sequence
atgcgctatatcgaggaggag

SEQ ID NO: 27410 - DNA, 21 bp, Artificial sequence
  SiRNA target sequence
tgcgctatatcgaggaggagt

SEQ ID NO: 27411 - DNA, 21 bp, Artificial sequence
  SiRNA target sequence
gcgctatatcgaggaggagtt

SEQ ID NO: 27412 - DNA, 21 bp, Artificial sequence
  SiRNA target sequence
cgctatatcgaggaggagttc

SEQ ID NO: 27413 - DNA, 21 bp, Artificial sequence
  SiRNA target sequence
gctatatcgaggaggagttcg

SEQ ID NO: 27414 - DNA, 21 bp, Artificial sequence
  SiRNA target sequence
ctatatcgaggaggagttcga

SEQ ID NO: 27415 - DNA, 21 bp, Artificial sequence
  SiRNA target sequence
tatatcgaggaggagttcgag

SEQ ID NO: 27416 - DNA, 21 bp, Artificial sequence
  SiRNA target sequence
atatcgaggaggagttcgagt

SEQ ID NO: 27417 - DNA, 21 bp, Artificial sequence
  SiRNA target sequence
tatcgaggaggagttcgagtt

SEQ ID NO: 27418 - DNA, 21 bp, Artificial sequence
  SiRNA target sequence
atcgaggaggagttcgagtta

SEQ ID NO: 27419 - DNA, 21 bp, Artificial sequence
  SiRNA target sequence
tcgaggaggagttcgagttaa

SEQ ID NO: 27420 - DNA, 21 bp, Artificial sequence
  SiRNA target sequence
cgaggaggagttcgagttaaa

SEQ ID NO: 27421 - DNA, 21 bp, Artificial sequence
  SiRNA target sequence
gaggaggagttcgagttaaag

SEQ ID NO: 27422 - DNA, 21 bp, Artificial sequence
  SiRNA target sequence
aggaggagttcgagttaaagt

SEQ ID NO: 27423 - DNA, 21 bp, Artificial sequence
  SiRNA target sequence
ggaggagttcgagttaaagta

SEQ ID NO: 27424 - DNA, 21 bp, Artificial sequence
  SiRNA target sequence
gaggagttcgagttaaagtag

SEQ ID NO: 27425 - DNA, 21 bp, Artificial sequence
  SiRNA target sequence
aggagttcgagttaaagtagt

SEQ ID NO: 27426 - DNA, 21 bp, Artificial sequence
  SiRNA target sequence
ggagttcgagttaaagtagtt

SEQ ID NO: 27427 - DNA, 21 bp, Artificial sequence
  SiRNA target sequence
gagttcgagttaaagtagtta

SEQ ID NO: 27428 - DNA, 21 bp, Artificial sequence
  SiRNA target sequence
agttcgagttaaagtagttac

SEQ ID NO: 27429 - DNA, 21 bp, Artificial sequence
  SiRNA target sequence
gttcgagttaaagtagttact

SEQ ID NO: 27430 - DNA, 21 bp, Artificial sequence
  SiRNA target sequence
ttcgagttaaagtagttactg

SEQ ID NO: 27431 - DNA, 21 bp, Artificial sequence
  SiRNA target sequence
tcgagttaaagtagttactga

SEQ ID NO: 27432 - DNA, 21 bp, Artificial sequence
  SiRNA target sequence
cgagttaaagtagttactgag

SEQ ID NO: 27433 - DNA, 21 bp, Artificial sequence
  SiRNA target sequence
gagttaaagtagttactgaga

SEQ ID NO: 27434 - DNA, 21 bp, Artificial sequence
  SiRNA target sequence
agttaaagtagttactgagaa

SEQ ID NO: 27435 - DNA, 21 bp, Artificial sequence
  SiRNA target sequence
gttaaagtagttactgagaag

SEQ ID NO: 27436 - DNA, 21 bp, Artificial sequence
  SiRNA target sequence
ttaaagtagttactgagaagg

SEQ ID NO: 27437 - DNA, 21 bp, Artificial sequence
  SiRNA target sequence
taaagtagttactgagaaggg

SEQ ID NO: 27438 - DNA, 21 bp, Artificial sequence
  SiRNA target sequence
aaagtagttactgagaagggt

SEQ ID NO: 27439 - DNA, 21 bp, Artificial sequence
  SiRNA target sequence
aagtagttactgagaagggtg

SEQ ID NO: 27440 - DNA, 21 bp, Artificial sequence
  SiRNA target sequence
agtagttactgagaagggtgt

SEQ ID NO: 27441 - DNA, 21 bp, Artificial sequence
  SiRNA target sequence
gtagttactgagaagggtgtg

SEQ ID NO: 27442 - DNA, 21 bp, Artificial sequence
  SiRNA target sequence
tagttactgagaagggtgtgg

SEQ ID NO: 27443 - DNA, 21 bp, Artificial sequence
  SiRNA target sequence
agttactgagaagggtgtgga

SEQ ID NO: 27444 - DNA, 21 bp, Artificial sequence
  SiRNA target sequence
gttactgagaagggtgtggat

SEQ ID NO: 27445 - DNA, 21 bp, Artificial sequence
  SiRNA target sequence
ttactgagaagggtgtggatt

SEQ ID NO: 27446 - DNA, 21 bp, Artificial sequence
  SiRNA target sequence
tactgagaagggtgtggatta

SEQ ID NO: 27447 - DNA, 21 bp, Artificial sequence
  SiRNA target sequence
actgagaagggtgtggattac

SEQ ID NO: 27448 - DNA, 21 bp, Artificial sequence
  SiRNA target sequence
ctgagaagggtgtggattacg

SEQ ID NO: 27449 - DNA, 21 bp, Artificial sequence
  SiRNA target sequence
tgagaagggtgtggattacgt

SEQ ID NO: 27450 - DNA, 21 bp, Artificial sequence
  SiRNA target sequence
gagaagggtgtggattacgtc

SEQ ID NO: 27451 - DNA, 21 bp, Artificial sequence
  SiRNA target sequence
agaagggtgtggattacgtcc

SEQ ID NO: 27452 - DNA, 21 bp, Artificial sequence
  SiRNA target sequence
gaagggtgtggattacgtccg

SEQ ID NO: 27453 - DNA, 21 bp, Artificial sequence
  SiRNA target sequence
aagggtgtggattacgtccga

SEQ ID NO: 27454 - DNA, 21 bp, Artificial sequence
  SiRNA target sequence
agggtgtggattacgtccgag

SEQ ID NO: 27455 - DNA, 21 bp, Artificial sequence
  SiRNA target sequence
gggtgtggattacgtccgagc

SEQ ID NO: 27456 - DNA, 21 bp, Artificial sequence
  SiRNA target sequence
ggtgtggattacgtccgagct

SEQ ID NO: 27457 - DNA, 21 bp, Artificial sequence
  SiRNA target sequence
gtgtggattacgtccgagcta

SEQ ID NO: 27458 - DNA, 21 bp, Artificial sequence
  SiRNA target sequence
tgtggattacgtccgagctac

SEQ ID NO: 27459 - DNA, 21 bp, Artificial sequence
  SiRNA target sequence
gtggattacgtccgagctact

SEQ ID NO: 27460 - DNA, 21 bp, Artificial sequence
  SiRNA target sequence
tggattacgtccgagctacta

SEQ ID NO: 27461 - DNA, 21 bp, Artificial sequence
  SiRNA target sequence
ggattacgtccgagctactat

SEQ ID NO: 27462 - DNA, 21 bp, Artificial sequence
  SiRNA target sequence
gattacgtccgagctactata

SEQ ID NO: 27463 - DNA, 21 bp, Artificial sequence
  SiRNA target sequence
attacgtccgagctactataa

SEQ ID NO: 27464 - DNA, 21 bp, Artificial sequence
  SiRNA target sequence
ttacgtccgagctactataag

SEQ ID NO: 27465 - DNA, 21 bp, Artificial sequence
  SiRNA target sequence
tacgtccgagctactataagt

SEQ ID NO: 27466 - DNA, 21 bp, Artificial sequence
  SiRNA target sequence
acgtccgagctactataagtc

SEQ ID NO: 27467 - DNA, 21 bp, Artificial sequence
  SiRNA target sequence
cgtccgagctactataagtcc

SEQ ID NO: 27468 - DNA, 21 bp, Artificial sequence
  SiRNA target sequence
gtccgagctactataagtcct

SEQ ID NO: 27469 - DNA, 21 bp, Artificial sequence
  SiRNA target sequence
tccgagctactataagtcctc

SEQ ID NO: 27470 - DNA, 21 bp, Artificial sequence
  SiRNA target sequence
ccgagctactataagtcctca

SEQ ID NO: 27471 - DNA, 21 bp, Artificial sequence
  SiRNA target sequence
cgagctactataagtcctcaa

SEQ ID NO: 27472 - DNA, 21 bp, Artificial sequence
  SiRNA target sequence
gagctactataagtcctcaac

SEQ ID NO: 27473 - DNA, 21 bp, Artificial sequence
  SiRNA target sequence
agctactataagtcctcaaca

SEQ ID NO: 27474 - DNA, 21 bp, Artificial sequence
  SiRNA target sequence
gctactataagtcctcaacag

SEQ ID NO: 27475 - DNA, 21 bp, Artificial sequence
  SiRNA target sequence
ctactataagtcctcaacaga

SEQ ID NO: 27476 - DNA, 21 bp, Artificial sequence
  SiRNA target sequence
tactataagtcctcaacagac

SEQ ID NO: 27477 - DNA, 21 bp, Artificial sequence
  SiRNA target sequence
actataagtcctcaacagact

SEQ ID NO: 27478 - DNA, 21 bp, Artificial sequence
  SiRNA target sequence
ctataagtcctcaacagactt

SEQ ID NO: 27479 - DNA, 21 bp, Artificial sequence
  SiRNA target sequence
tataagtcctcaacagactta

SEQ ID NO: 27480 - DNA, 21 bp, Artificial sequence
  SiRNA target sequence
ataagtcctcaacagacttat

SEQ ID NO: 27481 - DNA, 21 bp, Artificial sequence
  SiRNA target sequence
taagtcctcaacagacttatg

SEQ ID NO: 27482 - DNA, 21 bp, Artificial sequence
  SiRNA target sequence
aagtcctcaacagacttatgg

SEQ ID NO: 27483 - DNA, 21 bp, Artificial sequence
  SiRNA target sequence
agtcctcaacagacttatggt

SEQ ID NO: 27484 - DNA, 21 bp, Artificial sequence
  SiRNA target sequence
gtcctcaacagacttatggta

SEQ ID NO: 27485 - DNA, 21 bp, Artificial sequence
  SiRNA target sequence
tcctcaacagacttatggtag

SEQ ID NO: 27486 - DNA, 21 bp, Artificial sequence
  SiRNA target sequence
cctcaacagacttatggtagt

SEQ ID NO: 27487 - DNA, 21 bp, Artificial sequence
  SiRNA target sequence
ctcaacagacttatggtagtg

SEQ ID NO: 27488 - DNA, 21 bp, Artificial sequence
  SiRNA target sequence
tcaacagacttatggtagtga

SEQ ID NO: 27489 - DNA, 21 bp, Artificial sequence
  SiRNA target sequence
caacagacttatggtagtgac

SEQ ID NO: 27490 - DNA, 21 bp, Artificial sequence
  SiRNA target sequence
aacagacttatggtagtgacg

SEQ ID NO: 27491 - DNA, 21 bp, Artificial sequence
  SiRNA target sequence
acagacttatggtagtgacgt

SEQ ID NO: 27492 - DNA, 21 bp, Artificial sequence
  SiRNA target sequence
cagacttatggtagtgacgtc

SEQ ID NO: 27493 - DNA, 21 bp, Artificial sequence
  SiRNA target sequence
agacttatggtagtgacgtcg

SEQ ID NO: 27494 - DNA, 21 bp, Artificial sequence
  SiRNA target sequence
gacttatggtagtgacgtcgc

SEQ ID NO: 27495 - DNA, 21 bp, Artificial sequence
  SiRNA target sequence
acttatggtagtgacgtcgct

SEQ ID NO: 27496 - DNA, 21 bp, Artificial sequence
  SiRNA target sequence
cttatggtagtgacgtcgctc

SEQ ID NO: 27497 - DNA, 21 bp, Artificial sequence
  SiRNA target sequence
ttatggtagtgacgtcgctcc

SEQ ID NO: 27498 - DNA, 21 bp, Artificial sequence
  SiRNA target sequence
tatggtagtgacgtcgctcca

SEQ ID NO: 27499 - DNA, 21 bp, Artificial sequence
  SiRNA target sequence
atggtagtgacgtcgctccaa

SEQ ID NO: 27500 - DNA, 21 bp, Artificial sequence
  SiRNA target sequence
tggtagtgacgtcgctccaac

SEQ ID NO: 27501 - DNA, 21 bp, Artificial sequence
  SiRNA target sequence
ggtagtgacgtcgctccaact

SEQ ID NO: 27502 - DNA, 21 bp, Artificial sequence
  SiRNA target sequence
gtagtgacgtcgctccaacta

SEQ ID NO: 27503 - DNA, 21 bp, Artificial sequence
  SiRNA target sequence
tagtgacgtcgctccaactac

SEQ ID NO: 27504 - DNA, 21 bp, Artificial sequence
  SiRNA target sequence
agtgacgtcgctccaactacc

SEQ ID NO: 27505 - DNA, 21 bp, Artificial sequence
  SiRNA target sequence
gtgacgtcgctccaactaccc

SEQ ID NO: 27506 - DNA, 21 bp, Artificial sequence
  SiRNA target sequence
tgacgtcgctccaactaccca

SEQ ID NO: 27507 - DNA, 21 bp, Artificial sequence
  SiRNA target sequence
gacgtcgctccaactacccat

SEQ ID NO: 27508 - DNA, 21 bp, Artificial sequence
  SiRNA target sequence
acgtcgctccaactacccata

SEQ ID NO: 27509 - DNA, 21 bp, Artificial sequence
  SiRNA target sequence
cgtcgctccaactacccatat

SEQ ID NO: 27510 - DNA, 21 bp, Artificial sequence
  SiRNA target sequence
gtcgctccaactacccatatt

SEQ ID NO: 27511 - DNA, 21 bp, Artificial sequence
  SiRNA target sequence
tcgctccaactacccatatta

SEQ ID NO: 27512 - DNA, 21 bp, Artificial sequence
  SiRNA target sequence
cgctccaactacccatattag

SEQ ID NO: 27513 - DNA, 21 bp, Artificial sequence
  SiRNA target sequence
gctccaactacccatattagt

SEQ ID NO: 27514 - DNA, 21 bp, Artificial sequence
  SiRNA target sequence
ctccaactacccatattagta

SEQ ID NO: 27515 - DNA, 21 bp, Artificial sequence
  SiRNA target sequence
tccaactacccatattagtac

SEQ ID NO: 27516 - DNA, 21 bp, Artificial sequence
  SiRNA target sequence
ccaactacccatattagtact

SEQ ID NO: 27517 - DNA, 21 bp, Artificial sequence
  SiRNA target sequence
caactacccatattagtactc

SEQ ID NO: 27518 - DNA, 21 bp, Artificial sequence
  SiRNA target sequence
aactacccatattagtactcc

SEQ ID NO: 27519 - DNA, 21 bp, Artificial sequence
  SiRNA target sequence
actacccatattagtactcct

SEQ ID NO: 27520 - DNA, 21 bp, Artificial sequence
  SiRNA target sequence
ctacccatattagtactcctt

SEQ ID NO: 27521 - DNA, 21 bp, Artificial sequence
  SiRNA target sequence
tacccatattagtactccttt

SEQ ID NO: 27522 - DNA, 21 bp, Artificial sequence
  SiRNA target sequence
acccatattagtactcctttg

SEQ ID NO: 27523 - DNA, 21 bp, Artificial sequence
  SiRNA target sequence
cccatattagtactcctttgg

SEQ ID NO: 27524 - DNA, 21 bp, Artificial sequence
  SiRNA target sequence
ccatattagtactcctttggc

SEQ ID NO: 27525 - DNA, 21 bp, Artificial sequence
  SiRNA target sequence
catattagtactcctttggca

SEQ ID NO: 27526 - DNA, 21 bp, Artificial sequence
  SiRNA target sequence
atattagtactcctttggcaa

SEQ ID NO: 27527 - DNA, 21 bp, Artificial sequence
  SiRNA target sequence
tattagtactcctttggcaat

SEQ ID NO: 27528 - DNA, 21 bp, Artificial sequence
  SiRNA target sequence
attagtactcctttggcaata

SEQ ID NO: 27529 - DNA, 21 bp, Artificial sequence
  SiRNA target sequence
ttagtactcctttggcaatag

SEQ ID NO: 27530 - DNA, 21 bp, Artificial sequence
  SiRNA target sequence
tagtactcctttggcaataga

SEQ ID NO: 27531 - DNA, 21 bp, Artificial sequence
  SiRNA target sequence
agtactcctttggcaatagaa

SEQ ID NO: 27532 - DNA, 21 bp, Artificial sequence
  SiRNA target sequence
gtactcctttggcaatagaac

SEQ ID NO: 27533 - DNA, 21 bp, Artificial sequence
  SiRNA target sequence
tactcctttggcaatagaaca

SEQ ID NO: 27534 - DNA, 21 bp, Artificial sequence
  SiRNA target sequence
actcctttggcaatagaacaa

SEQ ID NO: 27535 - DNA, 21 bp, Artificial sequence
  SiRNA target sequence
ctcctttggcaatagaacaaa

SEQ ID NO: 27536 - DNA, 21 bp, Artificial sequence
  SiRNA target sequence
tcctttggcaatagaacaaat

SEQ ID NO: 27537 - DNA, 21 bp, Artificial sequence
  SiRNA target sequence
cctttggcaatagaacaaata

SEQ ID NO: 27538 - DNA, 21 bp, Artificial sequence
  SiRNA target sequence
ctttggcaatagaacaaatac

SEQ ID NO: 27539 - DNA, 21 bp, Artificial sequence
  SiRNA target sequence
tttggcaatagaacaaatacc

SEQ ID NO: 27540 - DNA, 21 bp, Artificial sequence
  SiRNA target sequence
ttggcaatagaacaaatacca

SEQ ID NO: 27541 - DNA, 21 bp, Artificial sequence
  SiRNA target sequence
tggcaatagaacaaataccaa

SEQ ID NO: 27542 - DNA, 21 bp, Artificial sequence
  SiRNA target sequence
ggcaatagaacaaataccaat

SEQ ID NO: 27543 - DNA, 21 bp, Artificial sequence
  SiRNA target sequence
gcaatagaacaaataccaata

SEQ ID NO: 27544 - DNA, 21 bp, Artificial sequence
  SiRNA target sequence
caatagaacaaataccaataa

SEQ ID NO: 27545 - DNA, 21 bp, Artificial sequence
  SiRNA target sequence
aatagaacaaataccaataaa

SEQ ID NO: 27546 - DNA, 21 bp, Artificial sequence
  SiRNA target sequence
atagaacaaataccaataaag

SEQ ID NO: 27547 - DNA, 21 bp, Artificial sequence
  SiRNA target sequence
tagaacaaataccaataaagg

SEQ ID NO: 27548 - DNA, 21 bp, Artificial sequence
  SiRNA target sequence
agaacaaataccaataaaggg

SEQ ID NO: 27549 - DNA, 21 bp, Artificial sequence
  SiRNA target sequence
gaacaaataccaataaaggga

SEQ ID NO: 27550 - DNA, 21 bp, Artificial sequence
  SiRNA target sequence
aacaaataccaataaagggag

SEQ ID NO: 27551 - DNA, 21 bp, Artificial sequence
  SiRNA target sequence
acaaataccaataaagggagt

SEQ ID NO: 27552 - DNA, 21 bp, Artificial sequence
  SiRNA target sequence
caaataccaataaagggagtc

SEQ ID NO: 27553 - DNA, 21 bp, Artificial sequence
  SiRNA target sequence
aaataccaataaagggagtcg

SEQ ID NO: 27554 - DNA, 21 bp, Artificial sequence
  SiRNA target sequence
aataccaataaagggagtcgc

SEQ ID NO: 27555 - DNA, 21 bp, Artificial sequence
  SiRNA target sequence
ataccaataaagggagtcgca

SEQ ID NO: 27556 - DNA, 21 bp, Artificial sequence
  SiRNA target sequence
taccaataaagggagtcgcag

SEQ ID NO: 27557 - DNA, 21 bp, Artificial sequence
  SiRNA target sequence
accaataaagggagtcgcaga

SEQ ID NO: 27558 - DNA, 21 bp, Artificial sequence
  SiRNA target sequence
ccaataaagggagtcgcagag

SEQ ID NO: 27559 - DNA, 21 bp, Artificial sequence
  SiRNA target sequence
caataaagggagtcgcagagt

SEQ ID NO: 27560 - DNA, 21 bp, Artificial sequence
  SiRNA target sequence
aataaagggagtcgcagagtt

SEQ ID NO: 27561 - DNA, 21 bp, Artificial sequence
  SiRNA target sequence
ataaagggagtcgcagagttc

SEQ ID NO: 27562 - DNA, 21 bp, Artificial sequence
  SiRNA target sequence
taaagggagtcgcagagttcc

SEQ ID NO: 27563 - DNA, 21 bp, Artificial sequence
  SiRNA target sequence
aaagggagtcgcagagttcca

SEQ ID NO: 27564 - DNA, 21 bp, Artificial sequence
  SiRNA target sequence
aagggagtcgcagagttccaa

SEQ ID NO: 27565 - DNA, 21 bp, Artificial sequence
  SiRNA target sequence
agggagtcgcagagttccaaa

SEQ ID NO: 27566 - DNA, 21 bp, Artificial sequence
  SiRNA target sequence
gggagtcgcagagttccaaat

SEQ ID NO: 27567 - DNA, 21 bp, Artificial sequence
  SiRNA target sequence
ggagtcgcagagttccaaata

SEQ ID NO: 27568 - DNA, 21 bp, Artificial sequence
  SiRNA target sequence
gagtcgcagagttccaaatac

SEQ ID NO: 27569 - DNA, 21 bp, Artificial sequence
  SiRNA target sequence
agtcgcagagttccaaatacc

SEQ ID NO: 27570 - DNA, 21 bp, Artificial sequence
  SiRNA target sequence
gtcgcagagttccaaataccg

SEQ ID NO: 27571 - DNA, 21 bp, Artificial sequence
  SiRNA target sequence
tcgcagagttccaaataccgt

SEQ ID NO: 27572 - DNA, 21 bp, Artificial sequence
  SiRNA target sequence
cgcagagttccaaataccgta

SEQ ID NO: 27573 - DNA, 21 bp, Artificial sequence
  SiRNA target sequence
gcagagttccaaataccgtac

SEQ ID NO: 27574 - DNA, 21 bp, Artificial sequence
  SiRNA target sequence
cagagttccaaataccgtact

SEQ ID NO: 27575 - DNA, 21 bp, Artificial sequence
  SiRNA target sequence
agagttccaaataccgtacta

SEQ ID NO: 27576 - DNA, 21 bp, Artificial sequence
  SiRNA target sequence
gagttccaaataccgtactat

SEQ ID NO: 27577 - DNA, 21 bp, Artificial sequence
  SiRNA target sequence
agttccaaataccgtactatg

SEQ ID NO: 27578 - DNA, 21 bp, Artificial sequence
  SiRNA target sequence
gttccaaataccgtactatgc

SEQ ID NO: 27579 - DNA, 21 bp, Artificial sequence
  SiRNA target sequence
ttccaaataccgtactatgct

SEQ ID NO: 27580 - DNA, 21 bp, Artificial sequence
  SiRNA target sequence
tccaaataccgtactatgctc

SEQ ID NO: 27581 - DNA, 21 bp, Artificial sequence
  SiRNA target sequence
ccaaataccgtactatgctcc

SEQ ID NO: 27582 - DNA, 21 bp, Artificial sequence
  SiRNA target sequence
caaataccgtactatgctcca

SEQ ID NO: 27583 - DNA, 21 bp, Artificial sequence
  SiRNA target sequence
aaataccgtactatgctccat

SEQ ID NO: 27584 - DNA, 21 bp, Artificial sequence
  SiRNA target sequence
aataccgtactatgctccatg

SEQ ID NO: 27585 - DNA, 21 bp, Artificial sequence
  SiRNA target sequence
ataccgtactatgctccatgt

SEQ ID NO: 27586 - DNA, 21 bp, Artificial sequence
  SiRNA target sequence
taccgtactatgctccatgtt

SEQ ID NO: 27587 - DNA, 21 bp, Artificial sequence
  SiRNA target sequence
accgtactatgctccatgttt

SEQ ID NO: 27588 - DNA, 21 bp, Artificial sequence
  SiRNA target sequence
ccgtactatgctccatgttta

SEQ ID NO: 27589 - DNA, 21 bp, Artificial sequence
  SiRNA target sequence
cgtactatgctccatgtttat

SEQ ID NO: 27590 - DNA, 21 bp, Artificial sequence
  SiRNA target sequence
gtactatgctccatgtttatc

SEQ ID NO: 27591 - DNA, 21 bp, Artificial sequence
  SiRNA target sequence
tactatgctccatgtttatca

SEQ ID NO: 27592 - DNA, 21 bp, Artificial sequence
  SiRNA target sequence
actatgctccatgtttatcat

SEQ ID NO: 27593 - DNA, 21 bp, Artificial sequence
  SiRNA target sequence
ctatgctccatgtttatcatc

SEQ ID NO: 27594 - DNA, 21 bp, Artificial sequence
  SiRNA target sequence
tatgctccatgtttatcatct

SEQ ID NO: 27595 - DNA, 21 bp, Artificial sequence
  SiRNA target sequence
atgctccatgtttatcatctt

SEQ ID NO: 27596 - DNA, 21 bp, Artificial sequence
  SiRNA target sequence
tgctccatgtttatcatcttc

SEQ ID NO: 27597 - DNA, 21 bp, Artificial sequence
  SiRNA target sequence
gctccatgtttatcatcttcg

SEQ ID NO: 27598 - DNA, 21 bp, Artificial sequence
  SiRNA target sequence
ctccatgtttatcatcttcgt

SEQ ID NO: 27599 - DNA, 21 bp, Artificial sequence
  SiRNA target sequence
tccatgtttatcatcttcgtt

SEQ ID NO: 27600 - DNA, 21 bp, Artificial sequence
  SiRNA target sequence
ccatgtttatcatcttcgttt

SEQ ID NO: 27601 - DNA, 21 bp, Artificial sequence
  SiRNA target sequence
catgtttatcatcttcgttta

SEQ ID NO: 27602 - DNA, 21 bp, Artificial sequence
  SiRNA target sequence
atgtttatcatcttcgtttag

SEQ ID NO: 27603 - DNA, 21 bp, Artificial sequence
  SiRNA target sequence
tgtttatcatcttcgtttaga

SEQ ID NO: 27604 - DNA, 21 bp, Artificial sequence
  SiRNA target sequence
gtttatcatcttcgtttagag

SEQ ID NO: 27605 - DNA, 21 bp, Artificial sequence
  SiRNA target sequence
tttatcatcttcgtttagagc

SEQ ID NO: 27606 - DNA, 21 bp, Artificial sequence
  SiRNA target sequence
ttatcatcttcgtttagagcg

SEQ ID NO: 27607 - DNA, 21 bp, Artificial sequence
  SiRNA target sequence
tatcatcttcgtttagagcga

SEQ ID NO: 27608 - DNA, 21 bp, Artificial sequence
  SiRNA target sequence
atcatcttcgtttagagcgaa

SEQ ID NO: 27609 - DNA, 21 bp, Artificial sequence
  SiRNA target sequence
tcatcttcgtttagagcgaat

SEQ ID NO: 27610 - DNA, 21 bp, Artificial sequence
  SiRNA target sequence
catcttcgtttagagcgaatt

SEQ ID NO: 27611 - DNA, 21 bp, Artificial sequence
  SiRNA target sequence
atcttcgtttagagcgaattc

SEQ ID NO: 27612 - DNA, 21 bp, Artificial sequence
  SiRNA target sequence
tcttcgtttagagcgaattca

SEQ ID NO: 27613 - DNA, 21 bp, Artificial sequence
  SiRNA target sequence
cttcgtttagagcgaattcag

SEQ ID NO: 27614 - DNA, 21 bp, Artificial sequence
  SiRNA target sequence
ttcgtttagagcgaattcaga

SEQ ID NO: 27615 - DNA, 21 bp, Artificial sequence
  SiRNA target sequence
tcgtttagagcgaattcagaa

SEQ ID NO: 27616 - DNA, 21 bp, Artificial sequence
  SiRNA target sequence
cgtttagagcgaattcagaaa

SEQ ID NO: 27617 - DNA, 21 bp, Artificial sequence
  SiRNA target sequence
gtttagagcgaattcagaaac

SEQ ID NO: 27618 - DNA, 21 bp, Artificial sequence
  SiRNA target sequence
tttagagcgaattcagaaaca

SEQ ID NO: 27619 - DNA, 21 bp, Artificial sequence
  SiRNA target sequence
ttagagcgaattcagaaacat

SEQ ID NO: 27620 - DNA, 21 bp, Artificial sequence
  SiRNA target sequence
tagagcgaattcagaaacatt

SEQ ID NO: 27621 - DNA, 21 bp, Artificial sequence
  SiRNA target sequence
agagcgaattcagaaacattt

SEQ ID NO: 27622 - DNA, 21 bp, Artificial sequence
  SiRNA target sequence
gagcgaattcagaaacatttt

SEQ ID NO: 27623 - DNA, 21 bp, Artificial sequence
  SiRNA target sequence
agcgaattcagaaacatttta

SEQ ID NO: 27624 - DNA, 21 bp, Artificial sequence
  SiRNA target sequence
gcgaattcagaaacattttac

SEQ ID NO: 27625 - DNA, 21 bp, Artificial sequence
  SiRNA target sequence
cgaattcagaaacattttact

SEQ ID NO: 27626 - DNA, 21 bp, Artificial sequence
  SiRNA target sequence
gaattcagaaacattttacta

SEQ ID NO: 27627 - DNA, 21 bp, Artificial sequence
  SiRNA target sequence
aattcagaaacattttactat

SEQ ID NO: 27628 - DNA, 21 bp, Artificial sequence
  SiRNA target sequence
attcagaaacattttactata

SEQ ID NO: 27629 - DNA, 21 bp, Artificial sequence
  SiRNA target sequence
ttcagaaacattttactatag

SEQ ID NO: 27630 - DNA, 21 bp, Artificial sequence
  SiRNA target sequence
tcagaaacattttactatagt

SEQ ID NO: 27631 - DNA, 21 bp, Artificial sequence
  SiRNA target sequence
cagaaacattttactatagtt

SEQ ID NO: 27632 - DNA, 21 bp, Artificial sequence
  SiRNA target sequence
agaaacattttactatagttc

SEQ ID NO: 27633 - DNA, 21 bp, Artificial sequence
  SiRNA target sequence
gaaacattttactatagttca

SEQ ID NO: 27634 - DNA, 21 bp, Artificial sequence
  SiRNA target sequence
aaacattttactatagttcag

SEQ ID NO: 27635 - DNA, 21 bp, Artificial sequence
  SiRNA target sequence
aacattttactatagttcagg

SEQ ID NO: 27636 - DNA, 21 bp, Artificial sequence
  SiRNA target sequence
acattttactatagttcaggt

SEQ ID NO: 27637 - DNA, 21 bp, Artificial sequence
  SiRNA target sequence
cattttactatagttcaggtc

SEQ ID NO: 27638 - DNA, 21 bp, Artificial sequence
  SiRNA target sequence
attttactatagttcaggtcg

SEQ ID NO: 27639 - DNA, 21 bp, Artificial sequence
  SiRNA target sequence
ttttactatagttcaggtcgg

SEQ ID NO: 27640 - DNA, 21 bp, Artificial sequence
  SiRNA target sequence
tttactatagttcaggtcgga

SEQ ID NO: 27641 - DNA, 21 bp, Artificial sequence
  SiRNA target sequence
ttactatagttcaggtcggaa

SEQ ID NO: 27642 - DNA, 21 bp, Artificial sequence
  SiRNA target sequence
tactatagttcaggtcggaat

SEQ ID NO: 27643 - DNA, 21 bp, Artificial sequence
  SiRNA target sequence
actatagttcaggtcggaata

SEQ ID NO: 27644 - DNA, 21 bp, Artificial sequence
  SiRNA target sequence
ctatagttcaggtcggaataa

SEQ ID NO: 27645 - DNA, 21 bp, Artificial sequence
  SiRNA target sequence
tatagttcaggtcggaataat

SEQ ID NO: 27646 - DNA, 21 bp, Artificial sequence
  SiRNA target sequence
atagttcaggtcggaataatc

SEQ ID NO: 27647 - DNA, 21 bp, Artificial sequence
  SiRNA target sequence
tagttcaggtcggaataatct

SEQ ID NO: 27648 - DNA, 21 bp, Artificial sequence
  SiRNA target sequence
agttcaggtcggaataatctc

SEQ ID NO: 27649 - DNA, 21 bp, Artificial sequence
  SiRNA target sequence
gttcaggtcggaataatctcg

SEQ ID NO: 27650 - DNA, 21 bp, Artificial sequence
  SiRNA target sequence
ttcaggtcggaataatctcga

SEQ ID NO: 27651 - DNA, 21 bp, Artificial sequence
  SiRNA target sequence
tcaggtcggaataatctcgat

SEQ ID NO: 27652 - DNA, 21 bp, Artificial sequence
  SiRNA target sequence
caggtcggaataatctcgata

SEQ ID NO: 27653 - DNA, 21 bp, Artificial sequence
  SiRNA target sequence
aggtcggaataatctcgatat

SEQ ID NO: 27654 - DNA, 21 bp, Artificial sequence
  SiRNA target sequence
ggtcggaataatctcgatata

SEQ ID NO: 27655 - DNA, 21 bp, Artificial sequence
  SiRNA target sequence
gtcggaataatctcgatatag

SEQ ID NO: 27656 - DNA, 21 bp, Artificial sequence
  SiRNA target sequence
tcggaataatctcgatatagc

SEQ ID NO: 27657 - DNA, 21 bp, Artificial sequence
  SiRNA target sequence
cggaataatctcgatatagcc

SEQ ID NO: 27658 - DNA, 21 bp, Artificial sequence
  SiRNA target sequence
ggaataatctcgatatagcca

SEQ ID NO: 27659 - DNA, 21 bp, Artificial sequence
  SiRNA target sequence
gaataatctcgatatagccac

SEQ ID NO: 27660 - DNA, 21 bp, Artificial sequence
  SiRNA target sequence
aataatctcgatatagccact

SEQ ID NO: 27661 - DNA, 21 bp, Artificial sequence
  SiRNA target sequence
ataatctcgatatagccactt

SEQ ID NO: 27662 - DNA, 21 bp, Artificial sequence
  SiRNA target sequence
taatctcgatatagccacttc

SEQ ID NO: 27663 - DNA, 21 bp, Artificial sequence
  SiRNA target sequence
aatctcgatatagccacttca

SEQ ID NO: 27664 - DNA, 21 bp, Artificial sequence
  SiRNA target sequence
atctcgatatagccacttcac

SEQ ID NO: 27665 - DNA, 21 bp, Artificial sequence
  SiRNA target sequence
tctcgatatagccacttcacc

SEQ ID NO: 27666 - DNA, 21 bp, Artificial sequence
  SiRNA target sequence
ctcgatatagccacttcacct

SEQ ID NO: 27667 - DNA, 21 bp, Artificial sequence
  SiRNA target sequence
tcgatatagccacttcacctc

SEQ ID NO: 27668 - DNA, 21 bp, Artificial sequence
  SiRNA target sequence
cgatatagccacttcacctcc

SEQ ID NO: 27669 - DNA, 21 bp, Artificial sequence
  SiRNA target sequence
gatatagccacttcacctccc

SEQ ID NO: 27670 - DNA, 21 bp, Artificial sequence
  SiRNA target sequence
atatagccacttcacctccct

SEQ ID NO: 27671 - DNA, 21 bp, Artificial sequence
  SiRNA target sequence
tatagccacttcacctccctc

SEQ ID NO: 27672 - DNA, 21 bp, Artificial sequence
  SiRNA target sequence
atagccacttcacctccctcc

SEQ ID NO: 27673 - DNA, 21 bp, Artificial sequence
  SiRNA target sequence
tagccacttcacctccctcca

SEQ ID NO: 27674 - DNA, 21 bp, Artificial sequence
  SiRNA target sequence
agccacttcacctccctccat

SEQ ID NO: 27675 - DNA, 21 bp, Artificial sequence
  SiRNA target sequence
gccacttcacctccctccatc

SEQ ID NO: 27676 - DNA, 21 bp, Artificial sequence
  SiRNA target sequence
ccacttcacctccctccatca

SEQ ID NO: 27677 - DNA, 21 bp, Artificial sequence
  SiRNA target sequence
cacttcacctccctccatcaa

SEQ ID NO: 27678 - DNA, 21 bp, Artificial sequence
  SiRNA target sequence
acttcacctccctccatcaat

SEQ ID NO: 27679 - DNA, 21 bp, Artificial sequence
  SiRNA target sequence
cttcacctccctccatcaatc

SEQ ID NO: 27680 - DNA, 21 bp, Artificial sequence
  SiRNA target sequence
ttcacctccctccatcaatcg

SEQ ID NO: 27681 - DNA, 21 bp, Artificial sequence
  SiRNA target sequence
tcacctccctccatcaatcgc

SEQ ID NO: 27682 - DNA, 21 bp, Artificial sequence
  SiRNA target sequence
cacctccctccatcaatcgct

SEQ ID NO: 27683 - DNA, 21 bp, Artificial sequence
  SiRNA target sequence
acctccctccatcaatcgcta

SEQ ID NO: 27684 - DNA, 21 bp, Artificial sequence
  SiRNA target sequence
cctccctccatcaatcgctat

SEQ ID NO: 27685 - DNA, 21 bp, Artificial sequence
  SiRNA target sequence
ctccctccatcaatcgctatt

SEQ ID NO: 27686 - DNA, 21 bp, Artificial sequence
  SiRNA target sequence
tccctccatcaatcgctatta

SEQ ID NO: 27687 - DNA, 21 bp, Artificial sequence
  SiRNA target sequence
ccctccatcaatcgctattat

SEQ ID NO: 27688 - DNA, 21 bp, Artificial sequence
  SiRNA target sequence
cctccatcaatcgctattatg

SEQ ID NO: 27689 - DNA, 21 bp, Artificial sequence
  SiRNA target sequence
ctccatcaatcgctattatgc

SEQ ID NO: 27690 - DNA, 21 bp, Artificial sequence
  SiRNA target sequence
tccatcaatcgctattatgcg

SEQ ID NO: 27691 - DNA, 21 bp, Artificial sequence
  SiRNA target sequence
ccatcaatcgctattatgcgg

SEQ ID NO: 27692 - DNA, 21 bp, Artificial sequence
  SiRNA target sequence
catcaatcgctattatgcggt

SEQ ID NO: 27693 - DNA, 21 bp, Artificial sequence
  SiRNA target sequence
atcaatcgctattatgcggtt

SEQ ID NO: 27694 - DNA, 21 bp, Artificial sequence
  SiRNA target sequence
tcaatcgctattatgcggttg

SEQ ID NO: 27695 - DNA, 21 bp, Artificial sequence
  SiRNA target sequence
caatcgctattatgcggttgg

SEQ ID NO: 27696 - DNA, 21 bp, Artificial sequence
  SiRNA target sequence
aatcgctattatgcggttggt

SEQ ID NO: 27697 - DNA, 21 bp, Artificial sequence
  SiRNA target sequence
atcgctattatgcggttggtg

SEQ ID NO: 27698 - DNA, 21 bp, Artificial sequence
  SiRNA target sequence
tcgctattatgcggttggtgc

SEQ ID NO: 27699 - DNA, 21 bp, Artificial sequence
  SiRNA target sequence
cgctattatgcggttggtgcg

SEQ ID NO: 27700 - DNA, 21 bp, Artificial sequence
  SiRNA target sequence
gctattatgcggttggtgcgg

SEQ ID NO: 27701 - DNA, 21 bp, Artificial sequence
  SiRNA target sequence
ctattatgcggttggtgcggg

SEQ ID NO: 27702 - DNA, 21 bp, Artificial sequence
  SiRNA target sequence
tattatgcggttggtgcggga

SEQ ID NO: 27703 - DNA, 21 bp, Artificial sequence
  SiRNA target sequence
attatgcggttggtgcgggag

SEQ ID NO: 27704 - DNA, 21 bp, Artificial sequence
  SiRNA target sequence
ttatgcggttggtgcgggaga

SEQ ID NO: 27705 - DNA, 21 bp, Artificial sequence
  SiRNA target sequence
tatgcggttggtgcgggagat

SEQ ID NO: 27706 - DNA, 21 bp, Artificial sequence
  SiRNA target sequence
atgcggttggtgcgggagatg

SEQ ID NO: 27707 - DNA, 21 bp, Artificial sequence
  SiRNA target sequence
tgcggttggtgcgggagatga

SEQ ID NO: 27708 - DNA, 21 bp, Artificial sequence
  SiRNA target sequence
gcggttggtgcgggagatgat

SEQ ID NO: 27709 - DNA, 21 bp, Artificial sequence
  SiRNA target sequence
cggttggtgcgggagatgata

SEQ ID NO: 27710 - DNA, 21 bp, Artificial sequence
  SiRNA target sequence
ggttggtgcgggagatgatat

SEQ ID NO: 27711 - DNA, 21 bp, Artificial sequence
  SiRNA target sequence
gttggtgcgggagatgatatg

SEQ ID NO: 27712 - DNA, 21 bp, Artificial sequence
  SiRNA target sequence
ttggtgcgggagatgatatgg

SEQ ID NO: 27713 - DNA, 21 bp, Artificial sequence
  SiRNA target sequence
tggtgcgggagatgatatgga

SEQ ID NO: 27714 - DNA, 21 bp, Artificial sequence
  SiRNA target sequence
ggtgcgggagatgatatggac

SEQ ID NO: 27715 - DNA, 21 bp, Artificial sequence
  SiRNA target sequence
gtgcgggagatgatatggact

SEQ ID NO: 27716 - DNA, 21 bp, Artificial sequence
  SiRNA target sequence
tgcgggagatgatatggactt

SEQ ID NO: 27717 - DNA, 21 bp, Artificial sequence
  SiRNA target sequence
gcgggagatgatatggacttt

SEQ ID NO: 27718 - DNA, 21 bp, Artificial sequence
  SiRNA target sequence
cgggagatgatatggactttt

SEQ ID NO: 27719 - DNA, 21 bp, Artificial sequence
  SiRNA target sequence
gggagatgatatggacttttc

SEQ ID NO: 27720 - DNA, 21 bp, Artificial sequence
  SiRNA target sequence
ggagatgatatggacttttcc

SEQ ID NO: 27721 - DNA, 21 bp, Artificial sequence
  SiRNA target sequence
gagatgatatggacttttcca

SEQ ID NO: 27722 - DNA, 21 bp, Artificial sequence
  SiRNA target sequence
agatgatatggacttttccat

SEQ ID NO: 27723 - DNA, 21 bp, Artificial sequence
  SiRNA target sequence
gatgatatggacttttccatc

SEQ ID NO: 27724 - DNA, 21 bp, Artificial sequence
  SiRNA target sequence
atgatatggacttttccatct

SEQ ID NO: 27725 - DNA, 21 bp, Artificial sequence
  SiRNA target sequence
tgatatggacttttccatctt

SEQ ID NO: 27726 - DNA, 21 bp, Artificial sequence
  SiRNA target sequence
gatatggacttttccatcttt

SEQ ID NO: 27727 - DNA, 21 bp, Artificial sequence
  SiRNA target sequence
atatggacttttccatcttta

SEQ ID NO: 27728 - DNA, 21 bp, Artificial sequence
  SiRNA target sequence
tatggacttttccatctttat

SEQ ID NO: 27729 - DNA, 21 bp, Artificial sequence
  SiRNA target sequence
atggacttttccatctttatc

SEQ ID NO: 27730 - DNA, 21 bp, Artificial sequence
  SiRNA target sequence
tggacttttccatctttatcg

SEQ ID NO: 27731 - DNA, 21 bp, Artificial sequence
  SiRNA target sequence
ggacttttccatctttatcgg

SEQ ID NO: 27732 - DNA, 21 bp, Artificial sequence
  SiRNA target sequence
gacttttccatctttatcggt

SEQ ID NO: 27733 - DNA, 21 bp, Artificial sequence
  SiRNA target sequence
acttttccatctttatcggta

SEQ ID NO: 27734 - DNA, 21 bp, Artificial sequence
  SiRNA target sequence
cttttccatctttatcggtac

SEQ ID NO: 27735 - DNA, 21 bp, Artificial sequence
  SiRNA target sequence
ttttccatctttatcggtacg

SEQ ID NO: 27736 - DNA, 21 bp, Artificial sequence
  SiRNA target sequence
tttccatctttatcggtacgc

SEQ ID NO: 27737 - DNA, 21 bp, Artificial sequence
  SiRNA target sequence
ttccatctttatcggtacgcc

SEQ ID NO: 27738 - DNA, 21 bp, Artificial sequence
  SiRNA target sequence
tccatctttatcggtacgccg

SEQ ID NO: 27739 - DNA, 21 bp, Artificial sequence
  SiRNA target sequence
ccatctttatcggtacgccgc

SEQ ID NO: 27740 - DNA, 21 bp, Artificial sequence
  SiRNA target sequence
catctttatcggtacgccgcc

SEQ ID NO: 27741 - DNA, 21 bp, Artificial sequence
  SiRNA target sequence
atctttatcggtacgccgccc

SEQ ID NO: 27742 - DNA, 21 bp, Artificial sequence
  SiRNA target sequence
tctttatcggtacgccgccct

SEQ ID NO: 27743 - DNA, 21 bp, Artificial sequence
  SiRNA target sequence
ctttatcggtacgccgccctg

SEQ ID NO: 27744 - DNA, 21 bp, Artificial sequence
  SiRNA target sequence
tttatcggtacgccgccctgt

SEQ ID NO: 27745 - DNA, 21 bp, Artificial sequence
  SiRNA target sequence
ttatcggtacgccgccctgta

SEQ ID NO: 27746 - DNA, 21 bp, Artificial sequence
  SiRNA target sequence
tatcggtacgccgccctgtat

SEQ ID NO: 27747 - DNA, 21 bp, Artificial sequence
  SiRNA target sequence
atcggtacgccgccctgtatt

SEQ ID NO: 27748 - DNA, 21 bp, Artificial sequence
  SiRNA target sequence
tcggtacgccgccctgtattc

SEQ ID NO: 27749 - DNA, 21 bp, Artificial sequence
  SiRNA target sequence
cggtacgccgccctgtattca

SEQ ID NO: 27750 - DNA, 21 bp, Artificial sequence
  SiRNA target sequence
ggtacgccgccctgtattcat

SEQ ID NO: 27751 - DNA, 21 bp, Artificial sequence
  SiRNA target sequence
gtacgccgccctgtattcatg

SEQ ID NO: 27752 - DNA, 21 bp, Artificial sequence
  SiRNA target sequence
tacgccgccctgtattcatgc

SEQ ID NO: 27753 - DNA, 21 bp, Artificial sequence
  SiRNA target sequence
acgccgccctgtattcatgca

SEQ ID NO: 27754 - DNA, 21 bp, Artificial sequence
  SiRNA target sequence
cgccgccctgtattcatgcat

SEQ ID NO: 27755 - DNA, 21 bp, Artificial sequence
  SiRNA target sequence
gccgccctgtattcatgcatc

SEQ ID NO: 27756 - DNA, 21 bp, Artificial sequence
  SiRNA target sequence
ccgccctgtattcatgcatct

SEQ ID NO: 27757 - DNA, 21 bp, Artificial sequence
  SiRNA target sequence
cgccctgtattcatgcatctc

SEQ ID NO: 27758 - DNA, 21 bp, Artificial sequence
  SiRNA target sequence
gccctgtattcatgcatctca

SEQ ID NO: 27759 - DNA, 21 bp, Artificial sequence
  SiRNA target sequence
ccctgtattcatgcatctcag

SEQ ID NO: 27760 - DNA, 21 bp, Artificial sequence
  SiRNA target sequence
cctgtattcatgcatctcaga

SEQ ID NO: 27761 - DNA, 21 bp, Artificial sequence
  SiRNA target sequence
ctgtattcatgcatctcagac

SEQ ID NO: 27762 - DNA, 21 bp, Artificial sequence
  SiRNA target sequence
tgtattcatgcatctcagacg

SEQ ID NO: 27763 - DNA, 21 bp, Artificial sequence
  SiRNA target sequence
gtattcatgcatctcagacgg

SEQ ID NO: 27764 - DNA, 21 bp, Artificial sequence
  SiRNA target sequence
tattcatgcatctcagacggc

SEQ ID NO: 27765 - DNA, 21 bp, Artificial sequence
  SiRNA target sequence
attcatgcatctcagacggct

SEQ ID NO: 27766 - DNA, 21 bp, Artificial sequence
  SiRNA target sequence
ttcatgcatctcagacggctc

SEQ ID NO: 27767 - DNA, 21 bp, Artificial sequence
  SiRNA target sequence
tcatgcatctcagacggctca

SEQ ID NO: 27768 - DNA, 21 bp, Artificial sequence
  SiRNA target sequence
catgcatctcagacggctcag

SEQ ID NO: 27769 - DNA, 21 bp, Artificial sequence
  SiRNA target sequence
atgcatctcagacggctcagt

SEQ ID NO: 27770 - DNA, 21 bp, Artificial sequence
  SiRNA target sequence
tgcatctcagacggctcagtt

SEQ ID NO: 27771 - DNA, 21 bp, Artificial sequence
  SiRNA target sequence
gcatctcagacggctcagttt

SEQ ID NO: 27772 - DNA, 21 bp, Artificial sequence
  SiRNA target sequence
catctcagacggctcagttta

SEQ ID NO: 27773 - DNA, 21 bp, Artificial sequence
  SiRNA target sequence
atctcagacggctcagtttac

SEQ ID NO: 27774 - DNA, 21 bp, Artificial sequence
  SiRNA target sequence
tctcagacggctcagtttacc

SEQ ID NO: 27775 - DNA, 21 bp, Artificial sequence
  SiRNA target sequence
ctcagacggctcagtttacca

SEQ ID NO: 27776 - DNA, 21 bp, Artificial sequence
  SiRNA target sequence
tcagacggctcagtttaccaa

SEQ ID NO: 27777 - DNA, 21 bp, Artificial sequence
  SiRNA target sequence
cagacggctcagtttaccaag

SEQ ID NO: 27778 - DNA, 21 bp, Artificial sequence
  SiRNA target sequence
agacggctcagtttaccaaga

SEQ ID NO: 27779 - DNA, 21 bp, Artificial sequence
  SiRNA target sequence
gacggctcagtttaccaagat

SEQ ID NO: 27780 - DNA, 21 bp, Artificial sequence
  SiRNA target sequence
acggctcagtttaccaagata

SEQ ID NO: 27781 - DNA, 21 bp, Artificial sequence
  SiRNA target sequence
cggctcagtttaccaagataa

SEQ ID NO: 27782 - DNA, 21 bp, Artificial sequence
  SiRNA target sequence
ggctcagtttaccaagataaa

SEQ ID NO: 27783 - DNA, 21 bp, Artificial sequence
  SiRNA target sequence
gctcagtttaccaagataaaa

SEQ ID NO: 27784 - DNA, 21 bp, Artificial sequence
  SiRNA target sequence
ctcagtttaccaagataaaac

SEQ ID NO: 27785 - DNA, 21 bp, Artificial sequence
  SiRNA target sequence
tcagtttaccaagataaaaca

SEQ ID NO: 27786 - DNA, 21 bp, Artificial sequence
  SiRNA target sequence
cagtttaccaagataaaacaa

SEQ ID NO: 27787 - DNA, 21 bp, Artificial sequence
  SiRNA target sequence
agtttaccaagataaaacaag

SEQ ID NO: 27788 - DNA, 21 bp, Artificial sequence
  SiRNA target sequence
gtttaccaagataaaacaagg

SEQ ID NO: 27789 - DNA, 21 bp, Artificial sequence
  SiRNA target sequence
tttaccaagataaaacaaggt

SEQ ID NO: 27790 - DNA, 21 bp, Artificial sequence
  SiRNA target sequence
ttaccaagataaaacaaggta

SEQ ID NO: 27791 - DNA, 21 bp, Artificial sequence
  SiRNA target sequence
taccaagataaaacaaggtaa

SEQ ID NO: 27792 - DNA, 21 bp, Artificial sequence
  SiRNA target sequence
accaagataaaacaaggtaaa

SEQ ID NO: 27793 - DNA, 21 bp, Artificial sequence
  SiRNA target sequence
ccaagataaaacaaggtaaag

SEQ ID NO: 27794 - DNA, 21 bp, Artificial sequence
  SiRNA target sequence
caagataaaacaaggtaaagt

SEQ ID NO: 27795 - DNA, 21 bp, Artificial sequence
  SiRNA target sequence
aagataaaacaaggtaaagtg

SEQ ID NO: 27796 - DNA, 21 bp, Artificial sequence
  SiRNA target sequence
agataaaacaaggtaaagtgt

SEQ ID NO: 27797 - DNA, 21 bp, Artificial sequence
  SiRNA target sequence
gataaaacaaggtaaagtgta

SEQ ID NO: 27798 - DNA, 21 bp, Artificial sequence
  SiRNA target sequence
ataaaacaaggtaaagtgtat

SEQ ID NO: 27799 - DNA, 21 bp, Artificial sequence
  SiRNA target sequence
taaaacaaggtaaagtgtatg

SEQ ID NO: 27800 - DNA, 21 bp, Artificial sequence
  SiRNA target sequence
aaaacaaggtaaagtgtatga

SEQ ID NO: 27801 - DNA, 21 bp, Artificial sequence
  SiRNA target sequence
aaacaaggtaaagtgtatgat

SEQ ID NO: 27802 - DNA, 21 bp, Artificial sequence
  SiRNA target sequence
aacaaggtaaagtgtatgatt

SEQ ID NO: 27803 - DNA, 21 bp, Artificial sequence
  SiRNA target sequence
acaaggtaaagtgtatgattt

SEQ ID NO: 27804 - DNA, 21 bp, Artificial sequence
  SiRNA target sequence
caaggtaaagtgtatgatttg

SEQ ID NO: 27805 - DNA, 21 bp, Artificial sequence
  SiRNA target sequence
aaggtaaagtgtatgatttga

SEQ ID NO: 27806 - DNA, 21 bp, Artificial sequence
  SiRNA target sequence
aggtaaagtgtatgatttgag

SEQ ID NO: 27807 - DNA, 21 bp, Artificial sequence
  SiRNA target sequence
ggtaaagtgtatgatttgagg

SEQ ID NO: 27808 - DNA, 21 bp, Artificial sequence
  SiRNA target sequence
gtaaagtgtatgatttgaggt

SEQ ID NO: 27809 - DNA, 21 bp, Artificial sequence
  SiRNA target sequence
taaagtgtatgatttgaggta

SEQ ID NO: 27810 - DNA, 21 bp, Artificial sequence
  SiRNA target sequence
aaagtgtatgatttgaggtat

SEQ ID NO: 27811 - DNA, 21 bp, Artificial sequence
  SiRNA target sequence
aagtgtatgatttgaggtatg

SEQ ID NO: 27812 - DNA, 21 bp, Artificial sequence
  SiRNA target sequence
agtgtatgatttgaggtatga

SEQ ID NO: 27813 - DNA, 21 bp, Artificial sequence
  SiRNA target sequence
gtgtatgatttgaggtatgat

SEQ ID NO: 27814 - DNA, 21 bp, Artificial sequence
  SiRNA target sequence
tgtatgatttgaggtatgatc

SEQ ID NO: 27815 - DNA, 21 bp, Artificial sequence
  SiRNA target sequence
gtatgatttgaggtatgatca

SEQ ID NO: 27816 - DNA, 21 bp, Artificial sequence
  SiRNA target sequence
tatgatttgaggtatgatcag

SEQ ID NO: 27817 - DNA, 21 bp, Artificial sequence
  SiRNA target sequence
atgatttgaggtatgatcagt

SEQ ID NO: 27818 - DNA, 21 bp, Artificial sequence
  SiRNA target sequence
tgatttgaggtatgatcagta

SEQ ID NO: 27819 - DNA, 21 bp, Artificial sequence
  SiRNA target sequence
gatttgaggtatgatcagtac

SEQ ID NO: 27820 - DNA, 21 bp, Artificial sequence
  SiRNA target sequence
atttgaggtatgatcagtacg

SEQ ID NO: 27821 - DNA, 21 bp, Artificial sequence
  SiRNA target sequence
tttgaggtatgatcagtacga

SEQ ID NO: 27822 - DNA, 21 bp, Artificial sequence
  SiRNA target sequence
ttgaggtatgatcagtacgac

SEQ ID NO: 27823 - DNA, 21 bp, Artificial sequence
  SiRNA target sequence
tgaggtatgatcagtacgacc

SEQ ID NO: 27824 - DNA, 21 bp, Artificial sequence
  SiRNA target sequence
gaggtatgatcagtacgaccc

SEQ ID NO: 27825 - DNA, 21 bp, Artificial sequence
  SiRNA target sequence
aggtatgatcagtacgacccc

SEQ ID NO: 27826 - DNA, 21 bp, Artificial sequence
  SiRNA target sequence
ggtatgatcagtacgacccct

SEQ ID NO: 27827 - DNA, 21 bp, Artificial sequence
  SiRNA target sequence
gtatgatcagtacgacccctt

SEQ ID NO: 27828 - DNA, 21 bp, Artificial sequence
  SiRNA target sequence
tatgatcagtacgaccccttc

SEQ ID NO: 27829 - DNA, 21 bp, Artificial sequence
  SiRNA target sequence
atgatcagtacgaccccttcc

SEQ ID NO: 27830 - DNA, 21 bp, Artificial sequence
  SiRNA target sequence
tgatcagtacgaccccttccg

SEQ ID NO: 27831 - DNA, 21 bp, Artificial sequence
  SiRNA target sequence
gatcagtacgaccccttccgg

SEQ ID NO: 27832 - DNA, 21 bp, Artificial sequence
  SiRNA target sequence
atcagtacgaccccttccggg

SEQ ID NO: 27833 - DNA, 21 bp, Artificial sequence
  SiRNA target sequence
tcagtacgaccccttccggga

SEQ ID NO: 27834 - DNA, 21 bp, Artificial sequence
  SiRNA target sequence
cagtacgaccccttccgggaa

SEQ ID NO: 27835 - DNA, 21 bp, Artificial sequence
  SiRNA target sequence
agtacgaccccttccgggaag

SEQ ID NO: 27836 - DNA, 21 bp, Artificial sequence
  SiRNA target sequence
gtacgaccccttccgggaagt

SEQ ID NO: 27837 - DNA, 21 bp, Artificial sequence
  SiRNA target sequence
tacgaccccttccgggaagtc

SEQ ID NO: 27838 - DNA, 21 bp, Artificial sequence
  SiRNA target sequence
acgaccccttccgggaagtcc

SEQ ID NO: 27839 - DNA, 21 bp, Artificial sequence
  SiRNA target sequence
cgaccccttccgggaagtcca

SEQ ID NO: 27840 - DNA, 21 bp, Artificial sequence
  SiRNA target sequence
gaccccttccgggaagtccag

SEQ ID NO: 27841 - DNA, 21 bp, Artificial sequence
  SiRNA target sequence
accccttccgggaagtccagg

SEQ ID NO: 27842 - DNA, 21 bp, Artificial sequence
  SiRNA target sequence
ccccttccgggaagtccagga

SEQ ID NO: 27843 - DNA, 21 bp, Artificial sequence
  SiRNA target sequence
cccttccgggaagtccaggac

SEQ ID NO: 27844 - DNA, 21 bp, Artificial sequence
  SiRNA target sequence
ccttccgggaagtccaggacg

SEQ ID NO: 27845 - DNA, 21 bp, Artificial sequence
  SiRNA target sequence
cttccgggaagtccaggacgg

SEQ ID NO: 27846 - DNA, 21 bp, Artificial sequence
  SiRNA target sequence
ttccgggaagtccaggacggt

SEQ ID NO: 27847 - DNA, 21 bp, Artificial sequence
  SiRNA target sequence
tccgggaagtccaggacggta

SEQ ID NO: 27848 - DNA, 21 bp, Artificial sequence
  SiRNA target sequence
ccgggaagtccaggacggtac

SEQ ID NO: 27849 - DNA, 21 bp, Artificial sequence
  SiRNA target sequence
cgggaagtccaggacggtacg

SEQ ID NO: 27850 - DNA, 21 bp, Artificial sequence
  SiRNA target sequence
gggaagtccaggacggtacgg

SEQ ID NO: 27851 - DNA, 21 bp, Artificial sequence
  SiRNA target sequence
ggaagtccaggacggtacggc

SEQ ID NO: 27852 - DNA, 21 bp, Artificial sequence
  SiRNA target sequence
gaagtccaggacggtacggct

SEQ ID NO: 27853 - DNA, 21 bp, Artificial sequence
  SiRNA target sequence
aagtccaggacggtacggctt

SEQ ID NO: 27854 - DNA, 21 bp, Artificial sequence
  SiRNA target sequence
agtccaggacggtacggcttt

SEQ ID NO: 27855 - DNA, 21 bp, Artificial sequence
  SiRNA target sequence
gtccaggacggtacggctttc

SEQ ID NO: 27856 - DNA, 21 bp, Artificial sequence
  SiRNA target sequence
tccaggacggtacggctttcc

SEQ ID NO: 27857 - DNA, 21 bp, Artificial sequence
  SiRNA target sequence
ccaggacggtacggctttcct

SEQ ID NO: 27858 - DNA, 21 bp, Artificial sequence
  SiRNA target sequence
caggacggtacggctttcctc

SEQ ID NO: 27859 - DNA, 21 bp, Artificial sequence
  SiRNA target sequence
aggacggtacggctttcctca

SEQ ID NO: 27860 - DNA, 21 bp, Artificial sequence
  SiRNA target sequence
ggacggtacggctttcctcaa

SEQ ID NO: 27861 - DNA, 21 bp, Artificial sequence
  SiRNA target sequence
gacggtacggctttcctcaat

SEQ ID NO: 27862 - DNA, 21 bp, Artificial sequence
  SiRNA target sequence
acggtacggctttcctcaatg

SEQ ID NO: 27863 - DNA, 21 bp, Artificial sequence
  SiRNA target sequence
cggtacggctttcctcaatgc

SEQ ID NO: 27864 - DNA, 21 bp, Artificial sequence
  SiRNA target sequence
ggtacggctttcctcaatgct

SEQ ID NO: 27865 - DNA, 21 bp, Artificial sequence
  SiRNA target sequence
gtacggctttcctcaatgctc

SEQ ID NO: 27866 - DNA, 21 bp, Artificial sequence
  SiRNA target sequence
tacggctttcctcaatgctcg

SEQ ID NO: 27867 - DNA, 21 bp, Artificial sequence
  SiRNA target sequence
acggctttcctcaatgctcga

SEQ ID NO: 27868 - DNA, 21 bp, Artificial sequence
  SiRNA target sequence
cggctttcctcaatgctcgaa

SEQ ID NO: 27869 - DNA, 21 bp, Artificial sequence
  SiRNA target sequence
ggctttcctcaatgctcgaag

SEQ ID NO: 27870 - DNA, 21 bp, Artificial sequence
  SiRNA target sequence
gctttcctcaatgctcgaagt

SEQ ID NO: 27871 - DNA, 21 bp, Artificial sequence
  SiRNA target sequence
ctttcctcaatgctcgaagta

SEQ ID NO: 27872 - DNA, 21 bp, Artificial sequence
  SiRNA target sequence
tttcctcaatgctcgaagtat

SEQ ID NO: 27873 - DNA, 21 bp, Artificial sequence
  SiRNA target sequence
ttcctcaatgctcgaagtatt

SEQ ID NO: 27874 - DNA, 21 bp, Artificial sequence
  SiRNA target sequence
tcctcaatgctcgaagtattg

SEQ ID NO: 27875 - DNA, 21 bp, Artificial sequence
  SiRNA target sequence
cctcaatgctcgaagtattga

SEQ ID NO: 27876 - DNA, 21 bp, Artificial sequence
  SiRNA target sequence
ctcaatgctcgaagtattgag

SEQ ID NO: 27877 - DNA, 21 bp, Artificial sequence
  SiRNA target sequence
tcaatgctcgaagtattgagg

SEQ ID NO: 27878 - DNA, 21 bp, Artificial sequence
  SiRNA target sequence
caatgctcgaagtattgagga

SEQ ID NO: 27879 - DNA, 21 bp, Artificial sequence
  SiRNA target sequence
aatgctcgaagtattgaggat

SEQ ID NO: 27880 - DNA, 21 bp, Artificial sequence
  SiRNA target sequence
atgctcgaagtattgaggata

SEQ ID NO: 27881 - DNA, 21 bp, Artificial sequence
  SiRNA target sequence
tgctcgaagtattgaggatag

SEQ ID NO: 27882 - DNA, 21 bp, Artificial sequence
  SiRNA target sequence
gctcgaagtattgaggatagc

SEQ ID NO: 27883 - DNA, 21 bp, Artificial sequence
  SiRNA target sequence
ctcgaagtattgaggatagcg

SEQ ID NO: 27884 - DNA, 21 bp, Artificial sequence
  SiRNA target sequence
tcgaagtattgaggatagcga

SEQ ID NO: 27885 - DNA, 21 bp, Artificial sequence
  SiRNA target sequence
cgaagtattgaggatagcgat

SEQ ID NO: 27886 - DNA, 21 bp, Artificial sequence
  SiRNA target sequence
gaagtattgaggatagcgatt

SEQ ID NO: 27887 - DNA, 21 bp, Artificial sequence
  SiRNA target sequence
aagtattgaggatagcgattt

SEQ ID NO: 27888 - DNA, 21 bp, Artificial sequence
  SiRNA target sequence
agtattgaggatagcgatttg

SEQ ID NO: 27889 - DNA, 21 bp, Artificial sequence
  SiRNA target sequence
gtattgaggatagcgatttgt

SEQ ID NO: 27890 - DNA, 21 bp, Artificial sequence
  SiRNA target sequence
tattgaggatagcgatttgtt

SEQ ID NO: 27891 - DNA, 21 bp, Artificial sequence
  SiRNA target sequence
attgaggatagcgatttgttg

SEQ ID NO: 27892 - DNA, 21 bp, Artificial sequence
  SiRNA target sequence
ttgaggatagcgatttgttgt

SEQ ID NO: 27893 - DNA, 21 bp, Artificial sequence
  SiRNA target sequence
tgaggatagcgatttgttgtg

SEQ ID NO: 27894 - DNA, 21 bp, Artificial sequence
  SiRNA target sequence
gaggatagcgatttgttgtga

SEQ ID NO: 27895 - DNA, 21 bp, Artificial sequence
  SiRNA target sequence
aggatagcgatttgttgtgag

SEQ ID NO: 27896 - DNA, 21 bp, Artificial sequence
  SiRNA target sequence
ggatagcgatttgttgtgagc

SEQ ID NO: 27897 - DNA, 21 bp, Artificial sequence
  SiRNA target sequence
gatagcgatttgttgtgagct

SEQ ID NO: 27898 - DNA, 21 bp, Artificial sequence
  SiRNA target sequence
atagcgatttgttgtgagctc

SEQ ID NO: 27899 - DNA, 21 bp, Artificial sequence
  SiRNA target sequence
tagcgatttgttgtgagctcc

SEQ ID NO: 27900 - DNA, 21 bp, Artificial sequence
  SiRNA target sequence
agcgatttgttgtgagctcct

SEQ ID NO: 27901 - DNA, 21 bp, Artificial sequence
  SiRNA target sequence
gcgatttgttgtgagctcctt

SEQ ID NO: 27902 - DNA, 21 bp, Artificial sequence
  SiRNA target sequence
cgatttgttgtgagctccttt

SEQ ID NO: 27903 - DNA, 21 bp, Artificial sequence
  SiRNA target sequence
gatttgttgtgagctccttta

SEQ ID NO: 27904 - DNA, 21 bp, Artificial sequence
  SiRNA target sequence
atttgttgtgagctcctttag

SEQ ID NO: 27905 - DNA, 21 bp, Artificial sequence
  SiRNA target sequence
tttgttgtgagctcctttaga

SEQ ID NO: 27906 - DNA, 21 bp, Artificial sequence
  SiRNA target sequence
ttgttgtgagctcctttagag

SEQ ID NO: 27907 - DNA, 21 bp, Artificial sequence
  SiRNA target sequence
tgttgtgagctcctttagagg

SEQ ID NO: 27908 - DNA, 21 bp, Artificial sequence
  SiRNA target sequence
gttgtgagctcctttagaggg

SEQ ID NO: 27909 - DNA, 21 bp, Artificial sequence
  SiRNA target sequence
ttgtgagctcctttagaggga

SEQ ID NO: 27910 - DNA, 21 bp, Artificial sequence
  SiRNA target sequence
tgtgagctcctttagagggag

SEQ ID NO: 27911 - DNA, 21 bp, Artificial sequence
  SiRNA target sequence
gtgagctcctttagagggagg

SEQ ID NO: 27912 - DNA, 21 bp, Artificial sequence
  SiRNA target sequence
tgagctcctttagagggaggg

SEQ ID NO: 27913 - DNA, 21 bp, Artificial sequence
  SiRNA target sequence
gagctcctttagagggagggc

SEQ ID NO: 27914 - DNA, 21 bp, Artificial sequence
  SiRNA target sequence
agctcctttagagggagggct

SEQ ID NO: 27915 - DNA, 21 bp, Artificial sequence
  SiRNA target sequence
gctcctttagagggagggctc

SEQ ID NO: 27916 - DNA, 21 bp, Artificial sequence
  SiRNA target sequence
ctcctttagagggagggctca

SEQ ID NO: 27917 - DNA, 21 bp, Artificial sequence
  SiRNA target sequence
tcctttagagggagggctcac

SEQ ID NO: 27918 - DNA, 21 bp, Artificial sequence
  SiRNA target sequence
cctttagagggagggctcact

SEQ ID NO: 27919 - DNA, 21 bp, Artificial sequence
  SiRNA target sequence
ctttagagggagggctcactt

SEQ ID NO: 27920 - DNA, 21 bp, Artificial sequence
  SiRNA target sequence
tttagagggagggctcacttt

SEQ ID NO: 27921 - DNA, 21 bp, Artificial sequence
  SiRNA target sequence
ttagagggagggctcacttta

SEQ ID NO: 27922 - DNA, 21 bp, Artificial sequence
  SiRNA target sequence
tagagggagggctcactttat

SEQ ID NO: 27923 - DNA, 21 bp, Artificial sequence
  SiRNA target sequence
agagggagggctcactttatc

SEQ ID NO: 27924 - DNA, 21 bp, Artificial sequence
  SiRNA target sequence
gagggagggctcactttatct

SEQ ID NO: 27925 - DNA, 21 bp, Artificial sequence
  SiRNA target sequence
agggagggctcactttatcta

SEQ ID NO: 27926 - DNA, 21 bp, Artificial sequence
  SiRNA target sequence
gggagggctcactttatctat

SEQ ID NO: 27927 - DNA, 21 bp, Artificial sequence
  SiRNA target sequence
ggagggctcactttatctatt

SEQ ID NO: 27928 - DNA, 21 bp, Artificial sequence
  SiRNA target sequence
gagggctcactttatctattg

SEQ ID NO: 27929 - DNA, 21 bp, Artificial sequence
  SiRNA target sequence
agggctcactttatctattgc

SEQ ID NO: 27930 - DNA, 21 bp, Artificial sequence
  SiRNA target sequence
gggctcactttatctattgct

SEQ ID NO: 27931 - DNA, 21 bp, Artificial sequence
  SiRNA target sequence
ggctcactttatctattgctt

SEQ ID NO: 27932 - DNA, 21 bp, Artificial sequence
  SiRNA target sequence
gctcactttatctattgctta

SEQ ID NO: 27933 - DNA, 21 bp, Artificial sequence
  SiRNA target sequence
ctcactttatctattgcttaa

SEQ ID NO: 27934 - DNA, 21 bp, Artificial sequence
  SiRNA target sequence
tcactttatctattgcttaat

SEQ ID NO: 27935 - DNA, 21 bp, Artificial sequence
  SiRNA target sequence
gtaaaccttaggctttcatct

SEQ ID NO: 27936 - DNA, 21 bp, Artificial sequence
  SiRNA target sequence
taaaccttaggctttcatcta

SEQ ID NO: 27937 - DNA, 21 bp, Artificial sequence
  SiRNA target sequence
aaaccttaggctttcatctat

SEQ ID NO: 27938 - DNA, 21 bp, Artificial sequence
  SiRNA target sequence
aaccttaggctttcatctatg

SEQ ID NO: 27939 - DNA, 21 bp, Artificial sequence
  SiRNA target sequence
accttaggctttcatctatgg

SEQ ID NO: 27940 - DNA, 21 bp, Artificial sequence
  SiRNA target sequence
ccttaggctttcatctatgga

SEQ ID NO: 27941 - DNA, 21 bp, Artificial sequence
  SiRNA target sequence
cttaggctttcatctatggat

SEQ ID NO: 27942 - DNA, 21 bp, Artificial sequence
  SiRNA target sequence
ttaggctttcatctatggata

SEQ ID NO: 27943 - DNA, 21 bp, Artificial sequence
  SiRNA target sequence
taggctttcatctatggatag

SEQ ID NO: 27944 - DNA, 21 bp, Artificial sequence
  SiRNA target sequence
aggctttcatctatggataga

SEQ ID NO: 27945 - DNA, 21 bp, Artificial sequence
  SiRNA target sequence
ggctttcatctatggatagag

SEQ ID NO: 27946 - DNA, 21 bp, Artificial sequence
  SiRNA target sequence
gctttcatctatggatagagt

SEQ ID NO: 27947 - DNA, 21 bp, Artificial sequence
  SiRNA target sequence
ctttcatctatggatagagtc

SEQ ID NO: 27948 - DNA, 21 bp, Artificial sequence
  SiRNA target sequence
tttcatctatggatagagtcc

SEQ ID NO: 27949 - DNA, 21 bp, Artificial sequence
  SiRNA target sequence
ttcatctatggatagagtcct

SEQ ID NO: 27950 - DNA, 21 bp, Artificial sequence
  SiRNA target sequence
tcatctatggatagagtccta

SEQ ID NO: 27951 - DNA, 21 bp, Artificial sequence
  SiRNA target sequence
catctatggatagagtcctac

SEQ ID NO: 27952 - DNA, 21 bp, Artificial sequence
  SiRNA target sequence
atctatggatagagtcctacc

SEQ ID NO: 27953 - DNA, 21 bp, Artificial sequence
  SiRNA target sequence
tctatggatagagtcctacca

SEQ ID NO: 27954 - DNA, 21 bp, Artificial sequence
  SiRNA target sequence
ctatggatagagtcctaccat

SEQ ID NO: 27955 - DNA, 21 bp, Artificial sequence
  SiRNA target sequence
tatggatagagtcctaccatt

SEQ ID NO: 27956 - DNA, 21 bp, Artificial sequence
  SiRNA target sequence
atggatagagtcctaccatta

SEQ ID NO: 27957 - DNA, 21 bp, Artificial sequence
  SiRNA target sequence
tggatagagtcctaccattat

SEQ ID NO: 27958 - DNA, 21 bp, Artificial sequence
  SiRNA target sequence
ggatagagtcctaccattatc

SEQ ID NO: 27959 - DNA, 21 bp, Artificial sequence
  SiRNA target sequence
gatagagtcctaccattatcc

SEQ ID NO: 27960 - DNA, 21 bp, Artificial sequence
  SiRNA target sequence
atagagtcctaccattatcct

SEQ ID NO: 27961 - DNA, 21 bp, Artificial sequence
  SiRNA target sequence
tagagtcctaccattatcctt

SEQ ID NO: 27962 - DNA, 21 bp, Artificial sequence
  SiRNA target sequence
agagtcctaccattatccttc

SEQ ID NO: 27963 - DNA, 21 bp, Artificial sequence
  SiRNA target sequence
gagtcctaccattatccttca

SEQ ID NO: 27964 - DNA, 21 bp, Artificial sequence
  SiRNA target sequence
agtcctaccattatccttcat

SEQ ID NO: 27965 - DNA, 21 bp, Artificial sequence
  SiRNA target sequence
gtcctaccattatccttcatc

SEQ ID NO: 27966 - DNA, 21 bp, Artificial sequence
  SiRNA target sequence
tcctaccattatccttcatct

SEQ ID NO: 27967 - DNA, 21 bp, Artificial sequence
  SiRNA target sequence
cctaccattatccttcatcta

SEQ ID NO: 27968 - DNA, 21 bp, Artificial sequence
  SiRNA target sequence
ctaccattatccttcatctac

SEQ ID NO: 27969 - DNA, 21 bp, Artificial sequence
  SiRNA target sequence
taccattatccttcatctact

SEQ ID NO: 27970 - DNA, 21 bp, Artificial sequence
  SiRNA target sequence
accattatccttcatctacta

SEQ ID NO: 27971 - DNA, 21 bp, Artificial sequence
  SiRNA target sequence
ccattatccttcatctactac

SEQ ID NO: 27972 - DNA, 21 bp, Artificial sequence
  SiRNA target sequence
cattatccttcatctactact

SEQ ID NO: 27973 - DNA, 21 bp, Artificial sequence
  SiRNA target sequence
attatccttcatctactactc

SEQ ID NO: 27974 - DNA, 21 bp, Artificial sequence
  SiRNA target sequence
ttatccttcatctactactcc

SEQ ID NO: 27975 - DNA, 21 bp, Artificial sequence
  SiRNA target sequence
tatccttcatctactactcct

SEQ ID NO: 27976 - DNA, 21 bp, Artificial sequence
  SiRNA target sequence
atccttcatctactactcctt

SEQ ID NO: 27977 - DNA, 21 bp, Artificial sequence
  SiRNA target sequence
tccttcatctactactcctta

SEQ ID NO: 27978 - DNA, 21 bp, Artificial sequence
  SiRNA target sequence
ccttcatctactactccttag

SEQ ID NO: 27979 - DNA, 21 bp, Artificial sequence
  SiRNA target sequence
cttcatctactactccttagc

SEQ ID NO: 27980 - DNA, 21 bp, Artificial sequence
  SiRNA target sequence
ttcatctactactccttagct

SEQ ID NO: 27981 - DNA, 21 bp, Artificial sequence
  SiRNA target sequence
tcatctactactccttagctg

SEQ ID NO: 27982 - DNA, 21 bp, Artificial sequence
  SiRNA target sequence
catctactactccttagctga

SEQ ID NO: 27983 - DNA, 21 bp, Artificial sequence
  SiRNA target sequence
atctactactccttagctgag

SEQ ID NO: 27984 - DNA, 21 bp, Artificial sequence
  SiRNA target sequence
tctactactccttagctgagc

SEQ ID NO: 27985 - DNA, 21 bp, Artificial sequence
  SiRNA target sequence
ctactactccttagctgagca

SEQ ID NO: 27986 - DNA, 21 bp, Artificial sequence
  SiRNA target sequence
tactactccttagctgagcag

SEQ ID NO: 27987 - DNA, 21 bp, Artificial sequence
  SiRNA target sequence
actactccttagctgagcagt

SEQ ID NO: 27988 - DNA, 21 bp, Artificial sequence
  SiRNA target sequence
ctactccttagctgagcagtt

SEQ ID NO: 27989 - DNA, 21 bp, Artificial sequence
  SiRNA target sequence
tactccttagctgagcagtta

SEQ ID NO: 27990 - DNA, 21 bp, Artificial sequence
  SiRNA target sequence
actccttagctgagcagttac

SEQ ID NO: 27991 - DNA, 21 bp, Artificial sequence
  SiRNA target sequence
ctccttagctgagcagttacg

SEQ ID NO: 27992 - DNA, 21 bp, Artificial sequence
  SiRNA target sequence
tccttagctgagcagttacgc

SEQ ID NO: 27993 - DNA, 21 bp, Artificial sequence
  SiRNA target sequence
ccttagctgagcagttacgca

SEQ ID NO: 27994 - DNA, 21 bp, Artificial sequence
  SiRNA target sequence
cttagctgagcagttacgcat

SEQ ID NO: 27995 - DNA, 21 bp, Artificial sequence
  SiRNA target sequence
ttagctgagcagttacgcatt

SEQ ID NO: 27996 - DNA, 21 bp, Artificial sequence
  SiRNA target sequence
tagctgagcagttacgcattg

SEQ ID NO: 27997 - DNA, 21 bp, Artificial sequence
  SiRNA target sequence
agctgagcagttacgcattgc

SEQ ID NO: 27998 - DNA, 21 bp, Artificial sequence
  SiRNA target sequence
gctgagcagttacgcattgct

SEQ ID NO: 27999 - DNA, 21 bp, Artificial sequence
  SiRNA target sequence
ctgagcagttacgcattgctg

SEQ ID NO: 28000 - DNA, 21 bp, Artificial sequence
  SiRNA target sequence
tgagcagttacgcattgctgc

SEQ ID NO: 28001 - DNA, 21 bp, Artificial sequence
  SiRNA target sequence
gagcagttacgcattgctgcc

SEQ ID NO: 28002 - DNA, 21 bp, Artificial sequence
  SiRNA target sequence
agcagttacgcattgctgcca

SEQ ID NO: 28003 - DNA, 21 bp, Artificial sequence
  SiRNA target sequence
gcagttacgcattgctgccat

SEQ ID NO: 28004 - DNA, 21 bp, Artificial sequence
  SiRNA target sequence
cagttacgcattgctgccatc

SEQ ID NO: 28005 - DNA, 21 bp, Artificial sequence
  SiRNA target sequence
agttacgcattgctgccatca

SEQ ID NO: 28006 - DNA, 21 bp, Artificial sequence
  SiRNA target sequence
gttacgcattgctgccatcat

SEQ ID NO: 28007 - DNA, 21 bp, Artificial sequence
  SiRNA target sequence
ttacgcattgctgccatcatc

SEQ ID NO: 28008 - DNA, 21 bp, Artificial sequence
  SiRNA target sequence
tacgcattgctgccatcatct

SEQ ID NO: 28009 - DNA, 21 bp, Artificial sequence
  SiRNA target sequence
acgcattgctgccatcatctc

SEQ ID NO: 28010 - DNA, 21 bp, Artificial sequence
  SiRNA target sequence
cgcattgctgccatcatctct

SEQ ID NO: 28011 - DNA, 21 bp, Artificial sequence
  SiRNA target sequence
gcattgctgccatcatctcta

SEQ ID NO: 28012 - DNA, 21 bp, Artificial sequence
  SiRNA target sequence
cattgctgccatcatctctag

SEQ ID NO: 28013 - DNA, 21 bp, Artificial sequence
  SiRNA target sequence
attgctgccatcatctctagc

SEQ ID NO: 28014 - DNA, 21 bp, Artificial sequence
  SiRNA target sequence
ttgctgccatcatctctagca

SEQ ID NO: 28015 - DNA, 21 bp, Artificial sequence
  SiRNA target sequence
tgctgccatcatctctagcac

SEQ ID NO: 28016 - DNA, 21 bp, Artificial sequence
  SiRNA target sequence
gctgccatcatctctagcaca

SEQ ID NO: 28017 - DNA, 21 bp, Artificial sequence
  SiRNA target sequence
ctgccatcatctctagcacat

SEQ ID NO: 28018 - DNA, 21 bp, Artificial sequence
  SiRNA target sequence
tgccatcatctctagcacatt

SEQ ID NO: 28019 - DNA, 21 bp, Artificial sequence
  SiRNA target sequence
gccatcatctctagcacattc

SEQ ID NO: 28020 - DNA, 21 bp, Artificial sequence
  SiRNA target sequence
ccatcatctctagcacattcc

SEQ ID NO: 28021 - DNA, 21 bp, Artificial sequence
  SiRNA target sequence
catcatctctagcacattcca

SEQ ID NO: 28022 - DNA, 21 bp, Artificial sequence
  SiRNA target sequence
atcatctctagcacattccac

SEQ ID NO: 28023 - DNA, 21 bp, Artificial sequence
  SiRNA target sequence
tcatctctagcacattccaca

SEQ ID NO: 28024 - DNA, 21 bp, Artificial sequence
  SiRNA target sequence
catctctagcacattccacac

SEQ ID NO: 28025 - DNA, 21 bp, Artificial sequence
  SiRNA target sequence
atctctagcacattccacact

SEQ ID NO: 28026 - DNA, 21 bp, Artificial sequence
  SiRNA target sequence
tctctagcacattccacactc

SEQ ID NO: 28027 - DNA, 21 bp, Artificial sequence
  SiRNA target sequence
ctctagcacattccacactcc

SEQ ID NO: 28028 - DNA, 21 bp, Artificial sequence
  SiRNA target sequence
tctagcacattccacactccc

SEQ ID NO: 28029 - DNA, 21 bp, Artificial sequence
  SiRNA target sequence
ctagcacattccacactcccg

SEQ ID NO: 28030 - DNA, 21 bp, Artificial sequence
  SiRNA target sequence
tagcacattccacactcccgt

SEQ ID NO: 28031 - DNA, 21 bp, Artificial sequence
  SiRNA target sequence
agcacattccacactcccgtc

SEQ ID NO: 28032 - DNA, 21 bp, Artificial sequence
  SiRNA target sequence
gcacattccacactcccgtcg

SEQ ID NO: 28033 - DNA, 21 bp, Artificial sequence
  SiRNA target sequence
cacattccacactcccgtcgt

SEQ ID NO: 28034 - DNA, 21 bp, Artificial sequence
  SiRNA target sequence
acattccacactcccgtcgtt

SEQ ID NO: 28035 - DNA, 21 bp, Artificial sequence
  SiRNA target sequence
cattccacactcccgtcgttg

SEQ ID NO: 28036 - DNA, 21 bp, Artificial sequence
  SiRNA target sequence
attccacactcccgtcgttgt

SEQ ID NO: 28037 - DNA, 21 bp, Artificial sequence
  SiRNA target sequence
ttccacactcccgtcgttgtg

SEQ ID NO: 28038 - DNA, 21 bp, Artificial sequence
  SiRNA target sequence
tccacactcccgtcgttgtgt

SEQ ID NO: 28039 - DNA, 21 bp, Artificial sequence
  SiRNA target sequence
ccacactcccgtcgttgtgtt

SEQ ID NO: 28040 - DNA, 21 bp, Artificial sequence
  SiRNA target sequence
cacactcccgtcgttgtgttc

SEQ ID NO: 28041 - DNA, 21 bp, Artificial sequence
  SiRNA target sequence
acactcccgtcgttgtgttct

SEQ ID NO: 28042 - DNA, 21 bp, Artificial sequence
  SiRNA target sequence
cactcccgtcgttgtgttctc

SEQ ID NO: 28043 - DNA, 21 bp, Artificial sequence
  SiRNA target sequence
actcccgtcgttgtgttctcc

SEQ ID NO: 28044 - DNA, 21 bp, Artificial sequence
  SiRNA target sequence
ctcccgtcgttgtgttctcct

SEQ ID NO: 28045 - DNA, 21 bp, Artificial sequence
  SiRNA target sequence
tcccgtcgttgtgttctcctt

SEQ ID NO: 28046 - DNA, 21 bp, Artificial sequence
  SiRNA target sequence
cccgtcgttgtgttctccttg

SEQ ID NO: 28047 - DNA, 21 bp, Artificial sequence
  SiRNA target sequence
ccgtcgttgtgttctccttgg

SEQ ID NO: 28048 - DNA, 21 bp, Artificial sequence
  SiRNA target sequence
cgtcgttgtgttctccttgga

SEQ ID NO: 28049 - DNA, 21 bp, Artificial sequence
  SiRNA target sequence
gtcgttgtgttctccttggac

SEQ ID NO: 28050 - DNA, 21 bp, Artificial sequence
  SiRNA target sequence
tcgttgtgttctccttggacc

SEQ ID NO: 28051 - DNA, 21 bp, Artificial sequence
  SiRNA target sequence
cgttgtgttctccttggaccc

SEQ ID NO: 28052 - DNA, 21 bp, Artificial sequence
  SiRNA target sequence
gttgtgttctccttggaccct

SEQ ID NO: 28053 - DNA, 21 bp, Artificial sequence
  SiRNA target sequence
ttgtgttctccttggaccctc

SEQ ID NO: 28054 - DNA, 21 bp, Artificial sequence
  SiRNA target sequence
tgtgttctccttggaccctcg

SEQ ID NO: 28055 - DNA, 21 bp, Artificial sequence
  SiRNA target sequence
gtgttctccttggaccctcgt

SEQ ID NO: 28056 - DNA, 21 bp, Artificial sequence
  SiRNA target sequence
tgttctccttggaccctcgtt

SEQ ID NO: 28057 - DNA, 21 bp, Artificial sequence
  SiRNA target sequence
gttctccttggaccctcgttg

SEQ ID NO: 28058 - DNA, 21 bp, Artificial sequence
  SiRNA target sequence
ttctccttggaccctcgttgg

SEQ ID NO: 28059 - DNA, 21 bp, Artificial sequence
  SiRNA target sequence
tctccttggaccctcgttgga

SEQ ID NO: 28060 - DNA, 21 bp, Artificial sequence
  SiRNA target sequence
ctccttggaccctcgttggac

SEQ ID NO: 28061 - DNA, 21 bp, Artificial sequence
  SiRNA target sequence
tccttggaccctcgttggact

SEQ ID NO: 28062 - DNA, 21 bp, Artificial sequence
  SiRNA target sequence
ccttggaccctcgttggactg

SEQ ID NO: 28063 - DNA, 21 bp, Artificial sequence
  SiRNA target sequence
cttggaccctcgttggactga

SEQ ID NO: 28064 - DNA, 21 bp, Artificial sequence
  SiRNA target sequence
ttggaccctcgttggactgac

SEQ ID NO: 28065 - DNA, 21 bp, Artificial sequence
  SiRNA target sequence
tggaccctcgttggactgacg

SEQ ID NO: 28066 - DNA, 21 bp, Artificial sequence
  SiRNA target sequence
ggaccctcgttggactgacgc

SEQ ID NO: 28067 - DNA, 21 bp, Artificial sequence
  SiRNA target sequence
gaccctcgttggactgacgcc

SEQ ID NO: 28068 - DNA, 21 bp, Artificial sequence
  SiRNA target sequence
accctcgttggactgacgccg

SEQ ID NO: 28069 - DNA, 21 bp, Artificial sequence
  SiRNA target sequence
ccctcgttggactgacgccga

SEQ ID NO: 28070 - DNA, 21 bp, Artificial sequence
  SiRNA target sequence
cctcgttggactgacgccgac

SEQ ID NO: 28071 - DNA, 21 bp, Artificial sequence
  SiRNA target sequence
ctcgttggactgacgccgacg

SEQ ID NO: 28072 - DNA, 21 bp, Artificial sequence
  SiRNA target sequence
tcgttggactgacgccgacgc

SEQ ID NO: 28073 - DNA, 21 bp, Artificial sequence
  SiRNA target sequence
cgttggactgacgccgacgcc

SEQ ID NO: 28074 - DNA, 21 bp, Artificial sequence
  SiRNA target sequence
gttggactgacgccgacgccc

SEQ ID NO: 28075 - DNA, 21 bp, Artificial sequence
  SiRNA target sequence
ttggactgacgccgacgccct

SEQ ID NO: 28076 - DNA, 21 bp, Artificial sequence
  SiRNA target sequence
tggactgacgccgacgcccta

SEQ ID NO: 28077 - DNA, 21 bp, Artificial sequence
  SiRNA target sequence
ggactgacgccgacgccctat

SEQ ID NO: 28078 - DNA, 21 bp, Artificial sequence
  SiRNA target sequence
gactgacgccgacgccctatc

SEQ ID NO: 28079 - DNA, 21 bp, Artificial sequence
  SiRNA target sequence
actgacgccgacgccctatct

SEQ ID NO: 28080 - DNA, 21 bp, Artificial sequence
  SiRNA target sequence
ctgacgccgacgccctatctc

SEQ ID NO: 28081 - DNA, 21 bp, Artificial sequence
  SiRNA target sequence
tgacgccgacgccctatctca

SEQ ID NO: 28082 - DNA, 21 bp, Artificial sequence
  SiRNA target sequence
gacgccgacgccctatctcac

SEQ ID NO: 28083 - DNA, 21 bp, Artificial sequence
  SiRNA target sequence
acgccgacgccctatctcacc

SEQ ID NO: 28084 - DNA, 21 bp, Artificial sequence
  SiRNA target sequence
cgccgacgccctatctcacca

SEQ ID NO: 28085 - DNA, 21 bp, Artificial sequence
  SiRNA target sequence
gccgacgccctatctcaccaa

SEQ ID NO: 28086 - DNA, 21 bp, Artificial sequence
  SiRNA target sequence
ccgacgccctatctcaccaag

SEQ ID NO: 28087 - DNA, 21 bp, Artificial sequence
  SiRNA target sequence
cgacgccctatctcaccaagg

SEQ ID NO: 28088 - DNA, 21 bp, Artificial sequence
  SiRNA target sequence
gacgccctatctcaccaaggc

SEQ ID NO: 28089 - DNA, 21 bp, Artificial sequence
  SiRNA target sequence
acgccctatctcaccaaggcc

SEQ ID NO: 28090 - DNA, 21 bp, Artificial sequence
  SiRNA target sequence
cgccctatctcaccaaggcct

SEQ ID NO: 28091 - DNA, 21 bp, Artificial sequence
  SiRNA target sequence
gccctatctcaccaaggccta

SEQ ID NO: 28092 - DNA, 21 bp, Artificial sequence
  SiRNA target sequence
ccctatctcaccaaggcctac

SEQ ID NO: 28093 - DNA, 21 bp, Artificial sequence
  SiRNA target sequence
cctatctcaccaaggcctacg

SEQ ID NO: 28094 - DNA, 21 bp, Artificial sequence
  SiRNA target sequence
ctatctcaccaaggcctacgt

SEQ ID NO: 28095 - DNA, 21 bp, Artificial sequence
  SiRNA target sequence
tatctcaccaaggcctacgtt

SEQ ID NO: 28096 - DNA, 21 bp, Artificial sequence
  SiRNA target sequence
atctcaccaaggcctacgtta

SEQ ID NO: 28097 - DNA, 21 bp, Artificial sequence
  SiRNA target sequence
tctcaccaaggcctacgttat

SEQ ID NO: 28098 - DNA, 21 bp, Artificial sequence
  SiRNA target sequence
ctcaccaaggcctacgttatc

SEQ ID NO: 28099 - DNA, 21 bp, Artificial sequence
  SiRNA target sequence
tcaccaaggcctacgttatct

SEQ ID NO: 28100 - DNA, 21 bp, Artificial sequence
  SiRNA target sequence
caccaaggcctacgttatctc

SEQ ID NO: 28101 - DNA, 21 bp, Artificial sequence
  SiRNA target sequence
accaaggcctacgttatctca

SEQ ID NO: 28102 - DNA, 21 bp, Artificial sequence
  SiRNA target sequence
ccaaggcctacgttatctcag

SEQ ID NO: 28103 - DNA, 21 bp, Artificial sequence
  SiRNA target sequence
caaggcctacgttatctcagg

SEQ ID NO: 28104 - DNA, 21 bp, Artificial sequence
  SiRNA target sequence
aaggcctacgttatctcaggt

SEQ ID NO: 28105 - DNA, 21 bp, Artificial sequence
  SiRNA target sequence
aggcctacgttatctcaggtc

SEQ ID NO: 28106 - DNA, 21 bp, Artificial sequence
  SiRNA target sequence
ggcctacgttatctcaggtcc

SEQ ID NO: 28107 - DNA, 21 bp, Artificial sequence
  SiRNA target sequence
gcctacgttatctcaggtccg

SEQ ID NO: 28108 - DNA, 21 bp, Artificial sequence
  SiRNA target sequence
cctacgttatctcaggtccgg

SEQ ID NO: 28109 - DNA, 21 bp, Artificial sequence
  SiRNA target sequence
ctacgttatctcaggtccggc

SEQ ID NO: 28110 - DNA, 21 bp, Artificial sequence
  SiRNA target sequence
tacgttatctcaggtccggca

SEQ ID NO: 28111 - DNA, 21 bp, Artificial sequence
  SiRNA target sequence
acgttatctcaggtccggcaa

SEQ ID NO: 28112 - DNA, 21 bp, Artificial sequence
  SiRNA target sequence
cgttatctcaggtccggcaac

SEQ ID NO: 28113 - DNA, 21 bp, Artificial sequence
  SiRNA target sequence
gttatctcaggtccggcaacg

SEQ ID NO: 28114 - DNA, 21 bp, Artificial sequence
  SiRNA target sequence
ttatctcaggtccggcaacga

SEQ ID NO: 28115 - DNA, 21 bp, Artificial sequence
  SiRNA target sequence
tatctcaggtccggcaacgaa

SEQ ID NO: 28116 - DNA, 21 bp, Artificial sequence
  SiRNA target sequence
atctcaggtccggcaacgaac

SEQ ID NO: 28117 - DNA, 21 bp, Artificial sequence
  SiRNA target sequence
tctcaggtccggcaacgaact

SEQ ID NO: 28118 - DNA, 21 bp, Artificial sequence
  SiRNA target sequence
ctcaggtccggcaacgaactt

SEQ ID NO: 28119 - DNA, 21 bp, Artificial sequence
  SiRNA target sequence
tcaggtccggcaacgaacttg

SEQ ID NO: 28120 - DNA, 21 bp, Artificial sequence
  SiRNA target sequence
caggtccggcaacgaacttgc

SEQ ID NO: 28121 - DNA, 21 bp, Artificial sequence
  SiRNA target sequence
aggtccggcaacgaacttgct

SEQ ID NO: 28122 - DNA, 21 bp, Artificial sequence
  SiRNA target sequence
ggtccggcaacgaacttgctg

SEQ ID NO: 28123 - DNA, 21 bp, Artificial sequence
  SiRNA target sequence
gtccggcaacgaacttgctgt

SEQ ID NO: 28124 - DNA, 21 bp, Artificial sequence
  SiRNA target sequence
tccggcaacgaacttgctgtt

SEQ ID NO: 28125 - DNA, 21 bp, Artificial sequence
  SiRNA target sequence
ccggcaacgaacttgctgttc

SEQ ID NO: 28126 - DNA, 21 bp, Artificial sequence
  SiRNA target sequence
cggcaacgaacttgctgttct

SEQ ID NO: 28127 - DNA, 21 bp, Artificial sequence
  SiRNA target sequence
ggcaacgaacttgctgttctc

SEQ ID NO: 28128 - DNA, 21 bp, Artificial sequence
  SiRNA target sequence
gcaacgaacttgctgttctct

SEQ ID NO: 28129 - DNA, 21 bp, Artificial sequence
  SiRNA target sequence
caacgaacttgctgttctctc

SEQ ID NO: 28130 - DNA, 21 bp, Artificial sequence
  SiRNA target sequence
aacgaacttgctgttctctcc

SEQ ID NO: 28131 - DNA, 21 bp, Artificial sequence
  SiRNA target sequence
acgaacttgctgttctctcca

SEQ ID NO: 28132 - DNA, 21 bp, Artificial sequence
  SiRNA target sequence
cgaacttgctgttctctccag

SEQ ID NO: 28133 - DNA, 21 bp, Artificial sequence
  SiRNA target sequence
gaacttgctgttctctccagg

SEQ ID NO: 28134 - DNA, 21 bp, Artificial sequence
  SiRNA target sequence
aacttgctgttctctccaggg

SEQ ID NO: 28135 - DNA, 21 bp, Artificial sequence
  SiRNA target sequence
acttgctgttctctccagggc

SEQ ID NO: 28136 - DNA, 21 bp, Artificial sequence
  SiRNA target sequence
cttgctgttctctccagggcc

SEQ ID NO: 28137 - DNA, 21 bp, Artificial sequence
  SiRNA target sequence
ttgctgttctctccagggccg

SEQ ID NO: 28138 - DNA, 21 bp, Artificial sequence
  SiRNA target sequence
tgctgttctctccagggccgc

SEQ ID NO: 28139 - DNA, 21 bp, Artificial sequence
  SiRNA target sequence
gctgttctctccagggccgcc

SEQ ID NO: 28140 - DNA, 21 bp, Artificial sequence
  SiRNA target sequence
ctgttctctccagggccgccc

SEQ ID NO: 28141 - DNA, 21 bp, Artificial sequence
  SiRNA target sequence
tgttctctccagggccgccca

SEQ ID NO: 28142 - DNA, 21 bp, Artificial sequence
  SiRNA target sequence
gttctctccagggccgcccaa

SEQ ID NO: 28143 - DNA, 21 bp, Artificial sequence
  SiRNA target sequence
ttctctccagggccgcccaac

SEQ ID NO: 28144 - DNA, 21 bp, Artificial sequence
  SiRNA target sequence
tctctccagggccgcccaacg

SEQ ID NO: 28145 - DNA, 21 bp, Artificial sequence
  SiRNA target sequence
ctctccagggccgcccaacga

SEQ ID NO: 28146 - DNA, 21 bp, Artificial sequence
  SiRNA target sequence
tctccagggccgcccaacgaa

SEQ ID NO: 28147 - DNA, 21 bp, Artificial sequence
  SiRNA target sequence
ctccagggccgcccaacgaac

SEQ ID NO: 28148 - DNA, 21 bp, Artificial sequence
  SiRNA target sequence
tccagggccgcccaacgaact

SEQ ID NO: 28149 - DNA, 21 bp, Artificial sequence
  SiRNA target sequence
ccagggccgcccaacgaactt

SEQ ID NO: 28150 - DNA, 21 bp, Artificial sequence
  SiRNA target sequence
cagggccgcccaacgaacttt

SEQ ID NO: 28151 - DNA, 21 bp, Artificial sequence
  SiRNA target sequence
agggccgcccaacgaactttc

SEQ ID NO: 28152 - DNA, 21 bp, Artificial sequence
  SiRNA target sequence
gggccgcccaacgaactttca

SEQ ID NO: 28153 - DNA, 21 bp, Artificial sequence
  SiRNA target sequence
ggccgcccaacgaactttcat

SEQ ID NO: 28154 - DNA, 21 bp, Artificial sequence
  SiRNA target sequence
gccgcccaacgaactttcatc

SEQ ID NO: 28155 - DNA, 21 bp, Artificial sequence
  SiRNA target sequence
ccgcccaacgaactttcatct

SEQ ID NO: 28156 - DNA, 21 bp, Artificial sequence
  SiRNA target sequence
cgcccaacgaactttcatctg

SEQ ID NO: 28157 - DNA, 21 bp, Artificial sequence
  SiRNA target sequence
gcccaacgaactttcatctgt

SEQ ID NO: 28158 - DNA, 21 bp, Artificial sequence
  SiRNA target sequence
cccaacgaactttcatctgtc

SEQ ID NO: 28159 - DNA, 21 bp, Artificial sequence
  SiRNA target sequence
ccaacgaactttcatctgtcc

SEQ ID NO: 28160 - DNA, 21 bp, Artificial sequence
  SiRNA target sequence
caacgaactttcatctgtcca

SEQ ID NO: 28161 - DNA, 21 bp, Artificial sequence
  SiRNA target sequence
aacgaactttcatctgtccat

SEQ ID NO: 28162 - DNA, 21 bp, Artificial sequence
  SiRNA target sequence
acgaactttcatctgtccatc

SEQ ID NO: 28163 - DNA, 21 bp, Artificial sequence
  SiRNA target sequence
cgaactttcatctgtccatct

SEQ ID NO: 28164 - DNA, 21 bp, Artificial sequence
  SiRNA target sequence
gaactttcatctgtccatctc

SEQ ID NO: 28165 - DNA, 21 bp, Artificial sequence
  SiRNA target sequence
aactttcatctgtccatctca

SEQ ID NO: 28166 - DNA, 21 bp, Artificial sequence
  SiRNA target sequence
actttcatctgtccatctcaa

SEQ ID NO: 28167 - DNA, 21 bp, Artificial sequence
  SiRNA target sequence
ctttcatctgtccatctcaat

SEQ ID NO: 28168 - DNA, 21 bp, Artificial sequence
  SiRNA target sequence
tttcatctgtccatctcaata

SEQ ID NO: 28169 - DNA, 21 bp, Artificial sequence
  SiRNA target sequence
ttcatctgtccatctcaatac

SEQ ID NO: 28170 - DNA, 21 bp, Artificial sequence
  SiRNA target sequence
tcatctgtccatctcaataca

SEQ ID NO: 28171 - DNA, 21 bp, Artificial sequence
  SiRNA target sequence
catctgtccatctcaatacac

SEQ ID NO: 28172 - DNA, 21 bp, Artificial sequence
  SiRNA target sequence
atctgtccatctcaatacacc

SEQ ID NO: 28173 - DNA, 21 bp, Artificial sequence
  SiRNA target sequence
tctgtccatctcaatacaccg

SEQ ID NO: 28174 - DNA, 21 bp, Artificial sequence
  SiRNA target sequence
ctgtccatctcaatacaccga

SEQ ID NO: 28175 - DNA, 21 bp, Artificial sequence
  SiRNA target sequence
tgtccatctcaatacaccgaa

SEQ ID NO: 28176 - DNA, 21 bp, Artificial sequence
  SiRNA target sequence
gtccatctcaatacaccgaat

SEQ ID NO: 28177 - DNA, 21 bp, Artificial sequence
  SiRNA target sequence
tccatctcaatacaccgaata

SEQ ID NO: 28178 - DNA, 21 bp, Artificial sequence
  SiRNA target sequence
ccatctcaatacaccgaatac

SEQ ID NO: 28179 - DNA, 21 bp, Artificial sequence
  SiRNA target sequence
catctcaatacaccgaataca

SEQ ID NO: 28180 - DNA, 21 bp, Artificial sequence
  SiRNA target sequence
atctcaatacaccgaatacac

SEQ ID NO: 28181 - DNA, 21 bp, Artificial sequence
  SiRNA target sequence
tctcaatacaccgaatacaca

SEQ ID NO: 28182 - DNA, 21 bp, Artificial sequence
  SiRNA target sequence
ctcaatacaccgaatacacaa

SEQ ID NO: 28183 - DNA, 21 bp, Artificial sequence
  SiRNA target sequence
tcaatacaccgaatacacaac

SEQ ID NO: 28184 - DNA, 21 bp, Artificial sequence
  SiRNA target sequence
caatacaccgaatacacaacc

SEQ ID NO: 28185 - DNA, 21 bp, Artificial sequence
  SiRNA target sequence
aatacaccgaatacacaacca

SEQ ID NO: 28186 - DNA, 21 bp, Artificial sequence
  SiRNA target sequence
atacaccgaatacacaaccat

SEQ ID NO: 28187 - DNA, 21 bp, Artificial sequence
  SiRNA target sequence
tacaccgaatacacaaccatc

SEQ ID NO: 28188 - DNA, 21 bp, Artificial sequence
  SiRNA target sequence
acaccgaatacacaaccatcc

SEQ ID NO: 28189 - DNA, 21 bp, Artificial sequence
  SiRNA target sequence
caccgaatacacaaccatccc

SEQ ID NO: 28190 - DNA, 21 bp, Artificial sequence
  SiRNA target sequence
accgaatacacaaccatccca

SEQ ID NO: 28191 - DNA, 21 bp, Artificial sequence
  SiRNA target sequence
ccgaatacacaaccatcccat

SEQ ID NO: 28192 - DNA, 21 bp, Artificial sequence
  SiRNA target sequence
cgaatacacaaccatcccatt

SEQ ID NO: 28193 - DNA, 21 bp, Artificial sequence
  SiRNA target sequence
gaatacacaaccatcccattg

SEQ ID NO: 28194 - DNA, 21 bp, Artificial sequence
  SiRNA target sequence
aatacacaaccatcccattgg

SEQ ID NO: 28195 - DNA, 21 bp, Artificial sequence
  SiRNA target sequence
atacacaaccatcccattgga

SEQ ID NO: 28196 - DNA, 21 bp, Artificial sequence
  SiRNA target sequence
tacacaaccatcccattggac

SEQ ID NO: 28197 - DNA, 21 bp, Artificial sequence
  SiRNA target sequence
acacaaccatcccattggact

SEQ ID NO: 28198 - DNA, 21 bp, Artificial sequence
  SiRNA target sequence
cacaaccatcccattggactg

SEQ ID NO: 28199 - DNA, 21 bp, Artificial sequence
  SiRNA target sequence
acaaccatcccattggactgt

SEQ ID NO: 28200 - DNA, 21 bp, Artificial sequence
  SiRNA target sequence
caaccatcccattggactgtg

SEQ ID NO: 28201 - DNA, 21 bp, Artificial sequence
  SiRNA target sequence
aaccatcccattggactgtga

SEQ ID NO: 28202 - DNA, 21 bp, Artificial sequence
  SiRNA target sequence
accatcccattggactgtgac

SEQ ID NO: 28203 - DNA, 21 bp, Artificial sequence
  SiRNA target sequence
ccatcccattggactgtgacg

SEQ ID NO: 28204 - DNA, 21 bp, Artificial sequence
  SiRNA target sequence
catcccattggactgtgacga

SEQ ID NO: 28205 - DNA, 21 bp, Artificial sequence
  SiRNA target sequence
atcccattggactgtgacgaa

SEQ ID NO: 28206 - DNA, 21 bp, Artificial sequence
  SiRNA target sequence
tcccattggactgtgacgaac

SEQ ID NO: 28207 - DNA, 21 bp, Artificial sequence
  SiRNA target sequence
cccattggactgtgacgaact

SEQ ID NO: 28208 - DNA, 21 bp, Artificial sequence
  SiRNA target sequence
ccattggactgtgacgaactc

SEQ ID NO: 28209 - DNA, 21 bp, Artificial sequence
  SiRNA target sequence
cattggactgtgacgaactca

SEQ ID NO: 28210 - DNA, 21 bp, Artificial sequence
  SiRNA target sequence
attggactgtgacgaactcaa

SEQ ID NO: 28211 - DNA, 21 bp, Artificial sequence
  SiRNA target sequence
ttggactgtgacgaactcaat

SEQ ID NO: 28212 - DNA, 21 bp, Artificial sequence
  SiRNA target sequence
tggactgtgacgaactcaatg

SEQ ID NO: 28213 - DNA, 21 bp, Artificial sequence
  SiRNA target sequence
ggactgtgacgaactcaatgt

SEQ ID NO: 28214 - DNA, 21 bp, Artificial sequence
  SiRNA target sequence
gactgtgacgaactcaatgtg

SEQ ID NO: 28215 - DNA, 21 bp, Artificial sequence
  SiRNA target sequence
actgtgacgaactcaatgtgc

SEQ ID NO: 28216 - DNA, 21 bp, Artificial sequence
  SiRNA target sequence
ctgtgacgaactcaatgtgcg

SEQ ID NO: 28217 - DNA, 21 bp, Artificial sequence
  SiRNA target sequence
tgtgacgaactcaatgtgcga

SEQ ID NO: 28218 - DNA, 21 bp, Artificial sequence
  SiRNA target sequence
gtgacgaactcaatgtgcgat

SEQ ID NO: 28219 - DNA, 21 bp, Artificial sequence
  SiRNA target sequence
tgacgaactcaatgtgcgatg

SEQ ID NO: 28220 - DNA, 21 bp, Artificial sequence
  SiRNA target sequence
gacgaactcaatgtgcgatgg

SEQ ID NO: 28221 - DNA, 21 bp, Artificial sequence
  SiRNA target sequence
acgaactcaatgtgcgatggc

SEQ ID NO: 28222 - DNA, 21 bp, Artificial sequence
  SiRNA target sequence
cgaactcaatgtgcgatggcc

SEQ ID NO: 28223 - DNA, 21 bp, Artificial sequence
  SiRNA target sequence
gaactcaatgtgcgatggccc

SEQ ID NO: 28224 - DNA, 21 bp, Artificial sequence
  SiRNA target sequence
aactcaatgtgcgatggcccg

SEQ ID NO: 28225 - DNA, 21 bp, Artificial sequence
  SiRNA target sequence
actcaatgtgcgatggcccgt

SEQ ID NO: 28226 - DNA, 21 bp, Artificial sequence
  SiRNA target sequence
ctcaatgtgcgatggcccgtt

SEQ ID NO: 28227 - DNA, 21 bp, Artificial sequence
  SiRNA target sequence
tcaatgtgcgatggcccgttc

SEQ ID NO: 28228 - DNA, 21 bp, Artificial sequence
  SiRNA target sequence
caatgtgcgatggcccgttca

SEQ ID NO: 28229 - DNA, 21 bp, Artificial sequence
  SiRNA target sequence
aatgtgcgatggcccgttcac

SEQ ID NO: 28230 - DNA, 21 bp, Artificial sequence
  SiRNA target sequence
atgtgcgatggcccgttcacg

SEQ ID NO: 28231 - DNA, 21 bp, Artificial sequence
  SiRNA target sequence
tgtgcgatggcccgttcacgc

SEQ ID NO: 28232 - DNA, 21 bp, Artificial sequence
  SiRNA target sequence
gtgcgatggcccgttcacgct

SEQ ID NO: 28233 - DNA, 21 bp, Artificial sequence
  SiRNA target sequence
tgcgatggcccgttcacgctc

SEQ ID NO: 28234 - DNA, 21 bp, Artificial sequence
  SiRNA target sequence
gcgatggcccgttcacgctca

SEQ ID NO: 28235 - DNA, 21 bp, Artificial sequence
  SiRNA target sequence
cgatggcccgttcacgctcaa

SEQ ID NO: 28236 - DNA, 21 bp, Artificial sequence
  SiRNA target sequence
gatggcccgttcacgctcaat

SEQ ID NO: 28237 - DNA, 21 bp, Artificial sequence
  SiRNA target sequence
atggcccgttcacgctcaatc

SEQ ID NO: 28238 - DNA, 21 bp, Artificial sequence
  SiRNA target sequence
tggcccgttcacgctcaatct

SEQ ID NO: 28239 - DNA, 21 bp, Artificial sequence
  SiRNA target sequence
ggcccgttcacgctcaatctc

SEQ ID NO: 28240 - DNA, 21 bp, Artificial sequence
  SiRNA target sequence
gcccgttcacgctcaatctcc

SEQ ID NO: 28241 - DNA, 21 bp, Artificial sequence
  SiRNA target sequence
cccgttcacgctcaatctccc

SEQ ID NO: 28242 - DNA, 21 bp, Artificial sequence
  SiRNA target sequence
ccgttcacgctcaatctcccg

SEQ ID NO: 28243 - DNA, 21 bp, Artificial sequence
  SiRNA target sequence
cgttcacgctcaatctcccgc

SEQ ID NO: 28244 - DNA, 21 bp, Artificial sequence
  SiRNA target sequence
gttcacgctcaatctcccgca

SEQ ID NO: 28245 - DNA, 21 bp, Artificial sequence
  SiRNA target sequence
ttcacgctcaatctcccgcag

SEQ ID NO: 28246 - DNA, 21 bp, Artificial sequence
  SiRNA target sequence
tcacgctcaatctcccgcaga

SEQ ID NO: 28247 - DNA, 21 bp, Artificial sequence
  SiRNA target sequence
cacgctcaatctcccgcagac

SEQ ID NO: 28248 - DNA, 21 bp, Artificial sequence
  SiRNA target sequence
acgctcaatctcccgcagacg

SEQ ID NO: 28249 - DNA, 21 bp, Artificial sequence
  SiRNA target sequence
cgctcaatctcccgcagacgc

SEQ ID NO: 28250 - DNA, 21 bp, Artificial sequence
  SiRNA target sequence
gctcaatctcccgcagacgct

SEQ ID NO: 28251 - DNA, 21 bp, Artificial sequence
  SiRNA target sequence
ctcaatctcccgcagacgctc

SEQ ID NO: 28252 - DNA, 21 bp, Artificial sequence
  SiRNA target sequence
tcaatctcccgcagacgctct

SEQ ID NO: 28253 - DNA, 21 bp, Artificial sequence
  SiRNA target sequence
caatctcccgcagacgctctc

SEQ ID NO: 28254 - DNA, 21 bp, Artificial sequence
  SiRNA target sequence
aatctcccgcagacgctctcg

SEQ ID NO: 28255 - DNA, 21 bp, Artificial sequence
  SiRNA target sequence
atctcccgcagacgctctcga

SEQ ID NO: 28256 - DNA, 21 bp, Artificial sequence
  SiRNA target sequence
tctcccgcagacgctctcgat

SEQ ID NO: 28257 - DNA, 21 bp, Artificial sequence
  SiRNA target sequence
ctcccgcagacgctctcgatc

SEQ ID NO: 28258 - DNA, 21 bp, Artificial sequence
  SiRNA target sequence
tcccgcagacgctctcgatca

SEQ ID NO: 28259 - DNA, 21 bp, Artificial sequence
  SiRNA target sequence
cccgcagacgctctcgatcat

SEQ ID NO: 28260 - DNA, 21 bp, Artificial sequence
  SiRNA target sequence
ccgcagacgctctcgatcatt

SEQ ID NO: 28261 - DNA, 21 bp, Artificial sequence
  SiRNA target sequence
cgcagacgctctcgatcattg

SEQ ID NO: 28262 - DNA, 21 bp, Artificial sequence
  SiRNA target sequence
gcagacgctctcgatcattga

SEQ ID NO: 28263 - DNA, 21 bp, Artificial sequence
  SiRNA target sequence
cagacgctctcgatcattgag

SEQ ID NO: 28264 - DNA, 21 bp, Artificial sequence
  SiRNA target sequence
agacgctctcgatcattgagc

SEQ ID NO: 28265 - DNA, 21 bp, Artificial sequence
  SiRNA target sequence
gacgctctcgatcattgagcg

SEQ ID NO: 28266 - DNA, 21 bp, Artificial sequence
  SiRNA target sequence
acgctctcgatcattgagcgc

SEQ ID NO: 28267 - DNA, 21 bp, Artificial sequence
  SiRNA target sequence
cgctctcgatcattgagcgcc

SEQ ID NO: 28268 - DNA, 21 bp, Artificial sequence
  SiRNA target sequence
gctctcgatcattgagcgcca

SEQ ID NO: 28269 - DNA, 21 bp, Artificial sequence
  SiRNA target sequence
ctctcgatcattgagcgccag

SEQ ID NO: 28270 - DNA, 21 bp, Artificial sequence
  SiRNA target sequence
tctcgatcattgagcgccagt

SEQ ID NO: 28271 - DNA, 21 bp, Artificial sequence
  SiRNA target sequence
ctcgatcattgagcgccagtc

SEQ ID NO: 28272 - DNA, 21 bp, Artificial sequence
  SiRNA target sequence
tcgatcattgagcgccagtcg

SEQ ID NO: 28273 - DNA, 21 bp, Artificial sequence
  SiRNA target sequence
cgatcattgagcgccagtcgt

SEQ ID NO: 28274 - DNA, 21 bp, Artificial sequence
  SiRNA target sequence
gatcattgagcgccagtcgtc

SEQ ID NO: 28275 - DNA, 21 bp, Artificial sequence
  SiRNA target sequence
atcattgagcgccagtcgtcg

SEQ ID NO: 28276 - DNA, 21 bp, Artificial sequence
  SiRNA target sequence
tcattgagcgccagtcgtcgt

SEQ ID NO: 28277 - DNA, 21 bp, Artificial sequence
  SiRNA target sequence
cattgagcgccagtcgtcgtc

SEQ ID NO: 28278 - DNA, 21 bp, Artificial sequence
  SiRNA target sequence
attgagcgccagtcgtcgtcc

SEQ ID NO: 28279 - DNA, 21 bp, Artificial sequence
  SiRNA target sequence
ttgagcgccagtcgtcgtccg

SEQ ID NO: 28280 - DNA, 21 bp, Artificial sequence
  SiRNA target sequence
tgagcgccagtcgtcgtccga

SEQ ID NO: 28281 - DNA, 21 bp, Artificial sequence
  SiRNA target sequence
gagcgccagtcgtcgtccgag

SEQ ID NO: 28282 - DNA, 21 bp, Artificial sequence
  SiRNA target sequence
agcgccagtcgtcgtccgagc

SEQ ID NO: 28283 - DNA, 21 bp, Artificial sequence
  SiRNA target sequence
gcgccagtcgtcgtccgagcc

SEQ ID NO: 28284 - DNA, 21 bp, Artificial sequence
  SiRNA target sequence
cgccagtcgtcgtccgagccg

SEQ ID NO: 28285 - DNA, 21 bp, Artificial sequence
  SiRNA target sequence
gccagtcgtcgtccgagccga

SEQ ID NO: 28286 - DNA, 21 bp, Artificial sequence
  SiRNA target sequence
ccagtcgtcgtccgagccgac

SEQ ID NO: 28287 - DNA, 21 bp, Artificial sequence
  SiRNA target sequence
cagtcgtcgtccgagccgacc

SEQ ID NO: 28288 - DNA, 21 bp, Artificial sequence
  SiRNA target sequence
agtcgtcgtccgagccgacca

SEQ ID NO: 28289 - DNA, 21 bp, Artificial sequence
  SiRNA target sequence
gtcgtcgtccgagccgaccac

SEQ ID NO: 28290 - DNA, 21 bp, Artificial sequence
  SiRNA target sequence
tcgtcgtccgagccgaccacg

SEQ ID NO: 28291 - DNA, 21 bp, Artificial sequence
  SiRNA target sequence
cgtcgtccgagccgaccacgc

SEQ ID NO: 28292 - DNA, 21 bp, Artificial sequence
  SiRNA target sequence
gtcgtccgagccgaccacgcc

SEQ ID NO: 28293 - DNA, 21 bp, Artificial sequence
  SiRNA target sequence
tcgtccgagccgaccacgccg

SEQ ID NO: 28294 - DNA, 21 bp, Artificial sequence
  SiRNA target sequence
cgtccgagccgaccacgccgg

SEQ ID NO: 28295 - DNA, 21 bp, Artificial sequence
  SiRNA target sequence
gtccgagccgaccacgccggt

SEQ ID NO: 28296 - DNA, 21 bp, Artificial sequence
  SiRNA target sequence
tccgagccgaccacgccggtc

SEQ ID NO: 28297 - DNA, 21 bp, Artificial sequence
  SiRNA target sequence
ccgagccgaccacgccggtcc

SEQ ID NO: 28298 - DNA, 21 bp, Artificial sequence
  SiRNA target sequence
cgagccgaccacgccggtcca

SEQ ID NO: 28299 - DNA, 21 bp, Artificial sequence
  SiRNA target sequence
gagccgaccacgccggtccat

SEQ ID NO: 28300 - DNA, 21 bp, Artificial sequence
  SiRNA target sequence
agccgaccacgccggtccatt

SEQ ID NO: 28301 - DNA, 21 bp, Artificial sequence
  SiRNA target sequence
gccgaccacgccggtccattc

SEQ ID NO: 28302 - DNA, 21 bp, Artificial sequence
  SiRNA target sequence
ccgaccacgccggtccattct

SEQ ID NO: 28303 - DNA, 21 bp, Artificial sequence
  SiRNA target sequence
cgaccacgccggtccattcta

SEQ ID NO: 28304 - DNA, 21 bp, Artificial sequence
  SiRNA target sequence
gaccacgccggtccattctag

SEQ ID NO: 28305 - DNA, 21 bp, Artificial sequence
  SiRNA target sequence
accacgccggtccattctaga

SEQ ID NO: 28306 - DNA, 21 bp, Artificial sequence
  SiRNA target sequence
ccacgccggtccattctagac

SEQ ID NO: 28307 - DNA, 21 bp, Artificial sequence
  SiRNA target sequence
cacgccggtccattctagacc

SEQ ID NO: 28308 - DNA, 21 bp, Artificial sequence
  SiRNA target sequence
acgccggtccattctagaccg

SEQ ID NO: 28309 - DNA, 21 bp, Artificial sequence
  SiRNA target sequence
cgccggtccattctagaccgc

SEQ ID NO: 28310 - DNA, 21 bp, Artificial sequence
  SiRNA target sequence
gccggtccattctagaccgca

SEQ ID NO: 28311 - DNA, 21 bp, Artificial sequence
  SiRNA target sequence
ccggtccattctagaccgcat

SEQ ID NO: 28312 - DNA, 21 bp, Artificial sequence
  SiRNA target sequence
cggtccattctagaccgcatc

SEQ ID NO: 28313 - DNA, 21 bp, Artificial sequence
  SiRNA target sequence
ggtccattctagaccgcatcg

SEQ ID NO: 28314 - DNA, 21 bp, Artificial sequence
  SiRNA target sequence
gtccattctagaccgcatcgg

SEQ ID NO: 28315 - DNA, 21 bp, Artificial sequence
  SiRNA target sequence
tccattctagaccgcatcggc

SEQ ID NO: 28316 - DNA, 21 bp, Artificial sequence
  SiRNA target sequence
ccattctagaccgcatcggcc

SEQ ID NO: 28317 - DNA, 21 bp, Artificial sequence
  SiRNA target sequence
cattctagaccgcatcggccg

SEQ ID NO: 28318 - DNA, 21 bp, Artificial sequence
  SiRNA target sequence
attctagaccgcatcggccgt

SEQ ID NO: 28319 - DNA, 21 bp, Artificial sequence
  SiRNA target sequence
ttctagaccgcatcggccgtg

SEQ ID NO: 28320 - DNA, 21 bp, Artificial sequence
  SiRNA target sequence
tctagaccgcatcggccgtgc

SEQ ID NO: 28321 - DNA, 21 bp, Artificial sequence
  SiRNA target sequence
ctagaccgcatcggccgtgcc

SEQ ID NO: 28322 - DNA, 21 bp, Artificial sequence
  SiRNA target sequence
tagaccgcatcggccgtgcct

SEQ ID NO: 28323 - DNA, 21 bp, Artificial sequence
  SiRNA target sequence
agaccgcatcggccgtgcctt

SEQ ID NO: 28324 - DNA, 21 bp, Artificial sequence
  SiRNA target sequence
gaccgcatcggccgtgccttt

SEQ ID NO: 28325 - DNA, 21 bp, Artificial sequence
  SiRNA target sequence
accgcatcggccgtgcctttc

SEQ ID NO: 28326 - DNA, 21 bp, Artificial sequence
  SiRNA target sequence
ccgcatcggccgtgcctttca

SEQ ID NO: 28327 - DNA, 21 bp, Artificial sequence
  SiRNA target sequence
cgcatcggccgtgcctttcaa

SEQ ID NO: 28328 - DNA, 21 bp, Artificial sequence
  SiRNA target sequence
gcatcggccgtgcctttcaac

SEQ ID NO: 28329 - DNA, 21 bp, Artificial sequence
  SiRNA target sequence
catcggccgtgcctttcaacg

SEQ ID NO: 28330 - DNA, 21 bp, Artificial sequence
  SiRNA target sequence
atcggccgtgcctttcaacga

SEQ ID NO: 28331 - DNA, 21 bp, Artificial sequence
  SiRNA target sequence
tcggccgtgcctttcaacgag

SEQ ID NO: 28332 - DNA, 21 bp, Artificial sequence
  SiRNA target sequence
cggccgtgcctttcaacgagt

SEQ ID NO: 28333 - DNA, 21 bp, Artificial sequence
  SiRNA target sequence
ggccgtgcctttcaacgagtc

SEQ ID NO: 28334 - DNA, 21 bp, Artificial sequence
  SiRNA target sequence
gccgtgcctttcaacgagtcc

SEQ ID NO: 28335 - DNA, 21 bp, Artificial sequence
  SiRNA target sequence
ccgtgcctttcaacgagtcct

SEQ ID NO: 28336 - DNA, 21 bp, Artificial sequence
  SiRNA target sequence
cgtgcctttcaacgagtcctt

SEQ ID NO: 28337 - DNA, 21 bp, Artificial sequence
  SiRNA target sequence
gtgcctttcaacgagtccttg

SEQ ID NO: 28338 - DNA, 21 bp, Artificial sequence
  SiRNA target sequence
tgcctttcaacgagtccttgc

SEQ ID NO: 28339 - DNA, 21 bp, Artificial sequence
  SiRNA target sequence
gcctttcaacgagtccttgcc

SEQ ID NO: 28340 - DNA, 21 bp, Artificial sequence
  SiRNA target sequence
cctttcaacgagtccttgcca

SEQ ID NO: 28341 - DNA, 21 bp, Artificial sequence
  SiRNA target sequence
ctttcaacgagtccttgccaa

SEQ ID NO: 28342 - DNA, 21 bp, Artificial sequence
  SiRNA target sequence
tttcaacgagtccttgccaat

SEQ ID NO: 28343 - DNA, 21 bp, Artificial sequence
  SiRNA target sequence
ttcaacgagtccttgccaatc

SEQ ID NO: 28344 - DNA, 21 bp, Artificial sequence
  SiRNA target sequence
tcaacgagtccttgccaatcc

SEQ ID NO: 28345 - DNA, 21 bp, Artificial sequence
  SiRNA target sequence
caacgagtccttgccaatcca

SEQ ID NO: 28346 - DNA, 21 bp, Artificial sequence
  SiRNA target sequence
aacgagtccttgccaatccaa

SEQ ID NO: 28347 - DNA, 21 bp, Artificial sequence
  SiRNA target sequence
acgagtccttgccaatccaac

SEQ ID NO: 28348 - DNA, 21 bp, Artificial sequence
  SiRNA target sequence
cgagtccttgccaatccaact

SEQ ID NO: 28349 - DNA, 21 bp, Artificial sequence
  SiRNA target sequence
gagtccttgccaatccaactg

SEQ ID NO: 28350 - DNA, 21 bp, Artificial sequence
  SiRNA target sequence
agtccttgccaatccaactgc

SEQ ID NO: 28351 - DNA, 21 bp, Artificial sequence
  SiRNA target sequence
gtccttgccaatccaactgct

SEQ ID NO: 28352 - DNA, 21 bp, Artificial sequence
  SiRNA target sequence
tccttgccaatccaactgctg

SEQ ID NO: 28353 - DNA, 21 bp, Artificial sequence
  SiRNA target sequence
ccttgccaatccaactgctgt

SEQ ID NO: 28354 - DNA, 21 bp, Artificial sequence
  SiRNA target sequence
cttgccaatccaactgctgtg

SEQ ID NO: 28355 - DNA, 21 bp, Artificial sequence
  SiRNA target sequence
ttgccaatccaactgctgtgg

SEQ ID NO: 28356 - DNA, 21 bp, Artificial sequence
  SiRNA target sequence
tgccaatccaactgctgtggt

SEQ ID NO: 28357 - DNA, 21 bp, Artificial sequence
  SiRNA target sequence
gccaatccaactgctgtggta

SEQ ID NO: 28358 - DNA, 21 bp, Artificial sequence
  SiRNA target sequence
ccaatccaactgctgtggtag

SEQ ID NO: 28359 - DNA, 21 bp, Artificial sequence
  SiRNA target sequence
caatccaactgctgtggtagc

SEQ ID NO: 28360 - DNA, 21 bp, Artificial sequence
  SiRNA target sequence
aatccaactgctgtggtagcc

SEQ ID NO: 28361 - DNA, 21 bp, Artificial sequence
  SiRNA target sequence
atccaactgctgtggtagcct

SEQ ID NO: 28362 - DNA, 21 bp, Artificial sequence
  SiRNA target sequence
tccaactgctgtggtagcctt

SEQ ID NO: 28363 - DNA, 21 bp, Artificial sequence
  SiRNA target sequence
ccaactgctgtggtagccttc

SEQ ID NO: 28364 - DNA, 21 bp, Artificial sequence
  SiRNA target sequence
caactgctgtggtagccttcg

SEQ ID NO: 28365 - DNA, 21 bp, Artificial sequence
  SiRNA target sequence
aactgctgtggtagccttcgt

SEQ ID NO: 28366 - DNA, 21 bp, Artificial sequence
  SiRNA target sequence
actgctgtggtagccttcgtc

SEQ ID NO: 28367 - DNA, 21 bp, Artificial sequence
  SiRNA target sequence
ctgctgtggtagccttcgtcg

SEQ ID NO: 28368 - DNA, 21 bp, Artificial sequence
  SiRNA target sequence
tgctgtggtagccttcgtcgt

SEQ ID NO: 28369 - DNA, 21 bp, Artificial sequence
  SiRNA target sequence
gctgtggtagccttcgtcgta

SEQ ID NO: 28370 - DNA, 21 bp, Artificial sequence
  SiRNA target sequence
ctgtggtagccttcgtcgtat

SEQ ID NO: 28371 - DNA, 21 bp, Artificial sequence
  SiRNA target sequence
tgtggtagccttcgtcgtatg

SEQ ID NO: 28372 - DNA, 21 bp, Artificial sequence
  SiRNA target sequence
gtggtagccttcgtcgtatgc

SEQ ID NO: 28373 - DNA, 21 bp, Artificial sequence
  SiRNA target sequence
tggtagccttcgtcgtatgcg

SEQ ID NO: 28374 - DNA, 21 bp, Artificial sequence
  SiRNA target sequence
ggtagccttcgtcgtatgcgc

SEQ ID NO: 28375 - DNA, 21 bp, Artificial sequence
  SiRNA target sequence
gtagccttcgtcgtatgcgcg

SEQ ID NO: 28376 - DNA, 21 bp, Artificial sequence
  SiRNA target sequence
tagccttcgtcgtatgcgcga

SEQ ID NO: 28377 - DNA, 21 bp, Artificial sequence
  SiRNA target sequence
agccttcgtcgtatgcgcgat

SEQ ID NO: 28378 - DNA, 21 bp, Artificial sequence
  SiRNA target sequence
gccttcgtcgtatgcgcgatc

SEQ ID NO: 28379 - DNA, 21 bp, Artificial sequence
  SiRNA target sequence
ccttcgtcgtatgcgcgatct

SEQ ID NO: 28380 - DNA, 21 bp, Artificial sequence
  SiRNA target sequence
cttcgtcgtatgcgcgatctt

SEQ ID NO: 28381 - DNA, 21 bp, Artificial sequence
  SiRNA target sequence
ttcgtcgtatgcgcgatctta

SEQ ID NO: 28382 - DNA, 21 bp, Artificial sequence
  SiRNA target sequence
tcgtcgtatgcgcgatcttag

SEQ ID NO: 28383 - DNA, 21 bp, Artificial sequence
  SiRNA target sequence
cgtcgtatgcgcgatcttagc

SEQ ID NO: 28384 - DNA, 21 bp, Artificial sequence
  SiRNA target sequence
gtcgtatgcgcgatcttagct

SEQ ID NO: 28385 - DNA, 21 bp, Artificial sequence
  SiRNA target sequence
tcgtatgcgcgatcttagctg

SEQ ID NO: 28386 - DNA, 21 bp, Artificial sequence
  SiRNA target sequence
cgtatgcgcgatcttagctgt

SEQ ID NO: 28387 - DNA, 21 bp, Artificial sequence
  SiRNA target sequence
gtatgcgcgatcttagctgtt

SEQ ID NO: 28388 - DNA, 21 bp, Artificial sequence
  SiRNA target sequence
tatgcgcgatcttagctgttt

SEQ ID NO: 28389 - DNA, 21 bp, Artificial sequence
  SiRNA target sequence
atgcgcgatcttagctgtttc

SEQ ID NO: 28390 - DNA, 21 bp, Artificial sequence
  SiRNA target sequence
tgcgcgatcttagctgtttcc

SEQ ID NO: 28391 - DNA, 21 bp, Artificial sequence
  SiRNA target sequence
gcgcgatcttagctgtttccc

SEQ ID NO: 28392 - DNA, 21 bp, Artificial sequence
  SiRNA target sequence
cgcgatcttagctgtttccca

SEQ ID NO: 28393 - DNA, 21 bp, Artificial sequence
  SiRNA target sequence
gcgatcttagctgtttcccat

SEQ ID NO: 28394 - DNA, 21 bp, Artificial sequence
  SiRNA target sequence
cgatcttagctgtttcccata

SEQ ID NO: 28395 - DNA, 21 bp, Artificial sequence
  SiRNA target sequence
gatcttagctgtttcccatac

SEQ ID NO: 28396 - DNA, 21 bp, Artificial sequence
  SiRNA target sequence
atcttagctgtttcccataca

SEQ ID NO: 28397 - DNA, 21 bp, Artificial sequence
  SiRNA target sequence
tcttagctgtttcccatacat

SEQ ID NO: 28398 - DNA, 21 bp, Artificial sequence
  SiRNA target sequence
cttagctgtttcccatacatc

SEQ ID NO: 28399 - DNA, 21 bp, Artificial sequence
  SiRNA target sequence
ttagctgtttcccatacatca

SEQ ID NO: 28400 - DNA, 21 bp, Artificial sequence
  SiRNA target sequence
tagctgtttcccatacatcag

SEQ ID NO: 28401 - DNA, 21 bp, Artificial sequence
  SiRNA target sequence
agctgtttcccatacatcaga

SEQ ID NO: 28402 - DNA, 21 bp, Artificial sequence
  SiRNA target sequence
gctgtttcccatacatcagat

SEQ ID NO: 28403 - DNA, 21 bp, Artificial sequence
  SiRNA target sequence
ctgtttcccatacatcagatc

SEQ ID NO: 28404 - DNA, 21 bp, Artificial sequence
  SiRNA target sequence
tgtttcccatacatcagatcc

SEQ ID NO: 28405 - DNA, 21 bp, Artificial sequence
  SiRNA target sequence
gtttcccatacatcagatcca

SEQ ID NO: 28406 - DNA, 21 bp, Artificial sequence
  SiRNA target sequence
tttcccatacatcagatccag

SEQ ID NO: 28407 - DNA, 21 bp, Artificial sequence
  SiRNA target sequence
ttcccatacatcagatccagc

SEQ ID NO: 28408 - DNA, 21 bp, Artificial sequence
  SiRNA target sequence
tcccatacatcagatccagcc

SEQ ID NO: 28409 - DNA, 21 bp, Artificial sequence
  SiRNA target sequence
cccatacatcagatccagcca

SEQ ID NO: 28410 - DNA, 21 bp, Artificial sequence
  SiRNA target sequence
ccatacatcagatccagccaa

SEQ ID NO: 28411 - DNA, 21 bp, Artificial sequence
  SiRNA target sequence
catacatcagatccagccaaa

SEQ ID NO: 28412 - DNA, 21 bp, Artificial sequence
  SiRNA target sequence
atacatcagatccagccaaat

SEQ ID NO: 28413 - DNA, 21 bp, Artificial sequence
  SiRNA target sequence
tacatcagatccagccaaatc

SEQ ID NO: 28414 - DNA, 21 bp, Artificial sequence
  SiRNA target sequence
acatcagatccagccaaatca

SEQ ID NO: 28415 - DNA, 21 bp, Artificial sequence
  SiRNA target sequence
catcagatccagccaaatcaa

SEQ ID NO: 28416 - DNA, 21 bp, Artificial sequence
  SiRNA target sequence
atcagatccagccaaatcaat

SEQ ID NO: 28417 - DNA, 21 bp, Artificial sequence
  SiRNA target sequence
tcagatccagccaaatcaatc

SEQ ID NO: 28418 - DNA, 21 bp, Artificial sequence
  SiRNA target sequence
cagatccagccaaatcaatcg

SEQ ID NO: 28419 - DNA, 21 bp, Artificial sequence
  SiRNA target sequence
agatccagccaaatcaatcgt

SEQ ID NO: 28420 - DNA, 21 bp, Artificial sequence
  SiRNA target sequence
gatccagccaaatcaatcgtg

SEQ ID NO: 28421 - DNA, 21 bp, Artificial sequence
  SiRNA target sequence
atccagccaaatcaatcgtgg

SEQ ID NO: 28422 - DNA, 21 bp, Artificial sequence
  SiRNA target sequence
tccagccaaatcaatcgtggt

SEQ ID NO: 28423 - DNA, 21 bp, Artificial sequence
  SiRNA target sequence
ccagccaaatcaatcgtggtt

SEQ ID NO: 28424 - DNA, 21 bp, Artificial sequence
  SiRNA target sequence
cagccaaatcaatcgtggtta

SEQ ID NO: 28425 - DNA, 21 bp, Artificial sequence
  SiRNA target sequence
agccaaatcaatcgtggttac

SEQ ID NO: 28426 - DNA, 21 bp, Artificial sequence
  SiRNA target sequence
gccaaatcaatcgtggttacc

SEQ ID NO: 28427 - DNA, 21 bp, Artificial sequence
  SiRNA target sequence
ccaaatcaatcgtggttaccc

SEQ ID NO: 28428 - DNA, 21 bp, Artificial sequence
  SiRNA target sequence
caaatcaatcgtggttaccct

SEQ ID NO: 28429 - DNA, 21 bp, Artificial sequence
  SiRNA target sequence
aaatcaatcgtggttaccctc

SEQ ID NO: 28430 - DNA, 21 bp, Artificial sequence
  SiRNA target sequence
aatcaatcgtggttaccctcg

SEQ ID NO: 28431 - DNA, 21 bp, Artificial sequence
  SiRNA target sequence
atcaatcgtggttaccctcgg

SEQ ID NO: 28432 - DNA, 21 bp, Artificial sequence
  SiRNA target sequence
tcaatcgtggttaccctcggg

SEQ ID NO: 28433 - DNA, 21 bp, Artificial sequence
  SiRNA target sequence
caatcgtggttaccctcgggc

SEQ ID NO: 28434 - DNA, 21 bp, Artificial sequence
  SiRNA target sequence
aatcgtggttaccctcgggca

SEQ ID NO: 28435 - DNA, 21 bp, Artificial sequence
  SiRNA target sequence
atcgtggttaccctcgggcag

SEQ ID NO: 28436 - DNA, 21 bp, Artificial sequence
  SiRNA target sequence
tcgtggttaccctcgggcaga

SEQ ID NO: 28437 - DNA, 21 bp, Artificial sequence
  SiRNA target sequence
cgtggttaccctcgggcagaa

SEQ ID NO: 28438 - DNA, 21 bp, Artificial sequence
  SiRNA target sequence
gtggttaccctcgggcagaag

SEQ ID NO: 28439 - DNA, 21 bp, Artificial sequence
  SiRNA target sequence
tggttaccctcgggcagaagc

SEQ ID NO: 28440 - DNA, 21 bp, Artificial sequence
  SiRNA target sequence
ggttaccctcgggcagaagct

SEQ ID NO: 28441 - DNA, 21 bp, Artificial sequence
  SiRNA target sequence
gttaccctcgggcagaagctc

SEQ ID NO: 28442 - DNA, 21 bp, Artificial sequence
  SiRNA target sequence
ttaccctcgggcagaagctcc

SEQ ID NO: 28443 - DNA, 21 bp, Artificial sequence
  SiRNA target sequence
taccctcgggcagaagctcca

SEQ ID NO: 28444 - DNA, 21 bp, Artificial sequence
  SiRNA target sequence
accctcgggcagaagctccaa

SEQ ID NO: 28445 - DNA, 21 bp, Artificial sequence
  SiRNA target sequence
ccctcgggcagaagctccaaa

SEQ ID NO: 28446 - DNA, 21 bp, Artificial sequence
  SiRNA target sequence
cctcgggcagaagctccaaac

SEQ ID NO: 28447 - DNA, 21 bp, Artificial sequence
  SiRNA target sequence
ctcgggcagaagctccaaact

SEQ ID NO: 28448 - DNA, 21 bp, Artificial sequence
  SiRNA target sequence
tcgggcagaagctccaaactg

SEQ ID NO: 28449 - DNA, 21 bp, Artificial sequence
  SiRNA target sequence
cgggcagaagctccaaactgt

SEQ ID NO: 28450 - DNA, 21 bp, Artificial sequence
  SiRNA target sequence
gggcagaagctccaaactgtc

SEQ ID NO: 28451 - DNA, 21 bp, Artificial sequence
  SiRNA target sequence
ggcagaagctccaaactgtca

SEQ ID NO: 28452 - DNA, 21 bp, Artificial sequence
  SiRNA target sequence
gcagaagctccaaactgtcaa

SEQ ID NO: 28453 - DNA, 21 bp, Artificial sequence
  SiRNA target sequence
cagaagctccaaactgtcaat

SEQ ID NO: 28454 - DNA, 21 bp, Artificial sequence
  SiRNA target sequence
agaagctccaaactgtcaatg

SEQ ID NO: 28455 - DNA, 21 bp, Artificial sequence
  SiRNA target sequence
gaagctccaaactgtcaatgc

SEQ ID NO: 28456 - DNA, 21 bp, Artificial sequence
  SiRNA target sequence
aagctccaaactgtcaatgcc

SEQ ID NO: 28457 - DNA, 21 bp, Artificial sequence
  SiRNA target sequence
agctccaaactgtcaatgccc

SEQ ID NO: 28458 - DNA, 21 bp, Artificial sequence
  SiRNA target sequence
gctccaaactgtcaatgccct

SEQ ID NO: 28459 - DNA, 21 bp, Artificial sequence
  SiRNA target sequence
ctccaaactgtcaatgccctc

SEQ ID NO: 28460 - DNA, 21 bp, Artificial sequence
  SiRNA target sequence
tccaaactgtcaatgccctca

SEQ ID NO: 28461 - DNA, 21 bp, Artificial sequence
  SiRNA target sequence
ccaaactgtcaatgccctcaa

SEQ ID NO: 28462 - DNA, 21 bp, Artificial sequence
  SiRNA target sequence
caaactgtcaatgccctcaaa

SEQ ID NO: 28463 - DNA, 21 bp, Artificial sequence
  SiRNA target sequence
aaactgtcaatgccctcaaat

SEQ ID NO: 28464 - DNA, 21 bp, Artificial sequence
  SiRNA target sequence
aactgtcaatgccctcaaatt

SEQ ID NO: 28465 - DNA, 21 bp, Artificial sequence
  SiRNA target sequence
actgtcaatgccctcaaattc

SEQ ID NO: 28466 - DNA, 21 bp, Artificial sequence
  SiRNA target sequence
ctgtcaatgccctcaaattca

SEQ ID NO: 28467 - DNA, 21 bp, Artificial sequence
  SiRNA target sequence
tgtcaatgccctcaaattcat

SEQ ID NO: 28468 - DNA, 21 bp, Artificial sequence
  SiRNA target sequence
gtcaatgccctcaaattcatc

SEQ ID NO: 28469 - DNA, 21 bp, Artificial sequence
  SiRNA target sequence
tcaatgccctcaaattcatcg

SEQ ID NO: 28470 - DNA, 21 bp, Artificial sequence
  SiRNA target sequence
caatgccctcaaattcatcgg

SEQ ID NO: 28471 - DNA, 21 bp, Artificial sequence
  SiRNA target sequence
aatgccctcaaattcatcggg

SEQ ID NO: 28472 - DNA, 21 bp, Artificial sequence
  SiRNA target sequence
atgccctcaaattcatcgggg

SEQ ID NO: 28473 - DNA, 21 bp, Artificial sequence
  SiRNA target sequence
tgccctcaaattcatcgggga

SEQ ID NO: 28474 - DNA, 21 bp, Artificial sequence
  SiRNA target sequence
gccctcaaattcatcggggac

SEQ ID NO: 28475 - DNA, 21 bp, Artificial sequence
  SiRNA target sequence
ccctcaaattcatcggggact

SEQ ID NO: 28476 - DNA, 21 bp, Artificial sequence
  SiRNA target sequence
cctcaaattcatcggggactt

SEQ ID NO: 28477 - DNA, 21 bp, Artificial sequence
  SiRNA target sequence
ctcaaattcatcggggacttc

SEQ ID NO: 28478 - DNA, 21 bp, Artificial sequence
  SiRNA target sequence
tcaaattcatcggggacttca

SEQ ID NO: 28479 - DNA, 21 bp, Artificial sequence
  SiRNA target sequence
caaattcatcggggacttcat

SEQ ID NO: 28480 - DNA, 21 bp, Artificial sequence
  SiRNA target sequence
aaattcatcggggacttcatc

SEQ ID NO: 28481 - DNA, 21 bp, Artificial sequence
  SiRNA target sequence
aattcatcggggacttcatca

SEQ ID NO: 28482 - DNA, 21 bp, Artificial sequence
  SiRNA target sequence
attcatcggggacttcatcac

SEQ ID NO: 28483 - DNA, 21 bp, Artificial sequence
  SiRNA target sequence
ttcatcggggacttcatcaca

SEQ ID NO: 28484 - DNA, 21 bp, Artificial sequence
  SiRNA target sequence
tcatcggggacttcatcacag

SEQ ID NO: 28485 - DNA, 21 bp, Artificial sequence
  SiRNA target sequence
catcggggacttcatcacaga

SEQ ID NO: 28486 - DNA, 21 bp, Artificial sequence
  SiRNA target sequence
atcggggacttcatcacagaa

SEQ ID NO: 28487 - DNA, 21 bp, Artificial sequence
  SiRNA target sequence
tcggggacttcatcacagaac

SEQ ID NO: 28488 - DNA, 21 bp, Artificial sequence
  SiRNA target sequence
cggggacttcatcacagaaca

SEQ ID NO: 28489 - DNA, 21 bp, Artificial sequence
  SiRNA target sequence
ggggacttcatcacagaacat

SEQ ID NO: 28490 - DNA, 21 bp, Artificial sequence
  SiRNA target sequence
gggacttcatcacagaacatc

SEQ ID NO: 28491 - DNA, 21 bp, Artificial sequence
  SiRNA target sequence
ggacttcatcacagaacatcc

SEQ ID NO: 28492 - DNA, 21 bp, Artificial sequence
  SiRNA target sequence
gacttcatcacagaacatccg

SEQ ID NO: 28493 - DNA, 21 bp, Artificial sequence
  SiRNA target sequence
acttcatcacagaacatccgg

SEQ ID NO: 28494 - DNA, 21 bp, Artificial sequence
  SiRNA target sequence
cttcatcacagaacatccgga

SEQ ID NO: 28495 - DNA, 21 bp, Artificial sequence
  SiRNA target sequence
ttcatcacagaacatccggaa

SEQ ID NO: 28496 - DNA, 21 bp, Artificial sequence
  SiRNA target sequence
tcatcacagaacatccggaac

SEQ ID NO: 28497 - DNA, 21 bp, Artificial sequence
  SiRNA target sequence
catcacagaacatccggaaca

SEQ ID NO: 28498 - DNA, 21 bp, Artificial sequence
  SiRNA target sequence
atcacagaacatccggaacag

SEQ ID NO: 28499 - DNA, 21 bp, Artificial sequence
  SiRNA target sequence
tcacagaacatccggaacaga

SEQ ID NO: 28500 - DNA, 21 bp, Artificial sequence
  SiRNA target sequence
cacagaacatccggaacagac

SEQ ID NO: 28501 - DNA, 21 bp, Artificial sequence
  SiRNA target sequence
acagaacatccggaacagacg

SEQ ID NO: 28502 - DNA, 21 bp, Artificial sequence
  SiRNA target sequence
cagaacatccggaacagacga

SEQ ID NO: 28503 - DNA, 21 bp, Artificial sequence
  SiRNA target sequence
agaacatccggaacagacgat

SEQ ID NO: 28504 - DNA, 21 bp, Artificial sequence
  SiRNA target sequence
gaacatccggaacagacgata

SEQ ID NO: 28505 - DNA, 21 bp, Artificial sequence
  SiRNA target sequence
aacatccggaacagacgatag

SEQ ID NO: 28506 - DNA, 21 bp, Artificial sequence
  SiRNA target sequence
acatccggaacagacgatagg

SEQ ID NO: 28507 - DNA, 21 bp, Artificial sequence
  SiRNA target sequence
catccggaacagacgataggc

SEQ ID NO: 28508 - DNA, 21 bp, Artificial sequence
  SiRNA target sequence
atccggaacagacgataggcg

SEQ ID NO: 28509 - DNA, 21 bp, Artificial sequence
  SiRNA target sequence
tccggaacagacgataggcgc

SEQ ID NO: 28510 - DNA, 21 bp, Artificial sequence
  SiRNA target sequence
ccggaacagacgataggcgcc

SEQ ID NO: 28511 - DNA, 21 bp, Artificial sequence
  SiRNA target sequence
cggaacagacgataggcgccg

SEQ ID NO: 28512 - DNA, 21 bp, Artificial sequence
  SiRNA target sequence
ggaacagacgataggcgccgt

SEQ ID NO: 28513 - DNA, 21 bp, Artificial sequence
  SiRNA target sequence
gaacagacgataggcgccgta

SEQ ID NO: 28514 - DNA, 21 bp, Artificial sequence
  SiRNA target sequence
aacagacgataggcgccgtag

SEQ ID NO: 28515 - DNA, 21 bp, Artificial sequence
  SiRNA target sequence
acagacgataggcgccgtagc

SEQ ID NO: 28516 - DNA, 21 bp, Artificial sequence
  SiRNA target sequence
cagacgataggcgccgtagct

SEQ ID NO: 28517 - DNA, 21 bp, Artificial sequence
  SiRNA target sequence
agacgataggcgccgtagctg

SEQ ID NO: 28518 - DNA, 21 bp, Artificial sequence
  SiRNA target sequence
gacgataggcgccgtagctgt

SEQ ID NO: 28519 - DNA, 21 bp, Artificial sequence
  SiRNA target sequence
acgataggcgccgtagctgtt

SEQ ID NO: 28520 - DNA, 21 bp, Artificial sequence
  SiRNA target sequence
cgataggcgccgtagctgttt

SEQ ID NO: 28521 - DNA, 21 bp, Artificial sequence
  SiRNA target sequence
gataggcgccgtagctgtttc

SEQ ID NO: 28522 - DNA, 21 bp, Artificial sequence
  SiRNA target sequence
ataggcgccgtagctgtttct

SEQ ID NO: 28523 - DNA, 21 bp, Artificial sequence
  SiRNA target sequence
taggcgccgtagctgtttctg

SEQ ID NO: 28524 - DNA, 21 bp, Artificial sequence
  SiRNA target sequence
aggcgccgtagctgtttctgc

SEQ ID NO: 28525 - DNA, 21 bp, Artificial sequence
  SiRNA target sequence
ggcgccgtagctgtttctgct

SEQ ID NO: 28526 - DNA, 21 bp, Artificial sequence
  SiRNA target sequence
gcgccgtagctgtttctgctg

SEQ ID NO: 28527 - DNA, 21 bp, Artificial sequence
  SiRNA target sequence
cgccgtagctgtttctgctgc

SEQ ID NO: 28528 - DNA, 21 bp, Artificial sequence
  SiRNA target sequence
gccgtagctgtttctgctgcg

SEQ ID NO: 28529 - DNA, 21 bp, Artificial sequence
  SiRNA target sequence
ccgtagctgtttctgctgcgg

SEQ ID NO: 28530 - DNA, 21 bp, Artificial sequence
  SiRNA target sequence
cgtagctgtttctgctgcggt

SEQ ID NO: 28531 - DNA, 21 bp, Artificial sequence
  SiRNA target sequence
gtagctgtttctgctgcggta

SEQ ID NO: 28532 - DNA, 21 bp, Artificial sequence
  SiRNA target sequence
tagctgtttctgctgcggtac

SEQ ID NO: 28533 - DNA, 21 bp, Artificial sequence
  SiRNA target sequence
agctgtttctgctgcggtact

SEQ ID NO: 28534 - DNA, 21 bp, Artificial sequence
  SiRNA target sequence
gctgtttctgctgcggtactc

SEQ ID NO: 28535 - DNA, 21 bp, Artificial sequence
  SiRNA target sequence
ctgtttctgctgcggtactca

SEQ ID NO: 28536 - DNA, 21 bp, Artificial sequence
  SiRNA target sequence
tgtttctgctgcggtactcag

SEQ ID NO: 28537 - DNA, 21 bp, Artificial sequence
  SiRNA target sequence
gtttctgctgcggtactcagc

SEQ ID NO: 28538 - DNA, 21 bp, Artificial sequence
  SiRNA target sequence
tttctgctgcggtactcagct

SEQ ID NO: 28539 - DNA, 21 bp, Artificial sequence
  SiRNA target sequence
ttctgctgcggtactcagctc

SEQ ID NO: 28540 - DNA, 21 bp, Artificial sequence
  SiRNA target sequence
tctgctgcggtactcagctca

SEQ ID NO: 28541 - DNA, 21 bp, Artificial sequence
  SiRNA target sequence
ctgctgcggtactcagctcag

SEQ ID NO: 28542 - DNA, 21 bp, Artificial sequence
  SiRNA target sequence
tgctgcggtactcagctcagc

SEQ ID NO: 28543 - DNA, 21 bp, Artificial sequence
  SiRNA target sequence
gctgcggtactcagctcagct

SEQ ID NO: 28544 - DNA, 21 bp, Artificial sequence
  SiRNA target sequence
ctgcggtactcagctcagctc

SEQ ID NO: 28545 - DNA, 21 bp, Artificial sequence
  SiRNA target sequence
tgcggtactcagctcagctcg

SEQ ID NO: 28546 - DNA, 21 bp, Artificial sequence
  SiRNA target sequence
gcggtactcagctcagctcga

SEQ ID NO: 28547 - DNA, 21 bp, Artificial sequence
  SiRNA target sequence
cggtactcagctcagctcgac

SEQ ID NO: 28548 - DNA, 21 bp, Artificial sequence
  SiRNA target sequence
ggtactcagctcagctcgacg

SEQ ID NO: 28549 - DNA, 21 bp, Artificial sequence
  SiRNA target sequence
gtactcagctcagctcgacgc

SEQ ID NO: 28550 - DNA, 21 bp, Artificial sequence
  SiRNA target sequence
tactcagctcagctcgacgct

SEQ ID NO: 28551 - DNA, 21 bp, Artificial sequence
  SiRNA target sequence
actcagctcagctcgacgctc

SEQ ID NO: 28552 - DNA, 21 bp, Artificial sequence
  SiRNA target sequence
ctcagctcagctcgacgctca

SEQ ID NO: 28553 - DNA, 21 bp, Artificial sequence
  SiRNA target sequence
tcagctcagctcgacgctcag

SEQ ID NO: 28554 - DNA, 21 bp, Artificial sequence
  SiRNA target sequence
cagctcagctcgacgctcaga

SEQ ID NO: 28555 - DNA, 21 bp, Artificial sequence
  SiRNA target sequence
agctcagctcgacgctcagag

SEQ ID NO: 28556 - DNA, 21 bp, Artificial sequence
  SiRNA target sequence
gctcagctcgacgctcagaga

SEQ ID NO: 28557 - DNA, 21 bp, Artificial sequence
  SiRNA target sequence
ctcagctcgacgctcagagaa

SEQ ID NO: 28558 - DNA, 21 bp, Artificial sequence
  SiRNA target sequence
tcagctcgacgctcagagaag

SEQ ID NO: 28559 - DNA, 21 bp, Artificial sequence
  SiRNA target sequence
cagctcgacgctcagagaagt

SEQ ID NO: 28560 - DNA, 21 bp, Artificial sequence
  SiRNA target sequence
agctcgacgctcagagaagtt

SEQ ID NO: 28561 - DNA, 21 bp, Artificial sequence
  SiRNA target sequence
gctcgacgctcagagaagttt

SEQ ID NO: 28562 - DNA, 21 bp, Artificial sequence
  SiRNA target sequence
ctcgacgctcagagaagtttg

SEQ ID NO: 28563 - DNA, 21 bp, Artificial sequence
  SiRNA target sequence
tcgacgctcagagaagtttgc

SEQ ID NO: 28564 - DNA, 21 bp, Artificial sequence
  SiRNA target sequence
cgacgctcagagaagtttgct

SEQ ID NO: 28565 - DNA, 21 bp, Artificial sequence
  SiRNA target sequence
gacgctcagagaagtttgctt

SEQ ID NO: 28566 - DNA, 21 bp, Artificial sequence
  SiRNA target sequence
acgctcagagaagtttgctta

SEQ ID NO: 28567 - DNA, 21 bp, Artificial sequence
  SiRNA target sequence
cgctcagagaagtttgcttat

SEQ ID NO: 28568 - DNA, 21 bp, Artificial sequence
  SiRNA target sequence
gctcagagaagtttgcttata

SEQ ID NO: 28569 - DNA, 21 bp, Artificial sequence
  SiRNA target sequence
ctcagagaagtttgcttatat

SEQ ID NO: 28570 - DNA, 21 bp, Artificial sequence
  SiRNA target sequence
tcagagaagtttgcttatatg

SEQ ID NO: 28571 - DNA, 21 bp, Artificial sequence
  SiRNA target sequence
cagagaagtttgcttatatga

SEQ ID NO: 28572 - DNA, 21 bp, Artificial sequence
  SiRNA target sequence
agagaagtttgcttatatgat

SEQ ID NO: 28573 - DNA, 21 bp, Artificial sequence
  SiRNA target sequence
gagaagtttgcttatatgatc

SEQ ID NO: 28574 - DNA, 21 bp, Artificial sequence
  SiRNA target sequence
agaagtttgcttatatgatcg

SEQ ID NO: 28575 - DNA, 21 bp, Artificial sequence
  SiRNA target sequence
gaagtttgcttatatgatcgg

SEQ ID NO: 28576 - DNA, 21 bp, Artificial sequence
  SiRNA target sequence
aagtttgcttatatgatcggg

SEQ ID NO: 28577 - DNA, 21 bp, Artificial sequence
  SiRNA target sequence
agtttgcttatatgatcgggg

SEQ ID NO: 28578 - DNA, 21 bp, Artificial sequence
  SiRNA target sequence
gtttgcttatatgatcggggc

SEQ ID NO: 28579 - DNA, 21 bp, Artificial sequence
  SiRNA target sequence
tttgcttatatgatcggggca

SEQ ID NO: 28580 - DNA, 21 bp, Artificial sequence
  SiRNA target sequence
ttgcttatatgatcggggcaa

SEQ ID NO: 28581 - DNA, 21 bp, Artificial sequence
  SiRNA target sequence
tgcttatatgatcggggcaat

SEQ ID NO: 28582 - DNA, 21 bp, Artificial sequence
  SiRNA target sequence
gcttatatgatcggggcaatc

SEQ ID NO: 28583 - DNA, 21 bp, Artificial sequence
  SiRNA target sequence
cttatatgatcggggcaatcc

SEQ ID NO: 28584 - DNA, 21 bp, Artificial sequence
  SiRNA target sequence
ttatatgatcggggcaatcct

SEQ ID NO: 28585 - DNA, 21 bp, Artificial sequence
  SiRNA target sequence
tatatgatcggggcaatcctg

SEQ ID NO: 28586 - DNA, 21 bp, Artificial sequence
  SiRNA target sequence
atatgatcggggcaatcctgg

SEQ ID NO: 28587 - DNA, 21 bp, Artificial sequence
  SiRNA target sequence
tatgatcggggcaatcctggt

SEQ ID NO: 28588 - DNA, 21 bp, Artificial sequence
  SiRNA target sequence
atgatcggggcaatcctggtc

SEQ ID NO: 28589 - DNA, 21 bp, Artificial sequence
  SiRNA target sequence
tgatcggggcaatcctggtcg

SEQ ID NO: 28590 - DNA, 21 bp, Artificial sequence
  SiRNA target sequence
gatcggggcaatcctggtcgt

SEQ ID NO: 28591 - DNA, 21 bp, Artificial sequence
  SiRNA target sequence
atcggggcaatcctggtcgta

SEQ ID NO: 28592 - DNA, 21 bp, Artificial sequence
  SiRNA target sequence
tcggggcaatcctggtcgtat

SEQ ID NO: 28593 - DNA, 21 bp, Artificial sequence
  SiRNA target sequence
cggggcaatcctggtcgtata

SEQ ID NO: 28594 - DNA, 21 bp, Artificial sequence
  SiRNA target sequence
ggggcaatcctggtcgtatat

SEQ ID NO: 28595 - DNA, 21 bp, Artificial sequence
  SiRNA target sequence
gggcaatcctggtcgtatatg

SEQ ID NO: 28596 - DNA, 21 bp, Artificial sequence
  SiRNA target sequence
ggcaatcctggtcgtatatgt

SEQ ID NO: 28597 - DNA, 21 bp, Artificial sequence
  SiRNA target sequence
gcaatcctggtcgtatatgtg

SEQ ID NO: 28598 - DNA, 21 bp, Artificial sequence
  SiRNA target sequence
caatcctggtcgtatatgtgt

SEQ ID NO: 28599 - DNA, 21 bp, Artificial sequence
  SiRNA target sequence
aatcctggtcgtatatgtgtt

SEQ ID NO: 28600 - DNA, 21 bp, Artificial sequence
  SiRNA target sequence
atcctggtcgtatatgtgttg

SEQ ID NO: 28601 - DNA, 21 bp, Artificial sequence
  SiRNA target sequence
tcctggtcgtatatgtgttgc

SEQ ID NO: 28602 - DNA, 21 bp, Artificial sequence
  SiRNA target sequence
cctggtcgtatatgtgttgcc

SEQ ID NO: 28603 - DNA, 21 bp, Artificial sequence
  SiRNA target sequence
ctggtcgtatatgtgttgcct

SEQ ID NO: 28604 - DNA, 21 bp, Artificial sequence
  SiRNA target sequence
tggtcgtatatgtgttgcctg

SEQ ID NO: 28605 - DNA, 21 bp, Artificial sequence
  SiRNA target sequence
ggtcgtatatgtgttgcctgc

SEQ ID NO: 28606 - DNA, 21 bp, Artificial sequence
  SiRNA target sequence
gtcgtatatgtgttgcctgca

SEQ ID NO: 28607 - DNA, 21 bp, Artificial sequence
  SiRNA target sequence
tcgtatatgtgttgcctgcaa

SEQ ID NO: 28608 - DNA, 21 bp, Artificial sequence
  SiRNA target sequence
cgtatatgtgttgcctgcaac

SEQ ID NO: 28609 - DNA, 21 bp, Artificial sequence
  SiRNA target sequence
gtatatgtgttgcctgcaaca

SEQ ID NO: 28610 - DNA, 21 bp, Artificial sequence
  SiRNA target sequence
tatatgtgttgcctgcaacag

SEQ ID NO: 28611 - DNA, 21 bp, Artificial sequence
  SiRNA target sequence
atatgtgttgcctgcaacaga

SEQ ID NO: 28612 - DNA, 21 bp, Artificial sequence
  SiRNA target sequence
tatgtgttgcctgcaacagat

SEQ ID NO: 28613 - DNA, 21 bp, Artificial sequence
  SiRNA target sequence
atgtgttgcctgcaacagatg

SEQ ID NO: 28614 - DNA, 21 bp, Artificial sequence
  SiRNA target sequence
tgtgttgcctgcaacagatgc

SEQ ID NO: 28615 - DNA, 21 bp, Artificial sequence
  SiRNA target sequence
gtgttgcctgcaacagatgct

SEQ ID NO: 28616 - DNA, 21 bp, Artificial sequence
  SiRNA target sequence
tgttgcctgcaacagatgctt

SEQ ID NO: 28617 - DNA, 21 bp, Artificial sequence
  SiRNA target sequence
gttgcctgcaacagatgcttg

SEQ ID NO: 28618 - DNA, 21 bp, Artificial sequence
  SiRNA target sequence
ttgcctgcaacagatgcttgg

SEQ ID NO: 28619 - DNA, 21 bp, Artificial sequence
  SiRNA target sequence
tgcctgcaacagatgcttgga

SEQ ID NO: 28620 - DNA, 21 bp, Artificial sequence
  SiRNA target sequence
gcctgcaacagatgcttggac

SEQ ID NO: 28621 - DNA, 21 bp, Artificial sequence
  SiRNA target sequence
cctgcaacagatgcttggaca

SEQ ID NO: 28622 - DNA, 21 bp, Artificial sequence
  SiRNA target sequence
ctgcaacagatgcttggacat

SEQ ID NO: 28623 - DNA, 21 bp, Artificial sequence
  SiRNA target sequence
tgcaacagatgcttggacata

SEQ ID NO: 28624 - DNA, 21 bp, Artificial sequence
  SiRNA target sequence
gcaacagatgcttggacatat

SEQ ID NO: 28625 - DNA, 21 bp, Artificial sequence
  SiRNA target sequence
caacagatgcttggacatatg

SEQ ID NO: 28626 - DNA, 21 bp, Artificial sequence
  SiRNA target sequence
aacagatgcttggacatatgg

SEQ ID NO: 28627 - DNA, 21 bp, Artificial sequence
  SiRNA target sequence
acagatgcttggacatatggc

SEQ ID NO: 28628 - DNA, 21 bp, Artificial sequence
  SiRNA target sequence
cagatgcttggacatatggcg

SEQ ID NO: 28629 - DNA, 21 bp, Artificial sequence
  SiRNA target sequence
agatgcttggacatatggcgc

SEQ ID NO: 28630 - DNA, 21 bp, Artificial sequence
  SiRNA target sequence
gatgcttggacatatggcgct

SEQ ID NO: 28631 - DNA, 21 bp, Artificial sequence
  SiRNA target sequence
atgcttggacatatggcgctt

SEQ ID NO: 28632 - DNA, 21 bp, Artificial sequence
  SiRNA target sequence
tgcttggacatatggcgcttg

SEQ ID NO: 28633 - DNA, 21 bp, Artificial sequence
  SiRNA target sequence
gcttggacatatggcgcttgg

SEQ ID NO: 28634 - DNA, 21 bp, Artificial sequence
  SiRNA target sequence
cttggacatatggcgcttggg

SEQ ID NO: 28635 - DNA, 21 bp, Artificial sequence
  SiRNA target sequence
ttggacatatggcgcttgggc

SEQ ID NO: 28636 - DNA, 21 bp, Artificial sequence
  SiRNA target sequence
tggacatatggcgcttgggcc

SEQ ID NO: 28637 - DNA, 21 bp, Artificial sequence
  SiRNA target sequence
ggacatatggcgcttgggccg

SEQ ID NO: 28638 - DNA, 21 bp, Artificial sequence
  SiRNA target sequence
gacatatggcgcttgggccgc

SEQ ID NO: 28639 - DNA, 21 bp, Artificial sequence
  SiRNA target sequence
acatatggcgcttgggccgcc

SEQ ID NO: 28640 - DNA, 21 bp, Artificial sequence
  SiRNA target sequence
catatggcgcttgggccgccg

SEQ ID NO: 28641 - DNA, 21 bp, Artificial sequence
  SiRNA target sequence
atatggcgcttgggccgccgc

SEQ ID NO: 28642 - DNA, 21 bp, Artificial sequence
  SiRNA target sequence
tatggcgcttgggccgccgcc

SEQ ID NO: 28643 - DNA, 21 bp, Artificial sequence
  SiRNA target sequence
atggcgcttgggccgccgccc

SEQ ID NO: 28644 - DNA, 21 bp, Artificial sequence
  SiRNA target sequence
tggcgcttgggccgccgccct

SEQ ID NO: 28645 - DNA, 21 bp, Artificial sequence
  SiRNA target sequence
ggcgcttgggccgccgccctg

SEQ ID NO: 28646 - DNA, 21 bp, Artificial sequence
  SiRNA target sequence
gcgcttgggccgccgccctgg

SEQ ID NO: 28647 - DNA, 21 bp, Artificial sequence
  SiRNA target sequence
cgcttgggccgccgccctggc

SEQ ID NO: 28648 - DNA, 21 bp, Artificial sequence
  SiRNA target sequence
gcttgggccgccgccctggcg

SEQ ID NO: 28649 - DNA, 21 bp, Artificial sequence
  SiRNA target sequence
cttgggccgccgccctggcgt

SEQ ID NO: 28650 - DNA, 21 bp, Artificial sequence
  SiRNA target sequence
ttgggccgccgccctggcgtt

SEQ ID NO: 28651 - DNA, 21 bp, Artificial sequence
  SiRNA target sequence
tgggccgccgccctggcgtta

SEQ ID NO: 28652 - DNA, 21 bp, Artificial sequence
  SiRNA target sequence
gggccgccgccctggcgttat

SEQ ID NO: 28653 - DNA, 21 bp, Artificial sequence
  SiRNA target sequence
ggccgccgccctggcgttatt

SEQ ID NO: 28654 - DNA, 21 bp, Artificial sequence
  SiRNA target sequence
gccgccgccctggcgttattt

SEQ ID NO: 28655 - DNA, 21 bp, Artificial sequence
  SiRNA target sequence
ccgccgccctggcgttatttc

SEQ ID NO: 28656 - DNA, 21 bp, Artificial sequence
  SiRNA target sequence
cgccgccctggcgttatttct

SEQ ID NO: 28657 - DNA, 21 bp, Artificial sequence
  SiRNA target sequence
gccgccctggcgttatttctc

SEQ ID NO: 28658 - DNA, 21 bp, Artificial sequence
  SiRNA target sequence
ccgccctggcgttatttctcc

SEQ ID NO: 28659 - DNA, 21 bp, Artificial sequence
  SiRNA target sequence
cgccctggcgttatttctcca

SEQ ID NO: 28660 - DNA, 21 bp, Artificial sequence
  SiRNA target sequence
gccctggcgttatttctccaa

SEQ ID NO: 28661 - DNA, 21 bp, Artificial sequence
  SiRNA target sequence
ccctggcgttatttctccaac

SEQ ID NO: 28662 - DNA, 21 bp, Artificial sequence
  SiRNA target sequence
cctggcgttatttctccaact

SEQ ID NO: 28663 - DNA, 21 bp, Artificial sequence
  SiRNA target sequence
ctggcgttatttctccaactc

SEQ ID NO: 28664 - DNA, 21 bp, Artificial sequence
  SiRNA target sequence
tggcgttatttctccaactcc

SEQ ID NO: 28665 - DNA, 21 bp, Artificial sequence
  SiRNA target sequence
ggcgttatttctccaactccg

SEQ ID NO: 28666 - DNA, 21 bp, Artificial sequence
  SiRNA target sequence
gcgttatttctccaactccga

SEQ ID NO: 28667 - DNA, 21 bp, Artificial sequence
  SiRNA target sequence
cgttatttctccaactccgaa

SEQ ID NO: 28668 - DNA, 21 bp, Artificial sequence
  SiRNA target sequence
gttatttctccaactccgaac

SEQ ID NO: 28669 - DNA, 21 bp, Artificial sequence
  SiRNA target sequence
ttatttctccaactccgaacc

SEQ ID NO: 28670 - DNA, 21 bp, Artificial sequence
  SiRNA target sequence
tatttctccaactccgaacca

SEQ ID NO: 28671 - DNA, 21 bp, Artificial sequence
  SiRNA target sequence
atttctccaactccgaaccat

SEQ ID NO: 28672 - DNA, 21 bp, Artificial sequence
  SiRNA target sequence
tttctccaactccgaaccatc

SEQ ID NO: 28673 - DNA, 21 bp, Artificial sequence
  SiRNA target sequence
ttctccaactccgaaccatcg

SEQ ID NO: 28674 - DNA, 21 bp, Artificial sequence
  SiRNA target sequence
tctccaactccgaaccatcga

SEQ ID NO: 28675 - DNA, 21 bp, Artificial sequence
  SiRNA target sequence
ctccaactccgaaccatcgag

SEQ ID NO: 28676 - DNA, 21 bp, Artificial sequence
  SiRNA target sequence
tccaactccgaaccatcgagg

SEQ ID NO: 28677 - DNA, 21 bp, Artificial sequence
  SiRNA target sequence
ccaactccgaaccatcgagga

SEQ ID NO: 28678 - DNA, 21 bp, Artificial sequence
  SiRNA target sequence
caactccgaaccatcgaggat

SEQ ID NO: 28679 - DNA, 21 bp, Artificial sequence
  SiRNA target sequence
aactccgaaccatcgaggatc

SEQ ID NO: 28680 - DNA, 21 bp, Artificial sequence
  SiRNA target sequence
actccgaaccatcgaggatcg

SEQ ID NO: 28681 - DNA, 21 bp, Artificial sequence
  SiRNA target sequence
ctccgaaccatcgaggatcgc

SEQ ID NO: 28682 - DNA, 21 bp, Artificial sequence
  SiRNA target sequence
tccgaaccatcgaggatcgca

SEQ ID NO: 28683 - DNA, 21 bp, Artificial sequence
  SiRNA target sequence
ccgaaccatcgaggatcgcat

SEQ ID NO: 28684 - DNA, 21 bp, Artificial sequence
  SiRNA target sequence
cgaaccatcgaggatcgcatt

SEQ ID NO: 28685 - DNA, 21 bp, Artificial sequence
  SiRNA target sequence
gaaccatcgaggatcgcattc

SEQ ID NO: 28686 - DNA, 21 bp, Artificial sequence
  SiRNA target sequence
aaccatcgaggatcgcattct

SEQ ID NO: 28687 - DNA, 21 bp, Artificial sequence
  SiRNA target sequence
accatcgaggatcgcattctc

SEQ ID NO: 28688 - DNA, 21 bp, Artificial sequence
  SiRNA target sequence
ccatcgaggatcgcattctcc

SEQ ID NO: 28689 - DNA, 21 bp, Artificial sequence
  SiRNA target sequence
catcgaggatcgcattctcct

SEQ ID NO: 28690 - DNA, 21 bp, Artificial sequence
  SiRNA target sequence
atcgaggatcgcattctcctc

SEQ ID NO: 28691 - DNA, 21 bp, Artificial sequence
  SiRNA target sequence
tcgaggatcgcattctcctca

SEQ ID NO: 28692 - DNA, 21 bp, Artificial sequence
  SiRNA target sequence
cgaggatcgcattctcctcag

SEQ ID NO: 28693 - DNA, 21 bp, Artificial sequence
  SiRNA target sequence
gaggatcgcattctcctcagc

SEQ ID NO: 28694 - DNA, 21 bp, Artificial sequence
  SiRNA target sequence
aggatcgcattctcctcagcg

SEQ ID NO: 28695 - DNA, 21 bp, Artificial sequence
  SiRNA target sequence
ggatcgcattctcctcagcgt

SEQ ID NO: 28696 - DNA, 21 bp, Artificial sequence
  SiRNA target sequence
gatcgcattctcctcagcgtc

SEQ ID NO: 28697 - DNA, 21 bp, Artificial sequence
  SiRNA target sequence
atcgcattctcctcagcgtct

SEQ ID NO: 28698 - DNA, 21 bp, Artificial sequence
  SiRNA target sequence
tcgcattctcctcagcgtctt

SEQ ID NO: 28699 - DNA, 21 bp, Artificial sequence
  SiRNA target sequence
cgcattctcctcagcgtcttt

SEQ ID NO: 28700 - DNA, 21 bp, Artificial sequence
  SiRNA target sequence
gcattctcctcagcgtctttg

SEQ ID NO: 28701 - DNA, 21 bp, Artificial sequence
  SiRNA target sequence
cattctcctcagcgtctttgc

SEQ ID NO: 28702 - DNA, 21 bp, Artificial sequence
  SiRNA target sequence
attctcctcagcgtctttgct

SEQ ID NO: 28703 - DNA, 21 bp, Artificial sequence
  SiRNA target sequence
ttctcctcagcgtctttgctc

SEQ ID NO: 28704 - DNA, 21 bp, Artificial sequence
  SiRNA target sequence
tctcctcagcgtctttgctct

SEQ ID NO: 28705 - DNA, 21 bp, Artificial sequence
  SiRNA target sequence
ctcctcagcgtctttgctctc

SEQ ID NO: 28706 - DNA, 21 bp, Artificial sequence
  SiRNA target sequence
tcctcagcgtctttgctctcg

SEQ ID NO: 28707 - DNA, 21 bp, Artificial sequence
  SiRNA target sequence
cctcagcgtctttgctctcgg

SEQ ID NO: 28708 - DNA, 21 bp, Artificial sequence
  SiRNA target sequence
ctcagcgtctttgctctcggc

SEQ ID NO: 28709 - DNA, 21 bp, Artificial sequence
  SiRNA target sequence
tcagcgtctttgctctcggcg

SEQ ID NO: 28710 - DNA, 21 bp, Artificial sequence
  SiRNA target sequence
cagcgtctttgctctcggcgt

SEQ ID NO: 28711 - DNA, 21 bp, Artificial sequence
  SiRNA target sequence
agcgtctttgctctcggcgtt

SEQ ID NO: 28712 - DNA, 21 bp, Artificial sequence
  SiRNA target sequence
gcgtctttgctctcggcgttt

SEQ ID NO: 28713 - DNA, 21 bp, Artificial sequence
  SiRNA target sequence
cgtctttgctctcggcgttta

SEQ ID NO: 28714 - DNA, 21 bp, Artificial sequence
  SiRNA target sequence
gtctttgctctcggcgtttat

SEQ ID NO: 28715 - DNA, 21 bp, Artificial sequence
  SiRNA target sequence
tctttgctctcggcgtttatg

SEQ ID NO: 28716 - DNA, 21 bp, Artificial sequence
  SiRNA target sequence
ctttgctctcggcgtttatgt

SEQ ID NO: 28717 - DNA, 21 bp, Artificial sequence
  SiRNA target sequence
tttgctctcggcgtttatgtc

SEQ ID NO: 28718 - DNA, 21 bp, Artificial sequence
  SiRNA target sequence
ttgctctcggcgtttatgtct

SEQ ID NO: 28719 - DNA, 21 bp, Artificial sequence
  SiRNA target sequence
tgctctcggcgtttatgtctg

SEQ ID NO: 28720 - DNA, 21 bp, Artificial sequence
  SiRNA target sequence
gctctcggcgtttatgtctgg

SEQ ID NO: 28721 - DNA, 21 bp, Artificial sequence
  SiRNA target sequence
ctctcggcgtttatgtctgga

SEQ ID NO: 28722 - DNA, 21 bp, Artificial sequence
  SiRNA target sequence
tctcggcgtttatgtctggac

SEQ ID NO: 28723 - DNA, 21 bp, Artificial sequence
  SiRNA target sequence
ctcggcgtttatgtctggact

SEQ ID NO: 28724 - DNA, 21 bp, Artificial sequence
  SiRNA target sequence
tcggcgtttatgtctggactc

SEQ ID NO: 28725 - DNA, 21 bp, Artificial sequence
  SiRNA target sequence
cggcgtttatgtctggactct

SEQ ID NO: 28726 - DNA, 21 bp, Artificial sequence
  SiRNA target sequence
ggcgtttatgtctggactctc

SEQ ID NO: 28727 - DNA, 21 bp, Artificial sequence
  SiRNA target sequence
gcgtttatgtctggactctcc

SEQ ID NO: 28728 - DNA, 21 bp, Artificial sequence
  SiRNA target sequence
cgtttatgtctggactctcca

SEQ ID NO: 28729 - DNA, 21 bp, Artificial sequence
  SiRNA target sequence
gtttatgtctggactctccag

SEQ ID NO: 28730 - DNA, 21 bp, Artificial sequence
  SiRNA target sequence
tttatgtctggactctccaga

SEQ ID NO: 28731 - DNA, 21 bp, Artificial sequence
  SiRNA target sequence
ttatgtctggactctccagac

SEQ ID NO: 28732 - DNA, 21 bp, Artificial sequence
  SiRNA target sequence
tatgtctggactctccagact

SEQ ID NO: 28733 - DNA, 21 bp, Artificial sequence
  SiRNA target sequence
atgtctggactctccagactc

SEQ ID NO: 28734 - DNA, 21 bp, Artificial sequence
  SiRNA target sequence
tgtctggactctccagactca

SEQ ID NO: 28735 - DNA, 21 bp, Artificial sequence
  SiRNA target sequence
gtctggactctccagactcaa

SEQ ID NO: 28736 - DNA, 21 bp, Artificial sequence
  SiRNA target sequence
tctggactctccagactcaac

SEQ ID NO: 28737 - DNA, 21 bp, Artificial sequence
  SiRNA target sequence
ctggactctccagactcaaca

SEQ ID NO: 28738 - DNA, 21 bp, Artificial sequence
  SiRNA target sequence
tggactctccagactcaacag

SEQ ID NO: 28739 - DNA, 21 bp, Artificial sequence
  SiRNA target sequence
ggactctccagactcaacaga

SEQ ID NO: 28740 - DNA, 21 bp, Artificial sequence
  SiRNA target sequence
gactctccagactcaacagac

SEQ ID NO: 28741 - DNA, 21 bp, Artificial sequence
  SiRNA target sequence
actctccagactcaacagaca

SEQ ID NO: 28742 - DNA, 21 bp, Artificial sequence
  SiRNA target sequence
ctctccagactcaacagacag

SEQ ID NO: 28743 - DNA, 21 bp, Artificial sequence
  SiRNA target sequence
tctccagactcaacagacagc

SEQ ID NO: 28744 - DNA, 21 bp, Artificial sequence
  SiRNA target sequence
ctccagactcaacagacagct

SEQ ID NO: 28745 - DNA, 21 bp, Artificial sequence
  SiRNA target sequence
tccagactcaacagacagctc

SEQ ID NO: 28746 - DNA, 21 bp, Artificial sequence
  SiRNA target sequence
ccagactcaacagacagctcc

SEQ ID NO: 28747 - DNA, 21 bp, Artificial sequence
  SiRNA target sequence
cagactcaacagacagctcct

SEQ ID NO: 28748 - DNA, 21 bp, Artificial sequence
  SiRNA target sequence
agactcaacagacagctcctc

SEQ ID NO: 28749 - DNA, 21 bp, Artificial sequence
  SiRNA target sequence
gactcaacagacagctcctcc

SEQ ID NO: 28750 - DNA, 21 bp, Artificial sequence
  SiRNA target sequence
actcaacagacagctcctcca

SEQ ID NO: 28751 - DNA, 21 bp, Artificial sequence
  SiRNA target sequence
ctcaacagacagctcctccag

SEQ ID NO: 28752 - DNA, 21 bp, Artificial sequence
  SiRNA target sequence
tcaacagacagctcctccagc

SEQ ID NO: 28753 - DNA, 21 bp, Artificial sequence
  SiRNA target sequence
caacagacagctcctccagca

SEQ ID NO: 28754 - DNA, 21 bp, Artificial sequence
  SiRNA target sequence
aacagacagctcctccagcac

SEQ ID NO: 28755 - DNA, 21 bp, Artificial sequence
  SiRNA target sequence
acagacagctcctccagcaca

SEQ ID NO: 28756 - DNA, 21 bp, Artificial sequence
  SiRNA target sequence
cagacagctcctccagcacag

SEQ ID NO: 28757 - DNA, 21 bp, Artificial sequence
  SiRNA target sequence
agacagctcctccagcacagt

SEQ ID NO: 28758 - DNA, 21 bp, Artificial sequence
  SiRNA target sequence
gacagctcctccagcacagta

SEQ ID NO: 28759 - DNA, 21 bp, Artificial sequence
  SiRNA target sequence
acagctcctccagcacagtaa

SEQ ID NO: 28760 - DNA, 21 bp, Artificial sequence
  SiRNA target sequence
cagctcctccagcacagtaag

SEQ ID NO: 28761 - DNA, 21 bp, Artificial sequence
  SiRNA target sequence
agctcctccagcacagtaagc

SEQ ID NO: 28762 - DNA, 21 bp, Artificial sequence
  SiRNA target sequence
gctcctccagcacagtaagca

SEQ ID NO: 28763 - DNA, 21 bp, Artificial sequence
  SiRNA target sequence
ctcctccagcacagtaagcag

SEQ ID NO: 28764 - DNA, 21 bp, Artificial sequence
  SiRNA target sequence
tcctccagcacagtaagcagc

SEQ ID NO: 28765 - DNA, 21 bp, Artificial sequence
  SiRNA target sequence
cctccagcacagtaagcagcc

SEQ ID NO: 28766 - DNA, 21 bp, Artificial sequence
  SiRNA target sequence
ctccagcacagtaagcagccc

SEQ ID NO: 28767 - DNA, 21 bp, Artificial sequence
  SiRNA target sequence
tccagcacagtaagcagcccg

SEQ ID NO: 28768 - DNA, 21 bp, Artificial sequence
  SiRNA target sequence
ccagcacagtaagcagcccgg

SEQ ID NO: 28769 - DNA, 21 bp, Artificial sequence
  SiRNA target sequence
cagcacagtaagcagcccgga

SEQ ID NO: 28770 - DNA, 21 bp, Artificial sequence
  SiRNA target sequence
agcacagtaagcagcccggag

SEQ ID NO: 28771 - DNA, 21 bp, Artificial sequence
  SiRNA target sequence
gcacagtaagcagcccggaga

SEQ ID NO: 28772 - DNA, 21 bp, Artificial sequence
  SiRNA target sequence
cacagtaagcagcccggagaa

SEQ ID NO: 28773 - DNA, 21 bp, Artificial sequence
  SiRNA target sequence
acagtaagcagcccggagaat

SEQ ID NO: 28774 - DNA, 21 bp, Artificial sequence
  SiRNA target sequence
cagtaagcagcccggagaatt

SEQ ID NO: 28775 - DNA, 21 bp, Artificial sequence
  SiRNA target sequence
agtaagcagcccggagaattc

SEQ ID NO: 28776 - DNA, 21 bp, Artificial sequence
  SiRNA target sequence
gtaagcagcccggagaattca

SEQ ID NO: 28777 - DNA, 21 bp, Artificial sequence
  SiRNA target sequence
taagcagcccggagaattcaa

SEQ ID NO: 28778 - DNA, 21 bp, Artificial sequence
  SiRNA target sequence
aagcagcccggagaattcaag

SEQ ID NO: 28779 - DNA, 21 bp, Artificial sequence
  SiRNA target sequence
agcagcccggagaattcaagc

SEQ ID NO: 28780 - DNA, 21 bp, Artificial sequence
  SiRNA target sequence
gcagcccggagaattcaagcg

SEQ ID NO: 28781 - DNA, 21 bp, Artificial sequence
  SiRNA target sequence
cagcccggagaattcaagcgg

SEQ ID NO: 28782 - DNA, 21 bp, Artificial sequence
  SiRNA target sequence
agcccggagaattcaagcggg

SEQ ID NO: 28783 - DNA, 21 bp, Artificial sequence
  SiRNA target sequence
gcccggagaattcaagcggga

SEQ ID NO: 28784 - DNA, 21 bp, Artificial sequence
  SiRNA target sequence
cccggagaattcaagcgggat

SEQ ID NO: 28785 - DNA, 21 bp, Artificial sequence
  SiRNA target sequence
ccggagaattcaagcgggatg

SEQ ID NO: 28786 - DNA, 21 bp, Artificial sequence
  SiRNA target sequence
cggagaattcaagcgggatgt

SEQ ID NO: 28787 - DNA, 21 bp, Artificial sequence
  SiRNA target sequence
ggagaattcaagcgggatgta

SEQ ID NO: 28788 - DNA, 21 bp, Artificial sequence
  SiRNA target sequence
gagaattcaagcgggatgtac

SEQ ID NO: 28789 - DNA, 21 bp, Artificial sequence
  SiRNA target sequence
agaattcaagcgggatgtaca

SEQ ID NO: 28790 - DNA, 21 bp, Artificial sequence
  SiRNA target sequence
gaattcaagcgggatgtacac

SEQ ID NO: 28791 - DNA, 21 bp, Artificial sequence
  SiRNA target sequence
aattcaagcgggatgtacaca

SEQ ID NO: 28792 - DNA, 21 bp, Artificial sequence
  SiRNA target sequence
attcaagcgggatgtacacac

SEQ ID NO: 28793 - DNA, 21 bp, Artificial sequence
  SiRNA target sequence
ttcaagcgggatgtacacacc

SEQ ID NO: 28794 - DNA, 21 bp, Artificial sequence
  SiRNA target sequence
tcaagcgggatgtacacacca

SEQ ID NO: 28795 - DNA, 21 bp, Artificial sequence
  SiRNA target sequence
caagcgggatgtacacaccac

SEQ ID NO: 28796 - DNA, 21 bp, Artificial sequence
  SiRNA target sequence
aagcgggatgtacacaccacc

SEQ ID NO: 28797 - DNA, 21 bp, Artificial sequence
  SiRNA target sequence
agcgggatgtacacaccaccc

SEQ ID NO: 28798 - DNA, 21 bp, Artificial sequence
  SiRNA target sequence
gcgggatgtacacaccacccg

SEQ ID NO: 28799 - DNA, 21 bp, Artificial sequence
  SiRNA target sequence
cgggatgtacacaccacccgc

SEQ ID NO: 28800 - DNA, 21 bp, Artificial sequence
  SiRNA target sequence
gggatgtacacaccacccgcc

SEQ ID NO: 28801 - DNA, 21 bp, Artificial sequence
  SiRNA target sequence
ggatgtacacaccacccgccg

SEQ ID NO: 28802 - DNA, 21 bp, Artificial sequence
  SiRNA target sequence
gatgtacacaccacccgccgg

SEQ ID NO: 28803 - DNA, 21 bp, Artificial sequence
  SiRNA target sequence
atgtacacaccacccgccggg

SEQ ID NO: 28804 - DNA, 21 bp, Artificial sequence
  SiRNA target sequence
tgtacacaccacccgccgggt

SEQ ID NO: 28805 - DNA, 21 bp, Artificial sequence
  SiRNA target sequence
gtacacaccacccgccgggtc

SEQ ID NO: 28806 - DNA, 21 bp, Artificial sequence
  SiRNA target sequence
tacacaccacccgccgggtcc

SEQ ID NO: 28807 - DNA, 21 bp, Artificial sequence
  SiRNA target sequence
acacaccacccgccgggtccg

SEQ ID NO: 28808 - DNA, 21 bp, Artificial sequence
  SiRNA target sequence
cacaccacccgccgggtccga

SEQ ID NO: 28809 - DNA, 21 bp, Artificial sequence
  SiRNA target sequence
acaccacccgccgggtccgat

SEQ ID NO: 28810 - DNA, 21 bp, Artificial sequence
  SiRNA target sequence
caccacccgccgggtccgatt

SEQ ID NO: 28811 - DNA, 21 bp, Artificial sequence
  SiRNA target sequence
accacccgccgggtccgattt

SEQ ID NO: 28812 - DNA, 21 bp, Artificial sequence
  SiRNA target sequence
ccacccgccgggtccgatttt

SEQ ID NO: 28813 - DNA, 21 bp, Artificial sequence
  SiRNA target sequence
cacccgccgggtccgattttc

SEQ ID NO: 28814 - DNA, 21 bp, Artificial sequence
  SiRNA target sequence
acccgccgggtccgattttct

SEQ ID NO: 28815 - DNA, 21 bp, Artificial sequence
  SiRNA target sequence
cccgccgggtccgattttctc

SEQ ID NO: 28816 - DNA, 21 bp, Artificial sequence
  SiRNA target sequence
ccgccgggtccgattttctcg

SEQ ID NO: 28817 - DNA, 21 bp, Artificial sequence
  SiRNA target sequence
cgccgggtccgattttctcgc

SEQ ID NO: 28818 - DNA, 21 bp, Artificial sequence
  SiRNA target sequence
gccgggtccgattttctcgcc

SEQ ID NO: 28819 - DNA, 21 bp, Artificial sequence
  SiRNA target sequence
ccgggtccgattttctcgccc

SEQ ID NO: 28820 - DNA, 21 bp, Artificial sequence
  SiRNA target sequence
cgggtccgattttctcgcccg

SEQ ID NO: 28821 - DNA, 21 bp, Artificial sequence
  SiRNA target sequence
gggtccgattttctcgcccga

SEQ ID NO: 28822 - DNA, 21 bp, Artificial sequence
  SiRNA target sequence
ggtccgattttctcgcccgac

SEQ ID NO: 28823 - DNA, 21 bp, Artificial sequence
  SiRNA target sequence
gtccgattttctcgcccgacg

SEQ ID NO: 28824 - DNA, 21 bp, Artificial sequence
  SiRNA target sequence
tccgattttctcgcccgacgt

SEQ ID NO: 28825 - DNA, 21 bp, Artificial sequence
  SiRNA target sequence
ccgattttctcgcccgacgta

SEQ ID NO: 28826 - DNA, 21 bp, Artificial sequence
  SiRNA target sequence
cgattttctcgcccgacgtat

SEQ ID NO: 28827 - DNA, 21 bp, Artificial sequence
  SiRNA target sequence
gattttctcgcccgacgtatc

SEQ ID NO: 28828 - DNA, 21 bp, Artificial sequence
  SiRNA target sequence
attttctcgcccgacgtatca

SEQ ID NO: 28829 - DNA, 21 bp, Artificial sequence
  SiRNA target sequence
ttttctcgcccgacgtatcaa

SEQ ID NO: 28830 - DNA, 21 bp, Artificial sequence
  SiRNA target sequence
tttctcgcccgacgtatcaag

SEQ ID NO: 28831 - DNA, 21 bp, Artificial sequence
  SiRNA target sequence
ttctcgcccgacgtatcaagg

SEQ ID NO: 28832 - DNA, 21 bp, Artificial sequence
  SiRNA target sequence
tctcgcccgacgtatcaaggc

SEQ ID NO: 28833 - DNA, 21 bp, Artificial sequence
  SiRNA target sequence
ctcgcccgacgtatcaaggcc

SEQ ID NO: 28834 - DNA, 21 bp, Artificial sequence
  SiRNA target sequence
tcgcccgacgtatcaaggcca

SEQ ID NO: 28835 - DNA, 21 bp, Artificial sequence
  SiRNA target sequence
cgcccgacgtatcaaggccat

SEQ ID NO: 28836 - DNA, 21 bp, Artificial sequence
  SiRNA target sequence
gcccgacgtatcaaggccatg

SEQ ID NO: 28837 - DNA, 21 bp, Artificial sequence
  SiRNA target sequence
cccgacgtatcaaggccatgc

SEQ ID NO: 28838 - DNA, 21 bp, Artificial sequence
  SiRNA target sequence
ccgacgtatcaaggccatgct

SEQ ID NO: 28839 - DNA, 21 bp, Artificial sequence
  SiRNA target sequence
cgacgtatcaaggccatgctt

SEQ ID NO: 28840 - DNA, 21 bp, Artificial sequence
  SiRNA target sequence
gacgtatcaaggccatgctta

SEQ ID NO: 28841 - DNA, 21 bp, Artificial sequence
  SiRNA target sequence
acgtatcaaggccatgcttat

SEQ ID NO: 28842 - DNA, 21 bp, Artificial sequence
  SiRNA target sequence
cgtatcaaggccatgcttatt

SEQ ID NO: 28843 - DNA, 21 bp, Artificial sequence
  SiRNA target sequence
gtatcaaggccatgcttattc

SEQ ID NO: 28844 - DNA, 21 bp, Artificial sequence
  SiRNA target sequence
tatcaaggccatgcttattct

SEQ ID NO: 28845 - DNA, 21 bp, Artificial sequence
  SiRNA target sequence
atcaaggccatgcttattcta

SEQ ID NO: 28846 - DNA, 21 bp, Artificial sequence
  SiRNA target sequence
tcaaggccatgcttattctac

SEQ ID NO: 28847 - DNA, 21 bp, Artificial sequence
  SiRNA target sequence
caaggccatgcttattctacc

SEQ ID NO: 28848 - DNA, 21 bp, Artificial sequence
  SiRNA target sequence
aaggccatgcttattctaccc

SEQ ID NO: 28849 - DNA, 21 bp, Artificial sequence
  SiRNA target sequence
aggccatgcttattctacccc

SEQ ID NO: 28850 - DNA, 21 bp, Artificial sequence
  SiRNA target sequence
ggccatgcttattctacccct

SEQ ID NO: 28851 - DNA, 21 bp, Artificial sequence
  SiRNA target sequence
gccatgcttattctacccctc

SEQ ID NO: 28852 - DNA, 21 bp, Artificial sequence
  SiRNA target sequence
ccatgcttattctacccctcg

SEQ ID NO: 28853 - DNA, 21 bp, Artificial sequence
  SiRNA target sequence
catgcttattctacccctcgc

SEQ ID NO: 28854 - DNA, 21 bp, Artificial sequence
  SiRNA target sequence
atgcttattctacccctcgcc

SEQ ID NO: 28855 - DNA, 21 bp, Artificial sequence
  SiRNA target sequence
tgcttattctacccctcgcct

SEQ ID NO: 28856 - DNA, 21 bp, Artificial sequence
  SiRNA target sequence
gcttattctacccctcgcctt

SEQ ID NO: 28857 - DNA, 21 bp, Artificial sequence
  SiRNA target sequence
cttattctacccctcgcctta

SEQ ID NO: 28858 - DNA, 21 bp, Artificial sequence
  SiRNA target sequence
ttattctacccctcgccttat

SEQ ID NO: 28859 - DNA, 21 bp, Artificial sequence
  SiRNA target sequence
tattctacccctcgccttatc

SEQ ID NO: 28860 - DNA, 21 bp, Artificial sequence
  SiRNA target sequence
attctacccctcgccttatcc

SEQ ID NO: 28861 - DNA, 21 bp, Artificial sequence
  SiRNA target sequence
ttctacccctcgccttatcca

SEQ ID NO: 28862 - DNA, 21 bp, Artificial sequence
  SiRNA target sequence
tctacccctcgccttatccat

SEQ ID NO: 28863 - DNA, 21 bp, Artificial sequence
  SiRNA target sequence
ctacccctcgccttatccatc

SEQ ID NO: 28864 - DNA, 21 bp, Artificial sequence
  SiRNA target sequence
tacccctcgccttatccatca

SEQ ID NO: 28865 - DNA, 21 bp, Artificial sequence
  SiRNA target sequence
acccctcgccttatccatcat

SEQ ID NO: 28866 - DNA, 21 bp, Artificial sequence
  SiRNA target sequence
cccctcgccttatccatcata

SEQ ID NO: 28867 - DNA, 21 bp, Artificial sequence
  SiRNA target sequence
ccctcgccttatccatcataa

SEQ ID NO: 28868 - DNA, 21 bp, Artificial sequence
  SiRNA target sequence
cctcgccttatccatcataac

SEQ ID NO: 28869 - DNA, 21 bp, Artificial sequence
  SiRNA target sequence
ctcgccttatccatcataaca

SEQ ID NO: 28870 - DNA, 21 bp, Artificial sequence
  SiRNA target sequence
tcgccttatccatcataacat

SEQ ID NO: 28871 - DNA, 21 bp, Artificial sequence
  SiRNA target sequence
cgccttatccatcataacatc

SEQ ID NO: 28872 - DNA, 21 bp, Artificial sequence
  SiRNA target sequence
gccttatccatcataacatcc

SEQ ID NO: 28873 - DNA, 21 bp, Artificial sequence
  SiRNA target sequence
ccttatccatcataacatcca

SEQ ID NO: 28874 - DNA, 21 bp, Artificial sequence
  SiRNA target sequence
cttatccatcataacatccat

SEQ ID NO: 28875 - DNA, 21 bp, Artificial sequence
  SiRNA target sequence
ttatccatcataacatccatt

SEQ ID NO: 28876 - DNA, 21 bp, Artificial sequence
  SiRNA target sequence
tatccatcataacatccattc

SEQ ID NO: 28877 - DNA, 21 bp, Artificial sequence
  SiRNA target sequence
atccatcataacatccattct

SEQ ID NO: 28878 - DNA, 21 bp, Artificial sequence
  SiRNA target sequence
tccatcataacatccattctg

SEQ ID NO: 28879 - DNA, 21 bp, Artificial sequence
  SiRNA target sequence
ccatcataacatccattctgc

SEQ ID NO: 28880 - DNA, 21 bp, Artificial sequence
  SiRNA target sequence
catcataacatccattctgcc

SEQ ID NO: 28881 - DNA, 21 bp, Artificial sequence
  SiRNA target sequence
atcataacatccattctgcct

SEQ ID NO: 28882 - DNA, 21 bp, Artificial sequence
  SiRNA target sequence
tcataacatccattctgcctc

SEQ ID NO: 28883 - DNA, 21 bp, Artificial sequence
  SiRNA target sequence
cataacatccattctgcctcc

SEQ ID NO: 28884 - DNA, 21 bp, Artificial sequence
  SiRNA target sequence
ataacatccattctgcctccc

SEQ ID NO: 28885 - DNA, 21 bp, Artificial sequence
  SiRNA target sequence
taacatccattctgcctcccg

SEQ ID NO: 28886 - DNA, 21 bp, Artificial sequence
  SiRNA target sequence
aacatccattctgcctcccgc

SEQ ID NO: 28887 - DNA, 21 bp, Artificial sequence
  SiRNA target sequence
acatccattctgcctcccgcc

SEQ ID NO: 28888 - DNA, 21 bp, Artificial sequence
  SiRNA target sequence
catccattctgcctcccgcct

SEQ ID NO: 28889 - DNA, 21 bp, Artificial sequence
  SiRNA target sequence
atccattctgcctcccgcctc

SEQ ID NO: 28890 - DNA, 21 bp, Artificial sequence
  SiRNA target sequence
tccattctgcctcccgcctcc

SEQ ID NO: 28891 - DNA, 21 bp, Artificial sequence
  SiRNA target sequence
ccattctgcctcccgcctccg

SEQ ID NO: 28892 - DNA, 21 bp, Artificial sequence
  SiRNA target sequence
cattctgcctcccgcctccgc

SEQ ID NO: 28893 - DNA, 21 bp, Artificial sequence
  SiRNA target sequence
attctgcctcccgcctccgcc

SEQ ID NO: 28894 - DNA, 21 bp, Artificial sequence
  SiRNA target sequence
ttctgcctcccgcctccgccg

SEQ ID NO: 28895 - DNA, 21 bp, Artificial sequence
  SiRNA target sequence
tctgcctcccgcctccgccgc

SEQ ID NO: 28896 - DNA, 21 bp, Artificial sequence
  SiRNA target sequence
ctgcctcccgcctccgccgcg

SEQ ID NO: 28897 - DNA, 21 bp, Artificial sequence
  SiRNA target sequence
tgcctcccgcctccgccgcgc

SEQ ID NO: 28898 - DNA, 21 bp, Artificial sequence
  SiRNA target sequence
gcctcccgcctccgccgcgcc

SEQ ID NO: 28899 - DNA, 21 bp, Artificial sequence
  SiRNA target sequence
cctcccgcctccgccgcgccc

SEQ ID NO: 28900 - DNA, 21 bp, Artificial sequence
  SiRNA target sequence
ctcccgcctccgccgcgccca

SEQ ID NO: 28901 - DNA, 21 bp, Artificial sequence
  SiRNA target sequence
tcccgcctccgccgcgcccaa

SEQ ID NO: 28902 - DNA, 21 bp, Artificial sequence
  SiRNA target sequence
cccgcctccgccgcgcccaaa

SEQ ID NO: 28903 - DNA, 21 bp, Artificial sequence
  SiRNA target sequence
ccgcctccgccgcgcccaaac

SEQ ID NO: 28904 - DNA, 21 bp, Artificial sequence
  SiRNA target sequence
cgcctccgccgcgcccaaaca

SEQ ID NO: 28905 - DNA, 21 bp, Artificial sequence
  SiRNA target sequence
gcctccgccgcgcccaaacaa

SEQ ID NO: 28906 - DNA, 21 bp, Artificial sequence
  SiRNA target sequence
cctccgccgcgcccaaacaaa

SEQ ID NO: 28907 - DNA, 21 bp, Artificial sequence
  SiRNA target sequence
ctccgccgcgcccaaacaaat

SEQ ID NO: 28908 - DNA, 21 bp, Artificial sequence
  SiRNA target sequence
tccgccgcgcccaaacaaata

SEQ ID NO: 28909 - DNA, 21 bp, Artificial sequence
  SiRNA target sequence
ccgccgcgcccaaacaaatac

SEQ ID NO: 28910 - DNA, 21 bp, Artificial sequence
  SiRNA target sequence
cgccgcgcccaaacaaatacc

SEQ ID NO: 28911 - DNA, 21 bp, Artificial sequence
  SiRNA target sequence
gccgcgcccaaacaaatacca

SEQ ID NO: 28912 - DNA, 21 bp, Artificial sequence
  SiRNA target sequence
ccgcgcccaaacaaataccaa

SEQ ID NO: 28913 - DNA, 21 bp, Artificial sequence
  SiRNA target sequence
cgcgcccaaacaaataccaat

SEQ ID NO: 28914 - DNA, 21 bp, Artificial sequence
  SiRNA target sequence
gcgcccaaacaaataccaatc

SEQ ID NO: 28915 - DNA, 21 bp, Artificial sequence
  SiRNA target sequence
cgcccaaacaaataccaatcg

SEQ ID NO: 28916 - DNA, 21 bp, Artificial sequence
  SiRNA target sequence
gcccaaacaaataccaatcgc

SEQ ID NO: 28917 - DNA, 21 bp, Artificial sequence
  SiRNA target sequence
cccaaacaaataccaatcgcc

SEQ ID NO: 28918 - DNA, 21 bp, Artificial sequence
  SiRNA target sequence
ccaaacaaataccaatcgcca

SEQ ID NO: 28919 - DNA, 21 bp, Artificial sequence
  SiRNA target sequence
caaacaaataccaatcgccaa

SEQ ID NO: 28920 - DNA, 21 bp, Artificial sequence
  SiRNA target sequence
aaacaaataccaatcgccaac

SEQ ID NO: 28921 - DNA, 21 bp, Artificial sequence
  SiRNA target sequence
aacaaataccaatcgccaact

SEQ ID NO: 28922 - DNA, 21 bp, Artificial sequence
  SiRNA target sequence
acaaataccaatcgccaactt

SEQ ID NO: 28923 - DNA, 21 bp, Artificial sequence
  SiRNA target sequence
caaataccaatcgccaacttc

SEQ ID NO: 28924 - DNA, 21 bp, Artificial sequence
  SiRNA target sequence
aaataccaatcgccaacttca

SEQ ID NO: 28925 - DNA, 21 bp, Artificial sequence
  SiRNA target sequence
aataccaatcgccaacttcaa

SEQ ID NO: 28926 - DNA, 21 bp, Artificial sequence
  SiRNA target sequence
ataccaatcgccaacttcaac

SEQ ID NO: 28927 - DNA, 21 bp, Artificial sequence
  SiRNA target sequence
taccaatcgccaacttcaacg

SEQ ID NO: 28928 - DNA, 21 bp, Artificial sequence
  SiRNA target sequence
accaatcgccaacttcaacga

SEQ ID NO: 28929 - DNA, 21 bp, Artificial sequence
  SiRNA target sequence
ccaatcgccaacttcaacgaa

SEQ ID NO: 28930 - DNA, 21 bp, Artificial sequence
  SiRNA target sequence
caatcgccaacttcaacgaat

SEQ ID NO: 28931 - DNA, 21 bp, Artificial sequence
  SiRNA target sequence
aatcgccaacttcaacgaatt

SEQ ID NO: 28932 - DNA, 21 bp, Artificial sequence
  SiRNA target sequence
atcgccaacttcaacgaattc

SEQ ID NO: 28933 - DNA, 21 bp, Artificial sequence
  SiRNA target sequence
tcgccaacttcaacgaattcc

SEQ ID NO: 28934 - DNA, 21 bp, Artificial sequence
  SiRNA target sequence
cgccaacttcaacgaattcct

SEQ ID NO: 28935 - DNA, 21 bp, Artificial sequence
  SiRNA target sequence
gccaacttcaacgaattcctc

SEQ ID NO: 28936 - DNA, 21 bp, Artificial sequence
  SiRNA target sequence
ccaacttcaacgaattcctca

SEQ ID NO: 28937 - DNA, 21 bp, Artificial sequence
  SiRNA target sequence
caacttcaacgaattcctcat

SEQ ID NO: 28938 - DNA, 21 bp, Artificial sequence
  SiRNA target sequence
aacttcaacgaattcctcatc

SEQ ID NO: 28939 - DNA, 21 bp, Artificial sequence
  SiRNA target sequence
acttcaacgaattcctcatca

SEQ ID NO: 28940 - DNA, 21 bp, Artificial sequence
  SiRNA target sequence
cttcaacgaattcctcatcaa

SEQ ID NO: 28941 - DNA, 21 bp, Artificial sequence
  SiRNA target sequence
ttcaacgaattcctcatcaag

SEQ ID NO: 28942 - DNA, 21 bp, Artificial sequence
  SiRNA target sequence
tcaacgaattcctcatcaaga

SEQ ID NO: 28943 - DNA, 21 bp, Artificial sequence
  SiRNA target sequence
caacgaattcctcatcaagaa

SEQ ID NO: 28944 - DNA, 21 bp, Artificial sequence
  SiRNA target sequence
aacgaattcctcatcaagaat

SEQ ID NO: 28945 - DNA, 21 bp, Artificial sequence
  SiRNA target sequence
acgaattcctcatcaagaatc

SEQ ID NO: 28946 - DNA, 21 bp, Artificial sequence
  SiRNA target sequence
cgaattcctcatcaagaatcg

SEQ ID NO: 28947 - DNA, 21 bp, Artificial sequence
  SiRNA target sequence
gaattcctcatcaagaatcgt

SEQ ID NO: 28948 - DNA, 21 bp, Artificial sequence
  SiRNA target sequence
aattcctcatcaagaatcgtc

SEQ ID NO: 28949 - DNA, 21 bp, Artificial sequence
  SiRNA target sequence
attcctcatcaagaatcgtct

SEQ ID NO: 28950 - DNA, 21 bp, Artificial sequence
  SiRNA target sequence
ttcctcatcaagaatcgtcta

SEQ ID NO: 28951 - DNA, 21 bp, Artificial sequence
  SiRNA target sequence
tcctcatcaagaatcgtctac

SEQ ID NO: 28952 - DNA, 21 bp, Artificial sequence
  SiRNA target sequence
cctcatcaagaatcgtctacc

SEQ ID NO: 28953 - DNA, 21 bp, Artificial sequence
  SiRNA target sequence
ctcatcaagaatcgtctacca

SEQ ID NO: 28954 - DNA, 21 bp, Artificial sequence
  SiRNA target sequence
tcatcaagaatcgtctaccac

SEQ ID NO: 28955 - DNA, 21 bp, Artificial sequence
  SiRNA target sequence
catcaagaatcgtctaccacc

SEQ ID NO: 28956 - DNA, 21 bp, Artificial sequence
  SiRNA target sequence
atcaagaatcgtctaccacca

SEQ ID NO: 28957 - DNA, 21 bp, Artificial sequence
  SiRNA target sequence
tcaagaatcgtctaccaccat

SEQ ID NO: 28958 - DNA, 21 bp, Artificial sequence
  SiRNA target sequence
caagaatcgtctaccaccata

SEQ ID NO: 28959 - DNA, 21 bp, Artificial sequence
  SiRNA target sequence
aagaatcgtctaccaccatat

SEQ ID NO: 28960 - DNA, 21 bp, Artificial sequence
  SiRNA target sequence
agaatcgtctaccaccatatc

SEQ ID NO: 28961 - DNA, 21 bp, Artificial sequence
  SiRNA target sequence
gaatcgtctaccaccatatct

SEQ ID NO: 28962 - DNA, 21 bp, Artificial sequence
  SiRNA target sequence
aatcgtctaccaccatatctt

SEQ ID NO: 28963 - DNA, 21 bp, Artificial sequence
  SiRNA target sequence
atcgtctaccaccatatcttc

SEQ ID NO: 28964 - DNA, 21 bp, Artificial sequence
  SiRNA target sequence
tcgtctaccaccatatcttcc

SEQ ID NO: 28965 - DNA, 21 bp, Artificial sequence
  SiRNA target sequence
cgtctaccaccatatcttccc

SEQ ID NO: 28966 - DNA, 21 bp, Artificial sequence
  SiRNA target sequence
gtctaccaccatatcttccct

SEQ ID NO: 28967 - DNA, 21 bp, Artificial sequence
  SiRNA target sequence
tctaccaccatatcttccctt

SEQ ID NO: 28968 - DNA, 21 bp, Artificial sequence
  SiRNA target sequence
ctaccaccatatcttcccttc

SEQ ID NO: 28969 - DNA, 21 bp, Artificial sequence
  SiRNA target sequence
taccaccatatcttcccttca

SEQ ID NO: 28970 - DNA, 21 bp, Artificial sequence
  SiRNA target sequence
accaccatatcttcccttcag

SEQ ID NO: 28971 - DNA, 21 bp, Artificial sequence
  SiRNA target sequence
ccaccatatcttcccttcagc

SEQ ID NO: 28972 - DNA, 21 bp, Artificial sequence
  SiRNA target sequence
caccatatcttcccttcagca

SEQ ID NO: 28973 - DNA, 21 bp, Artificial sequence
  SiRNA target sequence
accatatcttcccttcagcat

SEQ ID NO: 28974 - DNA, 21 bp, Artificial sequence
  SiRNA target sequence
ccatatcttcccttcagcatc

SEQ ID NO: 28975 - DNA, 21 bp, Artificial sequence
  SiRNA target sequence
catatcttcccttcagcatca

SEQ ID NO: 28976 - DNA, 21 bp, Artificial sequence
  SiRNA target sequence
atatcttcccttcagcatcaa

SEQ ID NO: 28977 - DNA, 21 bp, Artificial sequence
  SiRNA target sequence
tatcttcccttcagcatcaac

SEQ ID NO: 28978 - DNA, 21 bp, Artificial sequence
  SiRNA target sequence
atcttcccttcagcatcaacg

SEQ ID NO: 28979 - DNA, 21 bp, Artificial sequence
  SiRNA target sequence
tcttcccttcagcatcaacga

SEQ ID NO: 28980 - DNA, 21 bp, Artificial sequence
  SiRNA target sequence
cttcccttcagcatcaacgat

SEQ ID NO: 28981 - DNA, 21 bp, Artificial sequence
  SiRNA target sequence
ttcccttcagcatcaacgatt

SEQ ID NO: 28982 - DNA, 21 bp, Artificial sequence
  SiRNA target sequence
tcccttcagcatcaacgattc

SEQ ID NO: 28983 - DNA, 21 bp, Artificial sequence
  SiRNA target sequence
cccttcagcatcaacgattcg

SEQ ID NO: 28984 - DNA, 21 bp, Artificial sequence
  SiRNA target sequence
ccttcagcatcaacgattcga

SEQ ID NO: 28985 - DNA, 21 bp, Artificial sequence
  SiRNA target sequence
cttcagcatcaacgattcgaa

SEQ ID NO: 28986 - DNA, 21 bp, Artificial sequence
  SiRNA target sequence
ttcagcatcaacgattcgaaa

SEQ ID NO: 28987 - DNA, 21 bp, Artificial sequence
  SiRNA target sequence
tcagcatcaacgattcgaaac

SEQ ID NO: 28988 - DNA, 21 bp, Artificial sequence
  SiRNA target sequence
cagcatcaacgattcgaaact

SEQ ID NO: 28989 - DNA, 21 bp, Artificial sequence
  SiRNA target sequence
agcatcaacgattcgaaactg

SEQ ID NO: 28990 - DNA, 21 bp, Artificial sequence
  SiRNA target sequence
gcatcaacgattcgaaactgt

SEQ ID NO: 28991 - DNA, 21 bp, Artificial sequence
  SiRNA target sequence
catcaacgattcgaaactgtt

SEQ ID NO: 28992 - DNA, 21 bp, Artificial sequence
  SiRNA target sequence
atcaacgattcgaaactgttc

SEQ ID NO: 28993 - DNA, 21 bp, Artificial sequence
  SiRNA target sequence
tcaacgattcgaaactgttcc

SEQ ID NO: 28994 - DNA, 21 bp, Artificial sequence
  SiRNA target sequence
caacgattcgaaactgttcca

SEQ ID NO: 28995 - DNA, 21 bp, Artificial sequence
  SiRNA target sequence
aacgattcgaaactgttccac

SEQ ID NO: 28996 - DNA, 21 bp, Artificial sequence
  SiRNA target sequence
acgattcgaaactgttccact

SEQ ID NO: 28997 - DNA, 21 bp, Artificial sequence
  SiRNA target sequence
cgattcgaaactgttccacta

SEQ ID NO: 28998 - DNA, 21 bp, Artificial sequence
  SiRNA target sequence
gattcgaaactgttccactac

SEQ ID NO: 28999 - DNA, 21 bp, Artificial sequence
  SiRNA target sequence
attcgaaactgttccactact

SEQ ID NO: 29000 - DNA, 21 bp, Artificial sequence
  SiRNA target sequence
ttcgaaactgttccactacta

SEQ ID NO: 29001 - DNA, 21 bp, Artificial sequence
  SiRNA target sequence
tcgaaactgttccactactac

SEQ ID NO: 29002 - DNA, 21 bp, Artificial sequence
  SiRNA target sequence
cgaaactgttccactactacc

SEQ ID NO: 29003 - DNA, 21 bp, Artificial sequence
  SiRNA target sequence
gaaactgttccactactaccc

SEQ ID NO: 29004 - DNA, 21 bp, Artificial sequence
  SiRNA target sequence
aaactgttccactactaccca

SEQ ID NO: 29005 - DNA, 21 bp, Artificial sequence
  SiRNA target sequence
aactgttccactactacccac

SEQ ID NO: 29006 - DNA, 21 bp, Artificial sequence
  SiRNA target sequence
actgttccactactacccacc

SEQ ID NO: 29007 - DNA, 21 bp, Artificial sequence
  SiRNA target sequence
ctgttccactactacccaccg

SEQ ID NO: 29008 - DNA, 21 bp, Artificial sequence
  SiRNA target sequence
tgttccactactacccaccgt

SEQ ID NO: 29009 - DNA, 21 bp, Artificial sequence
  SiRNA target sequence
gttccactactacccaccgtt

SEQ ID NO: 29010 - DNA, 21 bp, Artificial sequence
  SiRNA target sequence
ttccactactacccaccgtta

SEQ ID NO: 29011 - DNA, 21 bp, Artificial sequence
  SiRNA target sequence
tccactactacccaccgttac

SEQ ID NO: 29012 - DNA, 21 bp, Artificial sequence
  SiRNA target sequence
ccactactacccaccgttaca

SEQ ID NO: 29013 - DNA, 21 bp, Artificial sequence
  SiRNA target sequence
cactactacccaccgttacag

SEQ ID NO: 29014 - DNA, 21 bp, Artificial sequence
  SiRNA target sequence
actactacccaccgttacagt

SEQ ID NO: 29015 - DNA, 21 bp, Artificial sequence
  SiRNA target sequence
ctactacccaccgttacagtt

SEQ ID NO: 29016 - DNA, 21 bp, Artificial sequence
  SiRNA target sequence
tactacccaccgttacagttg

SEQ ID NO: 29017 - DNA, 21 bp, Artificial sequence
  SiRNA target sequence
actacccaccgttacagttga

SEQ ID NO: 29018 - DNA, 21 bp, Artificial sequence
  SiRNA target sequence
ctacccaccgttacagttgag

SEQ ID NO: 29019 - DNA, 21 bp, Artificial sequence
  SiRNA target sequence
tacccaccgttacagttgaga

SEQ ID NO: 29020 - DNA, 21 bp, Artificial sequence
  SiRNA target sequence
acccaccgttacagttgagac

SEQ ID NO: 29021 - DNA, 21 bp, Artificial sequence
  SiRNA target sequence
cccaccgttacagttgagacg

SEQ ID NO: 29022 - DNA, 21 bp, Artificial sequence
  SiRNA target sequence
ccaccgttacagttgagacgc

SEQ ID NO: 29023 - DNA, 21 bp, Artificial sequence
  SiRNA target sequence
caccgttacagttgagacgcc

SEQ ID NO: 29024 - DNA, 21 bp, Artificial sequence
  SiRNA target sequence
accgttacagttgagacgccg

SEQ ID NO: 29025 - DNA, 21 bp, Artificial sequence
  SiRNA target sequence
ccgttacagttgagacgccgg

SEQ ID NO: 29026 - DNA, 21 bp, Artificial sequence
  SiRNA target sequence
cgttacagttgagacgccggt

SEQ ID NO: 29027 - DNA, 21 bp, Artificial sequence
  SiRNA target sequence
gttacagttgagacgccggtg

SEQ ID NO: 29028 - DNA, 21 bp, Artificial sequence
  SiRNA target sequence
ttacagttgagacgccggtgt

SEQ ID NO: 29029 - DNA, 21 bp, Artificial sequence
  SiRNA target sequence
tacagttgagacgccggtgtg

SEQ ID NO: 29030 - DNA, 21 bp, Artificial sequence
  SiRNA target sequence
acagttgagacgccggtgtgt

SEQ ID NO: 29031 - DNA, 21 bp, Artificial sequence
  SiRNA target sequence
cagttgagacgccggtgtgtt

SEQ ID NO: 29032 - DNA, 21 bp, Artificial sequence
  SiRNA target sequence
agttgagacgccggtgtgttg

SEQ ID NO: 29033 - DNA, 21 bp, Artificial sequence
  SiRNA target sequence
gttgagacgccggtgtgttga

SEQ ID NO: 29034 - DNA, 21 bp, Artificial sequence
  SiRNA target sequence
ttgagacgccggtgtgttgag

SEQ ID NO: 29035 - DNA, 21 bp, Artificial sequence
  SiRNA target sequence
tgagacgccggtgtgttgaga

SEQ ID NO: 29036 - DNA, 21 bp, Artificial sequence
  SiRNA target sequence
gagacgccggtgtgttgagat

SEQ ID NO: 29037 - DNA, 21 bp, Artificial sequence
  SiRNA target sequence
agacgccggtgtgttgagatt

SEQ ID NO: 29038 - DNA, 21 bp, Artificial sequence
  SiRNA target sequence
gacgccggtgtgttgagattc

SEQ ID NO: 29039 - DNA, 21 bp, Artificial sequence
  SiRNA target sequence
acgccggtgtgttgagattct

SEQ ID NO: 29040 - DNA, 21 bp, Artificial sequence
  SiRNA target sequence
cgccggtgtgttgagattcta

SEQ ID NO: 29041 - DNA, 21 bp, Artificial sequence
  SiRNA target sequence
gccggtgtgttgagattctac

SEQ ID NO: 29042 - DNA, 21 bp, Artificial sequence
  SiRNA target sequence
ccggtgtgttgagattctaca

SEQ ID NO: 29043 - DNA, 21 bp, Artificial sequence
  SiRNA target sequence
cggtgtgttgagattctacac

SEQ ID NO: 29044 - DNA, 21 bp, Artificial sequence
  SiRNA target sequence
ggtgtgttgagattctacaca

SEQ ID NO: 29045 - DNA, 21 bp, Artificial sequence
  SiRNA target sequence
gtgtgttgagattctacacac

SEQ ID NO: 29046 - DNA, 21 bp, Artificial sequence
  SiRNA target sequence
tgtgttgagattctacacacc

SEQ ID NO: 29047 - DNA, 21 bp, Artificial sequence
  SiRNA target sequence
gtgttgagattctacacacca

SEQ ID NO: 29048 - DNA, 21 bp, Artificial sequence
  SiRNA target sequence
tgttgagattctacacaccag

SEQ ID NO: 29049 - DNA, 21 bp, Artificial sequence
  SiRNA target sequence
gttgagattctacacaccagt

SEQ ID NO: 29050 - DNA, 21 bp, Artificial sequence
  SiRNA target sequence
ttgagattctacacaccagta

SEQ ID NO: 29051 - DNA, 21 bp, Artificial sequence
  SiRNA target sequence
tgagattctacacaccagtaa

SEQ ID NO: 29052 - DNA, 21 bp, Artificial sequence
  SiRNA target sequence
gagattctacacaccagtaaa

SEQ ID NO: 29053 - DNA, 21 bp, Artificial sequence
  SiRNA target sequence
agattctacacaccagtaaac

SEQ ID NO: 29054 - DNA, 21 bp, Artificial sequence
  SiRNA target sequence
gattctacacaccagtaaact

SEQ ID NO: 29055 - DNA, 21 bp, Artificial sequence
  SiRNA target sequence
attctacacaccagtaaactt

SEQ ID NO: 29056 - DNA, 21 bp, Artificial sequence
  SiRNA target sequence
ttctacacaccagtaaacttg

SEQ ID NO: 29057 - DNA, 21 bp, Artificial sequence
  SiRNA target sequence
tctacacaccagtaaacttgc

SEQ ID NO: 29058 - DNA, 21 bp, Artificial sequence
  SiRNA target sequence
ctacacaccagtaaacttgct

SEQ ID NO: 29059 - DNA, 21 bp, Artificial sequence
  SiRNA target sequence
tacacaccagtaaacttgctc

SEQ ID NO: 29060 - DNA, 21 bp, Artificial sequence
  SiRNA target sequence
acacaccagtaaacttgctcc

SEQ ID NO: 29061 - DNA, 21 bp, Artificial sequence
  SiRNA target sequence
cacaccagtaaacttgctcct

SEQ ID NO: 29062 - DNA, 21 bp, Artificial sequence
  SiRNA target sequence
acaccagtaaacttgctcctg

SEQ ID NO: 29063 - DNA, 21 bp, Artificial sequence
  SiRNA target sequence
caccagtaaacttgctcctgc

SEQ ID NO: 29064 - DNA, 21 bp, Artificial sequence
  SiRNA target sequence
accagtaaacttgctcctgcc

SEQ ID NO: 29065 - DNA, 21 bp, Artificial sequence
  SiRNA target sequence
ccagtaaacttgctcctgccg

SEQ ID NO: 29066 - DNA, 21 bp, Artificial sequence
  SiRNA target sequence
cagtaaacttgctcctgccga

SEQ ID NO: 29067 - DNA, 21 bp, Artificial sequence
  SiRNA target sequence
agtaaacttgctcctgccgat

SEQ ID NO: 29068 - DNA, 21 bp, Artificial sequence
  SiRNA target sequence
gtaaacttgctcctgccgatt

SEQ ID NO: 29069 - DNA, 21 bp, Artificial sequence
  SiRNA target sequence
taaacttgctcctgccgattg

SEQ ID NO: 29070 - DNA, 21 bp, Artificial sequence
  SiRNA target sequence
aaacttgctcctgccgattgt

SEQ ID NO: 29071 - DNA, 21 bp, Artificial sequence
  SiRNA target sequence
aacttgctcctgccgattgta

SEQ ID NO: 29072 - DNA, 21 bp, Artificial sequence
  SiRNA target sequence
acttgctcctgccgattgtag

SEQ ID NO: 29073 - DNA, 21 bp, Artificial sequence
  SiRNA target sequence
cttgctcctgccgattgtagc

SEQ ID NO: 29074 - DNA, 21 bp, Artificial sequence
  SiRNA target sequence
ttgctcctgccgattgtagcc

SEQ ID NO: 29075 - DNA, 21 bp, Artificial sequence
  SiRNA target sequence
tgctcctgccgattgtagcct

SEQ ID NO: 29076 - DNA, 21 bp, Artificial sequence
  SiRNA target sequence
gctcctgccgattgtagcctg

SEQ ID NO: 29077 - DNA, 21 bp, Artificial sequence
  SiRNA target sequence
ctcctgccgattgtagcctgc

SEQ ID NO: 29078 - DNA, 21 bp, Artificial sequence
  SiRNA target sequence
tcctgccgattgtagcctgcc

SEQ ID NO: 29079 - DNA, 21 bp, Artificial sequence
  SiRNA target sequence
cctgccgattgtagcctgcct

SEQ ID NO: 29080 - DNA, 21 bp, Artificial sequence
  SiRNA target sequence
ctgccgattgtagcctgcctt

SEQ ID NO: 29081 - DNA, 21 bp, Artificial sequence
  SiRNA target sequence
tgccgattgtagcctgccttc

SEQ ID NO: 29082 - DNA, 21 bp, Artificial sequence
  SiRNA target sequence
gccgattgtagcctgccttcg

SEQ ID NO: 29083 - DNA, 21 bp, Artificial sequence
  SiRNA target sequence
ccgattgtagcctgccttcgt

SEQ ID NO: 29084 - DNA, 21 bp, Artificial sequence
  SiRNA target sequence
cgattgtagcctgccttcgta

SEQ ID NO: 29085 - DNA, 21 bp, Artificial sequence
  SiRNA target sequence
gattgtagcctgccttcgtat

SEQ ID NO: 29086 - DNA, 21 bp, Artificial sequence
  SiRNA target sequence
attgtagcctgccttcgtatt

SEQ ID NO: 29087 - DNA, 21 bp, Artificial sequence
  SiRNA target sequence
ttgtagcctgccttcgtattg

SEQ ID NO: 29088 - DNA, 21 bp, Artificial sequence
  SiRNA target sequence
tgtagcctgccttcgtattgt

SEQ ID NO: 29089 - DNA, 21 bp, Artificial sequence
  SiRNA target sequence
gtagcctgccttcgtattgtg

SEQ ID NO: 29090 - DNA, 21 bp, Artificial sequence
  SiRNA target sequence
tagcctgccttcgtattgtgg

SEQ ID NO: 29091 - DNA, 21 bp, Artificial sequence
  SiRNA target sequence
agcctgccttcgtattgtggt

SEQ ID NO: 29092 - DNA, 21 bp, Artificial sequence
  SiRNA target sequence
gcctgccttcgtattgtggtc

SEQ ID NO: 29093 - DNA, 21 bp, Artificial sequence
  SiRNA target sequence
cctgccttcgtattgtggtca

SEQ ID NO: 29094 - DNA, 21 bp, Artificial sequence
  SiRNA target sequence
ctgccttcgtattgtggtcag

SEQ ID NO: 29095 - DNA, 21 bp, Artificial sequence
  SiRNA target sequence
tgccttcgtattgtggtcagg

SEQ ID NO: 29096 - DNA, 21 bp, Artificial sequence
  SiRNA target sequence
gccttcgtattgtggtcaggt

SEQ ID NO: 29097 - DNA, 21 bp, Artificial sequence
  SiRNA target sequence
ccttcgtattgtggtcaggtc

SEQ ID NO: 29098 - DNA, 21 bp, Artificial sequence
  SiRNA target sequence
cttcgtattgtggtcaggtcc

SEQ ID NO: 29099 - DNA, 21 bp, Artificial sequence
  SiRNA target sequence
ttcgtattgtggtcaggtcca

SEQ ID NO: 29100 - DNA, 21 bp, Artificial sequence
  SiRNA target sequence
tcgtattgtggtcaggtccat

SEQ ID NO: 29101 - DNA, 21 bp, Artificial sequence
  SiRNA target sequence
cgtattgtggtcaggtccatt

SEQ ID NO: 29102 - DNA, 21 bp, Artificial sequence
  SiRNA target sequence
gtattgtggtcaggtccattg

SEQ ID NO: 29103 - DNA, 21 bp, Artificial sequence
  SiRNA target sequence
tattgtggtcaggtccattgg

SEQ ID NO: 29104 - DNA, 21 bp, Artificial sequence
  SiRNA target sequence
attgtggtcaggtccattggt

SEQ ID NO: 29105 - DNA, 21 bp, Artificial sequence
  SiRNA target sequence
ttgtggtcaggtccattggtc

SEQ ID NO: 29106 - DNA, 21 bp, Artificial sequence
  SiRNA target sequence
tgtggtcaggtccattggtca

SEQ ID NO: 29107 - DNA, 21 bp, Artificial sequence
  SiRNA target sequence
gtggtcaggtccattggtcaa

SEQ ID NO: 29108 - DNA, 21 bp, Artificial sequence
  SiRNA target sequence
tggtcaggtccattggtcaac

SEQ ID NO: 29109 - DNA, 21 bp, Artificial sequence
  SiRNA target sequence
ggtcaggtccattggtcaacc

SEQ ID NO: 29110 - DNA, 21 bp, Artificial sequence
  SiRNA target sequence
gtcaggtccattggtcaacct

SEQ ID NO: 29111 - DNA, 21 bp, Artificial sequence
  SiRNA target sequence
tcaggtccattggtcaacctt

SEQ ID NO: 29112 - DNA, 21 bp, Artificial sequence
  SiRNA target sequence
caggtccattggtcaaccttc

SEQ ID NO: 29113 - DNA, 21 bp, Artificial sequence
  SiRNA target sequence
aggtccattggtcaaccttcc

SEQ ID NO: 29114 - DNA, 21 bp, Artificial sequence
  SiRNA target sequence
ggtccattggtcaaccttcca

SEQ ID NO: 29115 - DNA, 21 bp, Artificial sequence
  SiRNA target sequence
gtccattggtcaaccttccaa

SEQ ID NO: 29116 - DNA, 21 bp, Artificial sequence
  SiRNA target sequence
tccattggtcaaccttccaat

SEQ ID NO: 29117 - DNA, 21 bp, Artificial sequence
  SiRNA target sequence
ccattggtcaaccttccaatc

SEQ ID NO: 29118 - DNA, 21 bp, Artificial sequence
  SiRNA target sequence
cattggtcaaccttccaatcc

SEQ ID NO: 29119 - DNA, 21 bp, Artificial sequence
  SiRNA target sequence
attggtcaaccttccaatcca

SEQ ID NO: 29120 - DNA, 21 bp, Artificial sequence
  SiRNA target sequence
ttggtcaaccttccaatccac

SEQ ID NO: 29121 - DNA, 21 bp, Artificial sequence
  SiRNA target sequence
tggtcaaccttccaatccacc

SEQ ID NO: 29122 - DNA, 21 bp, Artificial sequence
  SiRNA target sequence
ggtcaaccttccaatccacct

SEQ ID NO: 29123 - DNA, 21 bp, Artificial sequence
  SiRNA target sequence
gtcaaccttccaatccacctg

SEQ ID NO: 29124 - DNA, 21 bp, Artificial sequence
  SiRNA target sequence
tcaaccttccaatccacctgg

SEQ ID NO: 29125 - DNA, 21 bp, Artificial sequence
  SiRNA target sequence
caaccttccaatccacctggt

SEQ ID NO: 29126 - DNA, 21 bp, Artificial sequence
  SiRNA target sequence
aaccttccaatccacctggta

SEQ ID NO: 29127 - DNA, 21 bp, Artificial sequence
  SiRNA target sequence
accttccaatccacctggtac

SEQ ID NO: 29128 - DNA, 21 bp, Artificial sequence
  SiRNA target sequence
ccttccaatccacctggtacg

SEQ ID NO: 29129 - DNA, 21 bp, Artificial sequence
  SiRNA target sequence
cttccaatccacctggtacgg

SEQ ID NO: 29130 - DNA, 21 bp, Artificial sequence
  SiRNA target sequence
ttccaatccacctggtacggg

SEQ ID NO: 29131 - DNA, 21 bp, Artificial sequence
  SiRNA target sequence
tccaatccacctggtacggga

SEQ ID NO: 29132 - DNA, 21 bp, Artificial sequence
  SiRNA target sequence
ccaatccacctggtacgggag

SEQ ID NO: 29133 - DNA, 21 bp, Artificial sequence
  SiRNA target sequence
caatccacctggtacgggagc

SEQ ID NO: 29134 - DNA, 21 bp, Artificial sequence
  SiRNA target sequence
aatccacctggtacgggagcg

SEQ ID NO: 29135 - DNA, 21 bp, Artificial sequence
  SiRNA target sequence
atccacctggtacgggagcga

SEQ ID NO: 29136 - DNA, 21 bp, Artificial sequence
  SiRNA target sequence
tccacctggtacgggagcgaa

SEQ ID NO: 29137 - DNA, 21 bp, Artificial sequence
  SiRNA target sequence
ccacctggtacgggagcgaag

SEQ ID NO: 29138 - DNA, 21 bp, Artificial sequence
  SiRNA target sequence
cacctggtacgggagcgaagt

SEQ ID NO: 29139 - DNA, 21 bp, Artificial sequence
  SiRNA target sequence
acctggtacgggagcgaagtt

SEQ ID NO: 29140 - DNA, 21 bp, Artificial sequence
  SiRNA target sequence
cctggtacgggagcgaagttg

SEQ ID NO: 29141 - DNA, 21 bp, Artificial sequence
  SiRNA target sequence
ctggtacgggagcgaagttgg

SEQ ID NO: 29142 - DNA, 21 bp, Artificial sequence
  SiRNA target sequence
tggtacgggagcgaagttggc

SEQ ID NO: 29143 - DNA, 21 bp, Artificial sequence
  SiRNA target sequence
ggtacgggagcgaagttggcg

SEQ ID NO: 29144 - DNA, 21 bp, Artificial sequence
  SiRNA target sequence
gtacgggagcgaagttggcgc

SEQ ID NO: 29145 - DNA, 21 bp, Artificial sequence
  SiRNA target sequence
tacgggagcgaagttggcgca

SEQ ID NO: 29146 - DNA, 21 bp, Artificial sequence
  SiRNA target sequence
acgggagcgaagttggcgcat

SEQ ID NO: 29147 - DNA, 21 bp, Artificial sequence
  SiRNA target sequence
cgggagcgaagttggcgcatg

SEQ ID NO: 29148 - DNA, 21 bp, Artificial sequence
  SiRNA target sequence
gggagcgaagttggcgcatgt

SEQ ID NO: 29149 - DNA, 21 bp, Artificial sequence
  SiRNA target sequence
ggagcgaagttggcgcatgtg

SEQ ID NO: 29150 - DNA, 21 bp, Artificial sequence
  SiRNA target sequence
gagcgaagttggcgcatgtgt

SEQ ID NO: 29151 - DNA, 21 bp, Artificial sequence
  SiRNA target sequence
agcgaagttggcgcatgtgtt

SEQ ID NO: 29152 - DNA, 21 bp, Artificial sequence
  SiRNA target sequence
gcgaagttggcgcatgtgttg

SEQ ID NO: 29153 - DNA, 21 bp, Artificial sequence
  SiRNA target sequence
cgaagttggcgcatgtgttgg

SEQ ID NO: 29154 - DNA, 21 bp, Artificial sequence
  SiRNA target sequence
gaagttggcgcatgtgttggt

SEQ ID NO: 29155 - DNA, 21 bp, Artificial sequence
  SiRNA target sequence
aagttggcgcatgtgttggta

SEQ ID NO: 29156 - DNA, 21 bp, Artificial sequence
  SiRNA target sequence
agttggcgcatgtgttggtac

SEQ ID NO: 29157 - DNA, 21 bp, Artificial sequence
  SiRNA target sequence
gttggcgcatgtgttggtaca

SEQ ID NO: 29158 - DNA, 21 bp, Artificial sequence
  SiRNA target sequence
ttggcgcatgtgttggtacag

SEQ ID NO: 29159 - DNA, 21 bp, Artificial sequence
  SiRNA target sequence
tggcgcatgtgttggtacagg

SEQ ID NO: 29160 - DNA, 21 bp, Artificial sequence
  SiRNA target sequence
ggcgcatgtgttggtacaggc

SEQ ID NO: 29161 - DNA, 21 bp, Artificial sequence
  SiRNA target sequence
gcgcatgtgttggtacaggcg

SEQ ID NO: 29162 - DNA, 21 bp, Artificial sequence
  SiRNA target sequence
cgcatgtgttggtacaggcgt

SEQ ID NO: 29163 - DNA, 21 bp, Artificial sequence
  SiRNA target sequence
gcatgtgttggtacaggcgtc

SEQ ID NO: 29164 - DNA, 21 bp, Artificial sequence
  SiRNA target sequence
catgtgttggtacaggcgtcc

SEQ ID NO: 29165 - DNA, 21 bp, Artificial sequence
  SiRNA target sequence
atgtgttggtacaggcgtcca

SEQ ID NO: 29166 - DNA, 21 bp, Artificial sequence
  SiRNA target sequence
tgtgttggtacaggcgtccat

SEQ ID NO: 29167 - DNA, 21 bp, Artificial sequence
  SiRNA target sequence
gtgttggtacaggcgtccatc

SEQ ID NO: 29168 - DNA, 21 bp, Artificial sequence
  SiRNA target sequence
tgttggtacaggcgtccatcc

SEQ ID NO: 29169 - DNA, 21 bp, Artificial sequence
  SiRNA target sequence
gttggtacaggcgtccatccg

SEQ ID NO: 29170 - DNA, 21 bp, Artificial sequence
  SiRNA target sequence
ttggtacaggcgtccatccgc

SEQ ID NO: 29171 - DNA, 21 bp, Artificial sequence
  SiRNA target sequence
tggtacaggcgtccatccgcc

SEQ ID NO: 29172 - DNA, 21 bp, Artificial sequence
  SiRNA target sequence
ggtacaggcgtccatccgcct

SEQ ID NO: 29173 - DNA, 21 bp, Artificial sequence
  SiRNA target sequence
gtacaggcgtccatccgcctg

SEQ ID NO: 29174 - DNA, 21 bp, Artificial sequence
  SiRNA target sequence
tacaggcgtccatccgcctgt

SEQ ID NO: 29175 - DNA, 21 bp, Artificial sequence
  SiRNA target sequence
acaggcgtccatccgcctgtt

SEQ ID NO: 29176 - DNA, 21 bp, Artificial sequence
  SiRNA target sequence
caggcgtccatccgcctgtta

SEQ ID NO: 29177 - DNA, 21 bp, Artificial sequence
  SiRNA target sequence
aggcgtccatccgcctgttag

SEQ ID NO: 29178 - DNA, 21 bp, Artificial sequence
  SiRNA target sequence
ggcgtccatccgcctgttagg

SEQ ID NO: 29179 - DNA, 21 bp, Artificial sequence
  SiRNA target sequence
gcgtccatccgcctgttaggt

SEQ ID NO: 29180 - DNA, 21 bp, Artificial sequence
  SiRNA target sequence
cgtccatccgcctgttaggta

SEQ ID NO: 29181 - DNA, 21 bp, Artificial sequence
  SiRNA target sequence
gtccatccgcctgttaggtac

SEQ ID NO: 29182 - DNA, 21 bp, Artificial sequence
  SiRNA target sequence
tccatccgcctgttaggtacg

SEQ ID NO: 29183 - DNA, 21 bp, Artificial sequence
  SiRNA target sequence
ccatccgcctgttaggtacga

SEQ ID NO: 29184 - DNA, 21 bp, Artificial sequence
  SiRNA target sequence
catccgcctgttaggtacgag

SEQ ID NO: 29185 - DNA, 21 bp, Artificial sequence
  SiRNA target sequence
atccgcctgttaggtacgagc

SEQ ID NO: 29186 - DNA, 21 bp, Artificial sequence
  SiRNA target sequence
tccgcctgttaggtacgagcc

SEQ ID NO: 29187 - DNA, 21 bp, Artificial sequence
  SiRNA target sequence
ccgcctgttaggtacgagcca

SEQ ID NO: 29188 - DNA, 21 bp, Artificial sequence
  SiRNA target sequence
cgcctgttaggtacgagccat

SEQ ID NO: 29189 - DNA, 21 bp, Artificial sequence
  SiRNA target sequence
gcctgttaggtacgagccatc

SEQ ID NO: 29190 - DNA, 21 bp, Artificial sequence
  SiRNA target sequence
cctgttaggtacgagccatct

SEQ ID NO: 29191 - DNA, 21 bp, Artificial sequence
  SiRNA target sequence
ctgttaggtacgagccatctc

SEQ ID NO: 29192 - DNA, 21 bp, Artificial sequence
  SiRNA target sequence
tgttaggtacgagccatctcc

SEQ ID NO: 29193 - DNA, 21 bp, Artificial sequence
  SiRNA target sequence
gttaggtacgagccatctcca

SEQ ID NO: 29194 - DNA, 21 bp, Artificial sequence
  SiRNA target sequence
ttaggtacgagccatctccat

SEQ ID NO: 29195 - DNA, 21 bp, Artificial sequence
  SiRNA target sequence
taggtacgagccatctccatt

SEQ ID NO: 29196 - DNA, 21 bp, Artificial sequence
  SiRNA target sequence
aggtacgagccatctccattt

SEQ ID NO: 29197 - DNA, 21 bp, Artificial sequence
  SiRNA target sequence
ggtacgagccatctccatttt

SEQ ID NO: 29198 - DNA, 21 bp, Artificial sequence
  SiRNA target sequence
gtacgagccatctccatttta

SEQ ID NO: 29199 - DNA, 21 bp, Artificial sequence
  SiRNA target sequence
tacgagccatctccattttat

SEQ ID NO: 29200 - DNA, 21 bp, Artificial sequence
  SiRNA target sequence
acgagccatctccattttatc

SEQ ID NO: 29201 - DNA, 21 bp, Artificial sequence
  SiRNA target sequence
cgagccatctccattttatca

SEQ ID NO: 29202 - DNA, 21 bp, Artificial sequence
  SiRNA target sequence
gagccatctccattttatcat

SEQ ID NO: 29203 - DNA, 21 bp, Artificial sequence
  SiRNA target sequence
agccatctccattttatcata

SEQ ID NO: 29204 - DNA, 21 bp, Artificial sequence
  SiRNA target sequence
gccatctccattttatcatat

SEQ ID NO: 29205 - DNA, 21 bp, Artificial sequence
  SiRNA target sequence
ccatctccattttatcatatc

SEQ ID NO: 29206 - DNA, 21 bp, Artificial sequence
  SiRNA target sequence
catctccattttatcatatcc

SEQ ID NO: 29207 - DNA, 21 bp, Artificial sequence
  SiRNA target sequence
atctccattttatcatatcct

SEQ ID NO: 29208 - DNA, 21 bp, Artificial sequence
  SiRNA target sequence
tctccattttatcatatcctc

SEQ ID NO: 29209 - DNA, 21 bp, Artificial sequence
  SiRNA target sequence
ctccattttatcatatcctca

SEQ ID NO: 29210 - DNA, 21 bp, Artificial sequence
  SiRNA target sequence
tccattttatcatatcctcaa

SEQ ID NO: 29211 - DNA, 21 bp, Artificial sequence
  SiRNA target sequence
ccattttatcatatcctcaat

SEQ ID NO: 29212 - DNA, 21 bp, Artificial sequence
  SiRNA target sequence
cattttatcatatcctcaatc

SEQ ID NO: 29213 - DNA, 21 bp, Artificial sequence
  SiRNA target sequence
attttatcatatcctcaatca

SEQ ID NO: 29214 - DNA, 21 bp, Artificial sequence
  SiRNA target sequence
ttttatcatatcctcaatcag

SEQ ID NO: 29215 - DNA, 21 bp, Artificial sequence
  SiRNA target sequence
tttatcatatcctcaatcagg

SEQ ID NO: 29216 - DNA, 21 bp, Artificial sequence
  SiRNA target sequence
ttatcatatcctcaatcaggg

SEQ ID NO: 29217 - DNA, 21 bp, Artificial sequence
  SiRNA target sequence
tatcatatcctcaatcaggga

SEQ ID NO: 29218 - DNA, 21 bp, Artificial sequence
  SiRNA target sequence
atcatatcctcaatcagggaa

SEQ ID NO: 29219 - DNA, 21 bp, Artificial sequence
  SiRNA target sequence
tcatatcctcaatcagggaaa

SEQ ID NO: 29220 - DNA, 21 bp, Artificial sequence
  SiRNA target sequence
catatcctcaatcagggaaag

SEQ ID NO: 29221 - DNA, 21 bp, Artificial sequence
  SiRNA target sequence
atatcctcaatcagggaaagt

SEQ ID NO: 29222 - DNA, 21 bp, Artificial sequence
  SiRNA target sequence
tatcctcaatcagggaaagtg

SEQ ID NO: 29223 - DNA, 21 bp, Artificial sequence
  SiRNA target sequence
atcctcaatcagggaaagtgg

SEQ ID NO: 29224 - DNA, 21 bp, Artificial sequence
  SiRNA target sequence
tcctcaatcagggaaagtggt

SEQ ID NO: 29225 - DNA, 21 bp, Artificial sequence
  SiRNA target sequence
cctcaatcagggaaagtggtt

SEQ ID NO: 29226 - DNA, 21 bp, Artificial sequence
  SiRNA target sequence
ctcaatcagggaaagtggttc

SEQ ID NO: 29227 - DNA, 21 bp, Artificial sequence
  SiRNA target sequence
tcaatcagggaaagtggttcc

SEQ ID NO: 29228 - DNA, 21 bp, Artificial sequence
  SiRNA target sequence
caatcagggaaagtggttccg

SEQ ID NO: 29229 - DNA, 21 bp, Artificial sequence
  SiRNA target sequence
aatcagggaaagtggttccgg

SEQ ID NO: 29230 - DNA, 21 bp, Artificial sequence
  SiRNA target sequence
atcagggaaagtggttccggt

SEQ ID NO: 29231 - DNA, 21 bp, Artificial sequence
  SiRNA target sequence
tcagggaaagtggttccggtc

SEQ ID NO: 29232 - DNA, 21 bp, Artificial sequence
  SiRNA target sequence
cagggaaagtggttccggtcc

SEQ ID NO: 29233 - DNA, 21 bp, Artificial sequence
  SiRNA target sequence
agggaaagtggttccggtccc

SEQ ID NO: 29234 - DNA, 21 bp, Artificial sequence
  SiRNA target sequence
gggaaagtggttccggtccca

SEQ ID NO: 29235 - DNA, 21 bp, Artificial sequence
  SiRNA target sequence
ggaaagtggttccggtcccat

SEQ ID NO: 29236 - DNA, 21 bp, Artificial sequence
  SiRNA target sequence
gaaagtggttccggtcccata

SEQ ID NO: 29237 - DNA, 21 bp, Artificial sequence
  SiRNA target sequence
aaagtggttccggtcccatac

SEQ ID NO: 29238 - DNA, 21 bp, Artificial sequence
  SiRNA target sequence
aagtggttccggtcccatacc

SEQ ID NO: 29239 - DNA, 21 bp, Artificial sequence
  SiRNA target sequence
agtggttccggtcccatacca

SEQ ID NO: 29240 - DNA, 21 bp, Artificial sequence
  SiRNA target sequence
gtggttccggtcccataccat

SEQ ID NO: 29241 - DNA, 21 bp, Artificial sequence
  SiRNA target sequence
tggttccggtcccataccatc

SEQ ID NO: 29242 - DNA, 21 bp, Artificial sequence
  SiRNA target sequence
ggttccggtcccataccatca

SEQ ID NO: 29243 - DNA, 21 bp, Artificial sequence
  SiRNA target sequence
gttccggtcccataccatcat

SEQ ID NO: 29244 - DNA, 21 bp, Artificial sequence
  SiRNA target sequence
ttccggtcccataccatcata

SEQ ID NO: 29245 - DNA, 21 bp, Artificial sequence
  SiRNA target sequence
tccggtcccataccatcataa

SEQ ID NO: 29246 - DNA, 21 bp, Artificial sequence
  SiRNA target sequence
ccggtcccataccatcataag

SEQ ID NO: 29247 - DNA, 21 bp, Artificial sequence
  SiRNA target sequence
cggtcccataccatcataagt

SEQ ID NO: 29248 - DNA, 21 bp, Artificial sequence
  SiRNA target sequence
ggtcccataccatcataagta

SEQ ID NO: 29249 - DNA, 21 bp, Artificial sequence
  SiRNA target sequence
gtcccataccatcataagtac

SEQ ID NO: 29250 - DNA, 21 bp, Artificial sequence
  SiRNA target sequence
tcccataccatcataagtacc

SEQ ID NO: 29251 - DNA, 21 bp, Artificial sequence
  SiRNA target sequence
cccataccatcataagtacca

SEQ ID NO: 29252 - DNA, 21 bp, Artificial sequence
  SiRNA target sequence
ccataccatcataagtaccaa

SEQ ID NO: 29253 - DNA, 21 bp, Artificial sequence
  SiRNA target sequence
cataccatcataagtaccaat

SEQ ID NO: 29254 - DNA, 21 bp, Artificial sequence
  SiRNA target sequence
ataccatcataagtaccaatc

SEQ ID NO: 29255 - DNA, 21 bp, Artificial sequence
  SiRNA target sequence
taccatcataagtaccaatca

SEQ ID NO: 29256 - DNA, 21 bp, Artificial sequence
  SiRNA target sequence
accatcataagtaccaatcaa

SEQ ID NO: 29257 - DNA, 21 bp, Artificial sequence
  SiRNA target sequence
ccatcataagtaccaatcaac

SEQ ID NO: 29258 - DNA, 21 bp, Artificial sequence
  SiRNA target sequence
catcataagtaccaatcaacc

SEQ ID NO: 29259 - DNA, 21 bp, Artificial sequence
  SiRNA target sequence
atcataagtaccaatcaacca

SEQ ID NO: 29260 - DNA, 21 bp, Artificial sequence
  SiRNA target sequence
tcataagtaccaatcaaccat

SEQ ID NO: 29261 - DNA, 21 bp, Artificial sequence
  SiRNA target sequence
cataagtaccaatcaaccata

SEQ ID NO: 29262 - DNA, 21 bp, Artificial sequence
  SiRNA target sequence
ataagtaccaatcaaccatat

SEQ ID NO: 29263 - DNA, 21 bp, Artificial sequence
  SiRNA target sequence
taagtaccaatcaaccatatc

SEQ ID NO: 29264 - DNA, 21 bp, Artificial sequence
  SiRNA target sequence
aagtaccaatcaaccatatcc

SEQ ID NO: 29265 - DNA, 21 bp, Artificial sequence
  SiRNA target sequence
agtaccaatcaaccatatcct

SEQ ID NO: 29266 - DNA, 21 bp, Artificial sequence
  SiRNA target sequence
gtaccaatcaaccatatcctt

SEQ ID NO: 29267 - DNA, 21 bp, Artificial sequence
  SiRNA target sequence
taccaatcaaccatatcctta

SEQ ID NO: 29268 - DNA, 21 bp, Artificial sequence
  SiRNA target sequence
accaatcaaccatatccttat

SEQ ID NO: 29269 - DNA, 21 bp, Artificial sequence
  SiRNA target sequence
ccaatcaaccatatccttatc

SEQ ID NO: 29270 - DNA, 21 bp, Artificial sequence
  SiRNA target sequence
caatcaaccatatccttatcc

SEQ ID NO: 29271 - DNA, 21 bp, Artificial sequence
  SiRNA target sequence
aatcaaccatatccttatccc

SEQ ID NO: 29272 - DNA, 21 bp, Artificial sequence
  SiRNA target sequence
atcaaccatatccttatccca

SEQ ID NO: 29273 - DNA, 21 bp, Artificial sequence
  SiRNA target sequence
tcaaccatatccttatcccat

SEQ ID NO: 29274 - DNA, 21 bp, Artificial sequence
  SiRNA target sequence
caaccatatccttatcccatt

SEQ ID NO: 29275 - DNA, 21 bp, Artificial sequence
  SiRNA target sequence
aaccatatccttatcccattg

SEQ ID NO: 29276 - DNA, 21 bp, Artificial sequence
  SiRNA target sequence
accatatccttatcccattgt

SEQ ID NO: 29277 - DNA, 21 bp, Artificial sequence
  SiRNA target sequence
ccatatccttatcccattgtc

SEQ ID NO: 29278 - DNA, 21 bp, Artificial sequence
  SiRNA target sequence
catatccttatcccattgtca

SEQ ID NO: 29279 - DNA, 21 bp, Artificial sequence
  SiRNA target sequence
atatccttatcccattgtcaa

SEQ ID NO: 29280 - DNA, 21 bp, Artificial sequence
  SiRNA target sequence
tatccttatcccattgtcaaa

SEQ ID NO: 29281 - DNA, 21 bp, Artificial sequence
  SiRNA target sequence
atccttatcccattgtcaaaa

SEQ ID NO: 29282 - DNA, 21 bp, Artificial sequence
  SiRNA target sequence
tccttatcccattgtcaaaat

SEQ ID NO: 29283 - DNA, 21 bp, Artificial sequence
  SiRNA target sequence
ccttatcccattgtcaaaatt

SEQ ID NO: 29284 - DNA, 21 bp, Artificial sequence
  SiRNA target sequence
cttatcccattgtcaaaattc

SEQ ID NO: 29285 - DNA, 21 bp, Artificial sequence
  SiRNA target sequence
ttatcccattgtcaaaattca

SEQ ID NO: 29286 - DNA, 21 bp, Artificial sequence
  SiRNA target sequence
tatcccattgtcaaaattcac

SEQ ID NO: 29287 - DNA, 21 bp, Artificial sequence
  SiRNA target sequence
atcccattgtcaaaattcaca

SEQ ID NO: 29288 - DNA, 21 bp, Artificial sequence
  SiRNA target sequence
tcccattgtcaaaattcacaa

SEQ ID NO: 29289 - DNA, 21 bp, Artificial sequence
  SiRNA target sequence
cccattgtcaaaattcacaag

SEQ ID NO: 29290 - DNA, 21 bp, Artificial sequence
  SiRNA target sequence
ccattgtcaaaattcacaaga

SEQ ID NO: 29291 - DNA, 21 bp, Artificial sequence
  SiRNA target sequence
cattgtcaaaattcacaagat

SEQ ID NO: 29292 - DNA, 21 bp, Artificial sequence
  SiRNA target sequence
attgtcaaaattcacaagata

SEQ ID NO: 29293 - DNA, 21 bp, Artificial sequence
  SiRNA target sequence
ttgtcaaaattcacaagatag

SEQ ID NO: 29294 - DNA, 21 bp, Artificial sequence
  SiRNA target sequence
tgtcaaaattcacaagataga

SEQ ID NO: 29295 - DNA, 21 bp, Artificial sequence
  SiRNA target sequence
gtcaaaattcacaagatagac

SEQ ID NO: 29296 - DNA, 21 bp, Artificial sequence
  SiRNA target sequence
tcaaaattcacaagatagaca

SEQ ID NO: 29297 - DNA, 21 bp, Artificial sequence
  SiRNA target sequence
caaaattcacaagatagacac

SEQ ID NO: 29298 - DNA, 21 bp, Artificial sequence
  SiRNA target sequence
aaaattcacaagatagacaca

SEQ ID NO: 29299 - DNA, 21 bp, Artificial sequence
  SiRNA target sequence
aaattcacaagatagacacac

SEQ ID NO: 29300 - DNA, 21 bp, Artificial sequence
  SiRNA target sequence
aattcacaagatagacacaca

SEQ ID NO: 29301 - DNA, 21 bp, Artificial sequence
  SiRNA target sequence
attcacaagatagacacacaa

SEQ ID NO: 29302 - DNA, 21 bp, Artificial sequence
  SiRNA target sequence
ttcacaagatagacacacaag

SEQ ID NO: 29303 - DNA, 21 bp, Artificial sequence
  SiRNA target sequence
tcacaagatagacacacaagc

SEQ ID NO: 29304 - DNA, 21 bp, Artificial sequence
  SiRNA target sequence
cacaagatagacacacaagcc

SEQ ID NO: 29305 - DNA, 21 bp, Artificial sequence
  SiRNA target sequence
acaagatagacacacaagcca

SEQ ID NO: 29306 - DNA, 21 bp, Artificial sequence
  SiRNA target sequence
caagatagacacacaagccac

SEQ ID NO: 29307 - DNA, 21 bp, Artificial sequence
  SiRNA target sequence
aagatagacacacaagccacg

SEQ ID NO: 29308 - DNA, 21 bp, Artificial sequence
  SiRNA target sequence
agatagacacacaagccacgc

SEQ ID NO: 29309 - DNA, 21 bp, Artificial sequence
  SiRNA target sequence
gatagacacacaagccacgct

SEQ ID NO: 29310 - DNA, 21 bp, Artificial sequence
  SiRNA target sequence
atagacacacaagccacgctc

SEQ ID NO: 29311 - DNA, 21 bp, Artificial sequence
  SiRNA target sequence
tagacacacaagccacgctct

SEQ ID NO: 29312 - DNA, 21 bp, Artificial sequence
  SiRNA target sequence
agacacacaagccacgctctc

SEQ ID NO: 29313 - DNA, 21 bp, Artificial sequence
  SiRNA target sequence
gacacacaagccacgctctca

SEQ ID NO: 29314 - DNA, 21 bp, Artificial sequence
  SiRNA target sequence
acacacaagccacgctctcag

SEQ ID NO: 29315 - DNA, 21 bp, Artificial sequence
  SiRNA target sequence
cacacaagccacgctctcaga

SEQ ID NO: 29316 - DNA, 21 bp, Artificial sequence
  SiRNA target sequence
acacaagccacgctctcagaa

SEQ ID NO: 29317 - DNA, 21 bp, Artificial sequence
  SiRNA target sequence
cacaagccacgctctcagaac

SEQ ID NO: 29318 - DNA, 21 bp, Artificial sequence
  SiRNA target sequence
acaagccacgctctcagaact

SEQ ID NO: 29319 - DNA, 21 bp, Artificial sequence
  SiRNA target sequence
caagccacgctctcagaactc

SEQ ID NO: 29320 - DNA, 21 bp, Artificial sequence
  SiRNA target sequence
aagccacgctctcagaactcc

SEQ ID NO: 29321 - DNA, 21 bp, Artificial sequence
  SiRNA target sequence
agccacgctctcagaactccg

SEQ ID NO: 29322 - DNA, 21 bp, Artificial sequence
  SiRNA target sequence
gccacgctctcagaactccgc

SEQ ID NO: 29323 - DNA, 21 bp, Artificial sequence
  SiRNA target sequence
ccacgctctcagaactccgcc

SEQ ID NO: 29324 - DNA, 21 bp, Artificial sequence
  SiRNA target sequence
cacgctctcagaactccgcct

SEQ ID NO: 29325 - DNA, 21 bp, Artificial sequence
  SiRNA target sequence
acgctctcagaactccgcctg

SEQ ID NO: 29326 - DNA, 21 bp, Artificial sequence
  SiRNA target sequence
cgctctcagaactccgcctgc

SEQ ID NO: 29327 - DNA, 21 bp, Artificial sequence
  SiRNA target sequence
gctctcagaactccgcctgct

SEQ ID NO: 29328 - DNA, 21 bp, Artificial sequence
  SiRNA target sequence
ctctcagaactccgcctgctt

SEQ ID NO: 29329 - DNA, 21 bp, Artificial sequence
  SiRNA target sequence
tctcagaactccgcctgcttg

SEQ ID NO: 29330 - DNA, 21 bp, Artificial sequence
  SiRNA target sequence
ctcagaactccgcctgcttga

SEQ ID NO: 29331 - DNA, 21 bp, Artificial sequence
  SiRNA target sequence
tcagaactccgcctgcttgag

SEQ ID NO: 29332 - DNA, 21 bp, Artificial sequence
  SiRNA target sequence
cagaactccgcctgcttgagg

SEQ ID NO: 29333 - DNA, 21 bp, Artificial sequence
  SiRNA target sequence
agaactccgcctgcttgaggg

SEQ ID NO: 29334 - DNA, 21 bp, Artificial sequence
  SiRNA target sequence
gaactccgcctgcttgagggc

SEQ ID NO: 29335 - DNA, 21 bp, Artificial sequence
  SiRNA target sequence
aactccgcctgcttgagggcc

SEQ ID NO: 29336 - DNA, 21 bp, Artificial sequence
  SiRNA target sequence
actccgcctgcttgagggccc

SEQ ID NO: 29337 - DNA, 21 bp, Artificial sequence
  SiRNA target sequence
ctccgcctgcttgagggccca

SEQ ID NO: 29338 - DNA, 21 bp, Artificial sequence
  SiRNA target sequence
tccgcctgcttgagggcccag

SEQ ID NO: 29339 - DNA, 21 bp, Artificial sequence
  SiRNA target sequence
ccgcctgcttgagggcccaga

SEQ ID NO: 29340 - DNA, 21 bp, Artificial sequence
  SiRNA target sequence
cgcctgcttgagggcccagac

SEQ ID NO: 29341 - DNA, 21 bp, Artificial sequence
  SiRNA target sequence
gcctgcttgagggcccagacg

SEQ ID NO: 29342 - DNA, 21 bp, Artificial sequence
  SiRNA target sequence
cctgcttgagggcccagacga

SEQ ID NO: 29343 - DNA, 21 bp, Artificial sequence
  SiRNA target sequence
ctgcttgagggcccagacgag

SEQ ID NO: 29344 - DNA, 21 bp, Artificial sequence
  SiRNA target sequence
tgcttgagggcccagacgagt

SEQ ID NO: 29345 - DNA, 21 bp, Artificial sequence
  SiRNA target sequence
gcttgagggcccagacgagtg

SEQ ID NO: 29346 - DNA, 21 bp, Artificial sequence
  SiRNA target sequence
cttgagggcccagacgagtgg

SEQ ID NO: 29347 - DNA, 21 bp, Artificial sequence
  SiRNA target sequence
ttgagggcccagacgagtggc

SEQ ID NO: 29348 - DNA, 21 bp, Artificial sequence
  SiRNA target sequence
tgagggcccagacgagtggct

SEQ ID NO: 29349 - DNA, 21 bp, Artificial sequence
  SiRNA target sequence
gagggcccagacgagtggctt

SEQ ID NO: 29350 - DNA, 21 bp, Artificial sequence
  SiRNA target sequence
agggcccagacgagtggcttt

SEQ ID NO: 29351 - DNA, 21 bp, Artificial sequence
  SiRNA target sequence
gggcccagacgagtggctttt

SEQ ID NO: 29352 - DNA, 21 bp, Artificial sequence
  SiRNA target sequence
ggcccagacgagtggcttttg

SEQ ID NO: 29353 - DNA, 21 bp, Artificial sequence
  SiRNA target sequence
gcccagacgagtggcttttgg

SEQ ID NO: 29354 - DNA, 21 bp, Artificial sequence
  SiRNA target sequence
cccagacgagtggcttttggt

SEQ ID NO: 29355 - DNA, 21 bp, Artificial sequence
  SiRNA target sequence
ccagacgagtggcttttggtc

SEQ ID NO: 29356 - DNA, 21 bp, Artificial sequence
  SiRNA target sequence
cagacgagtggcttttggtca

SEQ ID NO: 29357 - DNA, 21 bp, Artificial sequence
  SiRNA target sequence
agacgagtggcttttggtcac

SEQ ID NO: 29358 - DNA, 21 bp, Artificial sequence
  SiRNA target sequence
gacgagtggcttttggtcact

SEQ ID NO: 29359 - DNA, 21 bp, Artificial sequence
  SiRNA target sequence
acgagtggcttttggtcactg

SEQ ID NO: 29360 - DNA, 21 bp, Artificial sequence
  SiRNA target sequence
cgagtggcttttggtcactgc

SEQ ID NO: 29361 - DNA, 21 bp, Artificial sequence
  SiRNA target sequence
gagtggcttttggtcactgct

SEQ ID NO: 29362 - DNA, 21 bp, Artificial sequence
  SiRNA target sequence
agtggcttttggtcactgctc

SEQ ID NO: 29363 - DNA, 21 bp, Artificial sequence
  SiRNA target sequence
gtggcttttggtcactgctcg

SEQ ID NO: 29364 - DNA, 21 bp, Artificial sequence
  SiRNA target sequence
tggcttttggtcactgctcgc

SEQ ID NO: 29365 - DNA, 21 bp, Artificial sequence
  SiRNA target sequence
ggcttttggtcactgctcgcc

SEQ ID NO: 29366 - DNA, 21 bp, Artificial sequence
  SiRNA target sequence
gcttttggtcactgctcgcca

SEQ ID NO: 29367 - DNA, 21 bp, Artificial sequence
  SiRNA target sequence
cttttggtcactgctcgccag

SEQ ID NO: 29368 - DNA, 21 bp, Artificial sequence
  SiRNA target sequence
ttttggtcactgctcgccagc

SEQ ID NO: 29369 - DNA, 21 bp, Artificial sequence
  SiRNA target sequence
tttggtcactgctcgccagct

SEQ ID NO: 29370 - DNA, 21 bp, Artificial sequence
  SiRNA target sequence
ttggtcactgctcgccagctt

SEQ ID NO: 29371 - DNA, 21 bp, Artificial sequence
  SiRNA target sequence
tggtcactgctcgccagcttg

SEQ ID NO: 29372 - DNA, 21 bp, Artificial sequence
  SiRNA target sequence
ggtcactgctcgccagcttga

SEQ ID NO: 29373 - DNA, 21 bp, Artificial sequence
  SiRNA target sequence
gtcactgctcgccagcttgac

SEQ ID NO: 29374 - DNA, 21 bp, Artificial sequence
  SiRNA target sequence
tcactgctcgccagcttgact

SEQ ID NO: 29375 - DNA, 21 bp, Artificial sequence
  SiRNA target sequence
cactgctcgccagcttgactt

SEQ ID NO: 29376 - DNA, 21 bp, Artificial sequence
  SiRNA target sequence
actgctcgccagcttgacttc

SEQ ID NO: 29377 - DNA, 21 bp, Artificial sequence
  SiRNA target sequence
ctgctcgccagcttgacttct

SEQ ID NO: 29378 - DNA, 21 bp, Artificial sequence
  SiRNA target sequence
tgctcgccagcttgacttctc

SEQ ID NO: 29379 - DNA, 21 bp, Artificial sequence
  SiRNA target sequence
gctcgccagcttgacttctcc

SEQ ID NO: 29380 - DNA, 21 bp, Artificial sequence
  SiRNA target sequence
ctcgccagcttgacttctcct

SEQ ID NO: 29381 - DNA, 21 bp, Artificial sequence
  SiRNA target sequence
tcgccagcttgacttctcctt

SEQ ID NO: 29382 - DNA, 21 bp, Artificial sequence
  SiRNA target sequence
cgccagcttgacttctcctta

SEQ ID NO: 29383 - DNA, 21 bp, Artificial sequence
  SiRNA target sequence
gccagcttgacttctccttat

SEQ ID NO: 29384 - DNA, 21 bp, Artificial sequence
  SiRNA target sequence
ccagcttgacttctccttata

SEQ ID NO: 29385 - DNA, 21 bp, Artificial sequence
  SiRNA target sequence
cagcttgacttctccttatat

SEQ ID NO: 29386 - DNA, 21 bp, Artificial sequence
  SiRNA target sequence
agcttgacttctccttatatg

SEQ ID NO: 29387 - DNA, 21 bp, Artificial sequence
  SiRNA target sequence
gcttgacttctccttatatgt

SEQ ID NO: 29388 - DNA, 21 bp, Artificial sequence
  SiRNA target sequence
cttgacttctccttatatgtc

SEQ ID NO: 29389 - DNA, 21 bp, Artificial sequence
  SiRNA target sequence
ttgacttctccttatatgtca

SEQ ID NO: 29390 - DNA, 21 bp, Artificial sequence
  SiRNA target sequence
tgacttctccttatatgtcac

SEQ ID NO: 29391 - DNA, 21 bp, Artificial sequence
  SiRNA target sequence
gacttctccttatatgtcacc

SEQ ID NO: 29392 - DNA, 21 bp, Artificial sequence
  SiRNA target sequence
acttctccttatatgtcaccg

SEQ ID NO: 29393 - DNA, 21 bp, Artificial sequence
  SiRNA target sequence
cttctccttatatgtcaccga

SEQ ID NO: 29394 - DNA, 21 bp, Artificial sequence
  SiRNA target sequence
ttctccttatatgtcaccgac

SEQ ID NO: 29395 - DNA, 21 bp, Artificial sequence
  SiRNA target sequence
tctccttatatgtcaccgaca

SEQ ID NO: 29396 - DNA, 21 bp, Artificial sequence
  SiRNA target sequence
ctccttatatgtcaccgacaa

SEQ ID NO: 29397 - DNA, 21 bp, Artificial sequence
  SiRNA target sequence
tccttatatgtcaccgacaat

SEQ ID NO: 29398 - DNA, 21 bp, Artificial sequence
  SiRNA target sequence
ccttatatgtcaccgacaatc

SEQ ID NO: 29399 - DNA, 21 bp, Artificial sequence
  SiRNA target sequence
cttatatgtcaccgacaatct

SEQ ID NO: 29400 - DNA, 21 bp, Artificial sequence
  SiRNA target sequence
ttatatgtcaccgacaatctt

SEQ ID NO: 29401 - DNA, 21 bp, Artificial sequence
  SiRNA target sequence
tatatgtcaccgacaatcttg

SEQ ID NO: 29402 - DNA, 21 bp, Artificial sequence
  SiRNA target sequence
atatgtcaccgacaatcttga

SEQ ID NO: 29403 - DNA, 21 bp, Artificial sequence
  SiRNA target sequence
tatgtcaccgacaatcttgac

SEQ ID NO: 29404 - DNA, 21 bp, Artificial sequence
  SiRNA target sequence
atgtcaccgacaatcttgacg

SEQ ID NO: 29405 - DNA, 21 bp, Artificial sequence
  SiRNA target sequence
tgtcaccgacaatcttgacga

SEQ ID NO: 29406 - DNA, 21 bp, Artificial sequence
  SiRNA target sequence
gtcaccgacaatcttgacgaa

SEQ ID NO: 29407 - DNA, 21 bp, Artificial sequence
  SiRNA target sequence
tcaccgacaatcttgacgaac

SEQ ID NO: 29408 - DNA, 21 bp, Artificial sequence
  SiRNA target sequence
caccgacaatcttgacgaacc

SEQ ID NO: 29409 - DNA, 21 bp, Artificial sequence
  SiRNA target sequence
accgacaatcttgacgaaccc

SEQ ID NO: 29410 - DNA, 21 bp, Artificial sequence
  SiRNA target sequence
ccgacaatcttgacgaaccca

SEQ ID NO: 29411 - DNA, 21 bp, Artificial sequence
  SiRNA target sequence
cgacaatcttgacgaacccaa

SEQ ID NO: 29412 - DNA, 21 bp, Artificial sequence
  SiRNA target sequence
gacaatcttgacgaacccaaa

SEQ ID NO: 29413 - DNA, 21 bp, Artificial sequence
  SiRNA target sequence
acaatcttgacgaacccaaat

SEQ ID NO: 29414 - DNA, 21 bp, Artificial sequence
  SiRNA target sequence
caatcttgacgaacccaaata

SEQ ID NO: 29415 - DNA, 21 bp, Artificial sequence
  SiRNA target sequence
aatcttgacgaacccaaatat

SEQ ID NO: 29416 - DNA, 21 bp, Artificial sequence
  SiRNA target sequence
atcttgacgaacccaaatatc

SEQ ID NO: 29417 - DNA, 21 bp, Artificial sequence
  SiRNA target sequence
tcttgacgaacccaaatatcc

SEQ ID NO: 29418 - DNA, 21 bp, Artificial sequence
  SiRNA target sequence
cttgacgaacccaaatatcct

SEQ ID NO: 29419 - DNA, 21 bp, Artificial sequence
  SiRNA target sequence
ttgacgaacccaaatatccta

SEQ ID NO: 29420 - DNA, 21 bp, Artificial sequence
  SiRNA target sequence
tgacgaacccaaatatcctaa

SEQ ID NO: 29421 - DNA, 21 bp, Artificial sequence
  SiRNA target sequence
gacgaacccaaatatcctaag

SEQ ID NO: 29422 - DNA, 21 bp, Artificial sequence
  SiRNA target sequence
acgaacccaaatatcctaagt

SEQ ID NO: 29423 - DNA, 21 bp, Artificial sequence
  SiRNA target sequence
cgaacccaaatatcctaagta

SEQ ID NO: 29424 - DNA, 21 bp, Artificial sequence
  SiRNA target sequence
gaacccaaatatcctaagtac

SEQ ID NO: 29425 - DNA, 21 bp, Artificial sequence
  SiRNA target sequence
aacccaaatatcctaagtacg

SEQ ID NO: 29426 - DNA, 21 bp, Artificial sequence
  SiRNA target sequence
acccaaatatcctaagtacga

SEQ ID NO: 29427 - DNA, 21 bp, Artificial sequence
  SiRNA target sequence
cccaaatatcctaagtacgac

SEQ ID NO: 29428 - DNA, 21 bp, Artificial sequence
  SiRNA target sequence
ccaaatatcctaagtacgact

SEQ ID NO: 29429 - DNA, 21 bp, Artificial sequence
  SiRNA target sequence
caaatatcctaagtacgactg

SEQ ID NO: 29430 - DNA, 21 bp, Artificial sequence
  SiRNA target sequence
aaatatcctaagtacgactgg

SEQ ID NO: 29431 - DNA, 21 bp, Artificial sequence
  SiRNA target sequence
aatatcctaagtacgactggc

SEQ ID NO: 29432 - DNA, 21 bp, Artificial sequence
  SiRNA target sequence
atatcctaagtacgactggct

SEQ ID NO: 29433 - DNA, 21 bp, Artificial sequence
  SiRNA target sequence
tatcctaagtacgactggctt

SEQ ID NO: 29434 - DNA, 21 bp, Artificial sequence
  SiRNA target sequence
atcctaagtacgactggcttg

SEQ ID NO: 29435 - DNA, 21 bp, Artificial sequence
  SiRNA target sequence
tcctaagtacgactggcttgg

SEQ ID NO: 29436 - DNA, 21 bp, Artificial sequence
  SiRNA target sequence
cctaagtacgactggcttgga

SEQ ID NO: 29437 - DNA, 21 bp, Artificial sequence
  SiRNA target sequence
ctaagtacgactggcttggaa

SEQ ID NO: 29438 - DNA, 21 bp, Artificial sequence
  SiRNA target sequence
taagtacgactggcttggaag

SEQ ID NO: 29439 - DNA, 21 bp, Artificial sequence
  SiRNA target sequence
aagtacgactggcttggaagc

SEQ ID NO: 29440 - DNA, 21 bp, Artificial sequence
  SiRNA target sequence
agtacgactggcttggaagcg

SEQ ID NO: 29441 - DNA, 21 bp, Artificial sequence
  SiRNA target sequence
gtacgactggcttggaagcgg

SEQ ID NO: 29442 - DNA, 21 bp, Artificial sequence
  SiRNA target sequence
tacgactggcttggaagcggt

SEQ ID NO: 29443 - DNA, 21 bp, Artificial sequence
  SiRNA target sequence
acgactggcttggaagcggtg

SEQ ID NO: 29444 - DNA, 21 bp, Artificial sequence
  SiRNA target sequence
cgactggcttggaagcggtgg

SEQ ID NO: 29445 - DNA, 21 bp, Artificial sequence
  SiRNA target sequence
gactggcttggaagcggtggc

SEQ ID NO: 29446 - DNA, 21 bp, Artificial sequence
  SiRNA target sequence
actggcttggaagcggtggct

SEQ ID NO: 29447 - DNA, 21 bp, Artificial sequence
  SiRNA target sequence
ctggcttggaagcggtggctc

SEQ ID NO: 29448 - DNA, 21 bp, Artificial sequence
  SiRNA target sequence
tggcttggaagcggtggctct

SEQ ID NO: 29449 - DNA, 21 bp, Artificial sequence
  SiRNA target sequence
ggcttggaagcggtggctctt

SEQ ID NO: 29450 - DNA, 21 bp, Artificial sequence
  SiRNA target sequence
gcttggaagcggtggctctta

SEQ ID NO: 29451 - DNA, 21 bp, Artificial sequence
  SiRNA target sequence
cttggaagcggtggctcttac

SEQ ID NO: 29452 - DNA, 21 bp, Artificial sequence
  SiRNA target sequence
ttggaagcggtggctcttact

SEQ ID NO: 29453 - DNA, 21 bp, Artificial sequence
  SiRNA target sequence
tggaagcggtggctcttactg

SEQ ID NO: 29454 - DNA, 21 bp, Artificial sequence
  SiRNA target sequence
ggaagcggtggctcttactgt

SEQ ID NO: 29455 - DNA, 21 bp, Artificial sequence
  SiRNA target sequence
gaagcggtggctcttactgtt

SEQ ID NO: 29456 - DNA, 21 bp, Artificial sequence
  SiRNA target sequence
aagcggtggctcttactgttt

SEQ ID NO: 29457 - DNA, 21 bp, Artificial sequence
  SiRNA target sequence
agcggtggctcttactgtttg

SEQ ID NO: 29458 - DNA, 21 bp, Artificial sequence
  SiRNA target sequence
gcggtggctcttactgtttgg

SEQ ID NO: 29459 - DNA, 21 bp, Artificial sequence
  SiRNA target sequence
cggtggctcttactgtttggt

SEQ ID NO: 29460 - DNA, 21 bp, Artificial sequence
  SiRNA target sequence
ggtggctcttactgtttggta

SEQ ID NO: 29461 - DNA, 21 bp, Artificial sequence
  SiRNA target sequence
gtggctcttactgtttggtac

SEQ ID NO: 29462 - DNA, 21 bp, Artificial sequence
  SiRNA target sequence
tggctcttactgtttggtaca

SEQ ID NO: 29463 - DNA, 21 bp, Artificial sequence
  SiRNA target sequence
ggctcttactgtttggtacag

SEQ ID NO: 29464 - DNA, 21 bp, Artificial sequence
  SiRNA target sequence
gctcttactgtttggtacagc

SEQ ID NO: 29465 - DNA, 21 bp, Artificial sequence
  SiRNA target sequence
ctcttactgtttggtacagcc

SEQ ID NO: 29466 - DNA, 21 bp, Artificial sequence
  SiRNA target sequence
tcttactgtttggtacagcct

SEQ ID NO: 29467 - DNA, 21 bp, Artificial sequence
  SiRNA target sequence
cttactgtttggtacagcctg

SEQ ID NO: 29468 - DNA, 21 bp, Artificial sequence
  SiRNA target sequence
ttactgtttggtacagcctga

SEQ ID NO: 29469 - DNA, 21 bp, Artificial sequence
  SiRNA target sequence
tactgtttggtacagcctgac

SEQ ID NO: 29470 - DNA, 21 bp, Artificial sequence
  SiRNA target sequence
actgtttggtacagcctgacc

SEQ ID NO: 29471 - DNA, 21 bp, Artificial sequence
  SiRNA target sequence
ctgtttggtacagcctgaccg

SEQ ID NO: 29472 - DNA, 21 bp, Artificial sequence
  SiRNA target sequence
tgtttggtacagcctgaccgg

SEQ ID NO: 29473 - DNA, 21 bp, Artificial sequence
  SiRNA target sequence
gtttggtacagcctgaccggt

SEQ ID NO: 29474 - DNA, 21 bp, Artificial sequence
  SiRNA target sequence
tttggtacagcctgaccggtt

SEQ ID NO: 29475 - DNA, 21 bp, Artificial sequence
  SiRNA target sequence
ttggtacagcctgaccggttc

SEQ ID NO: 29476 - DNA, 21 bp, Artificial sequence
  SiRNA target sequence
tggtacagcctgaccggttct

SEQ ID NO: 29477 - DNA, 21 bp, Artificial sequence
  SiRNA target sequence
ggtacagcctgaccggttctt

SEQ ID NO: 29478 - DNA, 21 bp, Artificial sequence
  SiRNA target sequence
gtacagcctgaccggttcttc

SEQ ID NO: 29479 - DNA, 21 bp, Artificial sequence
  SiRNA target sequence
tacagcctgaccggttcttcc

SEQ ID NO: 29480 - DNA, 21 bp, Artificial sequence
  SiRNA target sequence
acagcctgaccggttcttccc

SEQ ID NO: 29481 - DNA, 21 bp, Artificial sequence
  SiRNA target sequence
cagcctgaccggttcttccca

SEQ ID NO: 29482 - DNA, 21 bp, Artificial sequence
  SiRNA target sequence
agcctgaccggttcttcccac

SEQ ID NO: 29483 - DNA, 21 bp, Artificial sequence
  SiRNA target sequence
gcctgaccggttcttcccact

SEQ ID NO: 29484 - DNA, 21 bp, Artificial sequence
  SiRNA target sequence
cctgaccggttcttcccactt

SEQ ID NO: 29485 - DNA, 21 bp, Artificial sequence
  SiRNA target sequence
ctgaccggttcttcccacttc

SEQ ID NO: 29486 - DNA, 21 bp, Artificial sequence
  SiRNA target sequence
tgaccggttcttcccacttca

SEQ ID NO: 29487 - DNA, 21 bp, Artificial sequence
  SiRNA target sequence
gaccggttcttcccacttcaa

SEQ ID NO: 29488 - DNA, 21 bp, Artificial sequence
  SiRNA target sequence
accggttcttcccacttcaac

SEQ ID NO: 29489 - DNA, 21 bp, Artificial sequence
  SiRNA target sequence
ccggttcttcccacttcaacc

SEQ ID NO: 29490 - DNA, 21 bp, Artificial sequence
  SiRNA target sequence
cggttcttcccacttcaaccc

SEQ ID NO: 29491 - DNA, 21 bp, Artificial sequence
  SiRNA target sequence
ggttcttcccacttcaacccc

SEQ ID NO: 29492 - DNA, 21 bp, Artificial sequence
  SiRNA target sequence
gttcttcccacttcaacccct

SEQ ID NO: 29493 - DNA, 21 bp, Artificial sequence
  SiRNA target sequence
ttcttcccacttcaacccctt

SEQ ID NO: 29494 - DNA, 21 bp, Artificial sequence
  SiRNA target sequence
tcttcccacttcaaccccttg

SEQ ID NO: 29495 - DNA, 21 bp, Artificial sequence
  SiRNA target sequence
cttcccacttcaaccccttgc

SEQ ID NO: 29496 - DNA, 21 bp, Artificial sequence
  SiRNA target sequence
ttcccacttcaaccccttgca

SEQ ID NO: 29497 - DNA, 21 bp, Artificial sequence
  SiRNA target sequence
tcccacttcaaccccttgcac

SEQ ID NO: 29498 - DNA, 21 bp, Artificial sequence
  SiRNA target sequence
cccacttcaaccccttgcacg

SEQ ID NO: 29499 - DNA, 21 bp, Artificial sequence
  SiRNA target sequence
ccacttcaaccccttgcacgc

SEQ ID NO: 29500 - DNA, 21 bp, Artificial sequence
  SiRNA target sequence
cacttcaaccccttgcacgcg

SEQ ID NO: 29501 - DNA, 21 bp, Artificial sequence
  SiRNA target sequence
acttcaaccccttgcacgcgc

SEQ ID NO: 29502 - DNA, 21 bp, Artificial sequence
  SiRNA target sequence
cttcaaccccttgcacgcgcc

SEQ ID NO: 29503 - DNA, 21 bp, Artificial sequence
  SiRNA target sequence
ttcaaccccttgcacgcgccg

SEQ ID NO: 29504 - DNA, 21 bp, Artificial sequence
  SiRNA target sequence
tcaaccccttgcacgcgccga

SEQ ID NO: 29505 - DNA, 21 bp, Artificial sequence
  SiRNA target sequence
caaccccttgcacgcgccgac

SEQ ID NO: 29506 - DNA, 21 bp, Artificial sequence
  SiRNA target sequence
aaccccttgcacgcgccgaca

SEQ ID NO: 29507 - DNA, 21 bp, Artificial sequence
  SiRNA target sequence
accccttgcacgcgccgacaa

SEQ ID NO: 29508 - DNA, 21 bp, Artificial sequence
  SiRNA target sequence
ccccttgcacgcgccgacaac

SEQ ID NO: 29509 - DNA, 21 bp, Artificial sequence
  SiRNA target sequence
cccttgcacgcgccgacaacc

SEQ ID NO: 29510 - DNA, 21 bp, Artificial sequence
  SiRNA target sequence
ccttgcacgcgccgacaaccc

SEQ ID NO: 29511 - DNA, 21 bp, Artificial sequence
  SiRNA target sequence
cttgcacgcgccgacaaccct

SEQ ID NO: 29512 - DNA, 21 bp, Artificial sequence
  SiRNA target sequence
ttgcacgcgccgacaaccctg

SEQ ID NO: 29513 - DNA, 21 bp, Artificial sequence
  SiRNA target sequence
tgcacgcgccgacaaccctga

SEQ ID NO: 29514 - DNA, 21 bp, Artificial sequence
  SiRNA target sequence
gcacgcgccgacaaccctgac

SEQ ID NO: 29515 - DNA, 21 bp, Artificial sequence
  SiRNA target sequence
cacgcgccgacaaccctgact

SEQ ID NO: 29516 - DNA, 21 bp, Artificial sequence
  SiRNA target sequence
acgcgccgacaaccctgactc

SEQ ID NO: 29517 - DNA, 21 bp, Artificial sequence
  SiRNA target sequence
cgcgccgacaaccctgactct

SEQ ID NO: 29518 - DNA, 21 bp, Artificial sequence
  SiRNA target sequence
gcgccgacaaccctgactctc

SEQ ID NO: 29519 - DNA, 21 bp, Artificial sequence
  SiRNA target sequence
cgccgacaaccctgactctct

SEQ ID NO: 29520 - DNA, 21 bp, Artificial sequence
  SiRNA target sequence
gccgacaaccctgactctcta

SEQ ID NO: 29521 - DNA, 21 bp, Artificial sequence
  SiRNA target sequence
ccgacaaccctgactctctac

SEQ ID NO: 29522 - DNA, 21 bp, Artificial sequence
  SiRNA target sequence
cgacaaccctgactctctact

SEQ ID NO: 29523 - DNA, 21 bp, Artificial sequence
  SiRNA target sequence
gacaaccctgactctctactc

SEQ ID NO: 29524 - DNA, 21 bp, Artificial sequence
  SiRNA target sequence
acaaccctgactctctactcg

SEQ ID NO: 29525 - DNA, 21 bp, Artificial sequence
  SiRNA target sequence
caaccctgactctctactcga

SEQ ID NO: 29526 - DNA, 21 bp, Artificial sequence
  SiRNA target sequence
aaccctgactctctactcgag

SEQ ID NO: 29527 - DNA, 21 bp, Artificial sequence
  SiRNA target sequence
accctgactctctactcgagg

SEQ ID NO: 29528 - DNA, 21 bp, Artificial sequence
  SiRNA target sequence
ccctgactctctactcgaggt

SEQ ID NO: 29529 - DNA, 21 bp, Artificial sequence
  SiRNA target sequence
cctgactctctactcgaggtc

SEQ ID NO: 29530 - DNA, 21 bp, Artificial sequence
  SiRNA target sequence
ctgactctctactcgaggtct

SEQ ID NO: 29531 - DNA, 21 bp, Artificial sequence
  SiRNA target sequence
tgactctctactcgaggtctt

SEQ ID NO: 29532 - DNA, 21 bp, Artificial sequence
  SiRNA target sequence
gactctctactcgaggtctta

SEQ ID NO: 29533 - DNA, 21 bp, Artificial sequence
  SiRNA target sequence
actctctactcgaggtcttac

SEQ ID NO: 29534 - DNA, 21 bp, Artificial sequence
  SiRNA target sequence
ctctctactcgaggtcttacc

SEQ ID NO: 29535 - DNA, 21 bp, Artificial sequence
  SiRNA target sequence
tctctactcgaggtcttaccc

SEQ ID NO: 29536 - DNA, 21 bp, Artificial sequence
  SiRNA target sequence
ctctactcgaggtcttacccg

SEQ ID NO: 29537 - DNA, 21 bp, Artificial sequence
  SiRNA target sequence
tctactcgaggtcttacccgt

SEQ ID NO: 29538 - DNA, 21 bp, Artificial sequence
  SiRNA target sequence
ctactcgaggtcttacccgtc

SEQ ID NO: 29539 - DNA, 21 bp, Artificial sequence
  SiRNA target sequence
tactcgaggtcttacccgtct

SEQ ID NO: 29540 - DNA, 21 bp, Artificial sequence
  SiRNA target sequence
actcgaggtcttacccgtctt

SEQ ID NO: 29541 - DNA, 21 bp, Artificial sequence
  SiRNA target sequence
ctcgaggtcttacccgtcttg

SEQ ID NO: 29542 - DNA, 21 bp, Artificial sequence
  SiRNA target sequence
tcgaggtcttacccgtcttgg

SEQ ID NO: 29543 - DNA, 21 bp, Artificial sequence
  SiRNA target sequence
cgaggtcttacccgtcttggt

SEQ ID NO: 29544 - DNA, 21 bp, Artificial sequence
  SiRNA target sequence
gaggtcttacccgtcttggta

SEQ ID NO: 29545 - DNA, 21 bp, Artificial sequence
  SiRNA target sequence
aggtcttacccgtcttggtat

SEQ ID NO: 29546 - DNA, 21 bp, Artificial sequence
  SiRNA target sequence
ggtcttacccgtcttggtatc

SEQ ID NO: 29547 - DNA, 21 bp, Artificial sequence
  SiRNA target sequence
gtcttacccgtcttggtatca

SEQ ID NO: 29548 - DNA, 21 bp, Artificial sequence
  SiRNA target sequence
tcttacccgtcttggtatcag

SEQ ID NO: 29549 - DNA, 21 bp, Artificial sequence
  SiRNA target sequence
cttacccgtcttggtatcagc

SEQ ID NO: 29550 - DNA, 21 bp, Artificial sequence
  SiRNA target sequence
ttacccgtcttggtatcagca

SEQ ID NO: 29551 - DNA, 21 bp, Artificial sequence
  SiRNA target sequence
tacccgtcttggtatcagcag

SEQ ID NO: 29552 - DNA, 21 bp, Artificial sequence
  SiRNA target sequence
acccgtcttggtatcagcaga

SEQ ID NO: 29553 - DNA, 21 bp, Artificial sequence
  SiRNA target sequence
cccgtcttggtatcagcagac

SEQ ID NO: 29554 - DNA, 21 bp, Artificial sequence
  SiRNA target sequence
ccgtcttggtatcagcagaca

SEQ ID NO: 29555 - DNA, 21 bp, Artificial sequence
  SiRNA target sequence
cgtcttggtatcagcagacat

SEQ ID NO: 29556 - DNA, 21 bp, Artificial sequence
  SiRNA target sequence
gtcttggtatcagcagacatc

SEQ ID NO: 29557 - DNA, 21 bp, Artificial sequence
  SiRNA target sequence
tcttggtatcagcagacatca

SEQ ID NO: 29558 - DNA, 21 bp, Artificial sequence
  SiRNA target sequence
cttggtatcagcagacatcaa

SEQ ID NO: 29559 - DNA, 21 bp, Artificial sequence
  SiRNA target sequence
ttggtatcagcagacatcaag

SEQ ID NO: 29560 - DNA, 21 bp, Artificial sequence
  SiRNA target sequence
tggtatcagcagacatcaaga

SEQ ID NO: 29561 - DNA, 21 bp, Artificial sequence
  SiRNA target sequence
ggtatcagcagacatcaagat

SEQ ID NO: 29562 - DNA, 21 bp, Artificial sequence
  SiRNA target sequence
gtatcagcagacatcaagata

SEQ ID NO: 29563 - DNA, 21 bp, Artificial sequence
  SiRNA target sequence
tatcagcagacatcaagatat

SEQ ID NO: 29564 - DNA, 21 bp, Artificial sequence
  SiRNA target sequence
atcagcagacatcaagatatc

SEQ ID NO: 29565 - DNA, 21 bp, Artificial sequence
  SiRNA target sequence
tcagcagacatcaagatatcc

SEQ ID NO: 29566 - DNA, 21 bp, Artificial sequence
  SiRNA target sequence
cagcagacatcaagatatcca

SEQ ID NO: 29567 - DNA, 21 bp, Artificial sequence
  SiRNA target sequence
agcagacatcaagatatccaa

SEQ ID NO: 29568 - DNA, 21 bp, Artificial sequence
  SiRNA target sequence
gcagacatcaagatatccaac

SEQ ID NO: 29569 - DNA, 21 bp, Artificial sequence
  SiRNA target sequence
cagacatcaagatatccaaca

SEQ ID NO: 29570 - DNA, 21 bp, Artificial sequence
  SiRNA target sequence
agacatcaagatatccaacat

SEQ ID NO: 29571 - DNA, 21 bp, Artificial sequence
  SiRNA target sequence
gacatcaagatatccaacatc

SEQ ID NO: 29572 - DNA, 21 bp, Artificial sequence
  SiRNA target sequence
acatcaagatatccaacatcc

SEQ ID NO: 29573 - DNA, 21 bp, Artificial sequence
  SiRNA target sequence
catcaagatatccaacatcca

SEQ ID NO: 29574 - DNA, 21 bp, Artificial sequence
  SiRNA target sequence
atcaagatatccaacatccac

SEQ ID NO: 29575 - DNA, 21 bp, Artificial sequence
  SiRNA target sequence
tcaagatatccaacatccacc

SEQ ID NO: 29576 - DNA, 21 bp, Artificial sequence
  SiRNA target sequence
caagatatccaacatccaccg

SEQ ID NO: 29577 - DNA, 21 bp, Artificial sequence
  SiRNA target sequence
aagatatccaacatccaccga

SEQ ID NO: 29578 - DNA, 21 bp, Artificial sequence
  SiRNA target sequence
agatatccaacatccaccgag

SEQ ID NO: 29579 - DNA, 21 bp, Artificial sequence
  SiRNA target sequence
gatatccaacatccaccgaga

SEQ ID NO: 29580 - DNA, 21 bp, Artificial sequence
  SiRNA target sequence
atatccaacatccaccgagac

SEQ ID NO: 29581 - DNA, 21 bp, Artificial sequence
  SiRNA target sequence
tatccaacatccaccgagacg

SEQ ID NO: 29582 - DNA, 21 bp, Artificial sequence
  SiRNA target sequence
atccaacatccaccgagacgt

SEQ ID NO: 29583 - DNA, 21 bp, Artificial sequence
  SiRNA target sequence
tccaacatccaccgagacgtt

SEQ ID NO: 29584 - DNA, 21 bp, Artificial sequence
  SiRNA target sequence
ccaacatccaccgagacgtta

SEQ ID NO: 29585 - DNA, 21 bp, Artificial sequence
  SiRNA target sequence
caacatccaccgagacgttaa

SEQ ID NO: 29586 - DNA, 21 bp, Artificial sequence
  SiRNA target sequence
aacatccaccgagacgttaac

SEQ ID NO: 29587 - DNA, 21 bp, Artificial sequence
  SiRNA target sequence
acatccaccgagacgttaaca

SEQ ID NO: 29588 - DNA, 21 bp, Artificial sequence
  SiRNA target sequence
catccaccgagacgttaacac

SEQ ID NO: 29589 - DNA, 21 bp, Artificial sequence
  SiRNA target sequence
atccaccgagacgttaacaca

SEQ ID NO: 29590 - DNA, 21 bp, Artificial sequence
  SiRNA target sequence
tccaccgagacgttaacacaa

SEQ ID NO: 29591 - DNA, 21 bp, Artificial sequence
  SiRNA target sequence
ccaccgagacgttaacacaac

SEQ ID NO: 29592 - DNA, 21 bp, Artificial sequence
  SiRNA target sequence
caccgagacgttaacacaacc

SEQ ID NO: 29593 - DNA, 21 bp, Artificial sequence
  SiRNA target sequence
accgagacgttaacacaaccg

SEQ ID NO: 29594 - DNA, 21 bp, Artificial sequence
  SiRNA target sequence
ccgagacgttaacacaaccgg

SEQ ID NO: 29595 - DNA, 21 bp, Artificial sequence
  SiRNA target sequence
cgagacgttaacacaaccgga

SEQ ID NO: 29596 - DNA, 21 bp, Artificial sequence
  SiRNA target sequence
gagacgttaacacaaccggac

SEQ ID NO: 29597 - DNA, 21 bp, Artificial sequence
  SiRNA target sequence
agacgttaacacaaccggact

SEQ ID NO: 29598 - DNA, 21 bp, Artificial sequence
  SiRNA target sequence
gacgttaacacaaccggactt

SEQ ID NO: 29599 - DNA, 21 bp, Artificial sequence
  SiRNA target sequence
acgttaacacaaccggacttt

SEQ ID NO: 29600 - DNA, 21 bp, Artificial sequence
  SiRNA target sequence
cgttaacacaaccggactttg

SEQ ID NO: 29601 - DNA, 21 bp, Artificial sequence
  SiRNA target sequence
gttaacacaaccggactttgt

SEQ ID NO: 29602 - DNA, 21 bp, Artificial sequence
  SiRNA target sequence
ttaacacaaccggactttgtt

SEQ ID NO: 29603 - DNA, 21 bp, Artificial sequence
  SiRNA target sequence
taacacaaccggactttgtta

SEQ ID NO: 29604 - DNA, 21 bp, Artificial sequence
  SiRNA target sequence
aacacaaccggactttgttat

SEQ ID NO: 29605 - DNA, 21 bp, Artificial sequence
  SiRNA target sequence
acacaaccggactttgttatc

SEQ ID NO: 29606 - DNA, 21 bp, Artificial sequence
  SiRNA target sequence
cacaaccggactttgttatcc

SEQ ID NO: 29607 - DNA, 21 bp, Artificial sequence
  SiRNA target sequence
acaaccggactttgttatcct

SEQ ID NO: 29608 - DNA, 21 bp, Artificial sequence
  SiRNA target sequence
caaccggactttgttatcctc

SEQ ID NO: 29609 - DNA, 21 bp, Artificial sequence
  SiRNA target sequence
aaccggactttgttatcctct

SEQ ID NO: 29610 - DNA, 21 bp, Artificial sequence
  SiRNA target sequence
accggactttgttatcctctc

SEQ ID NO: 29611 - DNA, 21 bp, Artificial sequence
  SiRNA target sequence
ccggactttgttatcctctct

SEQ ID NO: 29612 - DNA, 21 bp, Artificial sequence
  SiRNA target sequence
cggactttgttatcctctctc

SEQ ID NO: 29613 - DNA, 21 bp, Artificial sequence
  SiRNA target sequence
ggactttgttatcctctctcc

SEQ ID NO: 29614 - DNA, 21 bp, Artificial sequence
  SiRNA target sequence
gactttgttatcctctctcca

SEQ ID NO: 29615 - DNA, 21 bp, Artificial sequence
  SiRNA target sequence
actttgttatcctctctccac

SEQ ID NO: 29616 - DNA, 21 bp, Artificial sequence
  SiRNA target sequence
ctttgttatcctctctccacc

SEQ ID NO: 29617 - DNA, 21 bp, Artificial sequence
  SiRNA target sequence
tttgttatcctctctccacct

SEQ ID NO: 29618 - DNA, 21 bp, Artificial sequence
  SiRNA target sequence
ttgttatcctctctccaccta

SEQ ID NO: 29619 - DNA, 21 bp, Artificial sequence
  SiRNA target sequence
tgttatcctctctccacctac

SEQ ID NO: 29620 - DNA, 21 bp, Artificial sequence
  SiRNA target sequence
gttatcctctctccacctact

SEQ ID NO: 29621 - DNA, 21 bp, Artificial sequence
  SiRNA target sequence
ttatcctctctccacctactg

SEQ ID NO: 29622 - DNA, 21 bp, Artificial sequence
  SiRNA target sequence
tatcctctctccacctactgc

SEQ ID NO: 29623 - DNA, 21 bp, Artificial sequence
  SiRNA target sequence
atcctctctccacctactgcg

SEQ ID NO: 29624 - DNA, 21 bp, Artificial sequence
  SiRNA target sequence
tcctctctccacctactgcgt

SEQ ID NO: 29625 - DNA, 21 bp, Artificial sequence
  SiRNA target sequence
cctctctccacctactgcgtc

SEQ ID NO: 29626 - DNA, 21 bp, Artificial sequence
  SiRNA target sequence
ctctctccacctactgcgtct

SEQ ID NO: 29627 - DNA, 21 bp, Artificial sequence
  SiRNA target sequence
tctctccacctactgcgtctt

SEQ ID NO: 29628 - DNA, 21 bp, Artificial sequence
  SiRNA target sequence
ctctccacctactgcgtcttt

SEQ ID NO: 29629 - DNA, 21 bp, Artificial sequence
  SiRNA target sequence
tctccacctactgcgtctttc

SEQ ID NO: 29630 - DNA, 21 bp, Artificial sequence
  SiRNA target sequence
ctccacctactgcgtctttcg

SEQ ID NO: 29631 - DNA, 21 bp, Artificial sequence
  SiRNA target sequence
tccacctactgcgtctttcgg

SEQ ID NO: 29632 - DNA, 21 bp, Artificial sequence
  SiRNA target sequence
ccacctactgcgtctttcggt

SEQ ID NO: 29633 - DNA, 21 bp, Artificial sequence
  SiRNA target sequence
cacctactgcgtctttcggtc

SEQ ID NO: 29634 - DNA, 21 bp, Artificial sequence
  SiRNA target sequence
acctactgcgtctttcggtcc

SEQ ID NO: 29635 - DNA, 21 bp, Artificial sequence
  SiRNA target sequence
cctactgcgtctttcggtccg

SEQ ID NO: 29636 - DNA, 21 bp, Artificial sequence
  SiRNA target sequence
ctactgcgtctttcggtccgg

SEQ ID NO: 29637 - DNA, 21 bp, Artificial sequence
  SiRNA target sequence
tactgcgtctttcggtccggt

SEQ ID NO: 29638 - DNA, 21 bp, Artificial sequence
  SiRNA target sequence
actgcgtctttcggtccggtt

SEQ ID NO: 29639 - DNA, 21 bp, Artificial sequence
  SiRNA target sequence
ctgcgtctttcggtccggtta

SEQ ID NO: 29640 - DNA, 21 bp, Artificial sequence
  SiRNA target sequence
tgcgtctttcggtccggttat

SEQ ID NO: 29641 - DNA, 21 bp, Artificial sequence
  SiRNA target sequence
gcgtctttcggtccggttatg

SEQ ID NO: 29642 - DNA, 21 bp, Artificial sequence
  SiRNA target sequence
cgtctttcggtccggttatgt

SEQ ID NO: 29643 - DNA, 21 bp, Artificial sequence
  SiRNA target sequence
gtctttcggtccggttatgtc

SEQ ID NO: 29644 - DNA, 21 bp, Artificial sequence
  SiRNA target sequence
tctttcggtccggttatgtcg

SEQ ID NO: 29645 - DNA, 21 bp, Artificial sequence
  SiRNA target sequence
ctttcggtccggttatgtcga

SEQ ID NO: 29646 - DNA, 21 bp, Artificial sequence
  SiRNA target sequence
tttcggtccggttatgtcgac

SEQ ID NO: 29647 - DNA, 21 bp, Artificial sequence
  SiRNA target sequence
ttcggtccggttatgtcgaca

SEQ ID NO: 29648 - DNA, 21 bp, Artificial sequence
  SiRNA target sequence
tcggtccggttatgtcgacag

SEQ ID NO: 29649 - DNA, 21 bp, Artificial sequence
  SiRNA target sequence
cggtccggttatgtcgacagc

SEQ ID NO: 29650 - DNA, 21 bp, Artificial sequence
  SiRNA target sequence
ggtccggttatgtcgacagcc

SEQ ID NO: 29651 - DNA, 21 bp, Artificial sequence
  SiRNA target sequence
gtccggttatgtcgacagcca

SEQ ID NO: 29652 - DNA, 21 bp, Artificial sequence
  SiRNA target sequence
tccggttatgtcgacagccac

SEQ ID NO: 29653 - DNA, 21 bp, Artificial sequence
  SiRNA target sequence
ccggttatgtcgacagccact

SEQ ID NO: 29654 - DNA, 21 bp, Artificial sequence
  SiRNA target sequence
cggttatgtcgacagccactc

SEQ ID NO: 29655 - DNA, 21 bp, Artificial sequence
  SiRNA target sequence
ggttatgtcgacagccactct

SEQ ID NO: 29656 - DNA, 21 bp, Artificial sequence
  SiRNA target sequence
gttatgtcgacagccactcta

SEQ ID NO: 29657 - DNA, 21 bp, Artificial sequence
  SiRNA target sequence
ttatgtcgacagccactctaa

SEQ ID NO: 29658 - DNA, 21 bp, Artificial sequence
  SiRNA target sequence
tatgtcgacagccactctaac

SEQ ID NO: 29659 - DNA, 21 bp, Artificial sequence
  SiRNA target sequence
atgtcgacagccactctaaca

SEQ ID NO: 29660 - DNA, 21 bp, Artificial sequence
  SiRNA target sequence
tgtcgacagccactctaacat

SEQ ID NO: 29661 - DNA, 21 bp, Artificial sequence
  SiRNA target sequence
gtcgacagccactctaacatc

SEQ ID NO: 29662 - DNA, 21 bp, Artificial sequence
  SiRNA target sequence
tcgacagccactctaacatct

SEQ ID NO: 29663 - DNA, 21 bp, Artificial sequence
  SiRNA target sequence
cgacagccactctaacatctc

SEQ ID NO: 29664 - DNA, 21 bp, Artificial sequence
  SiRNA target sequence
gacagccactctaacatctca

SEQ ID NO: 29665 - DNA, 21 bp, Artificial sequence
  SiRNA target sequence
acagccactctaacatctcac

SEQ ID NO: 29666 - DNA, 21 bp, Artificial sequence
  SiRNA target sequence
cagccactctaacatctcaca

SEQ ID NO: 29667 - DNA, 21 bp, Artificial sequence
  SiRNA target sequence
agccactctaacatctcacag

SEQ ID NO: 29668 - DNA, 21 bp, Artificial sequence
  SiRNA target sequence
gccactctaacatctcacagg

SEQ ID NO: 29669 - DNA, 21 bp, Artificial sequence
  SiRNA target sequence
ccactctaacatctcacaggc

SEQ ID NO: 29670 - DNA, 21 bp, Artificial sequence
  SiRNA target sequence
cactctaacatctcacaggct

SEQ ID NO: 29671 - DNA, 21 bp, Artificial sequence
  SiRNA target sequence
actctaacatctcacaggctg

SEQ ID NO: 29672 - DNA, 21 bp, Artificial sequence
  SiRNA target sequence
ctctaacatctcacaggctgt

SEQ ID NO: 29673 - DNA, 21 bp, Artificial sequence
  SiRNA target sequence
tctaacatctcacaggctgtc

SEQ ID NO: 29674 - DNA, 21 bp, Artificial sequence
  SiRNA target sequence
ctaacatctcacaggctgtca

SEQ ID NO: 29675 - DNA, 21 bp, Artificial sequence
  SiRNA target sequence
taacatctcacaggctgtcac

SEQ ID NO: 29676 - DNA, 21 bp, Artificial sequence
  SiRNA target sequence
aacatctcacaggctgtcact

SEQ ID NO: 29677 - DNA, 21 bp, Artificial sequence
  SiRNA target sequence
acatctcacaggctgtcactt

SEQ ID NO: 29678 - DNA, 21 bp, Artificial sequence
  SiRNA target sequence
catctcacaggctgtcacttg

SEQ ID NO: 29679 - DNA, 21 bp, Artificial sequence
  SiRNA target sequence
atctcacaggctgtcacttgt

SEQ ID NO: 29680 - DNA, 21 bp, Artificial sequence
  SiRNA target sequence
tctcacaggctgtcacttgtg

SEQ ID NO: 29681 - DNA, 21 bp, Artificial sequence
  SiRNA target sequence
ctcacaggctgtcacttgtga

SEQ ID NO: 29682 - DNA, 21 bp, Artificial sequence
  SiRNA target sequence
tcacaggctgtcacttgtgat

SEQ ID NO: 29683 - DNA, 21 bp, Artificial sequence
  SiRNA target sequence
cacaggctgtcacttgtgatc

SEQ ID NO: 29684 - DNA, 21 bp, Artificial sequence
  SiRNA target sequence
acaggctgtcacttgtgatcc

SEQ ID NO: 29685 - DNA, 21 bp, Artificial sequence
  SiRNA target sequence
caggctgtcacttgtgatcca

SEQ ID NO: 29686 - DNA, 21 bp, Artificial sequence
  SiRNA target sequence
aggctgtcacttgtgatccat

SEQ ID NO: 29687 - DNA, 21 bp, Artificial sequence
  SiRNA target sequence
ggctgtcacttgtgatccatt

SEQ ID NO: 29688 - DNA, 21 bp, Artificial sequence
  SiRNA target sequence
gctgtcacttgtgatccattt

SEQ ID NO: 29689 - DNA, 21 bp, Artificial sequence
  SiRNA target sequence
ctgtcacttgtgatccattta

SEQ ID NO: 29690 - DNA, 21 bp, Artificial sequence
  SiRNA target sequence
tgtcacttgtgatccatttaa

SEQ ID NO: 29691 - DNA, 21 bp, Artificial sequence
  SiRNA target sequence
gtcacttgtgatccatttaag

SEQ ID NO: 29692 - DNA, 21 bp, Artificial sequence
  SiRNA target sequence
tcacttgtgatccatttaaga

SEQ ID NO: 29693 - DNA, 21 bp, Artificial sequence
  SiRNA target sequence
cacttgtgatccatttaagat

SEQ ID NO: 29694 - DNA, 21 bp, Artificial sequence
  SiRNA target sequence
acttgtgatccatttaagatg

SEQ ID NO: 29695 - DNA, 21 bp, Artificial sequence
  SiRNA target sequence
cttgtgatccatttaagatga

SEQ ID NO: 29696 - DNA, 21 bp, Artificial sequence
  SiRNA target sequence
ttgtgatccatttaagatgac

SEQ ID NO: 29697 - DNA, 21 bp, Artificial sequence
  SiRNA target sequence
tgtgatccatttaagatgacg

SEQ ID NO: 29698 - DNA, 21 bp, Artificial sequence
  SiRNA target sequence
gtgatccatttaagatgacga

SEQ ID NO: 29699 - DNA, 21 bp, Artificial sequence
  SiRNA target sequence
tgatccatttaagatgacgac

SEQ ID NO: 29700 - DNA, 21 bp, Artificial sequence
  SiRNA target sequence
gatccatttaagatgacgacg

SEQ ID NO: 29701 - DNA, 21 bp, Artificial sequence
  SiRNA target sequence
atccatttaagatgacgacgc

SEQ ID NO: 29702 - DNA, 21 bp, Artificial sequence
  SiRNA target sequence
tccatttaagatgacgacgca

SEQ ID NO: 29703 - DNA, 21 bp, Artificial sequence
  SiRNA target sequence
ccatttaagatgacgacgcag

SEQ ID NO: 29704 - DNA, 21 bp, Artificial sequence
  SiRNA target sequence
catttaagatgacgacgcagt

SEQ ID NO: 29705 - DNA, 21 bp, Artificial sequence
  SiRNA target sequence
atttaagatgacgacgcagta

SEQ ID NO: 29706 - DNA, 21 bp, Artificial sequence
  SiRNA target sequence
tttaagatgacgacgcagtat

SEQ ID NO: 29707 - DNA, 21 bp, Artificial sequence
  SiRNA target sequence
ttaagatgacgacgcagtata

SEQ ID NO: 29708 - DNA, 21 bp, Artificial sequence
  SiRNA target sequence
taagatgacgacgcagtataa

SEQ ID NO: 29709 - DNA, 21 bp, Artificial sequence
  SiRNA target sequence
aagatgacgacgcagtataac

SEQ ID NO: 29710 - DNA, 21 bp, Artificial sequence
  SiRNA target sequence
agatgacgacgcagtataaca

SEQ ID NO: 29711 - DNA, 21 bp, Artificial sequence
  SiRNA target sequence
gatgacgacgcagtataacat

SEQ ID NO: 29712 - DNA, 21 bp, Artificial sequence
  SiRNA target sequence
atgacgacgcagtataacatc

SEQ ID NO: 29713 - DNA, 21 bp, Artificial sequence
  SiRNA target sequence
tgacgacgcagtataacatcc

SEQ ID NO: 29714 - DNA, 21 bp, Artificial sequence
  SiRNA target sequence
gacgacgcagtataacatccc

SEQ ID NO: 29715 - DNA, 21 bp, Artificial sequence
  SiRNA target sequence
acgacgcagtataacatccct

SEQ ID NO: 29716 - DNA, 21 bp, Artificial sequence
  SiRNA target sequence
cgacgcagtataacatccctg

SEQ ID NO: 29717 - DNA, 21 bp, Artificial sequence
  SiRNA target sequence
gacgcagtataacatccctgg

SEQ ID NO: 29718 - DNA, 21 bp, Artificial sequence
  SiRNA target sequence
acgcagtataacatccctggg

SEQ ID NO: 29719 - DNA, 21 bp, Artificial sequence
  SiRNA target sequence
cgcagtataacatccctgggt

SEQ ID NO: 29720 - DNA, 21 bp, Artificial sequence
  SiRNA target sequence
gcagtataacatccctgggta

SEQ ID NO: 29721 - DNA, 21 bp, Artificial sequence
  SiRNA target sequence
cagtataacatccctgggtat

SEQ ID NO: 29722 - DNA, 21 bp, Artificial sequence
  SiRNA target sequence
agtataacatccctgggtatt

SEQ ID NO: 29723 - DNA, 21 bp, Artificial sequence
  SiRNA target sequence
gtataacatccctgggtattc

SEQ ID NO: 29724 - DNA, 21 bp, Artificial sequence
  SiRNA target sequence
tataacatccctgggtattcc

SEQ ID NO: 29725 - DNA, 21 bp, Artificial sequence
  SiRNA target sequence
ataacatccctgggtattcct

SEQ ID NO: 29726 - DNA, 21 bp, Artificial sequence
  SiRNA target sequence
taacatccctgggtattcctg

SEQ ID NO: 29727 - DNA, 21 bp, Artificial sequence
  SiRNA target sequence
aacatccctgggtattcctgg

SEQ ID NO: 29728 - DNA, 21 bp, Artificial sequence
  SiRNA target sequence
acatccctgggtattcctggc

SEQ ID NO: 29729 - DNA, 21 bp, Artificial sequence
  SiRNA target sequence
catccctgggtattcctggct

SEQ ID NO: 29730 - DNA, 21 bp, Artificial sequence
  SiRNA target sequence
atccctgggtattcctggctc

SEQ ID NO: 29731 - DNA, 21 bp, Artificial sequence
  SiRNA target sequence
tccctgggtattcctggctca

SEQ ID NO: 29732 - DNA, 21 bp, Artificial sequence
  SiRNA target sequence
ccctgggtattcctggctcaa

SEQ ID NO: 29733 - DNA, 21 bp, Artificial sequence
  SiRNA target sequence
cctgggtattcctggctcaag

SEQ ID NO: 29734 - DNA, 21 bp, Artificial sequence
  SiRNA target sequence
ctgggtattcctggctcaaga

SEQ ID NO: 29735 - DNA, 21 bp, Artificial sequence
  SiRNA target sequence
tgggtattcctggctcaagaa

SEQ ID NO: 29736 - DNA, 21 bp, Artificial sequence
  SiRNA target sequence
gggtattcctggctcaagaag

SEQ ID NO: 29737 - DNA, 21 bp, Artificial sequence
  SiRNA target sequence
ggtattcctggctcaagaagg

SEQ ID NO: 29738 - DNA, 21 bp, Artificial sequence
  SiRNA target sequence
gtattcctggctcaagaaggc

SEQ ID NO: 29739 - DNA, 21 bp, Artificial sequence
  SiRNA target sequence
tattcctggctcaagaaggca

SEQ ID NO: 29740 - DNA, 21 bp, Artificial sequence
  SiRNA target sequence
attcctggctcaagaaggcaa

SEQ ID NO: 29741 - DNA, 21 bp, Artificial sequence
  SiRNA target sequence
ttcctggctcaagaaggcaat

SEQ ID NO: 29742 - DNA, 21 bp, Artificial sequence
  SiRNA target sequence
tcctggctcaagaaggcaatc

SEQ ID NO: 29743 - DNA, 21 bp, Artificial sequence
  SiRNA target sequence
cctggctcaagaaggcaatct

SEQ ID NO: 29744 - DNA, 21 bp, Artificial sequence
  SiRNA target sequence
ctggctcaagaaggcaatctt

SEQ ID NO: 29745 - DNA, 21 bp, Artificial sequence
  SiRNA target sequence
tggctcaagaaggcaatcttg

SEQ ID NO: 29746 - DNA, 21 bp, Artificial sequence
  SiRNA target sequence
ggctcaagaaggcaatcttgt

SEQ ID NO: 29747 - DNA, 21 bp, Artificial sequence
  SiRNA target sequence
gctcaagaaggcaatcttgtt

SEQ ID NO: 29748 - DNA, 21 bp, Artificial sequence
  SiRNA target sequence
ctcaagaaggcaatcttgttt

SEQ ID NO: 29749 - DNA, 21 bp, Artificial sequence
  SiRNA target sequence
tcaagaaggcaatcttgtttt

SEQ ID NO: 29750 - DNA, 21 bp, Artificial sequence
  SiRNA target sequence
caagaaggcaatcttgttttt

SEQ ID NO: 29751 - DNA, 21 bp, Artificial sequence
  SiRNA target sequence
aagaaggcaatcttgtttttt

SEQ ID NO: 29752 - DNA, 21 bp, Artificial sequence
  SiRNA target sequence
agaaggcaatcttgtttttta

SEQ ID NO: 29753 - DNA, 21 bp, Artificial sequence
  SiRNA target sequence
gaaggcaatcttgttttttat

SEQ ID NO: 29754 - DNA, 21 bp, Artificial sequence
  SiRNA target sequence
aaggcaatcttgttttttatt

SEQ ID NO: 29755 - DNA, 21 bp, Artificial sequence
  SiRNA target sequence
aggcaatcttgttttttattg

SEQ ID NO: 29756 - DNA, 21 bp, Artificial sequence
  SiRNA target sequence
ggcaatcttgttttttattga

SEQ ID NO: 29757 - DNA, 21 bp, Artificial sequence
  SiRNA target sequence
gcaatcttgttttttattgag

SEQ ID NO: 29758 - DNA, 21 bp, Artificial sequence
  SiRNA target sequence
caatcttgttttttattgagt

SEQ ID NO: 29759 - DNA, 21 bp, Artificial sequence
  SiRNA target sequence
aatcttgttttttattgagtc

SEQ ID NO: 29760 - DNA, 21 bp, Artificial sequence
  SiRNA target sequence
atcttgttttttattgagtca

SEQ ID NO: 29761 - DNA, 21 bp, Artificial sequence
  SiRNA target sequence
tcttgttttttattgagtcag

SEQ ID NO: 29762 - DNA, 21 bp, Artificial sequence
  SiRNA target sequence
cttgttttttattgagtcagt

SEQ ID NO: 29763 - DNA, 21 bp, Artificial sequence
  SiRNA target sequence
ttgttttttattgagtcagtc

SEQ ID NO: 29764 - DNA, 21 bp, Artificial sequence
  SiRNA target sequence
tgttttttattgagtcagtcg

SEQ ID NO: 29765 - DNA, 21 bp, Artificial sequence
  SiRNA target sequence
gttttttattgagtcagtcgt

SEQ ID NO: 29766 - DNA, 21 bp, Artificial sequence
  SiRNA target sequence
ttttttattgagtcagtcgtt

SEQ ID NO: 29767 - DNA, 21 bp, Artificial sequence
  SiRNA target sequence
tttttattgagtcagtcgttg

SEQ ID NO: 29768 - DNA, 21 bp, Artificial sequence
  SiRNA target sequence
ttttattgagtcagtcgttga

SEQ ID NO: 29769 - DNA, 21 bp, Artificial sequence
  SiRNA target sequence
tttattgagtcagtcgttgac

SEQ ID NO: 29770 - DNA, 21 bp, Artificial sequence
  SiRNA target sequence
ttattgagtcagtcgttgaca

SEQ ID NO: 29771 - DNA, 21 bp, Artificial sequence
  SiRNA target sequence
tattgagtcagtcgttgacac

SEQ ID NO: 29772 - DNA, 21 bp, Artificial sequence
  SiRNA target sequence
attgagtcagtcgttgacact

SEQ ID NO: 29773 - DNA, 21 bp, Artificial sequence
  SiRNA target sequence
ttgagtcagtcgttgacactc

SEQ ID NO: 29774 - DNA, 21 bp, Artificial sequence
  SiRNA target sequence
tgagtcagtcgttgacactct

SEQ ID NO: 29775 - DNA, 21 bp, Artificial sequence
  SiRNA target sequence
gagtcagtcgttgacactctc

SEQ ID NO: 29776 - DNA, 21 bp, Artificial sequence
  SiRNA target sequence
agtcagtcgttgacactctca

SEQ ID NO: 29777 - DNA, 21 bp, Artificial sequence
  SiRNA target sequence
gtcagtcgttgacactctcat

SEQ ID NO: 29778 - DNA, 21 bp, Artificial sequence
  SiRNA target sequence
tcagtcgttgacactctcatt

SEQ ID NO: 29779 - DNA, 21 bp, Artificial sequence
  SiRNA target sequence
cagtcgttgacactctcattt

SEQ ID NO: 29780 - DNA, 21 bp, Artificial sequence
  SiRNA target sequence
agtcgttgacactctcatttc

SEQ ID NO: 29781 - DNA, 21 bp, Artificial sequence
  SiRNA target sequence
gtcgttgacactctcatttcc

SEQ ID NO: 29782 - DNA, 21 bp, Artificial sequence
  SiRNA target sequence
tcgttgacactctcatttcca

SEQ ID NO: 29783 - DNA, 21 bp, Artificial sequence
  SiRNA target sequence
cgttgacactctcatttccat

SEQ ID NO: 29784 - DNA, 21 bp, Artificial sequence
  SiRNA target sequence
gttgacactctcatttccatc

SEQ ID NO: 29785 - DNA, 21 bp, Artificial sequence
  SiRNA target sequence
ttgacactctcatttccatca

SEQ ID NO: 29786 - DNA, 21 bp, Artificial sequence
  SiRNA target sequence
tgacactctcatttccatcat

SEQ ID NO: 29787 - DNA, 21 bp, Artificial sequence
  SiRNA target sequence
gacactctcatttccatcata

SEQ ID NO: 29788 - DNA, 21 bp, Artificial sequence
  SiRNA target sequence
acactctcatttccatcatat

SEQ ID NO: 29789 - DNA, 21 bp, Artificial sequence
  SiRNA target sequence
cactctcatttccatcatatt

SEQ ID NO: 29790 - DNA, 21 bp, Artificial sequence
  SiRNA target sequence
actctcatttccatcatattg

SEQ ID NO: 29791 - DNA, 21 bp, Artificial sequence
  SiRNA target sequence
ctctcatttccatcatattgt

SEQ ID NO: 29792 - DNA, 21 bp, Artificial sequence
  SiRNA target sequence
tctcatttccatcatattgtc

SEQ ID NO: 29793 - DNA, 21 bp, Artificial sequence
  SiRNA target sequence
ctcatttccatcatattgtct

SEQ ID NO: 29794 - DNA, 21 bp, Artificial sequence
  SiRNA target sequence
tcatttccatcatattgtctc

SEQ ID NO: 29795 - DNA, 21 bp, Artificial sequence
  SiRNA target sequence
catttccatcatattgtctct

SEQ ID NO: 29796 - DNA, 21 bp, Artificial sequence
  SiRNA target sequence
atttccatcatattgtctctc

SEQ ID NO: 29797 - DNA, 21 bp, Artificial sequence
  SiRNA target sequence
tttccatcatattgtctctct

SEQ ID NO: 29798 - DNA, 21 bp, Artificial sequence
  SiRNA target sequence
ttccatcatattgtctctctt

SEQ ID NO: 29799 - DNA, 21 bp, Artificial sequence
  SiRNA target sequence
tccatcatattgtctctcttt

SEQ ID NO: 29800 - DNA, 21 bp, Artificial sequence
  SiRNA target sequence
ccatcatattgtctctctttg

SEQ ID NO: 29801 - DNA, 21 bp, Artificial sequence
  SiRNA target sequence
catcatattgtctctctttga

SEQ ID NO: 29802 - DNA, 21 bp, Artificial sequence
  SiRNA target sequence
atcatattgtctctctttgat

SEQ ID NO: 29803 - DNA, 21 bp, Artificial sequence
  SiRNA target sequence
tcatattgtctctctttgatg

SEQ ID NO: 29804 - DNA, 21 bp, Artificial sequence
  SiRNA target sequence
catattgtctctctttgatga

SEQ ID NO: 29805 - DNA, 21 bp, Artificial sequence
  SiRNA target sequence
atattgtctctctttgatgag

SEQ ID NO: 29806 - DNA, 21 bp, Artificial sequence
  SiRNA target sequence
tattgtctctctttgatgagt

SEQ ID NO: 29807 - DNA, 21 bp, Artificial sequence
  SiRNA target sequence
attgtctctctttgatgagtt

SEQ ID NO: 29808 - DNA, 21 bp, Artificial sequence
  SiRNA target sequence
ttgtctctctttgatgagttc

SEQ ID NO: 29809 - DNA, 21 bp, Artificial sequence
  SiRNA target sequence
tgtctctctttgatgagttct

SEQ ID NO: 29810 - DNA, 21 bp, Artificial sequence
  SiRNA target sequence
gtctctctttgatgagttctt

SEQ ID NO: 29811 - DNA, 21 bp, Artificial sequence
  SiRNA target sequence
tctctctttgatgagttctta

SEQ ID NO: 29812 - DNA, 21 bp, Artificial sequence
  SiRNA target sequence
ctctctttgatgagttcttat

SEQ ID NO: 29813 - DNA, 21 bp, Artificial sequence
  SiRNA target sequence
tctctttgatgagttcttatc

SEQ ID NO: 29814 - DNA, 21 bp, Artificial sequence
  SiRNA target sequence
ctctttgatgagttcttatct

SEQ ID NO: 29815 - DNA, 21 bp, Artificial sequence
  SiRNA target sequence
tctttgatgagttcttatctt

SEQ ID NO: 29816 - DNA, 21 bp, Artificial sequence
  SiRNA target sequence
ctttgatgagttcttatcttt

SEQ ID NO: 29817 - DNA, 21 bp, Artificial sequence
  SiRNA target sequence
tttgatgagttcttatcttta

SEQ ID NO: 29818 - DNA, 21 bp, Artificial sequence
  SiRNA target sequence
ttgatgagttcttatctttac

SEQ ID NO: 29819 - DNA, 21 bp, Artificial sequence
  SiRNA target sequence
tgatgagttcttatctttact

SEQ ID NO: 29820 - DNA, 21 bp, Artificial sequence
  SiRNA target sequence
gatgagttcttatctttactg

SEQ ID NO: 29821 - DNA, 21 bp, Artificial sequence
  SiRNA target sequence
atgagttcttatctttactga

SEQ ID NO: 29822 - DNA, 21 bp, Artificial sequence
  SiRNA target sequence
tgagttcttatctttactgag

SEQ ID NO: 29823 - DNA, 21 bp, Artificial sequence
  SiRNA target sequence
gagttcttatctttactgagg

SEQ ID NO: 29824 - DNA, 21 bp, Artificial sequence
  SiRNA target sequence
agttcttatctttactgagga

SEQ ID NO: 29825 - DNA, 21 bp, Artificial sequence
  SiRNA target sequence
gttcttatctttactgaggac

SEQ ID NO: 29826 - DNA, 21 bp, Artificial sequence
  SiRNA target sequence
ttcttatctttactgaggact

SEQ ID NO: 29827 - DNA, 21 bp, Artificial sequence
  SiRNA target sequence
tcttatctttactgaggactc

SEQ ID NO: 29828 - DNA, 21 bp, Artificial sequence
  SiRNA target sequence
cttatctttactgaggactct

SEQ ID NO: 29829 - DNA, 21 bp, Artificial sequence
  SiRNA target sequence
ttatctttactgaggactctc

SEQ ID NO: 29830 - DNA, 21 bp, Artificial sequence
  SiRNA target sequence
tatctttactgaggactctca

SEQ ID NO: 29831 - DNA, 21 bp, Artificial sequence
  SiRNA target sequence
atctttactgaggactctcaa

SEQ ID NO: 29832 - DNA, 21 bp, Artificial sequence
  SiRNA target sequence
tctttactgaggactctcaat

SEQ ID NO: 29833 - DNA, 21 bp, Artificial sequence
  SiRNA target sequence
ctttactgaggactctcaatg

SEQ ID NO: 29834 - DNA, 21 bp, Artificial sequence
  SiRNA target sequence
tttactgaggactctcaatga

SEQ ID NO: 29835 - DNA, 21 bp, Artificial sequence
  SiRNA target sequence
ttactgaggactctcaatgag

SEQ ID NO: 29836 - DNA, 21 bp, Artificial sequence
  SiRNA target sequence
tactgaggactctcaatgaga

SEQ ID NO: 29837 - DNA, 21 bp, Artificial sequence
  SiRNA target sequence
actgaggactctcaatgagaa

SEQ ID NO: 29838 - DNA, 21 bp, Artificial sequence
  SiRNA target sequence
ctgaggactctcaatgagaag

SEQ ID NO: 29839 - DNA, 21 bp, Artificial sequence
  SiRNA target sequence
tgaggactctcaatgagaagt

SEQ ID NO: 29840 - DNA, 21 bp, Artificial sequence
  SiRNA target sequence
gaggactctcaatgagaagta

SEQ ID NO: 29841 - DNA, 21 bp, Artificial sequence
  SiRNA target sequence
aggactctcaatgagaagtac

SEQ ID NO: 29842 - DNA, 21 bp, Artificial sequence
  SiRNA target sequence
ggactctcaatgagaagtacc

SEQ ID NO: 29843 - DNA, 21 bp, Artificial sequence
  SiRNA target sequence
gactctcaatgagaagtaccg

SEQ ID NO: 29844 - DNA, 21 bp, Artificial sequence
  SiRNA target sequence
actctcaatgagaagtaccgt

SEQ ID NO: 29845 - DNA, 21 bp, Artificial sequence
  SiRNA target sequence
ctctcaatgagaagtaccgtg

SEQ ID NO: 29846 - DNA, 21 bp, Artificial sequence
  SiRNA target sequence
tctcaatgagaagtaccgtgt

SEQ ID NO: 29847 - DNA, 21 bp, Artificial sequence
  SiRNA target sequence
ctcaatgagaagtaccgtgtc

SEQ ID NO: 29848 - DNA, 21 bp, Artificial sequence
  SiRNA target sequence
tcaatgagaagtaccgtgtct

SEQ ID NO: 29849 - DNA, 21 bp, Artificial sequence
  SiRNA target sequence
caatgagaagtaccgtgtctt

SEQ ID NO: 29850 - DNA, 21 bp, Artificial sequence
  SiRNA target sequence
aatgagaagtaccgtgtcttc

SEQ ID NO: 29851 - DNA, 21 bp, Artificial sequence
  SiRNA target sequence
atgagaagtaccgtgtcttcg

SEQ ID NO: 29852 - DNA, 21 bp, Artificial sequence
  SiRNA target sequence
tgagaagtaccgtgtcttcga

SEQ ID NO: 29853 - DNA, 21 bp, Artificial sequence
  SiRNA target sequence
gagaagtaccgtgtcttcgaa

SEQ ID NO: 29854 - DNA, 21 bp, Artificial sequence
  SiRNA target sequence
agaagtaccgtgtcttcgaat

SEQ ID NO: 29855 - DNA, 21 bp, Artificial sequence
  SiRNA target sequence
gaagtaccgtgtcttcgaata

SEQ ID NO: 29856 - DNA, 21 bp, Artificial sequence
  SiRNA target sequence
aagtaccgtgtcttcgaatac

SEQ ID NO: 29857 - DNA, 21 bp, Artificial sequence
  SiRNA target sequence
agtaccgtgtcttcgaatacc

SEQ ID NO: 29858 - DNA, 21 bp, Artificial sequence
  SiRNA target sequence
gtaccgtgtcttcgaatacct

SEQ ID NO: 29859 - DNA, 21 bp, Artificial sequence
  SiRNA target sequence
taccgtgtcttcgaatacctc

SEQ ID NO: 29860 - DNA, 21 bp, Artificial sequence
  SiRNA target sequence
accgtgtcttcgaatacctcg

SEQ ID NO: 29861 - DNA, 21 bp, Artificial sequence
  SiRNA target sequence
ccgtgtcttcgaatacctcgc

SEQ ID NO: 29862 - DNA, 21 bp, Artificial sequence
  SiRNA target sequence
cgtgtcttcgaatacctcgct

SEQ ID NO: 29863 - DNA, 21 bp, Artificial sequence
  SiRNA target sequence
gtgtcttcgaatacctcgctc

SEQ ID NO: 29864 - DNA, 21 bp, Artificial sequence
  SiRNA target sequence
tgtcttcgaatacctcgctct

SEQ ID NO: 29865 - DNA, 21 bp, Artificial sequence
  SiRNA target sequence
gtcttcgaatacctcgctctc

SEQ ID NO: 29866 - DNA, 21 bp, Artificial sequence
  SiRNA target sequence
tcttcgaatacctcgctctca

SEQ ID NO: 29867 - DNA, 21 bp, Artificial sequence
  SiRNA target sequence
cttcgaatacctcgctctcat

SEQ ID NO: 29868 - DNA, 21 bp, Artificial sequence
  SiRNA target sequence
ttcgaatacctcgctctcatt

SEQ ID NO: 29869 - DNA, 21 bp, Artificial sequence
  SiRNA target sequence
tcgaatacctcgctctcattg

SEQ ID NO: 29870 - DNA, 21 bp, Artificial sequence
  SiRNA target sequence
cgaatacctcgctctcattgg

SEQ ID NO: 29871 - DNA, 21 bp, Artificial sequence
  SiRNA target sequence
gaatacctcgctctcattggg

SEQ ID NO: 29872 - DNA, 21 bp, Artificial sequence
  SiRNA target sequence
aatacctcgctctcattgggt

SEQ ID NO: 29873 - DNA, 21 bp, Artificial sequence
  SiRNA target sequence
atacctcgctctcattgggtt

SEQ ID NO: 29874 - DNA, 21 bp, Artificial sequence
  SiRNA target sequence
tacctcgctctcattgggttc

SEQ ID NO: 29875 - DNA, 21 bp, Artificial sequence
  SiRNA target sequence
acctcgctctcattgggttct

SEQ ID NO: 29876 - DNA, 21 bp, Artificial sequence
  SiRNA target sequence
cctcgctctcattgggttctg

SEQ ID NO: 29877 - DNA, 21 bp, Artificial sequence
  SiRNA target sequence
ctcgctctcattgggttctgc

SEQ ID NO: 29878 - DNA, 21 bp, Artificial sequence
  SiRNA target sequence
tcgctctcattgggttctgcc

SEQ ID NO: 29879 - DNA, 21 bp, Artificial sequence
  SiRNA target sequence
cgctctcattgggttctgcct

SEQ ID NO: 29880 - DNA, 21 bp, Artificial sequence
  SiRNA target sequence
gctctcattgggttctgcctc

SEQ ID NO: 29881 - DNA, 21 bp, Artificial sequence
  SiRNA target sequence
ctctcattgggttctgcctct

SEQ ID NO: 29882 - DNA, 21 bp, Artificial sequence
  SiRNA target sequence
tctcattgggttctgcctctg

SEQ ID NO: 29883 - DNA, 21 bp, Artificial sequence
  SiRNA target sequence
ctcattgggttctgcctctgg

SEQ ID NO: 29884 - DNA, 21 bp, Artificial sequence
  SiRNA target sequence
tcattgggttctgcctctggc

SEQ ID NO: 29885 - DNA, 21 bp, Artificial sequence
  SiRNA target sequence
cattgggttctgcctctggcg

SEQ ID NO: 29886 - DNA, 21 bp, Artificial sequence
  SiRNA target sequence
attgggttctgcctctggcgt

SEQ ID NO: 29887 - DNA, 21 bp, Artificial sequence
  SiRNA target sequence
ttgggttctgcctctggcgtt

SEQ ID NO: 29888 - DNA, 21 bp, Artificial sequence
  SiRNA target sequence
tgggttctgcctctggcgttt

SEQ ID NO: 29889 - DNA, 21 bp, Artificial sequence
  SiRNA target sequence
gggttctgcctctggcgtttc

SEQ ID NO: 29890 - DNA, 21 bp, Artificial sequence
  SiRNA target sequence
ggttctgcctctggcgtttcc

SEQ ID NO: 29891 - DNA, 21 bp, Artificial sequence
  SiRNA target sequence
gttctgcctctggcgtttcca

SEQ ID NO: 29892 - DNA, 21 bp, Artificial sequence
  SiRNA target sequence
ttctgcctctggcgtttccag

SEQ ID NO: 29893 - DNA, 21 bp, Artificial sequence
  SiRNA target sequence
tctgcctctggcgtttccaga

SEQ ID NO: 29894 - DNA, 21 bp, Artificial sequence
  SiRNA target sequence
ctgcctctggcgtttccagaa

SEQ ID NO: 29895 - DNA, 21 bp, Artificial sequence
  SiRNA target sequence
tgcctctggcgtttccagaac

SEQ ID NO: 29896 - DNA, 21 bp, Artificial sequence
  SiRNA target sequence
gcctctggcgtttccagaacc

SEQ ID NO: 29897 - DNA, 21 bp, Artificial sequence
  SiRNA target sequence
cctctggcgtttccagaaccc

SEQ ID NO: 29898 - DNA, 21 bp, Artificial sequence
  SiRNA target sequence
ctctggcgtttccagaacccc

SEQ ID NO: 29899 - DNA, 21 bp, Artificial sequence
  SiRNA target sequence
tctggcgtttccagaacccct

SEQ ID NO: 29900 - DNA, 21 bp, Artificial sequence
  SiRNA target sequence
ctggcgtttccagaacccctg

SEQ ID NO: 29901 - DNA, 21 bp, Artificial sequence
  SiRNA target sequence
tggcgtttccagaacccctgg

SEQ ID NO: 29902 - DNA, 21 bp, Artificial sequence
  SiRNA target sequence
ggcgtttccagaacccctggc

SEQ ID NO: 29903 - DNA, 21 bp, Artificial sequence
  SiRNA target sequence
gcgtttccagaacccctggcc

SEQ ID NO: 29904 - DNA, 21 bp, Artificial sequence
  SiRNA target sequence
cgtttccagaacccctggcca

SEQ ID NO: 29905 - DNA, 21 bp, Artificial sequence
  SiRNA target sequence
gtttccagaacccctggccaa

SEQ ID NO: 29906 - DNA, 21 bp, Artificial sequence
  SiRNA target sequence
tttccagaacccctggccaac

SEQ ID NO: 29907 - DNA, 21 bp, Artificial sequence
  SiRNA target sequence
ttccagaacccctggccaact

SEQ ID NO: 29908 - DNA, 21 bp, Artificial sequence
  SiRNA target sequence
tccagaacccctggccaactg

SEQ ID NO: 29909 - DNA, 21 bp, Artificial sequence
  SiRNA target sequence
ccagaacccctggccaactgt

SEQ ID NO: 29910 - DNA, 21 bp, Artificial sequence
  SiRNA target sequence
cagaacccctggccaactgta

SEQ ID NO: 29911 - DNA, 21 bp, Artificial sequence
  SiRNA target sequence
agaacccctggccaactgtat

SEQ ID NO: 29912 - DNA, 21 bp, Artificial sequence
  SiRNA target sequence
gaacccctggccaactgtatc

SEQ ID NO: 29913 - DNA, 21 bp, Artificial sequence
  SiRNA target sequence
aacccctggccaactgtatca

SEQ ID NO: 29914 - DNA, 21 bp, Artificial sequence
  SiRNA target sequence
acccctggccaactgtatcaa

SEQ ID NO: 29915 - DNA, 21 bp, Artificial sequence
  SiRNA target sequence
cccctggccaactgtatcaat

SEQ ID NO: 29916 - DNA, 21 bp, Artificial sequence
  SiRNA target sequence
ccctggccaactgtatcaatt

SEQ ID NO: 29917 - DNA, 21 bp, Artificial sequence
  SiRNA target sequence
cctggccaactgtatcaattg

SEQ ID NO: 29918 - DNA, 21 bp, Artificial sequence
  SiRNA target sequence
ctggccaactgtatcaattgt

SEQ ID NO: 29919 - DNA, 21 bp, Artificial sequence
  SiRNA target sequence
tggccaactgtatcaattgtt

SEQ ID NO: 29920 - DNA, 21 bp, Artificial sequence
  SiRNA target sequence
ggccaactgtatcaattgttg

SEQ ID NO: 29921 - DNA, 21 bp, Artificial sequence
  SiRNA target sequence
gccaactgtatcaattgttgg

SEQ ID NO: 29922 - DNA, 21 bp, Artificial sequence
  SiRNA target sequence
ccaactgtatcaattgttggc

SEQ ID NO: 29923 - DNA, 21 bp, Artificial sequence
  SiRNA target sequence
caactgtatcaattgttggct

SEQ ID NO: 29924 - DNA, 21 bp, Artificial sequence
  SiRNA target sequence
aactgtatcaattgttggctt

SEQ ID NO: 29925 - DNA, 21 bp, Artificial sequence
  SiRNA target sequence
actgtatcaattgttggcttc

SEQ ID NO: 29926 - DNA, 21 bp, Artificial sequence
  SiRNA target sequence
ctgtatcaattgttggcttca

SEQ ID NO: 29927 - DNA, 21 bp, Artificial sequence
  SiRNA target sequence
tgtatcaattgttggcttcac

SEQ ID NO: 29928 - DNA, 21 bp, Artificial sequence
  SiRNA target sequence
gtatcaattgttggcttcact

SEQ ID NO: 29929 - DNA, 21 bp, Artificial sequence
  SiRNA target sequence
tatcaattgttggcttcactt

SEQ ID NO: 29930 - DNA, 21 bp, Artificial sequence
  SiRNA target sequence
atcaattgttggcttcacttt

SEQ ID NO: 29931 - DNA, 21 bp, Artificial sequence
  SiRNA target sequence
tcaattgttggcttcactttg

SEQ ID NO: 29932 - DNA, 21 bp, Artificial sequence
  SiRNA target sequence
caattgttggcttcactttgg

SEQ ID NO: 29933 - DNA, 21 bp, Artificial sequence
  SiRNA target sequence
aattgttggcttcactttggc

SEQ ID NO: 29934 - DNA, 21 bp, Artificial sequence
  SiRNA target sequence
attgttggcttcactttggcc

SEQ ID NO: 29935 - DNA, 21 bp, Artificial sequence
  SiRNA target sequence
ttgttggcttcactttggcca

SEQ ID NO: 29936 - DNA, 21 bp, Artificial sequence
  SiRNA target sequence
tgttggcttcactttggccat

SEQ ID NO: 29937 - DNA, 21 bp, Artificial sequence
  SiRNA target sequence
gttggcttcactttggccatg

SEQ ID NO: 29938 - DNA, 21 bp, Artificial sequence
  SiRNA target sequence
ttggcttcactttggccatga

SEQ ID NO: 29939 - DNA, 21 bp, Artificial sequence
  SiRNA target sequence
tggcttcactttggccatgat

SEQ ID NO: 29940 - DNA, 21 bp, Artificial sequence
  SiRNA target sequence
ggcttcactttggccatgatc

SEQ ID NO: 29941 - DNA, 21 bp, Artificial sequence
  SiRNA target sequence
gcttcactttggccatgatcg

SEQ ID NO: 29942 - DNA, 21 bp, Artificial sequence
  SiRNA target sequence
cttcactttggccatgatcgg

SEQ ID NO: 29943 - DNA, 21 bp, Artificial sequence
  SiRNA target sequence
ttcactttggccatgatcggc

SEQ ID NO: 29944 - DNA, 21 bp, Artificial sequence
  SiRNA target sequence
tcactttggccatgatcggcc

SEQ ID NO: 29945 - DNA, 21 bp, Artificial sequence
  SiRNA target sequence
cactttggccatgatcggcct

SEQ ID NO: 29946 - DNA, 21 bp, Artificial sequence
  SiRNA target sequence
actttggccatgatcggcctt

SEQ ID NO: 29947 - DNA, 21 bp, Artificial sequence
  SiRNA target sequence
ctttggccatgatcggccttg

SEQ ID NO: 29948 - DNA, 21 bp, Artificial sequence
  SiRNA target sequence
tttggccatgatcggccttgc

SEQ ID NO: 29949 - DNA, 21 bp, Artificial sequence
  SiRNA target sequence
ttggccatgatcggccttgca

SEQ ID NO: 29950 - DNA, 21 bp, Artificial sequence
  SiRNA target sequence
tggccatgatcggccttgcac

SEQ ID NO: 29951 - DNA, 21 bp, Artificial sequence
  SiRNA target sequence
ggccatgatcggccttgcacg

SEQ ID NO: 29952 - DNA, 21 bp, Artificial sequence
  SiRNA target sequence
gccatgatcggccttgcacgg

SEQ ID NO: 29953 - DNA, 21 bp, Artificial sequence
  SiRNA target sequence
ccatgatcggccttgcacggt

SEQ ID NO: 29954 - DNA, 21 bp, Artificial sequence
  SiRNA target sequence
catgatcggccttgcacggta

SEQ ID NO: 29955 - DNA, 21 bp, Artificial sequence
  SiRNA target sequence
atgatcggccttgcacggtag

SEQ ID NO: 29956 - DNA, 21 bp, Artificial sequence
  SiRNA target sequence
tgatcggccttgcacggtaga

SEQ ID NO: 29957 - DNA, 21 bp, Artificial sequence
  SiRNA target sequence
gatcggccttgcacggtagat

SEQ ID NO: 29958 - DNA, 21 bp, Artificial sequence
  SiRNA target sequence
atcggccttgcacggtagata

SEQ ID NO: 29959 - DNA, 21 bp, Artificial sequence
  SiRNA target sequence
tcggccttgcacggtagatac

SEQ ID NO: 29960 - DNA, 21 bp, Artificial sequence
  SiRNA target sequence
cggccttgcacggtagatact

SEQ ID NO: 29961 - DNA, 21 bp, Artificial sequence
  SiRNA target sequence
ggccttgcacggtagatacta

SEQ ID NO: 29962 - DNA, 21 bp, Artificial sequence
  SiRNA target sequence
gccttgcacggtagatactac

SEQ ID NO: 29963 - DNA, 21 bp, Artificial sequence
  SiRNA target sequence
ccttgcacggtagatactacc

SEQ ID NO: 29964 - DNA, 21 bp, Artificial sequence
  SiRNA target sequence
cttgcacggtagatactaccg

SEQ ID NO: 29965 - DNA, 21 bp, Artificial sequence
  SiRNA target sequence
ttgcacggtagatactaccgt

SEQ ID NO: 29966 - DNA, 21 bp, Artificial sequence
  SiRNA target sequence
tgcacggtagatactaccgtt

SEQ ID NO: 29967 - DNA, 21 bp, Artificial sequence
  SiRNA target sequence
gcacggtagatactaccgtta

SEQ ID NO: 29968 - DNA, 21 bp, Artificial sequence
  SiRNA target sequence
cacggtagatactaccgttat

SEQ ID NO: 29969 - DNA, 21 bp, Artificial sequence
  SiRNA target sequence
acggtagatactaccgttata

SEQ ID NO: 29970 - DNA, 21 bp, Artificial sequence
  SiRNA target sequence
cggtagatactaccgttatat

SEQ ID NO: 29971 - DNA, 21 bp, Artificial sequence
  SiRNA target sequence
ggtagatactaccgttatatc

SEQ ID NO: 29972 - DNA, 21 bp, Artificial sequence
  SiRNA target sequence
gtagatactaccgttatatcg

SEQ ID NO: 29973 - DNA, 21 bp, Artificial sequence
  SiRNA target sequence
tagatactaccgttatatcgt

SEQ ID NO: 29974 - DNA, 21 bp, Artificial sequence
  SiRNA target sequence
agatactaccgttatatcgtc

SEQ ID NO: 29975 - DNA, 21 bp, Artificial sequence
  SiRNA target sequence
gatactaccgttatatcgtct

SEQ ID NO: 29976 - DNA, 21 bp, Artificial sequence
  SiRNA target sequence
atactaccgttatatcgtctg

SEQ ID NO: 29977 - DNA, 21 bp, Artificial sequence
  SiRNA target sequence
tactaccgttatatcgtctga

SEQ ID NO: 29978 - DNA, 21 bp, Artificial sequence
  SiRNA target sequence
actaccgttatatcgtctgac

SEQ ID NO: 29979 - DNA, 21 bp, Artificial sequence
  SiRNA target sequence
ctaccgttatatcgtctgacc

SEQ ID NO: 29980 - DNA, 21 bp, Artificial sequence
  SiRNA target sequence
taccgttatatcgtctgacct

SEQ ID NO: 29981 - DNA, 21 bp, Artificial sequence
  SiRNA target sequence
accgttatatcgtctgaccta

SEQ ID NO: 29982 - DNA, 21 bp, Artificial sequence
  SiRNA target sequence
ccgttatatcgtctgacctac

SEQ ID NO: 29983 - DNA, 21 bp, Artificial sequence
  SiRNA target sequence
cgttatatcgtctgacctact

SEQ ID NO: 29984 - DNA, 21 bp, Artificial sequence
  SiRNA target sequence
gttatatcgtctgacctacta

SEQ ID NO: 29985 - DNA, 21 bp, Artificial sequence
  SiRNA target sequence
ttatatcgtctgacctactac

SEQ ID NO: 29986 - DNA, 21 bp, Artificial sequence
  SiRNA target sequence
tatatcgtctgacctactaca

SEQ ID NO: 29987 - DNA, 21 bp, Artificial sequence
  SiRNA target sequence
atatcgtctgacctactacac

SEQ ID NO: 29988 - DNA, 21 bp, Artificial sequence
  SiRNA target sequence
tatcgtctgacctactacact

SEQ ID NO: 29989 - DNA, 21 bp, Artificial sequence
  SiRNA target sequence
atcgtctgacctactacactg

SEQ ID NO: 29990 - DNA, 21 bp, Artificial sequence
  SiRNA target sequence
tcgtctgacctactacactgg

SEQ ID NO: 29991 - DNA, 21 bp, Artificial sequence
  SiRNA target sequence
cgtctgacctactacactggt

SEQ ID NO: 29992 - DNA, 21 bp, Artificial sequence
  SiRNA target sequence
gtctgacctactacactggtg

SEQ ID NO: 29993 - DNA, 21 bp, Artificial sequence
  SiRNA target sequence
tctgacctactacactggtgc

SEQ ID NO: 29994 - DNA, 21 bp, Artificial sequence
  SiRNA target sequence
ctgacctactacactggtgcc

SEQ ID NO: 29995 - DNA, 21 bp, Artificial sequence
  SiRNA target sequence
tgacctactacactggtgcca

SEQ ID NO: 29996 - DNA, 21 bp, Artificial sequence
  SiRNA target sequence
gacctactacactggtgccac

SEQ ID NO: 29997 - DNA, 21 bp, Artificial sequence
  SiRNA target sequence
acctactacactggtgccact

SEQ ID NO: 29998 - DNA, 21 bp, Artificial sequence
  SiRNA target sequence
cctactacactggtgccactg

SEQ ID NO: 29999 - DNA, 21 bp, Artificial sequence
  SiRNA target sequence
ctactacactggtgccactga

SEQ ID NO: 30000 - DNA, 21 bp, Artificial sequence
  SiRNA target sequence
tactacactggtgccactgac

SEQ ID NO: 30001 - DNA, 21 bp, Artificial sequence
  SiRNA target sequence
actacactggtgccactgaca

SEQ ID NO: 30002 - DNA, 21 bp, Artificial sequence
  SiRNA target sequence
ctacactggtgccactgacag

SEQ ID NO: 30003 - DNA, 21 bp, Artificial sequence
  SiRNA target sequence
tacactggtgccactgacagc

SEQ ID NO: 30004 - DNA, 21 bp, Artificial sequence
  SiRNA target sequence
acactggtgccactgacagct

SEQ ID NO: 30005 - DNA, 21 bp, Artificial sequence
  SiRNA target sequence
cactggtgccactgacagcta

SEQ ID NO: 30006 - DNA, 21 bp, Artificial sequence
  SiRNA target sequence
actggtgccactgacagctaa

SEQ ID NO: 30007 - DNA, 21 bp, Artificial sequence
  SiRNA target sequence
ctggtgccactgacagctaat

SEQ ID NO: 30008 - DNA, 21 bp, Artificial sequence
  SiRNA target sequence
tggtgccactgacagctaata

SEQ ID NO: 30009 - DNA, 21 bp, Artificial sequence
  SiRNA target sequence
ggtgccactgacagctaataa

SEQ ID NO: 30010 - DNA, 21 bp, Artificial sequence
  SiRNA target sequence
gtgccactgacagctaataac

SEQ ID NO: 30011 - DNA, 21 bp, Artificial sequence
  SiRNA target sequence
tgccactgacagctaataacg

SEQ ID NO: 30012 - DNA, 21 bp, Artificial sequence
  SiRNA target sequence
gccactgacagctaataacgc

SEQ ID NO: 30013 - DNA, 21 bp, Artificial sequence
  SiRNA target sequence
ccactgacagctaataacgcg

SEQ ID NO: 30014 - DNA, 21 bp, Artificial sequence
  SiRNA target sequence
cactgacagctaataacgcgg

SEQ ID NO: 30015 - DNA, 21 bp, Artificial sequence
  SiRNA target sequence
actgacagctaataacgcggt

SEQ ID NO: 30016 - DNA, 21 bp, Artificial sequence
  SiRNA target sequence
ctgacagctaataacgcggtc

SEQ ID NO: 30017 - DNA, 21 bp, Artificial sequence
  SiRNA target sequence
tgacagctaataacgcggtca

SEQ ID NO: 30018 - DNA, 21 bp, Artificial sequence
  SiRNA target sequence
gacagctaataacgcggtcaa

SEQ ID NO: 30019 - DNA, 21 bp, Artificial sequence
  SiRNA target sequence
acagctaataacgcggtcaac

SEQ ID NO: 30020 - DNA, 21 bp, Artificial sequence
  SiRNA target sequence
cagctaataacgcggtcaaca

SEQ ID NO: 30021 - DNA, 21 bp, Artificial sequence
  SiRNA target sequence
agctaataacgcggtcaacac

SEQ ID NO: 30022 - DNA, 21 bp, Artificial sequence
  SiRNA target sequence
gctaataacgcggtcaacacc

SEQ ID NO: 30023 - DNA, 21 bp, Artificial sequence
  SiRNA target sequence
ctaataacgcggtcaacacca

SEQ ID NO: 30024 - DNA, 21 bp, Artificial sequence
  SiRNA target sequence
taataacgcggtcaacaccac

SEQ ID NO: 30025 - DNA, 21 bp, Artificial sequence
  SiRNA target sequence
aataacgcggtcaacaccact

SEQ ID NO: 30026 - DNA, 21 bp, Artificial sequence
  SiRNA target sequence
ataacgcggtcaacaccacta

SEQ ID NO: 30027 - DNA, 21 bp, Artificial sequence
  SiRNA target sequence
taacgcggtcaacaccactat

SEQ ID NO: 30028 - DNA, 21 bp, Artificial sequence
  SiRNA target sequence
aacgcggtcaacaccactatt

SEQ ID NO: 30029 - DNA, 21 bp, Artificial sequence
  SiRNA target sequence
acgcggtcaacaccactattc

SEQ ID NO: 30030 - DNA, 21 bp, Artificial sequence
  SiRNA target sequence
cgcggtcaacaccactattct

SEQ ID NO: 30031 - DNA, 21 bp, Artificial sequence
  SiRNA target sequence
gcggtcaacaccactattctg

SEQ ID NO: 30032 - DNA, 21 bp, Artificial sequence
  SiRNA target sequence
cggtcaacaccactattctgg

SEQ ID NO: 30033 - DNA, 21 bp, Artificial sequence
  SiRNA target sequence
ggtcaacaccactattctggg

SEQ ID NO: 30034 - DNA, 21 bp, Artificial sequence
  SiRNA target sequence
gtcaacaccactattctgggt

SEQ ID NO: 30035 - DNA, 21 bp, Artificial sequence
  SiRNA target sequence
tcaacaccactattctgggtc

SEQ ID NO: 30036 - DNA, 21 bp, Artificial sequence
  SiRNA target sequence
caacaccactattctgggtca

SEQ ID NO: 30037 - DNA, 21 bp, Artificial sequence
  SiRNA target sequence
aacaccactattctgggtcag

SEQ ID NO: 30038 - DNA, 21 bp, Artificial sequence
  SiRNA target sequence
acaccactattctgggtcagg

SEQ ID NO: 30039 - DNA, 21 bp, Artificial sequence
  SiRNA target sequence
caccactattctgggtcaggc

SEQ ID NO: 30040 - DNA, 21 bp, Artificial sequence
  SiRNA target sequence
accactattctgggtcaggct

SEQ ID NO: 30041 - DNA, 21 bp, Artificial sequence
  SiRNA target sequence
ccactattctgggtcaggctg

SEQ ID NO: 30042 - DNA, 21 bp, Artificial sequence
  SiRNA target sequence
cactattctgggtcaggctgg

SEQ ID NO: 30043 - DNA, 21 bp, Artificial sequence
  SiRNA target sequence
actattctgggtcaggctgga

SEQ ID NO: 30044 - DNA, 21 bp, Artificial sequence
  SiRNA target sequence
ctattctgggtcaggctggac

SEQ ID NO: 30045 - DNA, 21 bp, Artificial sequence
  SiRNA target sequence
tattctgggtcaggctggact

SEQ ID NO: 30046 - DNA, 21 bp, Artificial sequence
  SiRNA target sequence
attctgggtcaggctggactt

SEQ ID NO: 30047 - DNA, 21 bp, Artificial sequence
  SiRNA target sequence
ttctgggtcaggctggacttg

SEQ ID NO: 30048 - DNA, 21 bp, Artificial sequence
  SiRNA target sequence
tctgggtcaggctggacttgg

SEQ ID NO: 30049 - DNA, 21 bp, Artificial sequence
  SiRNA target sequence
ctgggtcaggctggacttggt

SEQ ID NO: 30050 - DNA, 21 bp, Artificial sequence
  SiRNA target sequence
tgggtcaggctggacttggta

SEQ ID NO: 30051 - DNA, 21 bp, Artificial sequence
  SiRNA target sequence
gggtcaggctggacttggtaa

SEQ ID NO: 30052 - DNA, 21 bp, Artificial sequence
  SiRNA target sequence
ggtcaggctggacttggtaat

SEQ ID NO: 30053 - DNA, 21 bp, Artificial sequence
  SiRNA target sequence
gtcaggctggacttggtaatt

SEQ ID NO: 30054 - DNA, 21 bp, Artificial sequence
  SiRNA target sequence
tcaggctggacttggtaattg

SEQ ID NO: 30055 - DNA, 21 bp, Artificial sequence
  SiRNA target sequence
caggctggacttggtaattgg

SEQ ID NO: 30056 - DNA, 21 bp, Artificial sequence
  SiRNA target sequence
aggctggacttggtaattggg

SEQ ID NO: 30057 - DNA, 21 bp, Artificial sequence
  SiRNA target sequence
ggctggacttggtaattgggc

SEQ ID NO: 30058 - DNA, 21 bp, Artificial sequence
  SiRNA target sequence
gctggacttggtaattgggca

SEQ ID NO: 30059 - DNA, 21 bp, Artificial sequence
  SiRNA target sequence
ctggacttggtaattgggcat

SEQ ID NO: 30060 - DNA, 21 bp, Artificial sequence
  SiRNA target sequence
tggacttggtaattgggcatc

SEQ ID NO: 30061 - DNA, 21 bp, Artificial sequence
  SiRNA target sequence
ggacttggtaattgggcatct

SEQ ID NO: 30062 - DNA, 21 bp, Artificial sequence
  SiRNA target sequence
gacttggtaattgggcatctg

SEQ ID NO: 30063 - DNA, 21 bp, Artificial sequence
  SiRNA target sequence
acttggtaattgggcatctgc

SEQ ID NO: 30064 - DNA, 21 bp, Artificial sequence
  SiRNA target sequence
cttggtaattgggcatctgcc

SEQ ID NO: 30065 - DNA, 21 bp, Artificial sequence
  SiRNA target sequence
ttggtaattgggcatctgcca

SEQ ID NO: 30066 - DNA, 21 bp, Artificial sequence
  SiRNA target sequence
tggtaattgggcatctgccaa

SEQ ID NO: 30067 - DNA, 21 bp, Artificial sequence
  SiRNA target sequence
ggtaattgggcatctgccaac

SEQ ID NO: 30068 - DNA, 21 bp, Artificial sequence
  SiRNA target sequence
gtaattgggcatctgccaacc

SEQ ID NO: 30069 - DNA, 21 bp, Artificial sequence
  SiRNA target sequence
taattgggcatctgccaaccc

SEQ ID NO: 30070 - DNA, 21 bp, Artificial sequence
  SiRNA target sequence
aattgggcatctgccaacccc

SEQ ID NO: 30071 - DNA, 21 bp, Artificial sequence
  SiRNA target sequence
attgggcatctgccaacccca

SEQ ID NO: 30072 - DNA, 21 bp, Artificial sequence
  SiRNA target sequence
ttgggcatctgccaaccccac

SEQ ID NO: 30073 - DNA, 21 bp, Artificial sequence
  SiRNA target sequence
tgggcatctgccaaccccact

SEQ ID NO: 30074 - DNA, 21 bp, Artificial sequence
  SiRNA target sequence
gggcatctgccaaccccactg

SEQ ID NO: 30075 - DNA, 21 bp, Artificial sequence
  SiRNA target sequence
ggcatctgccaaccccactgt

SEQ ID NO: 30076 - DNA, 21 bp, Artificial sequence
  SiRNA target sequence
gcatctgccaaccccactgta

SEQ ID NO: 30077 - DNA, 21 bp, Artificial sequence
  SiRNA target sequence
catctgccaaccccactgtac

SEQ ID NO: 30078 - DNA, 21 bp, Artificial sequence
  SiRNA target sequence
atctgccaaccccactgtacg

SEQ ID NO: 30079 - DNA, 21 bp, Artificial sequence
  SiRNA target sequence
tctgccaaccccactgtacgg

SEQ ID NO: 30080 - DNA, 21 bp, Artificial sequence
  SiRNA target sequence
ctgccaaccccactgtacggg

SEQ ID NO: 30081 - DNA, 21 bp, Artificial sequence
  SiRNA target sequence
tgccaaccccactgtacgggc

SEQ ID NO: 30082 - DNA, 21 bp, Artificial sequence
  SiRNA target sequence
gccaaccccactgtacgggcc

SEQ ID NO: 30083 - DNA, 21 bp, Artificial sequence
  SiRNA target sequence
ccaaccccactgtacgggccc

SEQ ID NO: 30084 - DNA, 21 bp, Artificial sequence
  SiRNA target sequence
caaccccactgtacgggccca

SEQ ID NO: 30085 - DNA, 21 bp, Artificial sequence
  SiRNA target sequence
aaccccactgtacgggcccat

SEQ ID NO: 30086 - DNA, 21 bp, Artificial sequence
  SiRNA target sequence
accccactgtacgggcccata

SEQ ID NO: 30087 - DNA, 21 bp, Artificial sequence
  SiRNA target sequence
ccccactgtacgggcccatac

SEQ ID NO: 30088 - DNA, 21 bp, Artificial sequence
  SiRNA target sequence
cccactgtacgggcccatacc

SEQ ID NO: 30089 - DNA, 21 bp, Artificial sequence
  SiRNA target sequence
ccactgtacgggcccataccg

SEQ ID NO: 30090 - DNA, 21 bp, Artificial sequence
  SiRNA target sequence
cactgtacgggcccataccga

SEQ ID NO: 30091 - DNA, 21 bp, Artificial sequence
  SiRNA target sequence
actgtacgggcccataccgag

SEQ ID NO: 30092 - DNA, 21 bp, Artificial sequence
  SiRNA target sequence
ctgtacgggcccataccgaga

SEQ ID NO: 30093 - DNA, 21 bp, Artificial sequence
  SiRNA target sequence
tgtacgggcccataccgagac

SEQ ID NO: 30094 - DNA, 21 bp, Artificial sequence
  SiRNA target sequence
gtacgggcccataccgagacg

SEQ ID NO: 30095 - DNA, 21 bp, Artificial sequence
  SiRNA target sequence
tacgggcccataccgagacgg

SEQ ID NO: 30096 - DNA, 21 bp, Artificial sequence
  SiRNA target sequence
acgggcccataccgagacgga

SEQ ID NO: 30097 - DNA, 21 bp, Artificial sequence
  SiRNA target sequence
cgggcccataccgagacggat

SEQ ID NO: 30098 - DNA, 21 bp, Artificial sequence
  SiRNA target sequence
gggcccataccgagacggatg

SEQ ID NO: 30099 - DNA, 21 bp, Artificial sequence
  SiRNA target sequence
ggcccataccgagacggatgc

SEQ ID NO: 30100 - DNA, 21 bp, Artificial sequence
  SiRNA target sequence
gcccataccgagacggatgca

SEQ ID NO: 30101 - DNA, 21 bp, Artificial sequence
  SiRNA target sequence
cccataccgagacggatgcag

SEQ ID NO: 30102 - DNA, 21 bp, Artificial sequence
  SiRNA target sequence
ccataccgagacggatgcagc

SEQ ID NO: 30103 - DNA, 21 bp, Artificial sequence
  SiRNA target sequence
cataccgagacggatgcagcc

SEQ ID NO: 30104 - DNA, 21 bp, Artificial sequence
  SiRNA target sequence
ataccgagacggatgcagccc

SEQ ID NO: 30105 - DNA, 21 bp, Artificial sequence
  SiRNA target sequence
taccgagacggatgcagcccc

SEQ ID NO: 30106 - DNA, 21 bp, Artificial sequence
  SiRNA target sequence
accgagacggatgcagcccct

SEQ ID NO: 30107 - DNA, 21 bp, Artificial sequence
  SiRNA target sequence
ccgagacggatgcagcccctc

SEQ ID NO: 30108 - DNA, 21 bp, Artificial sequence
  SiRNA target sequence
cgagacggatgcagcccctct

SEQ ID NO: 30109 - DNA, 21 bp, Artificial sequence
  SiRNA target sequence
gagacggatgcagcccctctt

SEQ ID NO: 30110 - DNA, 21 bp, Artificial sequence
  SiRNA target sequence
agacggatgcagcccctcttc

SEQ ID NO: 30111 - DNA, 21 bp, Artificial sequence
  SiRNA target sequence
gacggatgcagcccctcttca

SEQ ID NO: 30112 - DNA, 21 bp, Artificial sequence
  SiRNA target sequence
acggatgcagcccctcttcag

SEQ ID NO: 30113 - DNA, 21 bp, Artificial sequence
  SiRNA target sequence
cggatgcagcccctcttcagg

SEQ ID NO: 30114 - DNA, 21 bp, Artificial sequence
  SiRNA target sequence
ggatgcagcccctcttcagga

SEQ ID NO: 30115 - DNA, 21 bp, Artificial sequence
  SiRNA target sequence
gatgcagcccctcttcaggag

SEQ ID NO: 30116 - DNA, 21 bp, Artificial sequence
  SiRNA target sequence
atgcagcccctcttcaggagg

SEQ ID NO: 30117 - DNA, 21 bp, Artificial sequence
  SiRNA target sequence
tgcagcccctcttcaggaggc

SEQ ID NO: 30118 - DNA, 21 bp, Artificial sequence
  SiRNA target sequence
gcagcccctcttcaggaggcc

SEQ ID NO: 30119 - DNA, 21 bp, Artificial sequence
  SiRNA target sequence
cagcccctcttcaggaggcca

SEQ ID NO: 30120 - DNA, 21 bp, Artificial sequence
  SiRNA target sequence
agcccctcttcaggaggccat

SEQ ID NO: 30121 - DNA, 21 bp, Artificial sequence
  SiRNA target sequence
gcccctcttcaggaggccatg

SEQ ID NO: 30122 - DNA, 21 bp, Artificial sequence
  SiRNA target sequence
cccctcttcaggaggccatgc

SEQ ID NO: 30123 - DNA, 21 bp, Artificial sequence
  SiRNA target sequence
ccctcttcaggaggccatgca

SEQ ID NO: 30124 - DNA, 21 bp, Artificial sequence
  SiRNA target sequence
cctcttcaggaggccatgcac

SEQ ID NO: 30125 - DNA, 21 bp, Artificial sequence
  SiRNA target sequence
ctcttcaggaggccatgcacc

SEQ ID NO: 30126 - DNA, 21 bp, Artificial sequence
  SiRNA target sequence
tcttcaggaggccatgcaccc

SEQ ID NO: 30127 - DNA, 21 bp, Artificial sequence
  SiRNA target sequence
cttcaggaggccatgcaccct

SEQ ID NO: 30128 - DNA, 21 bp, Artificial sequence
  SiRNA target sequence
ttcaggaggccatgcaccctc

SEQ ID NO: 30129 - DNA, 21 bp, Artificial sequence
  SiRNA target sequence
tcaggaggccatgcaccctct

SEQ ID NO: 30130 - DNA, 21 bp, Artificial sequence
  SiRNA target sequence
caggaggccatgcaccctctt

SEQ ID NO: 30131 - DNA, 21 bp, Artificial sequence
  SiRNA target sequence
aggaggccatgcaccctctta

SEQ ID NO: 30132 - DNA, 21 bp, Artificial sequence
  SiRNA target sequence
ggaggccatgcaccctcttac

SEQ ID NO: 30133 - DNA, 21 bp, Artificial sequence
  SiRNA target sequence
gaggccatgcaccctcttacc

SEQ ID NO: 30134 - DNA, 21 bp, Artificial sequence
  SiRNA target sequence
aggccatgcaccctcttacca

SEQ ID NO: 30135 - DNA, 21 bp, Artificial sequence
  SiRNA target sequence
ggccatgcaccctcttaccag

SEQ ID NO: 30136 - DNA, 21 bp, Artificial sequence
  SiRNA target sequence
gccatgcaccctcttaccagt

SEQ ID NO: 30137 - DNA, 21 bp, Artificial sequence
  SiRNA target sequence
ccatgcaccctcttaccagtc

SEQ ID NO: 30138 - DNA, 21 bp, Artificial sequence
  SiRNA target sequence
catgcaccctcttaccagtcc

SEQ ID NO: 30139 - DNA, 21 bp, Artificial sequence
  SiRNA target sequence
atgcaccctcttaccagtcct

SEQ ID NO: 30140 - DNA, 21 bp, Artificial sequence
  SiRNA target sequence
tgcaccctcttaccagtcctg

SEQ ID NO: 30141 - DNA, 21 bp, Artificial sequence
  SiRNA target sequence
gcaccctcttaccagtcctgg

SEQ ID NO: 30142 - DNA, 21 bp, Artificial sequence
  SiRNA target sequence
caccctcttaccagtcctgga

SEQ ID NO: 30143 - DNA, 21 bp, Artificial sequence
  SiRNA target sequence
accctcttaccagtcctggat

SEQ ID NO: 30144 - DNA, 21 bp, Artificial sequence
  SiRNA target sequence
ccctcttaccagtcctggata

SEQ ID NO: 30145 - DNA, 21 bp, Artificial sequence
  SiRNA target sequence
cctcttaccagtcctggatag

SEQ ID NO: 30146 - DNA, 21 bp, Artificial sequence
  SiRNA target sequence
ctcttaccagtcctggatagg

SEQ ID NO: 30147 - DNA, 21 bp, Artificial sequence
  SiRNA target sequence
tcttaccagtcctggataggt

SEQ ID NO: 30148 - DNA, 21 bp, Artificial sequence
  SiRNA target sequence
cttaccagtcctggataggtg

SEQ ID NO: 30149 - DNA, 21 bp, Artificial sequence
  SiRNA target sequence
ttaccagtcctggataggtgc

SEQ ID NO: 30150 - DNA, 21 bp, Artificial sequence
  SiRNA target sequence
taccagtcctggataggtgct

SEQ ID NO: 30151 - DNA, 21 bp, Artificial sequence
  SiRNA target sequence
accagtcctggataggtgctg

SEQ ID NO: 30152 - DNA, 21 bp, Artificial sequence
  SiRNA target sequence
ccagtcctggataggtgctgt

SEQ ID NO: 30153 - DNA, 21 bp, Artificial sequence
  SiRNA target sequence
cagtcctggataggtgctgta

SEQ ID NO: 30154 - DNA, 21 bp, Artificial sequence
  SiRNA target sequence
agtcctggataggtgctgtac

SEQ ID NO: 30155 - DNA, 21 bp, Artificial sequence
  SiRNA target sequence
gtcctggataggtgctgtacc

SEQ ID NO: 30156 - DNA, 21 bp, Artificial sequence
  SiRNA target sequence
tcctggataggtgctgtacct

SEQ ID NO: 30157 - DNA, 21 bp, Artificial sequence
  SiRNA target sequence
cctggataggtgctgtaccta

SEQ ID NO: 30158 - DNA, 21 bp, Artificial sequence
  SiRNA target sequence
ctggataggtgctgtacctat

SEQ ID NO: 30159 - DNA, 21 bp, Artificial sequence
  SiRNA target sequence
tggataggtgctgtacctatt

SEQ ID NO: 30160 - DNA, 21 bp, Artificial sequence
  SiRNA target sequence
ggataggtgctgtacctattc

SEQ ID NO: 30161 - DNA, 21 bp, Artificial sequence
  SiRNA target sequence
gataggtgctgtacctattcc

SEQ ID NO: 30162 - DNA, 21 bp, Artificial sequence
  SiRNA target sequence
ataggtgctgtacctattcct

SEQ ID NO: 30163 - DNA, 21 bp, Artificial sequence
  SiRNA target sequence
taggtgctgtacctattccta

SEQ ID NO: 30164 - DNA, 21 bp, Artificial sequence
  SiRNA target sequence
aggtgctgtacctattcctat

SEQ ID NO: 30165 - DNA, 21 bp, Artificial sequence
  SiRNA target sequence
ggtgctgtacctattcctata

SEQ ID NO: 30166 - DNA, 21 bp, Artificial sequence
  SiRNA target sequence
gtgctgtacctattcctatat

SEQ ID NO: 30167 - DNA, 21 bp, Artificial sequence
  SiRNA target sequence
tgctgtacctattcctatatg

SEQ ID NO: 30168 - DNA, 21 bp, Artificial sequence
  SiRNA target sequence
gctgtacctattcctatatgg

SEQ ID NO: 30169 - DNA, 21 bp, Artificial sequence
  SiRNA target sequence
ctgtacctattcctatatggg

SEQ ID NO: 30170 - DNA, 21 bp, Artificial sequence
  SiRNA target sequence
tgtacctattcctatatgggg

SEQ ID NO: 30171 - DNA, 21 bp, Artificial sequence
  SiRNA target sequence
gtacctattcctatatggggg

SEQ ID NO: 30172 - DNA, 21 bp, Artificial sequence
  SiRNA target sequence
tacctattcctatatggggga

SEQ ID NO: 30173 - DNA, 21 bp, Artificial sequence
  SiRNA target sequence
acctattcctatatgggggaa

SEQ ID NO: 30174 - DNA, 21 bp, Artificial sequence
  SiRNA target sequence
cctattcctatatgggggaac

SEQ ID NO: 30175 - DNA, 21 bp, Artificial sequence
  SiRNA target sequence
ctattcctatatgggggaaca

SEQ ID NO: 30176 - DNA, 21 bp, Artificial sequence
  SiRNA target sequence
tattcctatatgggggaacac

SEQ ID NO: 30177 - DNA, 21 bp, Artificial sequence
  SiRNA target sequence
attcctatatgggggaacaca

SEQ ID NO: 30178 - DNA, 21 bp, Artificial sequence
  SiRNA target sequence
ttcctatatgggggaacacag

SEQ ID NO: 30179 - DNA, 21 bp, Artificial sequence
  SiRNA target sequence
tcctatatgggggaacacagc

SEQ ID NO: 30180 - DNA, 21 bp, Artificial sequence
  SiRNA target sequence
cctatatgggggaacacagca

SEQ ID NO: 30181 - DNA, 21 bp, Artificial sequence
  SiRNA target sequence
ctatatgggggaacacagcag

SEQ ID NO: 30182 - DNA, 21 bp, Artificial sequence
  SiRNA target sequence
tatatgggggaacacagcagc

SEQ ID NO: 30183 - DNA, 21 bp, Artificial sequence
  SiRNA target sequence
atatgggggaacacagcagcc

SEQ ID NO: 30184 - DNA, 21 bp, Artificial sequence
  SiRNA target sequence
tatgggggaacacagcagcca

SEQ ID NO: 30185 - DNA, 21 bp, Artificial sequence
  SiRNA target sequence
atgggggaacacagcagccat

SEQ ID NO: 30186 - DNA, 21 bp, Artificial sequence
  SiRNA target sequence
tgggggaacacagcagccatc

SEQ ID NO: 30187 - DNA, 21 bp, Artificial sequence
  SiRNA target sequence
gggggaacacagcagccatcg

SEQ ID NO: 30188 - DNA, 21 bp, Artificial sequence
  SiRNA target sequence
ggggaacacagcagccatcga

SEQ ID NO: 30189 - DNA, 21 bp, Artificial sequence
  SiRNA target sequence
gggaacacagcagccatcgat

SEQ ID NO: 30190 - DNA, 21 bp, Artificial sequence
  SiRNA target sequence
ggaacacagcagccatcgata

SEQ ID NO: 30191 - DNA, 21 bp, Artificial sequence
  SiRNA target sequence
gaacacagcagccatcgatag

SEQ ID NO: 30192 - DNA, 21 bp, Artificial sequence
  SiRNA target sequence
aacacagcagccatcgataga

SEQ ID NO: 30193 - DNA, 21 bp, Artificial sequence
  SiRNA target sequence
acacagcagccatcgatagat

SEQ ID NO: 30194 - DNA, 21 bp, Artificial sequence
  SiRNA target sequence
cacagcagccatcgatagata

SEQ ID NO: 30195 - DNA, 21 bp, Artificial sequence
  SiRNA target sequence
acagcagccatcgatagataa

SEQ ID NO: 30196 - DNA, 21 bp, Artificial sequence
  SiRNA target sequence
cagcagccatcgatagataag

SEQ ID NO: 30197 - DNA, 21 bp, Artificial sequence
  SiRNA target sequence
agcagccatcgatagataagt

SEQ ID NO: 30198 - DNA, 21 bp, Artificial sequence
  SiRNA target sequence
gcagccatcgatagataagtc

SEQ ID NO: 30199 - DNA, 21 bp, Artificial sequence
  SiRNA target sequence
cagccatcgatagataagtcg

SEQ ID NO: 30200 - DNA, 21 bp, Artificial sequence
  SiRNA target sequence
agccatcgatagataagtcgt

SEQ ID NO: 30201 - DNA, 21 bp, Artificial sequence
  SiRNA target sequence
gccatcgatagataagtcgtc

SEQ ID NO: 30202 - DNA, 21 bp, Artificial sequence
  SiRNA target sequence
ccatcgatagataagtcgtca

SEQ ID NO: 30203 - DNA, 21 bp, Artificial sequence
  SiRNA target sequence
catcgatagataagtcgtcat

SEQ ID NO: 30204 - DNA, 21 bp, Artificial sequence
  SiRNA target sequence
atcgatagataagtcgtcata

SEQ ID NO: 30205 - DNA, 21 bp, Artificial sequence
  SiRNA target sequence
tcgatagataagtcgtcatac

SEQ ID NO: 30206 - DNA, 21 bp, Artificial sequence
  SiRNA target sequence
cgatagataagtcgtcatacg

SEQ ID NO: 30207 - DNA, 21 bp, Artificial sequence
  SiRNA target sequence
gatagataagtcgtcatacgc

SEQ ID NO: 30208 - DNA, 21 bp, Artificial sequence
  SiRNA target sequence
atagataagtcgtcatacgcc

SEQ ID NO: 30209 - DNA, 21 bp, Artificial sequence
  SiRNA target sequence
tagataagtcgtcatacgccc

SEQ ID NO: 30210 - DNA, 21 bp, Artificial sequence
  SiRNA target sequence
agataagtcgtcatacgccct

SEQ ID NO: 30211 - DNA, 21 bp, Artificial sequence
  SiRNA target sequence
gataagtcgtcatacgcccta

SEQ ID NO: 30212 - DNA, 21 bp, Artificial sequence
  SiRNA target sequence
ataagtcgtcatacgccctat

SEQ ID NO: 30213 - DNA, 21 bp, Artificial sequence
  SiRNA target sequence
taagtcgtcatacgccctatc

SEQ ID NO: 30214 - DNA, 21 bp, Artificial sequence
  SiRNA target sequence
aagtcgtcatacgccctatca

SEQ ID NO: 30215 - DNA, 21 bp, Artificial sequence
  SiRNA target sequence
agtcgtcatacgccctatcat

SEQ ID NO: 30216 - DNA, 21 bp, Artificial sequence
  SiRNA target sequence
gtcgtcatacgccctatcatg

SEQ ID NO: 30217 - DNA, 21 bp, Artificial sequence
  SiRNA target sequence
tcgtcatacgccctatcatgg

SEQ ID NO: 30218 - DNA, 21 bp, Artificial sequence
  SiRNA target sequence
cgtcatacgccctatcatggt

SEQ ID NO: 30219 - DNA, 21 bp, Artificial sequence
  SiRNA target sequence
gtcatacgccctatcatggtt

SEQ ID NO: 30220 - DNA, 21 bp, Artificial sequence
  SiRNA target sequence
gatgaacgtcgacctattgaa

SEQ ID NO: 30221 - DNA, 21 bp, Artificial sequence
  SiRNA target sequence
atgaacgtcgacctattgaaa

SEQ ID NO: 30222 - DNA, 21 bp, Artificial sequence
  SiRNA target sequence
tgaacgtcgacctattgaaaa

SEQ ID NO: 30223 - DNA, 21 bp, Artificial sequence
  SiRNA target sequence
gaacgtcgacctattgaaaaa

SEQ ID NO: 30224 - DNA, 21 bp, Artificial sequence
  SiRNA target sequence
aacgtcgacctattgaaaaag

SEQ ID NO: 30225 - DNA, 21 bp, Artificial sequence
  SiRNA target sequence
acgtcgacctattgaaaaagt

SEQ ID NO: 30226 - DNA, 21 bp, Artificial sequence
  SiRNA target sequence
cgtcgacctattgaaaaagtt

SEQ ID NO: 30227 - DNA, 21 bp, Artificial sequence
  SiRNA target sequence
gtcgacctattgaaaaagtta

SEQ ID NO: 30228 - DNA, 21 bp, Artificial sequence
  SiRNA target sequence
tcgacctattgaaaaagttaa

SEQ ID NO: 30229 - DNA, 21 bp, Artificial sequence
  SiRNA target sequence
cgacctattgaaaaagttaat

SEQ ID NO: 30230 - DNA, 21 bp, Artificial sequence
  SiRNA target sequence
gacctattgaaaaagttaatc

SEQ ID NO: 30231 - DNA, 21 bp, Artificial sequence
  SiRNA target sequence
acctattgaaaaagttaatca

SEQ ID NO: 30232 - DNA, 21 bp, Artificial sequence
  SiRNA target sequence
cctattgaaaaagttaatcaa

SEQ ID NO: 30233 - DNA, 21 bp, Artificial sequence
  SiRNA target sequence
ctattgaaaaagttaatcaat

SEQ ID NO: 30234 - DNA, 21 bp, Artificial sequence
  SiRNA target sequence
tattgaaaaagttaatcaatt

SEQ ID NO: 30235 - DNA, 21 bp, Artificial sequence
  SiRNA target sequence
attgaaaaagttaatcaattg

SEQ ID NO: 30236 - DNA, 21 bp, Artificial sequence
  SiRNA target sequence
ttgaaaaagttaatcaattga

SEQ ID NO: 30237 - DNA, 21 bp, Artificial sequence
  SiRNA target sequence
tgaaaaagttaatcaattgaa

SEQ ID NO: 30238 - DNA, 21 bp, Artificial sequence
  SiRNA target sequence
gaaaaagttaatcaattgaaa

SEQ ID NO: 30239 - DNA, 21 bp, Artificial sequence
  SiRNA target sequence
aaaaagttaatcaattgaaaa

SEQ ID NO: 30240 - DNA, 21 bp, Artificial sequence
  SiRNA target sequence
aaaagttaatcaattgaaaac

SEQ ID NO: 30241 - DNA, 21 bp, Artificial sequence
  SiRNA target sequence
aaagttaatcaattgaaaaca

SEQ ID NO: 30242 - DNA, 21 bp, Artificial sequence
  SiRNA target sequence
aagttaatcaattgaaaacac

SEQ ID NO: 30243 - DNA, 21 bp, Artificial sequence
  SiRNA target sequence
agttaatcaattgaaaacacg

SEQ ID NO: 30244 - DNA, 21 bp, Artificial sequence
  SiRNA target sequence
gttaatcaattgaaaacacga

SEQ ID NO: 30245 - DNA, 21 bp, Artificial sequence
  SiRNA target sequence
ttaatcaattgaaaacacgag

SEQ ID NO: 30246 - DNA, 21 bp, Artificial sequence
  SiRNA target sequence
taatcaattgaaaacacgagt

SEQ ID NO: 30247 - DNA, 21 bp, Artificial sequence
  SiRNA target sequence
aatcaattgaaaacacgagta

SEQ ID NO: 30248 - DNA, 21 bp, Artificial sequence
  SiRNA target sequence
atcaattgaaaacacgagtat

SEQ ID NO: 30249 - DNA, 21 bp, Artificial sequence
  SiRNA target sequence
tcaattgaaaacacgagtatt

SEQ ID NO: 30250 - DNA, 21 bp, Artificial sequence
  SiRNA target sequence
caattgaaaacacgagtattc

SEQ ID NO: 30251 - DNA, 21 bp, Artificial sequence
  SiRNA target sequence
aattgaaaacacgagtattct

SEQ ID NO: 30252 - DNA, 21 bp, Artificial sequence
  SiRNA target sequence
attgaaaacacgagtattctc

SEQ ID NO: 30253 - DNA, 21 bp, Artificial sequence
  SiRNA target sequence
ttgaaaacacgagtattctca

SEQ ID NO: 30254 - DNA, 21 bp, Artificial sequence
  SiRNA target sequence
tgaaaacacgagtattctcaa

SEQ ID NO: 30255 - DNA, 21 bp, Artificial sequence
  SiRNA target sequence
gaaaacacgagtattctcaaa

SEQ ID NO: 30256 - DNA, 21 bp, Artificial sequence
  SiRNA target sequence
aaaacacgagtattctcaaat

SEQ ID NO: 30257 - DNA, 21 bp, Artificial sequence
  SiRNA target sequence
aaacacgagtattctcaaatg

SEQ ID NO: 30258 - DNA, 21 bp, Artificial sequence
  SiRNA target sequence
aacacgagtattctcaaatgg

SEQ ID NO: 30259 - DNA, 21 bp, Artificial sequence
  SiRNA target sequence
acacgagtattctcaaatgga

SEQ ID NO: 30260 - DNA, 21 bp, Artificial sequence
  SiRNA target sequence
cacgagtattctcaaatggac

SEQ ID NO: 30261 - DNA, 21 bp, Artificial sequence
  SiRNA target sequence
acgagtattctcaaatggacc

SEQ ID NO: 30262 - DNA, 21 bp, Artificial sequence
  SiRNA target sequence
cgagtattctcaaatggacca

SEQ ID NO: 30263 - DNA, 21 bp, Artificial sequence
  SiRNA target sequence
gagtattctcaaatggaccaa

SEQ ID NO: 30264 - DNA, 21 bp, Artificial sequence
  SiRNA target sequence
agtattctcaaatggaccaat

SEQ ID NO: 30265 - DNA, 21 bp, Artificial sequence
  SiRNA target sequence
gtattctcaaatggaccaatg

SEQ ID NO: 30266 - DNA, 21 bp, Artificial sequence
  SiRNA target sequence
tattctcaaatggaccaatgg

SEQ ID NO: 30267 - DNA, 21 bp, Artificial sequence
  SiRNA target sequence
attctcaaatggaccaatgga

SEQ ID NO: 30268 - DNA, 21 bp, Artificial sequence
  SiRNA target sequence
ttctcaaatggaccaatggac

SEQ ID NO: 30269 - DNA, 21 bp, Artificial sequence
  SiRNA target sequence
tctcaaatggaccaatggact

SEQ ID NO: 30270 - DNA, 21 bp, Artificial sequence
  SiRNA target sequence
ctcaaatggaccaatggactt

SEQ ID NO: 30271 - DNA, 21 bp, Artificial sequence
  SiRNA target sequence
tcaaatggaccaatggacttc

SEQ ID NO: 30272 - DNA, 21 bp, Artificial sequence
  SiRNA target sequence
caaatggaccaatggacttct

SEQ ID NO: 30273 - DNA, 21 bp, Artificial sequence
  SiRNA target sequence
aaatggaccaatggacttctc

SEQ ID NO: 30274 - DNA, 21 bp, Artificial sequence
  SiRNA target sequence
aatggaccaatggacttctca

SEQ ID NO: 30275 - DNA, 21 bp, Artificial sequence
  SiRNA target sequence
atggaccaatggacttctcaa

SEQ ID NO: 30276 - DNA, 21 bp, Artificial sequence
  SiRNA target sequence
tggaccaatggacttctcaat

SEQ ID NO: 30277 - DNA, 21 bp, Artificial sequence
  SiRNA target sequence
ggaccaatggacttctcaatt

SEQ ID NO: 30278 - DNA, 21 bp, Artificial sequence
  SiRNA target sequence
gaccaatggacttctcaattg

SEQ ID NO: 30279 - DNA, 21 bp, Artificial sequence
  SiRNA target sequence
accaatggacttctcaattgc

SEQ ID NO: 30280 - DNA, 21 bp, Artificial sequence
  SiRNA target sequence
ccaatggacttctcaattgcg

SEQ ID NO: 30281 - DNA, 21 bp, Artificial sequence
  SiRNA target sequence
caatggacttctcaattgcgt

SEQ ID NO: 30282 - DNA, 21 bp, Artificial sequence
  SiRNA target sequence
aatggacttctcaattgcgtt

SEQ ID NO: 30283 - DNA, 21 bp, Artificial sequence
  SiRNA target sequence
atggacttctcaattgcgttt

SEQ ID NO: 30284 - DNA, 21 bp, Artificial sequence
  SiRNA target sequence
tggacttctcaattgcgtttc

SEQ ID NO: 30285 - DNA, 21 bp, Artificial sequence
  SiRNA target sequence
ggacttctcaattgcgtttcg

SEQ ID NO: 30286 - DNA, 21 bp, Artificial sequence
  SiRNA target sequence
gacttctcaattgcgtttcga

SEQ ID NO: 30287 - DNA, 21 bp, Artificial sequence
  SiRNA target sequence
acttctcaattgcgtttcgaa

SEQ ID NO: 30288 - DNA, 21 bp, Artificial sequence
  SiRNA target sequence
cttctcaattgcgtttcgaat

SEQ ID NO: 30289 - DNA, 21 bp, Artificial sequence
  SiRNA target sequence
ttctcaattgcgtttcgaatg

SEQ ID NO: 30290 - DNA, 21 bp, Artificial sequence
  SiRNA target sequence
tctcaattgcgtttcgaatgt

SEQ ID NO: 30291 - DNA, 21 bp, Artificial sequence
  SiRNA target sequence
ctcaattgcgtttcgaatgta

SEQ ID NO: 30292 - DNA, 21 bp, Artificial sequence
  SiRNA target sequence
tcaattgcgtttcgaatgtat

SEQ ID NO: 30293 - DNA, 21 bp, Artificial sequence
  SiRNA target sequence
caattgcgtttcgaatgtatt

SEQ ID NO: 30294 - DNA, 21 bp, Artificial sequence
  SiRNA target sequence
aattgcgtttcgaatgtatta

SEQ ID NO: 30295 - DNA, 21 bp, Artificial sequence
  SiRNA target sequence
attgcgtttcgaatgtattat

SEQ ID NO: 30296 - DNA, 21 bp, Artificial sequence
  SiRNA target sequence
ttgcgtttcgaatgtattatt

SEQ ID NO: 30297 - DNA, 21 bp, Artificial sequence
  SiRNA target sequence
tgcgtttcgaatgtattattt

SEQ ID NO: 30298 - DNA, 21 bp, Artificial sequence
  SiRNA target sequence
gcgtttcgaatgtattatttg

SEQ ID NO: 30299 - DNA, 21 bp, Artificial sequence
  SiRNA target sequence
cgtttcgaatgtattatttgg

SEQ ID NO: 30300 - DNA, 21 bp, Artificial sequence
  SiRNA target sequence
gtttcgaatgtattatttggg

SEQ ID NO: 30301 - DNA, 21 bp, Artificial sequence
  SiRNA target sequence
tttcgaatgtattatttgggc

SEQ ID NO: 30302 - DNA, 21 bp, Artificial sequence
  SiRNA target sequence
ttcgaatgtattatttgggct

SEQ ID NO: 30303 - DNA, 21 bp, Artificial sequence
  SiRNA target sequence
tcgaatgtattatttgggctt

SEQ ID NO: 30304 - DNA, 21 bp, Artificial sequence
  SiRNA target sequence
cgaatgtattatttgggcttt

SEQ ID NO: 30305 - DNA, 21 bp, Artificial sequence
  SiRNA target sequence
gaatgtattatttgggcttta

SEQ ID NO: 30306 - DNA, 21 bp, Artificial sequence
  SiRNA target sequence
aatgtattatttgggctttat

SEQ ID NO: 30307 - DNA, 21 bp, Artificial sequence
  SiRNA target sequence
atgtattatttgggctttata

SEQ ID NO: 30308 - DNA, 21 bp, Artificial sequence
  SiRNA target sequence
tgtattatttgggctttatag

SEQ ID NO: 30309 - DNA, 21 bp, Artificial sequence
  SiRNA target sequence
gtattatttgggctttatagc

SEQ ID NO: 30310 - DNA, 21 bp, Artificial sequence
  SiRNA target sequence
tattatttgggctttatagct

SEQ ID NO: 30311 - DNA, 21 bp, Artificial sequence
  SiRNA target sequence
attatttgggctttatagctc

SEQ ID NO: 30312 - DNA, 21 bp, Artificial sequence
  SiRNA target sequence
ttatttgggctttatagctca

SEQ ID NO: 30313 - DNA, 21 bp, Artificial sequence
  SiRNA target sequence
tatttgggctttatagctcat

SEQ ID NO: 30314 - DNA, 21 bp, Artificial sequence
  SiRNA target sequence
atttgggctttatagctcatt

SEQ ID NO: 30315 - DNA, 21 bp, Artificial sequence
  SiRNA target sequence
tttgggctttatagctcattt

SEQ ID NO: 30316 - DNA, 21 bp, Artificial sequence
  SiRNA target sequence
ttgggctttatagctcatttg

SEQ ID NO: 30317 - DNA, 21 bp, Artificial sequence
  SiRNA target sequence
tgggctttatagctcatttga

SEQ ID NO: 30318 - DNA, 21 bp, Artificial sequence
  SiRNA target sequence
gggctttatagctcatttgat

SEQ ID NO: 30319 - DNA, 21 bp, Artificial sequence
  SiRNA target sequence
ggctttatagctcatttgatg

SEQ ID NO: 30320 - DNA, 21 bp, Artificial sequence
  SiRNA target sequence
gctttatagctcatttgatgg

SEQ ID NO: 30321 - DNA, 21 bp, Artificial sequence
  SiRNA target sequence
ctttatagctcatttgatgga

SEQ ID NO: 30322 - DNA, 21 bp, Artificial sequence
  SiRNA target sequence
tttatagctcatttgatggag

SEQ ID NO: 30323 - DNA, 21 bp, Artificial sequence
  SiRNA target sequence
ttatagctcatttgatggaga

SEQ ID NO: 30324 - DNA, 21 bp, Artificial sequence
  SiRNA target sequence
tatagctcatttgatggagaa

SEQ ID NO: 30325 - DNA, 21 bp, Artificial sequence
  SiRNA target sequence
atagctcatttgatggagaat

SEQ ID NO: 30326 - DNA, 21 bp, Artificial sequence
  SiRNA target sequence
tagctcatttgatggagaatc

SEQ ID NO: 30327 - DNA, 21 bp, Artificial sequence
  SiRNA target sequence
agctcatttgatggagaatcg

SEQ ID NO: 30328 - DNA, 21 bp, Artificial sequence
  SiRNA target sequence
gctcatttgatggagaatcga

SEQ ID NO: 30329 - DNA, 21 bp, Artificial sequence
  SiRNA target sequence
ctcatttgatggagaatcgaa

SEQ ID NO: 30330 - DNA, 21 bp, Artificial sequence
  SiRNA target sequence
tcatttgatggagaatcgaat

SEQ ID NO: 30331 - DNA, 21 bp, Artificial sequence
  SiRNA target sequence
catttgatggagaatcgaatt

SEQ ID NO: 30332 - DNA, 21 bp, Artificial sequence
  SiRNA target sequence
atttgatggagaatcgaattg

SEQ ID NO: 30333 - DNA, 21 bp, Artificial sequence
  SiRNA target sequence
tttgatggagaatcgaattgc

SEQ ID NO: 30334 - DNA, 21 bp, Artificial sequence
  SiRNA target sequence
ttgatggagaatcgaattgca

SEQ ID NO: 30335 - DNA, 21 bp, Artificial sequence
  SiRNA target sequence
tgatggagaatcgaattgcaa

SEQ ID NO: 30336 - DNA, 21 bp, Artificial sequence
  SiRNA target sequence
gatggagaatcgaattgcaaa

SEQ ID NO: 30337 - DNA, 21 bp, Artificial sequence
  SiRNA target sequence
atggagaatcgaattgcaaat

SEQ ID NO: 30338 - DNA, 21 bp, Artificial sequence
  SiRNA target sequence
tggagaatcgaattgcaaatg

SEQ ID NO: 30339 - DNA, 21 bp, Artificial sequence
  SiRNA target sequence
ggagaatcgaattgcaaatga

SEQ ID NO: 30340 - DNA, 21 bp, Artificial sequence
  SiRNA target sequence
gagaatcgaattgcaaatgaa

SEQ ID NO: 30341 - DNA, 21 bp, Artificial sequence
  SiRNA target sequence
agaatcgaattgcaaatgaag

SEQ ID NO: 30342 - DNA, 21 bp, Artificial sequence
  SiRNA target sequence
gaatcgaattgcaaatgaagt

SEQ ID NO: 30343 - DNA, 21 bp, Artificial sequence
  SiRNA target sequence
aatcgaattgcaaatgaagtg

SEQ ID NO: 30344 - DNA, 21 bp, Artificial sequence
  SiRNA target sequence
atcgaattgcaaatgaagtgt

SEQ ID NO: 30345 - DNA, 21 bp, Artificial sequence
  SiRNA target sequence
tcgaattgcaaatgaagtgtc

SEQ ID NO: 30346 - DNA, 21 bp, Artificial sequence
  SiRNA target sequence
cgaattgcaaatgaagtgtct

SEQ ID NO: 30347 - DNA, 21 bp, Artificial sequence
  SiRNA target sequence
gaattgcaaatgaagtgtcta

SEQ ID NO: 30348 - DNA, 21 bp, Artificial sequence
  SiRNA target sequence
aattgcaaatgaagtgtctat

SEQ ID NO: 30349 - DNA, 21 bp, Artificial sequence
  SiRNA target sequence
attgcaaatgaagtgtctatt

SEQ ID NO: 30350 - DNA, 21 bp, Artificial sequence
  SiRNA target sequence
ttgcaaatgaagtgtctattg

SEQ ID NO: 30351 - DNA, 21 bp, Artificial sequence
  SiRNA target sequence
tgcaaatgaagtgtctattgg

SEQ ID NO: 30352 - DNA, 21 bp, Artificial sequence
  SiRNA target sequence
gcaaatgaagtgtctattgga

SEQ ID NO: 30353 - DNA, 21 bp, Artificial sequence
  SiRNA target sequence
caaatgaagtgtctattggaa

SEQ ID NO: 30354 - DNA, 21 bp, Artificial sequence
  SiRNA target sequence
aaatgaagtgtctattggaac

SEQ ID NO: 30355 - DNA, 21 bp, Artificial sequence
  SiRNA target sequence
aatgaagtgtctattggaacg

SEQ ID NO: 30356 - DNA, 21 bp, Artificial sequence
  SiRNA target sequence
atgaagtgtctattggaacga

SEQ ID NO: 30357 - DNA, 21 bp, Artificial sequence
  SiRNA target sequence
tgaagtgtctattggaacgaa

SEQ ID NO: 30358 - DNA, 21 bp, Artificial sequence
  SiRNA target sequence
gaagtgtctattggaacgaat

SEQ ID NO: 30359 - DNA, 21 bp, Artificial sequence
  SiRNA target sequence
aagtgtctattggaacgaatg

SEQ ID NO: 30360 - DNA, 21 bp, Artificial sequence
  SiRNA target sequence
agtgtctattggaacgaatgt

SEQ ID NO: 30361 - DNA, 21 bp, Artificial sequence
  SiRNA target sequence
gtgtctattggaacgaatgtt

SEQ ID NO: 30362 - DNA, 21 bp, Artificial sequence
  SiRNA target sequence
tgtctattggaacgaatgttt

SEQ ID NO: 30363 - DNA, 21 bp, Artificial sequence
  SiRNA target sequence
gtctattggaacgaatgttta

SEQ ID NO: 30364 - DNA, 21 bp, Artificial sequence
  SiRNA target sequence
tctattggaacgaatgtttat

SEQ ID NO: 30365 - DNA, 21 bp, Artificial sequence
  SiRNA target sequence
ctattggaacgaatgtttatt

SEQ ID NO: 30366 - DNA, 21 bp, Artificial sequence
  SiRNA target sequence
tattggaacgaatgtttattc

SEQ ID NO: 30367 - DNA, 21 bp, Artificial sequence
  SiRNA target sequence
attggaacgaatgtttattca

SEQ ID NO: 30368 - DNA, 21 bp, Artificial sequence
  SiRNA target sequence
ttggaacgaatgtttattcac

SEQ ID NO: 30369 - DNA, 21 bp, Artificial sequence
  SiRNA target sequence
tggaacgaatgtttattcaca

SEQ ID NO: 30370 - DNA, 21 bp, Artificial sequence
  SiRNA target sequence
ggaacgaatgtttattcacaa

SEQ ID NO: 30371 - DNA, 21 bp, Artificial sequence
  SiRNA target sequence
gaacgaatgtttattcacaag

SEQ ID NO: 30372 - DNA, 21 bp, Artificial sequence
  SiRNA target sequence
aacgaatgtttattcacaaga

SEQ ID NO: 30373 - DNA, 21 bp, Artificial sequence
  SiRNA target sequence
acgaatgtttattcacaagac

SEQ ID NO: 30374 - DNA, 21 bp, Artificial sequence
  SiRNA target sequence
cgaatgtttattcacaagact

SEQ ID NO: 30375 - DNA, 21 bp, Artificial sequence
  SiRNA target sequence
gaatgtttattcacaagactg

SEQ ID NO: 30376 - DNA, 21 bp, Artificial sequence
  SiRNA target sequence
aatgtttattcacaagactgg

SEQ ID NO: 30377 - DNA, 21 bp, Artificial sequence
  SiRNA target sequence
atgtttattcacaagactgga

SEQ ID NO: 30378 - DNA, 21 bp, Artificial sequence
  SiRNA target sequence
tgtttattcacaagactggag

SEQ ID NO: 30379 - DNA, 21 bp, Artificial sequence
  SiRNA target sequence
gtttattcacaagactggagt

SEQ ID NO: 30380 - DNA, 21 bp, Artificial sequence
  SiRNA target sequence
tttattcacaagactggagta

SEQ ID NO: 30381 - DNA, 21 bp, Artificial sequence
  SiRNA target sequence
ttattcacaagactggagtaa

SEQ ID NO: 30382 - DNA, 21 bp, Artificial sequence
  SiRNA target sequence
tattcacaagactggagtaaa

SEQ ID NO: 30383 - DNA, 21 bp, Artificial sequence
  SiRNA target sequence
attcacaagactggagtaaaa

SEQ ID NO: 30384 - DNA, 21 bp, Artificial sequence
  SiRNA target sequence
ttcacaagactggagtaaaac

SEQ ID NO: 30385 - DNA, 21 bp, Artificial sequence
  SiRNA target sequence
tcacaagactggagtaaaact

SEQ ID NO: 30386 - DNA, 21 bp, Artificial sequence
  SiRNA target sequence
cacaagactggagtaaaactg

SEQ ID NO: 30387 - DNA, 21 bp, Artificial sequence
  SiRNA target sequence
acaagactggagtaaaactgt

SEQ ID NO: 30388 - DNA, 21 bp, Artificial sequence
  SiRNA target sequence
caagactggagtaaaactgtt

SEQ ID NO: 30389 - DNA, 21 bp, Artificial sequence
  SiRNA target sequence
aagactggagtaaaactgtta

SEQ ID NO: 30390 - DNA, 21 bp, Artificial sequence
  SiRNA target sequence
agactggagtaaaactgttag

SEQ ID NO: 30391 - DNA, 21 bp, Artificial sequence
  SiRNA target sequence
gactggagtaaaactgttagg

SEQ ID NO: 30392 - DNA, 21 bp, Artificial sequence
  SiRNA target sequence
actggagtaaaactgttagga

SEQ ID NO: 30393 - DNA, 21 bp, Artificial sequence
  SiRNA target sequence
ctggagtaaaactgttaggaa

SEQ ID NO: 30394 - DNA, 21 bp, Artificial sequence
  SiRNA target sequence
tggagtaaaactgttaggaaa

SEQ ID NO: 30395 - DNA, 21 bp, Artificial sequence
  SiRNA target sequence
ggagtaaaactgttaggaaat

SEQ ID NO: 30396 - DNA, 21 bp, Artificial sequence
  SiRNA target sequence
gagtaaaactgttaggaaatt

SEQ ID NO: 30397 - DNA, 21 bp, Artificial sequence
  SiRNA target sequence
agtaaaactgttaggaaatta

SEQ ID NO: 30398 - DNA, 21 bp, Artificial sequence
  SiRNA target sequence
gtaaaactgttaggaaattaa

SEQ ID NO: 30399 - DNA, 21 bp, Artificial sequence
  SiRNA target sequence
taaaactgttaggaaattaac

SEQ ID NO: 30400 - DNA, 21 bp, Artificial sequence
  SiRNA target sequence
aaaactgttaggaaattaacc

SEQ ID NO: 30401 - DNA, 21 bp, Artificial sequence
  SiRNA target sequence
aaactgttaggaaattaacca

SEQ ID NO: 30402 - DNA, 21 bp, Artificial sequence
  SiRNA target sequence
aactgttaggaaattaaccaa

SEQ ID NO: 30403 - DNA, 21 bp, Artificial sequence
  SiRNA target sequence
actgttaggaaattaaccaaa

SEQ ID NO: 30404 - DNA, 21 bp, Artificial sequence
  SiRNA target sequence
ctgttaggaaattaaccaaat

SEQ ID NO: 30405 - DNA, 21 bp, Artificial sequence
  SiRNA target sequence
tgttaggaaattaaccaaatt

SEQ ID NO: 30406 - DNA, 21 bp, Artificial sequence
  SiRNA target sequence
gttaggaaattaaccaaattt

SEQ ID NO: 30407 - DNA, 21 bp, Artificial sequence
  SiRNA target sequence
ttaggaaattaaccaaatttg

SEQ ID NO: 30408 - DNA, 21 bp, Artificial sequence
  SiRNA target sequence
taggaaattaaccaaatttgg

SEQ ID NO: 30409 - DNA, 21 bp, Artificial sequence
  SiRNA target sequence
aggaaattaaccaaatttgga

SEQ ID NO: 30410 - DNA, 21 bp, Artificial sequence
  SiRNA target sequence
ggaaattaaccaaatttggaa

SEQ ID NO: 30411 - DNA, 21 bp, Artificial sequence
  SiRNA target sequence
gaaattaaccaaatttggaaa

SEQ ID NO: 30412 - DNA, 21 bp, Artificial sequence
  SiRNA target sequence
aaattaaccaaatttggaaat

SEQ ID NO: 30413 - DNA, 21 bp, Artificial sequence
  SiRNA target sequence
aattaaccaaatttggaaata

SEQ ID NO: 30414 - DNA, 21 bp, Artificial sequence
  SiRNA target sequence
attaaccaaatttggaaataa

SEQ ID NO: 30415 - DNA, 21 bp, Artificial sequence
  SiRNA target sequence
ttaaccaaatttggaaataaa

SEQ ID NO: 30416 - DNA, 21 bp, Artificial sequence
  SiRNA target sequence
taaccaaatttggaaataaag

SEQ ID NO: 30417 - DNA, 21 bp, Artificial sequence
  SiRNA target sequence
aaccaaatttggaaataaagt

SEQ ID NO: 30418 - DNA, 21 bp, Artificial sequence
  SiRNA target sequence
accaaatttggaaataaagta

SEQ ID NO: 30419 - DNA, 21 bp, Artificial sequence
  SiRNA target sequence
ccaaatttggaaataaagtaa

SEQ ID NO: 30420 - DNA, 21 bp, Artificial sequence
  SiRNA target sequence
caaatttggaaataaagtaat

SEQ ID NO: 30421 - DNA, 21 bp, Artificial sequence
  SiRNA target sequence
aaatttggaaataaagtaatt

SEQ ID NO: 30422 - DNA, 21 bp, Artificial sequence
  SiRNA target sequence
aatttggaaataaagtaattg

SEQ ID NO: 30423 - DNA, 21 bp, Artificial sequence
  SiRNA target sequence
atttggaaataaagtaattgc

SEQ ID NO: 30424 - DNA, 21 bp, Artificial sequence
  SiRNA target sequence
tttggaaataaagtaattgct

SEQ ID NO: 30425 - DNA, 21 bp, Artificial sequence
  SiRNA target sequence
ttggaaataaagtaattgctg

SEQ ID NO: 30426 - DNA, 21 bp, Artificial sequence
  SiRNA target sequence
tggaaataaagtaattgctgg

SEQ ID NO: 30427 - DNA, 21 bp, Artificial sequence
  SiRNA target sequence
ggaaataaagtaattgctggt

SEQ ID NO: 30428 - DNA, 21 bp, Artificial sequence
  SiRNA target sequence
gaaataaagtaattgctggtg

SEQ ID NO: 30429 - DNA, 21 bp, Artificial sequence
  SiRNA target sequence
aaataaagtaattgctggtga

SEQ ID NO: 30430 - DNA, 21 bp, Artificial sequence
  SiRNA target sequence
aataaagtaattgctggtgat

SEQ ID NO: 30431 - DNA, 21 bp, Artificial sequence
  SiRNA target sequence
ataaagtaattgctggtgatt

SEQ ID NO: 30432 - DNA, 21 bp, Artificial sequence
  SiRNA target sequence
taaagtaattgctggtgattt

SEQ ID NO: 30433 - DNA, 21 bp, Artificial sequence
  SiRNA target sequence
aaagtaattgctggtgatttt

SEQ ID NO: 30434 - DNA, 21 bp, Artificial sequence
  SiRNA target sequence
aagtaattgctggtgattttt

SEQ ID NO: 30435 - DNA, 21 bp, Artificial sequence
  SiRNA target sequence
agtaattgctggtgatttttc

SEQ ID NO: 30436 - DNA, 21 bp, Artificial sequence
  SiRNA target sequence
gtaattgctggtgatttttca

SEQ ID NO: 30437 - DNA, 21 bp, Artificial sequence
  SiRNA target sequence
taattgctggtgatttttcaa

SEQ ID NO: 30438 - DNA, 21 bp, Artificial sequence
  SiRNA target sequence
aattgctggtgatttttcaac

SEQ ID NO: 30439 - DNA, 21 bp, Artificial sequence
  SiRNA target sequence
attgctggtgatttttcaact

SEQ ID NO: 30440 - DNA, 21 bp, Artificial sequence
  SiRNA target sequence
ttgctggtgatttttcaactt

SEQ ID NO: 30441 - DNA, 21 bp, Artificial sequence
  SiRNA target sequence
tgctggtgatttttcaacttt

SEQ ID NO: 30442 - DNA, 21 bp, Artificial sequence
  SiRNA target sequence
gctggtgatttttcaactttt

SEQ ID NO: 30443 - DNA, 21 bp, Artificial sequence
  SiRNA target sequence
ctggtgatttttcaacttttg

SEQ ID NO: 30444 - DNA, 21 bp, Artificial sequence
  SiRNA target sequence
tggtgatttttcaacttttga

SEQ ID NO: 30445 - DNA, 21 bp, Artificial sequence
  SiRNA target sequence
ggtgatttttcaacttttgat

SEQ ID NO: 30446 - DNA, 21 bp, Artificial sequence
  SiRNA target sequence
gtgatttttcaacttttgatg

SEQ ID NO: 30447 - DNA, 21 bp, Artificial sequence
  SiRNA target sequence
tgatttttcaacttttgatgg

SEQ ID NO: 30448 - DNA, 21 bp, Artificial sequence
  SiRNA target sequence
gatttttcaacttttgatgga

SEQ ID NO: 30449 - DNA, 21 bp, Artificial sequence
  SiRNA target sequence
atttttcaacttttgatggat

SEQ ID NO: 30450 - DNA, 21 bp, Artificial sequence
  SiRNA target sequence
tttttcaacttttgatggatc

SEQ ID NO: 30451 - DNA, 21 bp, Artificial sequence
  SiRNA target sequence
ttttcaacttttgatggatca

SEQ ID NO: 30452 - DNA, 21 bp, Artificial sequence
  SiRNA target sequence
tttcaacttttgatggatcac

SEQ ID NO: 30453 - DNA, 21 bp, Artificial sequence
  SiRNA target sequence
ttcaacttttgatggatcact

SEQ ID NO: 30454 - DNA, 21 bp, Artificial sequence
  SiRNA target sequence
tcaacttttgatggatcacta

SEQ ID NO: 30455 - DNA, 21 bp, Artificial sequence
  SiRNA target sequence
caacttttgatggatcactaa

SEQ ID NO: 30456 - DNA, 21 bp, Artificial sequence
  SiRNA target sequence
aacttttgatggatcactaaa

SEQ ID NO: 30457 - DNA, 21 bp, Artificial sequence
  SiRNA target sequence
acttttgatggatcactaaac

SEQ ID NO: 30458 - DNA, 21 bp, Artificial sequence
  SiRNA target sequence
cttttgatggatcactaaacg

SEQ ID NO: 30459 - DNA, 21 bp, Artificial sequence
  SiRNA target sequence
ttttgatggatcactaaacgt

SEQ ID NO: 30460 - DNA, 21 bp, Artificial sequence
  SiRNA target sequence
tttgatggatcactaaacgtt

SEQ ID NO: 30461 - DNA, 21 bp, Artificial sequence
  SiRNA target sequence
ttgatggatcactaaacgttt

SEQ ID NO: 30462 - DNA, 21 bp, Artificial sequence
  SiRNA target sequence
tgatggatcactaaacgtttg

SEQ ID NO: 30463 - DNA, 21 bp, Artificial sequence
  SiRNA target sequence
gatggatcactaaacgtttgc

SEQ ID NO: 30464 - DNA, 21 bp, Artificial sequence
  SiRNA target sequence
atggatcactaaacgtttgca

SEQ ID NO: 30465 - DNA, 21 bp, Artificial sequence
  SiRNA target sequence
tggatcactaaacgtttgcat

SEQ ID NO: 30466 - DNA, 21 bp, Artificial sequence
  SiRNA target sequence
ggatcactaaacgtttgcatt

SEQ ID NO: 30467 - DNA, 21 bp, Artificial sequence
  SiRNA target sequence
gatcactaaacgtttgcatta

SEQ ID NO: 30468 - DNA, 21 bp, Artificial sequence
  SiRNA target sequence
atcactaaacgtttgcattat

SEQ ID NO: 30469 - DNA, 21 bp, Artificial sequence
  SiRNA target sequence
tcactaaacgtttgcattatg

SEQ ID NO: 30470 - DNA, 21 bp, Artificial sequence
  SiRNA target sequence
cactaaacgtttgcattatgg

SEQ ID NO: 30471 - DNA, 21 bp, Artificial sequence
  SiRNA target sequence
actaaacgtttgcattatgga

SEQ ID NO: 30472 - DNA, 21 bp, Artificial sequence
  SiRNA target sequence
ctaaacgtttgcattatggaa

SEQ ID NO: 30473 - DNA, 21 bp, Artificial sequence
  SiRNA target sequence
taaacgtttgcattatggaaa

SEQ ID NO: 30474 - DNA, 21 bp, Artificial sequence
  SiRNA target sequence
aaacgtttgcattatggaaaa

SEQ ID NO: 30475 - DNA, 21 bp, Artificial sequence
  SiRNA target sequence
aacgtttgcattatggaaaaa

SEQ ID NO: 30476 - DNA, 21 bp, Artificial sequence
  SiRNA target sequence
acgtttgcattatggaaaaat

SEQ ID NO: 30477 - DNA, 21 bp, Artificial sequence
  SiRNA target sequence
cgtttgcattatggaaaaatt

SEQ ID NO: 30478 - DNA, 21 bp, Artificial sequence
  SiRNA target sequence
gtttgcattatggaaaaattt

SEQ ID NO: 30479 - DNA, 21 bp, Artificial sequence
  SiRNA target sequence
tttgcattatggaaaaatttg

SEQ ID NO: 30480 - DNA, 21 bp, Artificial sequence
  SiRNA target sequence
ttgcattatggaaaaatttgc

SEQ ID NO: 30481 - DNA, 21 bp, Artificial sequence
  SiRNA target sequence
tgcattatggaaaaatttgca

SEQ ID NO: 30482 - DNA, 21 bp, Artificial sequence
  SiRNA target sequence
gcattatggaaaaatttgcag

SEQ ID NO: 30483 - DNA, 21 bp, Artificial sequence
  SiRNA target sequence
cattatggaaaaatttgcaga

SEQ ID NO: 30484 - DNA, 21 bp, Artificial sequence
  SiRNA target sequence
attatggaaaaatttgcagat

SEQ ID NO: 30485 - DNA, 21 bp, Artificial sequence
  SiRNA target sequence
ttatggaaaaatttgcagatt

SEQ ID NO: 30486 - DNA, 21 bp, Artificial sequence
  SiRNA target sequence
tatggaaaaatttgcagattt

SEQ ID NO: 30487 - DNA, 21 bp, Artificial sequence
  SiRNA target sequence
atggaaaaatttgcagattta

SEQ ID NO: 30488 - DNA, 21 bp, Artificial sequence
  SiRNA target sequence
tggaaaaatttgcagatttag

SEQ ID NO: 30489 - DNA, 21 bp, Artificial sequence
  SiRNA target sequence
ggaaaaatttgcagatttagc

SEQ ID NO: 30490 - DNA, 21 bp, Artificial sequence
  SiRNA target sequence
gaaaaatttgcagatttagct

SEQ ID NO: 30491 - DNA, 21 bp, Artificial sequence
  SiRNA target sequence
aaaaatttgcagatttagcta

SEQ ID NO: 30492 - DNA, 21 bp, Artificial sequence
  SiRNA target sequence
aaaatttgcagatttagctaa

SEQ ID NO: 30493 - DNA, 21 bp, Artificial sequence
  SiRNA target sequence
aaatttgcagatttagctaat

SEQ ID NO: 30494 - DNA, 21 bp, Artificial sequence
  SiRNA target sequence
aatttgcagatttagctaatg

SEQ ID NO: 30495 - DNA, 21 bp, Artificial sequence
  SiRNA target sequence
atttgcagatttagctaatga

SEQ ID NO: 30496 - DNA, 21 bp, Artificial sequence
  SiRNA target sequence
tttgcagatttagctaatgag

SEQ ID NO: 30497 - DNA, 21 bp, Artificial sequence
  SiRNA target sequence
ttgcagatttagctaatgagt

SEQ ID NO: 30498 - DNA, 21 bp, Artificial sequence
  SiRNA target sequence
tgcagatttagctaatgagtt

SEQ ID NO: 30499 - DNA, 21 bp, Artificial sequence
  SiRNA target sequence
gcagatttagctaatgagttt

SEQ ID NO: 30500 - DNA, 21 bp, Artificial sequence
  SiRNA target sequence
cagatttagctaatgagtttt

SEQ ID NO: 30501 - DNA, 21 bp, Artificial sequence
  SiRNA target sequence
agatttagctaatgagtttta

SEQ ID NO: 30502 - DNA, 21 bp, Artificial sequence
  SiRNA target sequence
gatttagctaatgagttttac

SEQ ID NO: 30503 - DNA, 21 bp, Artificial sequence
  SiRNA target sequence
atttagctaatgagttttacg

SEQ ID NO: 30504 - DNA, 21 bp, Artificial sequence
  SiRNA target sequence
tttagctaatgagttttacga

SEQ ID NO: 30505 - DNA, 21 bp, Artificial sequence
  SiRNA target sequence
ttagctaatgagttttacgat

SEQ ID NO: 30506 - DNA, 21 bp, Artificial sequence
  SiRNA target sequence
tagctaatgagttttacgatg

SEQ ID NO: 30507 - DNA, 21 bp, Artificial sequence
  SiRNA target sequence
agctaatgagttttacgatga

SEQ ID NO: 30508 - DNA, 21 bp, Artificial sequence
  SiRNA target sequence
gctaatgagttttacgatgat

SEQ ID NO: 30509 - DNA, 21 bp, Artificial sequence
  SiRNA target sequence
ctaatgagttttacgatgatg

SEQ ID NO: 30510 - DNA, 21 bp, Artificial sequence
  SiRNA target sequence
taatgagttttacgatgatgg

SEQ ID NO: 30511 - DNA, 21 bp, Artificial sequence
  SiRNA target sequence
aatgagttttacgatgatgga

SEQ ID NO: 30512 - DNA, 21 bp, Artificial sequence
  SiRNA target sequence
atgagttttacgatgatggac

SEQ ID NO: 30513 - DNA, 21 bp, Artificial sequence
  SiRNA target sequence
tgagttttacgatgatggacc

SEQ ID NO: 30514 - DNA, 21 bp, Artificial sequence
  SiRNA target sequence
gagttttacgatgatggacca

SEQ ID NO: 30515 - DNA, 21 bp, Artificial sequence
  SiRNA target sequence
agttttacgatgatggaccag

SEQ ID NO: 30516 - DNA, 21 bp, Artificial sequence
  SiRNA target sequence
gttttacgatgatggaccaga

SEQ ID NO: 30517 - DNA, 21 bp, Artificial sequence
  SiRNA target sequence
ttttacgatgatggaccagaa

SEQ ID NO: 30518 - DNA, 21 bp, Artificial sequence
  SiRNA target sequence
tttacgatgatggaccagaaa

SEQ ID NO: 30519 - DNA, 21 bp, Artificial sequence
  SiRNA target sequence
ttacgatgatggaccagaaaa

SEQ ID NO: 30520 - DNA, 21 bp, Artificial sequence
  SiRNA target sequence
tacgatgatggaccagaaaat

SEQ ID NO: 30521 - DNA, 21 bp, Artificial sequence
  SiRNA target sequence
acgatgatggaccagaaaatg

SEQ ID NO: 30522 - DNA, 21 bp, Artificial sequence
  SiRNA target sequence
cgatgatggaccagaaaatgc

SEQ ID NO: 30523 - DNA, 21 bp, Artificial sequence
  SiRNA target sequence
gatgatggaccagaaaatgct

SEQ ID NO: 30524 - DNA, 21 bp, Artificial sequence
  SiRNA target sequence
atgatggaccagaaaatgctt

SEQ ID NO: 30525 - DNA, 21 bp, Artificial sequence
  SiRNA target sequence
tgatggaccagaaaatgcttt

SEQ ID NO: 30526 - DNA, 21 bp, Artificial sequence
  SiRNA target sequence
gatggaccagaaaatgctttg

SEQ ID NO: 30527 - DNA, 21 bp, Artificial sequence
  SiRNA target sequence
atggaccagaaaatgctttga

SEQ ID NO: 30528 - DNA, 21 bp, Artificial sequence
  SiRNA target sequence
tggaccagaaaatgctttgat

SEQ ID NO: 30529 - DNA, 21 bp, Artificial sequence
  SiRNA target sequence
ggaccagaaaatgctttgatc

SEQ ID NO: 30530 - DNA, 21 bp, Artificial sequence
  SiRNA target sequence
gaccagaaaatgctttgatcc

SEQ ID NO: 30531 - DNA, 21 bp, Artificial sequence
  SiRNA target sequence
accagaaaatgctttgatccg

(The sequence listing continues in the following parts.)

What is claimed is:

1. An isolated nucleic acid agent comprising an IAPV-specific double stranded ribonucleic acid (RNA) consisting of SEQ ID NO: 34 and an RNA sequence complementary to the entire SEQ ID NO: 34.

2. The isolated nucleic acid agent of claim 1, further comprising a nucleic acid sequence selected from the group consisting of SEQ ID NOs: 54-9532.

3. The isolated nucleic acid agent of claim 1, further comprising a double stranded RNA comprising an RNA sequence complementary to the nucleic acid sequence of SEQ ID NOs: 24 or 33.

4. A nucleic acid construct comprising a nucleic acid sequence encoding the isolated nucleic acid agent of claim 1.

5. A composition comprising bee feed and the nucleic acid agent of claim 1.

6. The composition of claim 5, wherein said composition is in solid form.

7. The composition of claim 5, wherein said composition is in liquid form.

8. The composition of claim 7, wherein said liquid is a sucrose solution.

9. The composition of claim 7, wherein said liquid is a corn syrup solution.

10. The composition of claim 7, wherein said liquid further comprises a carbohydrate or sugar supplement.

11. The composition of claim 5, wherein said composition comprises protein.

12. The composition of claim 11, wherein said protein is in the form of pollen and/or soy patties.

13. A method for reducing the susceptibility of a bee to a disease caused by Israel Acute Paralysis Virus (IAPV) comprising feeding the bee a composition consisting of bee feed and an effective amount of a nucleic acid agent comprising an IAPV-specific double stranded ribonucleic acid (RNA) consisting of SEQ ID NO: 34 and an RNA sequence complementary to the entire SEQ ID NO: 34, thereby reducing the susceptibility of said bee to a disease caused by IAPV.

14. The method of claim 13, wherein said bee is a honeybee.

15. The method of claim 14, wherein said honeybee is a forager.

16. The method of claim 14, wherein said honeybee is a hive bee.

17. The method of claim 14, wherein said honeybee is a bee of a colony, wherein said feeding reduces the susceptibility of said bee colony to said disease.

18. The method of claim 13, wherein said disease is Colony Collapse Disorder.

19. The method of claim 13, wherein said nucleic acid agent further comprises a nucleic acid sequence selected from the group consisting of SEQ ID NOs: 54-9532.

20. The method of claim 13, wherein said nucleic acid agent further comprises a double stranded RNA comprising an RNA sequence complementary to the nucleic acid sequence of SEQ ID NOs: 24 or 33.

21. The method of claim 13, wherein said feeding comprises providing a liquid bee-ingestible composition.

22. The methods of claim 13, wherein said feeding comprises providing a solid bee-ingestible composition.

23. A method of reducing the susceptibility of honeybees to Colony Collapse Disorder (CCD), the method comprising feeding to the honeybee colony a bee-ingestible composition consisting of bee feed and an effective amount of a nucleic acid agent comprising an Israel Acute Paralysis Virus-specific double stranded ribonucleic nucleic acid (RNA) consisting of SEQ ID NO: 34 and an RNA sequence complementary to the entire SEQ ID NO: 34, thereby reducing the susceptibility of said honeybees to CCD.

* * * * *